United States Patent
Travers et al.

(10) Patent No.: US 12,378,586 B2
(45) Date of Patent: *Aug. 5, 2025

(54) SYSTEMS, METHODS, AND COMPOSITIONS FOR THE GLYCOSYLATION OF CANNABINOID COMPOUNDS

(71) Applicant: Trait Biosciences, Inc., Los Alamos, NM (US)

(72) Inventors: Timothy Travers, Los Alamos, NM (US); Erick LeBrun, Los Alamos, NM (US)

(73) Assignee: Trait Biosciences, Inc., Los Alamos, NM (US)

( * ) Notice: Subject to any disclaimer, the term of this patent is extended or adjusted under 35 U.S.C. 154(b) by 84 days.

This patent is subject to a terminal disclaimer.

(21) Appl. No.: 17/905,047

(22) PCT Filed: Feb. 26, 2021

(86) PCT No.: PCT/US2021/020040
§ 371 (c)(1),
(2) Date: Aug. 25, 2022

(87) PCT Pub. No.: WO2021/174092
PCT Pub. Date: Sep. 2, 2021

(65) Prior Publication Data
US 2023/0212625 A1   Jul. 6, 2023

Related U.S. Application Data

(60) Provisional application No. 62/983,019, filed on Feb. 28, 2020.

(51) Int. Cl.
*C12N 9/10* (2006.01)
*A61K 31/00* (2006.01)
*A61K 31/7034* (2006.01)
*C12P 17/06* (2006.01)

(52) U.S. Cl.
CPC ............ *C12P 17/06* (2013.01); *C12N 9/1051* (2013.01); *C12Y 204/01035* (2013.01)

(58) Field of Classification Search
None
See application file for complete search history.

(56) References Cited

U.S. PATENT DOCUMENTS

| 2008/0267966 A1 | 10/2008 | Masignani et al. |
| 2010/0011456 A1 | 1/2010 | Mathur et al. |
| 2019/0085347 A1* | 3/2019 | Sayre ............... C12N 9/0065 |
| 2019/0153460 A1 | 5/2019 | Sayre et al. |
| 2021/0071209 A1* | 3/2021 | Anderson ............... C12N 9/88 |

OTHER PUBLICATIONS

Hardman et al, 2017, bioRxiv, Cannabinoid glycosides: In vitro Production of a New Class of Cannabinoids with Improved Physiochemical Properties, p. 1-37.*
Madhav et al, 2013, Plant Physiology and Biochemistry, 63:245-253.*
Aizpurua-Olaizola et al, 2016, J. Nat. Prod., 79:324-331.*
Gertsch et al, 2010, British Journal of Pharmacology, 160:523-529.*
Sirikantaramas et al, *Cannabis sativa* L.—Botany and Biotechnology, 2017, section 8.*
Morimoto et al, 2007, The Journal of Biological Chemistry, 282:20739-20751.*
Peč et al, 2010, Biotechnol Lett, 32:935-941.*
Flores-Sanchez et al, 2009, Journal of Biotechnology, 143:157-168.*
Wrobel et al, 2018, Biotechnol Lett, 40:445-454.*
Cerdeno-Tarraga et al (2005, Science, 307:1463-1465.*
Sobhanifar et al. Structure and Mechanism of *Staphylococcus aureus* Tars, the Wall Teichoic Acid beta-glycosyltransferase Involved in Methicillin Resistance. PLoS Pathogens. Dec. 14, 2016, vol. 12, No. 12, e1006067; especially abstract; p. 18, para 1-2.
International Search Report and Written Opinion dated Jul. 22, 2021 in International Application No. PCT/US2021/020040, 22 pages.
Janee'. Hardman et al: "Cannabinoid glycosides: In vitro production of a new class of cannabinoids with improved physicochemical properties", BIORXIV, [Online] Jan. 30, 2017 (Jan. 30, 2017), XP055564615, DOI: 10.1101/104349 Retrieved from the Internet: URL:https://www.biorxiv.org/content/biorxiv/early/2017/01/30/104349.full.pdf&[retrieved on Jan. 29, 2024] * p. 3, paragraph 4-p. 7, paragraph 1; figure S5 *.
Muedlmmad Tayyab Akhtar et al: "Hydroxylation and glycosylation of [Delta] 9-tetrahydrocannabinol by Catharanthus roseus cell suspension culture", Biocatalysis and Biotransformation., vol. 33, No. 5-6, Feb. 29, 2016 (Feb. 29, 2016), pp. 279-286, XP055560191, GB ISSN: 1024-2422, DOI: 10.3109/10242422.2016.1151006 * p. 282, right-hand column, paragraph 1-p. 285, left-hand column, paragraph 1; figure 2 *.
Harish Madhav et al: Functional and structural variation of uridine diphosphate glycosyltransferase (UGT) gene of Stevia rebaudiana-UGTSr involved in the synthesis of rebaudioside Arr Plant Physiology and Biochemistry, vol. 63, Dec. 17, 2012 (Dec. 17, 2012), pp. 245-253, XP055111642, ISSN: 0981-9428, DOI: 10.1016/j.plaphy.2012.11.029 * the whole document *.
De Bruyn Frederik et al: Biotechnological advances in UDP-sugar based glycosylation of small moleculesrr Biotechnology Advances., vol. 33, No. 2, Feb. 16, 2015 (Feb. 16, 2015), pp. 288-302, XP093124872, GB ISSN: 0734-9750, DOI: 10.1016/j.biotechadv.2015.02.005 * the whole document *.

(Continued)

*Primary Examiner* — Jason Deveau Rosen
(74) *Attorney, Agent, or Firm* — Berg Hill Greenleaf Ruscitti LLP.

(57) ABSTRACT

The present invention relates generally to the identification novel UDP-glucosyltransferases enzymes having specific activity towards cannabinoid compounds. The present invention further relates generally to the use of novel UGT enzymes having specific activity towards cannabinoid compounds to generate water-soluble cannabinoid glycoside compounds.

4 Claims, 14 Drawing Sheets
Specification includes a Sequence Listing.

(56) References Cited

OTHER PUBLICATIONS

Supplementary European Search Report dated Jan. 30, 2024, 11 pages.

* cited by examiner

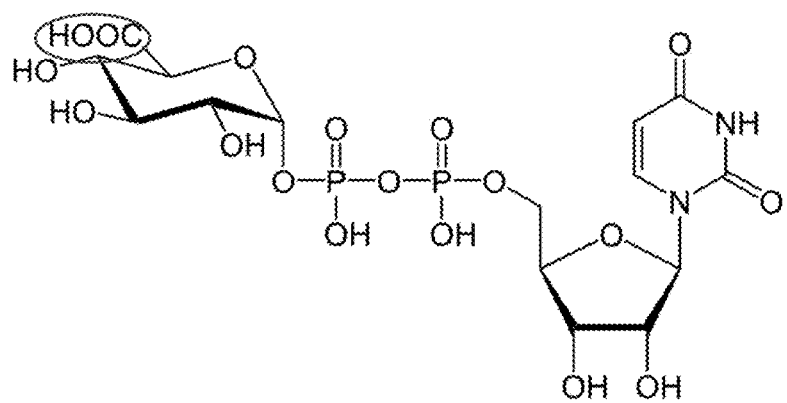
UDP- Glucuronic Acid
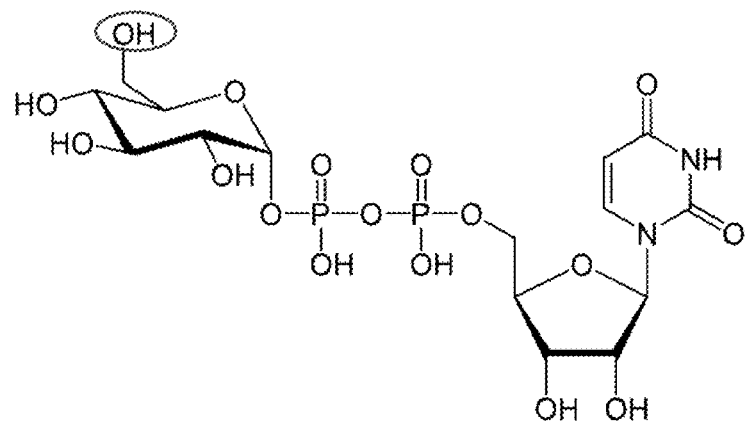
UDP-Glucose
FIG. 12

SYSTEMS, METHODS, AND COMPOSITIONS FOR THE GLYCOSYLATION OF CANNABINOID COMPOUNDS

CROSS-REFERENCE TO RELATED APPLICATION

This application is a national stage application under 35 U.S.C. 371 of PCT Application No. PCT/US2021/020040 having an international filing date of Feb. 26, 2021, which designated the United States, which PCT application claimed the benefit of U.S. Application Ser. No. 62/983,019, filed Feb. 28, 2020, both of which are incorporated by reference in their entirety.

SEQUENCE LISTING

The instant application contains contents of the electronic sequence listing (90425-00322-Sequence-Listing.xml; Size: 13,966,724 bytes; and Date of Creation: Aug. 25, 2022) is herein incorporated by reference in its entirety.

TECHNICAL FIELD

The present invention relates generally to the identification novel UDP-glucosyltransferases enzymes having specific activity towards cannabinoid compounds. The present invention further relates generally to the use of novel UGT enzymes having specific activity towards cannabinoid compounds to generate water-soluble cannabinoid glycoside compounds.

BACKGROUND

Cannabinoids are a class of specialized compounds synthesized by *Cannabis*. They are formed by condensation of terpene and phenol precursors. They include these more abundant forms: 49-tetrahydrocannabinol (THC), cannabidiol (CBD), cannabichromene (CBC), and cannabigerol (CBG). Another cannabinoid, cannabinol (CBN), is formed from THC as a degradation product and can be detected in some plant strains. Typically, THC, CBD, CBC, and CBG occur together in different ratios in the various plant strains. These cannabinoids are generally lipophilic, nitrogen-free, mostly phenolic compounds and are derived biogenetically from a monoterpene and phenol, the acid cannabinoids from a monoterpene and phenol carboxylic acid and have a C21 base. Cannabinoids also find their corresponding carboxylic acids in plant products. In general, the carboxylic acids have the function of a biosynthetic precursor. For example, the tetrahydrocannabinols $\Delta^9$- and $\Delta^8$-THC arise in vivo from the THC carboxylic acids by decarboxylation and likewise, CBD from the associated cannabidiolic acid.

Importantly, cannabinoids are hydrophobic small molecules and, as a result, are highly insoluble. Due to this insolubility, cannabinoids such as THC and CBD may need to be efficiently solubilized to facilitate transport, storage, and adsorption through certain tissues and organs. For example, the metabolism of cannabinoids in the human body goes through the classic two-phases detoxification process of oxidation followed by glucuronidation-which is a form of glycosylation involving the addition of a sugar from UDP-Glucuronic Acid to a cannabinoid. As shown below, the chemical structures of UDP-glucuronic acid and UDP-glucose are similar. As described in, U.S. Pat. No. 8,410,064 by Pandya et al., cannabinoids may be subject to cytochrome P450 oxidation and subsequent UDP-glucuronosyltransferase dependent glucuronidation in the body after consumption. (see FIG. 12) The resulting glucuronide of the oxidized cannabinoids is the main metabolite found in urine, and thus, this solubilization process plays a critical role in the metabolic clearance of cannabinoids. In another embodiment outlined in PCT/US18/24409 and PCT/US18/41710 (both of which are incorporated herein in their entirety by reference, including examples 1-19, and all specific materials and method), by Sayre et al., cannabinoids may be glycosylated to form water-soluble glycoside compounds. In preferred embodiment, such water-soluble cannabinoid glycoside may include one or more sugar moieties, and preferably 1-3 sugar moieties, also referred to a glycosylation sites.

One area where water-soluble cannabinoids has seen renewed interest is in the fields of cannabinoid-infused consumer products. However, the ability to effectively solubilize cannabinoids has limited their applicability. To overcome these limitations, many manufacturers of cannabinoid-infused products have adopted the use of traditional pharmaceutical delivery methods of using nanoemulsions of cannabinoids. This nanoemulsion process essentially coats the cannabinoid in a hydrophilic compound, such as oil or other similar compositions. However, the use of nanoemulsions is limited both technically, and from a safety perspective:

First, a large number of surfactants and cosurfactants are required for nanoemulsion stabilization. Moreover, the stability of nanoemulsions is inherently unstable, and may be disturbed by slight fluctuations in temperature and pH and is further subject to the "oswald ripening effect" or ORE. ORE describes the process whereby molecules on the surface of particles are more energetically unstable than those within. Therefore, the unstable surface molecules often go into solution shrinking the particle over time and increasing the number of free molecules in solution. When the solution is supersaturated with the molecules of the shrinking particles, those free molecules will redeposit on the larger particles. Thus, small particles decrease in size until they disappear, and large particles grow even larger. This shrinking and growing of particles will result in a larger mean diameter of a particle size distribution (PSD). Over time, this causes emulsion instability and eventually phase separation.

Second, nanoemulsions may not be safe for human consumption. For example, nanoemulsions were first developed as a method to deliver small quantities of pharmaceutical compounds having poor solubility. However, the ability to "hide" a compound, such as a cannabinoid, in a nanoemulsion may allow the cannabinoid to be delivered to parts of the body where it was previously prevented from entering, as well as accumulating in tissues and organs where cannabinoids and nanoparticles would not typically be found. Additionally, such nanoemulsions, as well as other water-compatible strategies, do not address one of the major-shortcomings of cannabinoid-infused commercial consumables, namely the strong unpleasant smell and taste. Moreover, such water-compatible strategies deliver inconsistent and delayed cannabinoid uptake in the body which may result in consumers ingesting a higher dose of cannabinoid-infused product than is recommended, as well as delayed, inconsistent, and unpredictable medical and/or psychotropic experiences. As will be discussed in more detail below, the current inventive technology overcomes the limitations of traditional cannabinoid emulsion systems while meeting the objectives of a truly effective and scalable cannabinoid production, solubilization, and isolation system.

SUMMARY OF THE INVENTION

One aspect of the present invention relates generally to the identification novel UDP-glucosyltransferases (UDP-UGTs or UGTs) enzymes having glycosylation activity towards one or more cannabinoid compounds. In one preferred aspect, the present invention includes the identification of novel UGTs according to the amino acid sequences identified as SEQ ID NOs. 1-9181, and UGTs having 90% sequence identity with SEQ ID NOs. 1-9181, that have glycosylation activity towards one or more cannabinoid compounds, and preferably THC and CBD.

One aspect of the present invention further relates generally to the use of novel UGT enzymes having specific activity towards one or more cannabinoid compounds to generate water-soluble cannabinoid glycoside compounds in in vitro, ex vivo, and in vivo systems. In one preferred aspect, the present invention use of novel UGT enzymes according to the amino acid sequences identified as SEQ ID NOs. 1-9181, and UGTs having 90% sequence identity with SEQ ID NOs. 1-9181, that have glycosylation activity towards one or more cannabinoid compounds, and preferably THC and CBD, in in vitro, ex vivo, and in vivo systems. In one preferred aspect of the invention, an in vivo system may include a whole organism system, such as a plant, or cell culture, such as a plant cell culture, an algal cell culture, a fungi cell culture, or a microorganism cell culture, such as a bacterial or yeast cell culture.

One aspect of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as SEQ ID NOs. 1-9181, and UGTs having 90% sequence identity with SEQ ID NOs. 1-9181, that have glycosylation activity towards one or more cannabinoid compounds, in in vitro, ex vivo, and in vivo systems. In one preferred aspect of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other aspects, an in vitro system may include chemical conversion of cannabinoids into water-soluble cannabinoid glycoside compounds.

Yet, another aspect of the current inventive technology may include the generation of genetically modified organisms configured to produce water-soluble cannabinoid glycoside compounds. In one preferred aspect, a plant, a plant cell, an algal cell, a fungi, a bacteria, or a yeast cell, may be genetically modified to express a nucleotide sequence encoding one or more UGTs that have glycosylation activity towards one or more cannabinoid compounds, and preferably a UGT selected from the group of nucleotide sequences consisting of: a nucleotide sequence encoding an amino acid sequence according to SEQ ID NOs. 1-9181, and a nucleotide sequence encoding an amino acid sequence having 90% sequence identity with SEQ ID NOs. 1-9181.

Another aspect of the current inventive technology includes the isolated amino acid sequences encoding one or more UGTs that have glycosylation activity towards one or more cannabinoid compounds according to SEQ ID NOs. 1-9181, and amino acid sequence having 90% sequence identity with SEQ ID NOs. 1-9181.

Another aspect of the current inventive technology includes a nucleotide sequence encoding one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181.

Another aspect of the current inventive technology includes an expression vector having a nucleotide sequence encoding one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181, operably linked to a promoter.

Another aspect of the current inventive technology includes one or more organisms, such as a plant, plant cell, bacteria, algae, fungi, or yeast cell, transformed by an expression vector having a nucleotide sequence encoding one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181, operably linked to a promoter.

One aspect of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the Gram+of class of UGTs may include the following structural groups: 5tzk (SEQ ID NOs. 1-1182), 3bcv (SEQ ID NOS. 1183-1222), 5hea (SEQ ID NOs. 1223-1805), 6h21 (SEQ ID NOs. 1806-1825), and UGTs having 90% sequence identity with SEQ ID NOs. 1-1825, that have glycosylation activity towards one or more cannabinoid compounds. In one preferred aspect of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other aspects, an in vitro system may include chemical conversion of cannabinoids into water-soluble cannabinoid glycoside compounds.

In another aspect, one or more of cannabinoid glycoside compounds identified as: 10B, 10C, 10D, 11A, 11B, 11C, 11D, 11E and 11F, may be generated through the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the Gram+of class of UGTs may include the following structural groups: 5tzk (SEQ ID NOs. 1-1182), 3bcv (SEQ ID NOs. 1183-1222), 5hea (SEQ ID NOs. 1223-1805), 6h21 (SEQ ID NOs. 1806-1825), and UGTs having 90% sequence identity with SEQ ID NOs. 1-1825, that have glycosylation activity towards one or more cannabinoid compounds.

Yet, another aspect of the current inventive technology may include the generation of genetically modified organisms configured to produce water-soluble cannabinoid glycoside compounds. In one preferred aspect, a plant, a plant cell, an algal cell, a fungi, a bacteria, or a yeast cell, may be genetically modified to express a nucleotide sequence encoding one or more Gram+class of UGTs that have glycosylation activity towards one or more cannabinoid compounds, and preferably a UGT selected from the group of nucleotide sequences consisting of: a nucleotide sequence encoding an amino acid sequence according to SEQ ID NOs. 1-1825, and a nucleotide sequence encoding an amino acid sequence having 90% sequence identity with SEQ ID NOs. 1-1825.

Another aspect of the current inventive technology includes the isolated amino acid sequences encoding one or more Gram+class of UGTs that have glycosylation activity towards one or more cannabinoid compounds according to SEQ ID NOs. 1-1825, and amino acid sequence having 90% sequence identity with SEQ ID NOs. 1-1825.

Another aspect of the current inventive technology includes a nucleotide sequence encoding one or more Gram+class of UGTs that have glycosylation activity towards one or more cannabinoid compounds according to SEQ ID NOs. 1-1825, and a nucleotide sequence encoding an amino acid sequence having 90% sequence identity with SEQ ID NOs. 1-1825.

Another aspect of the current inventive technology includes an expression vector having a nucleotide sequence encoding one or more Gram+class of UGTs that have glycosylation activity towards one or more cannabinoid compounds according to SEQ ID NOs. 1-9181, and a nucleotide sequence encoding an amino acid sequence having 90% sequence identity with SEQ ID NOs. 1-1825, operably linked to a promoter.

Another aspect of the current inventive technology includes one or more organisms, such as a plant, plant cell, bacteria, algae, fungi, or yeast cell, transformed by an expression vector having a nucleotide sequence encoding one or more Gram+class of UGTs that have glycosylation activity towards one or more cannabinoid compounds according to SEQ ID NOs. 1-1825, and a nucleotide sequence encoding an amino acid sequence having 90% sequence identity with SEQ ID NOs. 1-1825, operably linked to a promoter.

One aspect of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as belonging to the GT-A of class of UGTs as described herein, in an in vitro, ex vivo, and in vivo systems. In this preferred embodiment, the GT-A of class of UGTs may include the following structural groups: 1g9r (SEQ ID NOs. 1826-1828), 2286 (SEQ ID NOs. 1829-1985), 3ckj (SEQ ID NOs. 1986-2453), 3e25 (SEQ ID NOs. 2454-3126), 3fly (SEQ ID NOs. 3127-3430), 4dec (SEQ ID NOs. 3431-3481), 5mlz (SEQ ID NOs. 3482-3639), 5nv4 (SEQ ID NOs. 3640-3693), 6fsn (SEQ ID NOs. 3694-4699), 6p61 (SEQ ID NOs. 4700-5259) and UGTs having 90% sequence identity with SEQ ID NOs. 1826-5259, that have glycosylation activity towards one or more cannabinoid compounds. In one preferred aspect of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other aspects, an in vitro system may include chemical conversion of cannabinoids into water-soluble cannabinoid glycoside compounds.

In another aspect, one or more of cannabinoid glycoside compounds identified as: 10B, 10C, 10D, 11A, 11B, 11C, 11D, 11E and 11F, may be generated through the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the GT-A of class of UGTs may include the following structural groups: 1 g9r (SEQ ID NOs. 1826-1828), 2286 (SEQ ID NOs. 1829-1985), 3ckj (SEQ ID NOs. 1986-2453), 3c25 (SEQ ID NOs. 2454-3126), 3fly (SEQ ID NOs. 3127-3430), 4dec (SEQ ID NOs. 3431-3481), 5mlz (SEQ ID NOs. 3482-3639), 5nv4 (SEQ ID NOs. 3640-3693), 6fsn (SEQ ID NOs. 3694-4699), 6p61 (SEQ ID NOs. 4700-5259) and UGTs having 90% sequence identity with SEQ ID NOs. 1826-5259, that have glycosylation activity towards one or more cannabinoid compounds.

Yet, another aspect of the current inventive technology may include the generation of genetically modified organisms configured to produce water-soluble cannabinoid glycoside compounds. In one preferred aspect, a plant, a plant cell, an algal cell, a fungi, a bacteria, or a yeast cell, may be genetically modified to express a nucleotide sequence encoding one or more GT-A class of UGTs that have glycosylation activity towards one or more cannabinoid compounds, and preferably a UGT selected from the group of nucleotide sequences consisting of: a nucleotide sequence encoding an amino acid sequence according to SEQ ID NOs. 1826-5259, and a nucleotide sequence encoding an amino acid sequence having 90% sequence identity with SEQ ID NOs. 1826-5259.

Another aspect of the current inventive technology includes the isolated amino acid sequences encoding one or more GT-A class of UGTs that have glycosylation activity towards one or more cannabinoid compounds according to SEQ ID NOs. 1826-5259, and amino acid sequence having 90% sequence identity with SEQ ID NOs. 1826-5259.

Another aspect of the current inventive technology includes a nucleotide sequence encoding one or more GT-A class of UGTs that have glycosylation activity towards one or more cannabinoid compounds according to SEQ ID NOs. 1826-5259, and a nucleotide sequence encoding an amino acid sequence having 90% sequence identity with SEQ ID NOs. 1826-5259.

Another aspect of the current inventive technology includes an expression vector having a nucleotide sequence encoding one or more GT-A class of UGTs that have glycosylation activity towards one or more cannabinoid compounds according to SEQ ID NOs. 1826-5259, and a nucleotide sequence encoding an amino acid sequence having 90% sequence identity with SEQ ID NOs. 1826-5259, operably linked to a promoter.

Another aspect of the current inventive technology includes one or more organisms, such as a plant, plant cell, bacteria, algae, fungi, or yeast cell, transformed by an expression vector having a nucleotide sequence encoding one or more GT-A class of UGTs that have glycosylation activity towards one or more cannabinoid compounds according to SEQ ID NOs. 1826-5259, and a nucleotide sequence encoding an amino acid sequence having 90% sequence identity with SEQ ID NOs. 1826-5259, operably linked to a promoter.

One aspect of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as belonging to the GT-B of class of UGTs as described herein, in an in vitro, ex vivo, and in vivo systems. In this preferred embodiment, the GT-B of class of UGTs may include the following structural groups: 2acv (SEQ ID NOs. 5260-6290), 2iya (SEQ ID NOs. 6290-6953), 3hbf (SEQ ID NOs. 6954-7484), 5g15 (SEQ ID NOs. 7485-7998), 3c48 (SEQ ID NOs. 7999-8243), 5nlm (SEQ ID NOs. 8244-8486), 5du2 (SEQ ID NOs. 8487-8612), 2clx (SEQ ID NOS. 8613-8688), 5zfk (SEQ ID NOs. 8689-8758), 4rel (SEQ ID NOs. 8759-8816), 3otg (SEQ ID NOs. 8817-8873), 5v2j (SEQ ID NOs. 8874-8921), 2r60 (SEQ ID NOs. 8922-8965), 4amg (SEQ ID NOs. 8966-9007), 4n9w (SEQ ID NOs. 9008-9046), 2pq6 (SEQ ID NOs. 9047-9082), 4wyi (SEQ ID NOs. 9083-9111), 6bk0 (SEQ ID NOs. 9112-9133), 6inf (SEQ ID NOs. 9134-9149), 3ia7 (SEQ ID NOs. 9150-9158), 5d01 (SEQ ID NOs. 9159-9165), 6ij9 (SEQ ID NOs. 9166-9170), 6d9t (SEQ ID NOs. 9171-9175), 2jjm (SEQ ID NOs. 9176-9180), 3mbo (SEQ ID NO. 9181) and UGTs having 90% sequence identity with SEQ ID NOs. 5260-9181, that have glycosylation activity towards one or more cannabinoid compounds. In one preferred aspect of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other aspects, an in vitro system may include chemical conversion of cannabinoids into water-soluble cannabinoid glycoside compounds.

In another aspect, one or more of cannabinoid glycoside compounds identified as: 10B, 10C, 10D, 11A, 11B, 11C, 11D, 11E and 11F, may be generated through the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the GT-B of class of UGTs may include the following structural groups: 2acv (SEQ ID NOs. 5260-6290), 2iya (SEQ ID NOs. 6290-6953), 3hbf (SEQ ID NOs. 6954-7484), 5g15 (SEQ ID NOs. 7485-7998), 3c48 (SEQ ID NOs. 7999-8243), 5nlm (SEQ ID NOs. 8244-8486), 5du2 (SEQ ID NOs. 8487-8612), 2clx (SEQ ID NOs. 8613-8688), 5zfk (SEQ ID NOS. 8689-8758), 4rel (SEQ ID NOs. 8759-8816), 3otg (SEQ ID NOs. 8817-8873), 5v2j (SEQ ID NOS. 8874-8921), 2r60 (SEQ ID NOs. 8922-8965), 4amg (SEQ ID NOs. 8966-9007), 4n9w (SEQ ID NOs. 9008-9046), 2pq6 (SEQ ID NOs. 9047-9082), 4wyi (SEQ ID NOs. 9083-9111), 6bk0 (SEQ ID NOs. 9112-9133), 6inf (SEQ ID NOs. 9134-9149), 3ia7 (SEQ ID NOs. 9150-9158), 5d01 (SEQ ID NOs. 9159-9165), 6ij9 (SEQ ID NOs. 9166-9170), 6d9t (SEQ ID NOs. 9171-9175), 2jjm (SEQ ID NOs. 9176-9180), 3mbo (SEQ ID NO. 9181) and UGTs having 90% sequence identity with SEQ ID NOs. 5260-9181, that have glycosylation activity towards one or more cannabinoid compounds.

Yet, another aspect of the current inventive technology may include the generation of genetically modified organisms configured to produce water-soluble cannabinoid glycoside compounds. In one preferred aspect, a plant, a plant cell, an algal cell, a fungi, a bacteria, or a yeast cell, may be genetically modified to express a nucleotide sequence encoding one or more GT-B class of UGTs that have glycosylation activity towards one or more cannabinoid compounds, and preferably a GT-B class of UGT selected from the group of nucleotide sequences consisting of: a nucleotide sequence encoding an amino acid sequence according to SEQ ID NOs. 5260-9181, and a nucleotide sequence encoding an amino acid sequence having 90% sequence identity with SEQ ID NOs. 1-9181.

Another aspect of the current inventive technology includes the isolated amino acid sequences encoding one or more GT-B class of UGTs that have glycosylation activity towards one or more cannabinoid compounds according to SEQ ID NOs. 5260-9181, and amino acid sequence having 90% sequence identity with SEQ ID NOs. 5260-9181.

Another aspect of the current inventive technology includes a nucleotide sequence encoding one or more GT-B class of UGTs that have glycosylation activity towards one or more cannabinoid compounds according to SEQ ID NOs. 5260-9181, and a nucleotide sequence encoding an amino acid sequence having 90% sequence identity with SEQ ID NOs. 5260-9181.

Another aspect of the current inventive technology includes an expression vector having a nucleotide sequence encoding one or more GT-B class of UGTs that have glycosylation activity towards one or more cannabinoid compounds according to SEQ ID NOs. 1-9181, and a nucleotide sequence encoding an amino acid sequence having 90% sequence identity with SEQ ID NOs. 5260-9181, operably linked to a promoter.

Another aspect of the current inventive technology includes one or more organisms, such as a plant, plant cell, bacteria, algae, fungi, or yeast cell, transformed by an expression vector having a nucleotide sequence encoding one or more GT-B class of UGTs that have glycosylation activity towards one or more cannabinoid compounds according to SEQ ID NOs. 5260-9181, and a nucleotide sequence encoding an amino acid sequence having 90% sequence identity with SEQ ID NOs. 5260-9181, operably linked to a promoter.

One aspect of the current inventive technology includes improved systems and methods for the bioconversion of cannabinoid compounds into water-soluble cannabinoid glycosides, or water-soluble acetyl cannabinoid glycosides in a bacterial, yeast, or plant cell culture system. In another preferred aspect, a preferred plant cell culture system may include a *Cannabis* suspension cell culture, or a tobacco plant cell culture.

Another aspect of the current inventive technology includes one or more consumer products, or pharmaceutical preparations having at least one cannabinoid glycoside generated in an in vitro, ex vivo, or in vivo system by the action of one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181.

Additional aspects of the current invention may include one or more of the following preferred embodiments:
1. A method of generating a water-soluble cannabinoid comprising the steps:
   establishing a suspension cell culture of genetically modified yeast cells that express a nucleotide sequence encoding a heterologous UDP-glucosyltransferases (UGT) having glycosylation activity towards one or more cannabinoid compounds operably linked to a promotor, wherein said heterologous UGT comprises a heterologous UGT selected from the group of amino acid sequences consisting of: SEQ ID NOs. 1-9181, and a nucleotide sequence encoding an amino acid sequence having 90% sequence identity with SEQ ID NOs. 1-9181;

introducing at least one cannabinoid to said suspension cell culture of genetically modified yeast cells; and glycosylating the cannabinoid through the action of said heterologous UGT forming a water-soluble cannabinoid glycoside.

2. The method of embodiment 1, wherein said genetically modified yeast cells comprise genetically modified yeast cells selected from the group consisting of: genetically modified *Pichia pastoris* cells, genetically modified *Saccharomyces cerevisiae* cells, and genetically modified *Kluyveromyces marxianus* cells.

3. The method of embodiment 1, wherein said step of introducing at least one cannabinoid to said suspension cell culture of genetically modified yeast cells comprises the step of introducing at least one cannabinoid to the suspension cell culture selected from the group consisting of: cannabidiol (CBD), cannabidiolic acid (CBDA), delta-9-tetrahydrocannabinol (THC), and tetrahydrocannabinolic acid (THCA).

4. The method of embodiment 2, wherein said CBD or said CBDA are glycosylated to form a 2×CBD Glycoside, and a 2×CBDA Glycoside respectively.

5. The method of embodiment 1, wherein said step of introducing comprises the step of introducing selected from the group consisting of: introducing a cannabinoid extract containing a spectrum of cannabinoids to said suspension cell culture of genetically modified yeast cells, introducing one or more non-psychoactive cannabinoids to said suspension cell culture of genetically modified yeast cells, introducing one or more cannabinoid precursors to said suspension cell culture of genetically modified yeast cells, and introducing one or more cannabinoid acids to said suspension cell culture of genetically modified yeast cells.

6. The method of embodiment 1, and further comprising isolating said water-soluble cannabinoid glycoside.

7. The method of embodiments 1 and 6, wherein said isolated water-soluble cannabinoid glycoside comprises the compound 10C:

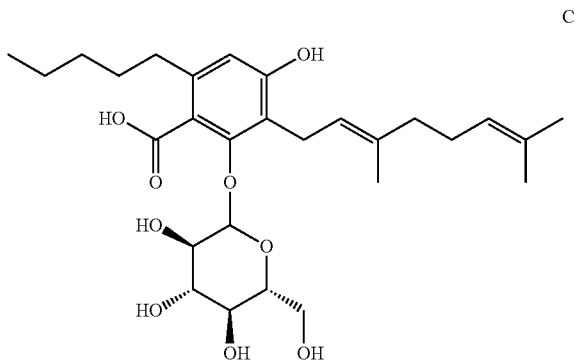 [SMILES: CCCCCc1cc(O)c(C/C=C(\C)CCC=C(C)C)c(OC2O[C@H](CO)[C@@H](O)[C@H](O)[C@H]2O)c1C(=O)O]

and/or a pharmaceutically acceptable salt.

8. The method of embodiments 1 and 6, wherein said isolated water-soluble cannabinoid glycoside comprises the compound 10D:

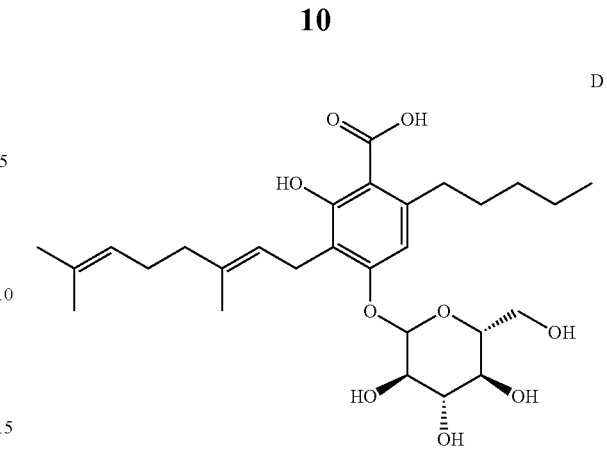

and/or a pharmaceutically acceptable salt.

9. The method of embodiments 1 and 6, wherein said isolated water-soluble cannabinoid glycoside comprises the compound 11B:

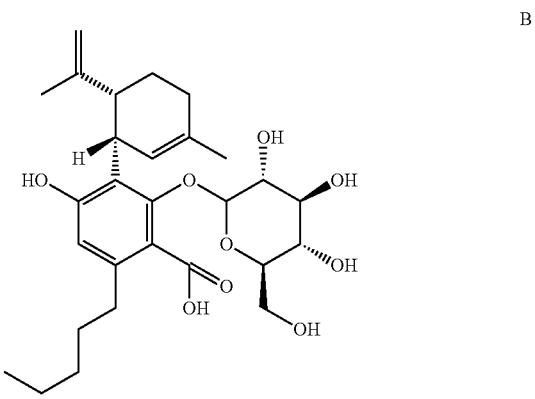 [SMILES: C=C(C)[C@@H]1CCC(C)=C[C@@H]1c1c(O)cc(CCCCC)c(C(=O)O)c1OC1O[C@H](CO)[C@@H](O)[C@H](O)[C@H]1O]

and/or a pharmaceutically acceptable salt.

10. The method of embodiments 1 and 6, wherein said isolated water-soluble cannabinoid glycoside comprises the compound 11C:

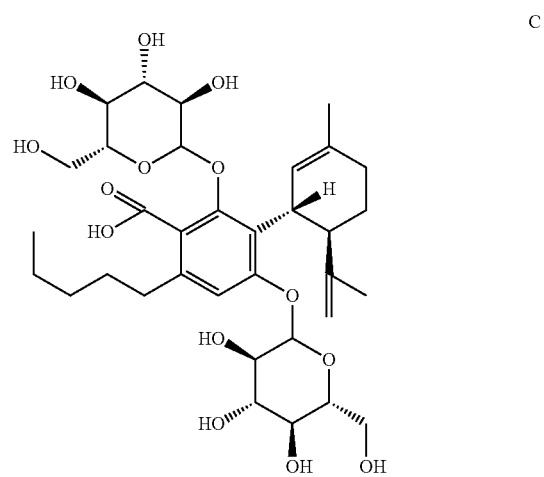

and/or a pharmaceutically acceptable salt.

11. The method of embodiments 1 and 6, wherein said isolated water-soluble cannabinoid glycoside comprises the compound 11D:

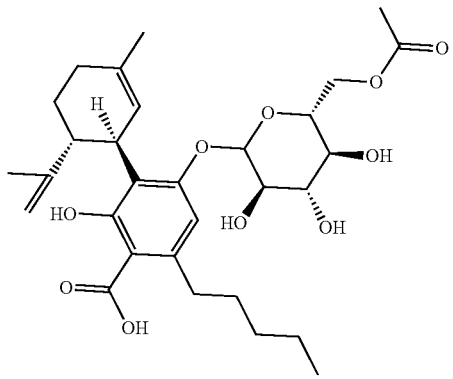

D and/or a pharmaceutically acceptable salt.

12. The method of embodiments 1 and 6, wherein said isolated water-soluble cannabinoid glycoside comprises the compound 11E:

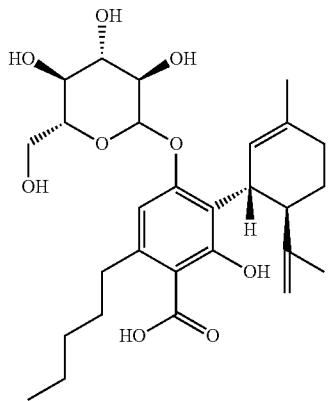

E and/or a pharmaceutically acceptable salt.

13. The method of embodiments 1 and 6, wherein said isolated water-soluble cannabinoid glycoside comprises the compound 11F:

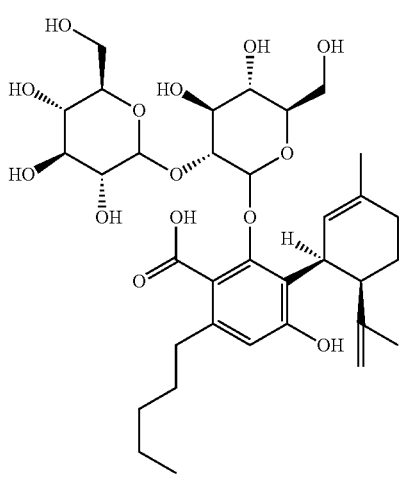

F and/or a pharmaceutically acceptable salt.

14. A method of generating a water-soluble cannabinoid comprising the step of introducing a cannabinoid compound to a UDP-glucosyltransferases (UGT) having glycosylation activity towards said cannabinoid wherein said UGT comprises a UGT selected from the group of amino acid sequences consisting of: SEQ ID NOs. 1-9181, and an amino acid sequence having 90% sequence identity with SEQ ID NOs. 1-9181, forming a cannabinoid glycoside.

15. The method of embodiment 14, wherein said step of introducing comprises the step of introducing selected from the group consisting of:
introducing a cannabinoid compound to a UGT having glycosylation activity towards said cannabinoid in an in vitro system;
introducing a cannabinoid compound to a UGT having glycosylation activity towards said cannabinoid in an ex vitro system; and
introducing a cannabinoid compound to a UGT having glycosylation activity towards said cannabinoid in an in vivo system.

16. The method of embodiment 15, wherein said ex vivo system comprises a bioreactor system, and said in vivo system comprises a cell culture, wherein said cell culture is further selected from the group consisting of a yeast cell culture, a bacterial cell culture, an algal cell culture, a fungi cell culture, and a plant cell culture.

17. The method of embodiment 14, wherein said cannabinoid compound is selected from the group consisting of: cannabidiol (CBD), cannabidiolic acid (CBDA), delta-9-tetrahydrocannabinol (THC), and tetrahydrocannabinolic acid (THCA).

18. The method of embodiment 17, wherein said CBD or said CBDA are glycosylated to form a 2×CBD Glycoside, and a 2×CBDA Glycoside respectively.

19. The method of embodiment 14, wherein said step of introducing comprises the step of introducing selected from the group consisting of: a cannabinoid extract containing a spectrum of cannabinoids, introducing one or more non-psychoactive cannabinoids, introducing one or more cannabinoid precursors, or introducing one and introducing one or more cannabinoid acids.

20. The method of embodiment 14, and further comprising isolating said water-soluble cannabinoid glycoside.

21. The method of embodiments 14 and 20, wherein said isolated water-soluble cannabinoid glycoside comprises the compound 10C:

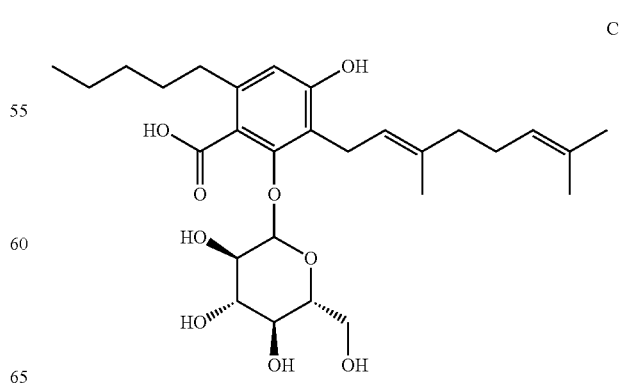

C and/or a pharmaceutically acceptable salt.

22. The method of embodiments 14 and 20, wherein said isolated water-soluble cannabinoid glycoside comprises the compound 10D:

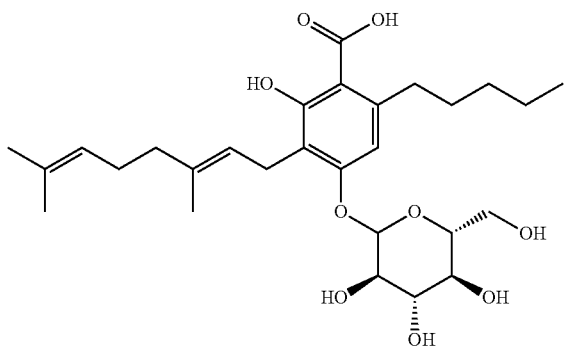

and/or a pharmaceutically acceptable salt.

23. The method of embodiments 14 and 20, wherein said isolated water-soluble cannabinoid glycoside comprises the compound 11B:

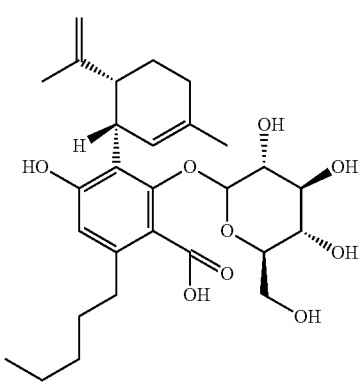

and/or a pharmaceutically acceptable salt.

24. The method of embodiments 14 and 20, wherein said isolated water-soluble cannabinoid glycoside comprises the compound 11C:

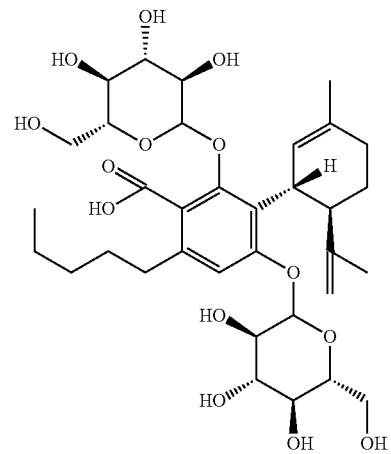

and/or a pharmaceutically acceptable salt.

25. The method of embodiments 14 and 20, wherein said isolated water-soluble cannabinoid glycoside comprises the compound 11D:

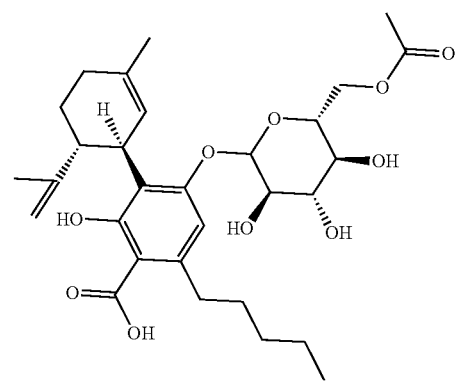

and/or a pharmaceutically acceptable salt.

26. The method of embodiments 14 and 20, wherein said isolated water-soluble cannabinoid glycoside comprises the compound 11E:

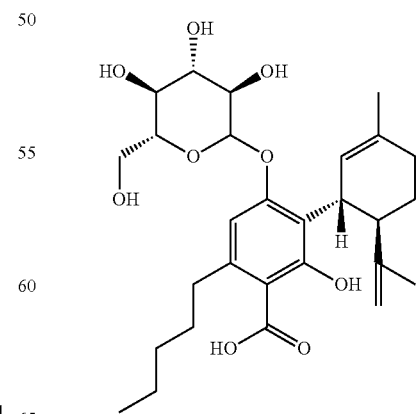

and/or a pharmaceutically acceptable salt.

27. The method of embodiments 14 and 20, wherein said isolated water-soluble cannabinoid glycoside comprises the compound 11F:

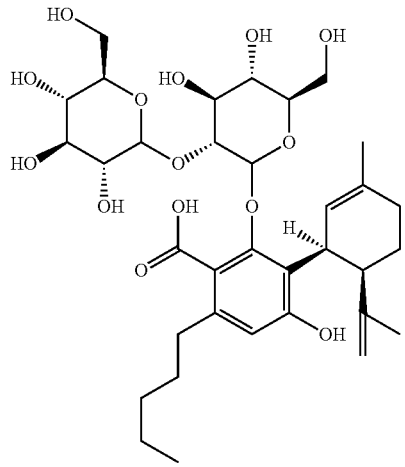

and/or a pharmaceutically acceptable salt.

28. A pharmaceutical preparations having at least one cannabinoid glycoside generated in an in vitro, ex vivo, or in vivo system by the action of one or more UDP-glucosyltransferases (UGT) having glycosylation activity towards one or more cannabinoid compounds according to SEQ ID NOs. 1-9181, and a nucleotide sequence encoding an amino acid sequence having 90% sequence identity with SEQ ID NOs. 1-9181.

29. A cannabinoid glycoside generated in an in vitro, ex vivo, or in vivo system by the action of one or more UDP-glucosyltransferases (UGT) have glycosylation activity towards one or more cannabinoid compounds according to SEQ ID NOs. 1-9181, and a nucleotide sequence encoding an amino acid sequence having 90% sequence identity with SEQ ID NOs. 1-9181, and/or a pharmaceutically acceptable salt.

30. A genetically modified cell that express a nucleotide sequence encoding a heterologous UDP-glucosyltransferases (UGT) having glycosylation activity towards one or more cannabinoid compounds operably linked to a promotor, wherein said heterologous UGT comprises a heterologous UGT selected from the group of amino acid sequences consisting of: SEQ ID NOs. 1-9181, and a nucleotide sequence encoding an amino acid sequence having 90% sequence identity with SEQ ID NOs. 1-9181.

31. The genetically modified cell of embodiment 30, wherein said genetically modified cell is selected from the group consisting of: a plant cell, a yeast cell, a bacterial cell, a fungi cell, and an algal cell.

32. The genetically modified cell of embodiment 30, wherein said genetically modified cell is selected from the group consisting of: a *Cannabis* plant cell, and a tobacco plant cell.

33. A method of generating a water-soluble cannabinoid comprising the step of introducing a cannabinoid compound to a UDP-glucosyltransferases (UGT) having glycosylation activity towards said cannabinoid forming a cannabinoid glycoside, wherein said UGT comprises a UGT selected from the group of amino acid sequences consisting of: a UGT from the structural group Gram+UGTs, structural group GT-A UGTs, and a UGT from the structural group GT-B UGTs.

34. The method of embodiment 33, wherein said step of introducing comprises the step of introducing selected from the group consisting of:
   introducing a cannabinoid compound to a UGT having glycosylation activity towards said cannabinoid forming a cannabinoid glycoside, in an in vitro system;
   introducing a cannabinoid compound to a UGT having glycosylation activity towards said cannabinoid forming a cannabinoid glycoside, in an ex vitro system; and
introducing a cannabinoid compound to a UGT having glycosylation activity towards said cannabinoid forming a cannabinoid glycoside, in an in vivo system.

35. The method of embodiment 34, wherein said ex vivo system comprises a bioreactor system, and said in vivo system comprises a cell culture, wherein said cell culture is further selected from the group consisting of a yeast cell culture, a bacterial cell culture, an algal cell culture, a fungi cell culture, and a plant cell culture.

36. The method of embodiment 33, wherein said cannabinoid compound is selected from the group consisting of: cannabidiol (CBD), cannabidiolic acid (CBDA), delta-9-tetrahydrocannabinol (THC), and tetrahydrocannabinolic acid (THCA).

37. The method of embodiment 33, wherein said structural group Gram+UGTs is selected from the group of UGT structural groups consisting of: 5tzk (SEQ ID NOs. 1-1182), 3bcv (SEQ ID NOs. 1183-1222), 5hea (SEQ ID NOs. 1223-1805), 6h21 (SEQ ID NOs. 1806-1825), and UGTs having 90% sequence identity with SEQ ID NOs. 1-1825, that have glycosylation activity towards one or more cannabinoid compounds.

38. The method of embodiment 33, wherein said structural group GT-A UGTs is selected from the group of UGT structural groups consisting of: 1g9r (SEQ ID NOs. 1826-1828), 2286 (SEQ ID NOs. 1829-1985), 3ckj (SEQ ID NOs. 1986-2453), 3e25 (SEQ ID NOs. 2454-3126), 3fly (SEQ ID NOs. 3127-3430), 4dec (SEQ ID NOs. 3431-3481), 5mlz (SEQ ID NOs. 3482-3639), 5nv4 (SEQ ID NOs. 3640-3693), 6fsn (SEQ ID NOs. 3694-4699), 6p61 (SEQ ID NOS. 4700-5259) and UGTs having 90% sequence identity with SEQ ID NOs. 1826-5259, that have glycosylation activity towards one or more cannabinoid compounds.

39. The method of embodiment 33, wherein said structural group GT-B UGTs is selected from the group of UGT structural groups consisting of: 2acv (SEQ ID NOs. 5260-6290), 2iya (SEQ ID NOs. 6290-6953), 3hbf (SEQ ID NOs. 6954-7484), 5g15 (SEQ ID NOs. 7485-7998), 3c48 (SEQ ID NOs. 7999-8243), 5nlm (SEQ ID NOs. 8244-8486), 5du2 (SEQ ID NOs. 8487-8612), 2clx (SEQ ID NOs. 8613-8688), 5zfk (SEQ ID NOs. 8689-8758), 4rel (SEQ ID NOs. 8759-8816), 3otg (SEQ ID NOs. 8817-8873), 5v2j (SEQ ID NOs. 8874-8921), 2r60 (SEQ ID NOs. 8922-8965), 4amg (SEQ ID NOs. 8966-9007), 4n9w (SEQ ID NOs. 9008-9046), 2pq6 (SEQ ID NOs. 9047-9082), 4wyi (SEQ ID NOs. 9083-9111), 6bk0 (SEQ ID NOs. 9112-9133), 6inf (SEQ ID NOs. 9134-9149), 3ia7 (SEQ ID NOs. 9150-9158), 5d01 (SEQ ID NOs. 9159-9165), 6ij9 (SEQ ID NOs. 9166-9170), 6d9t (SEQ ID NOs. 9171-9175), 2jjm (SEQ ID NOs. 9176-9180), 3mbo (SEQ ID NO. 9181) and UGTs having 90% sequence identity with SEQ ID NOs. 5260-9181, that have glycosylation activity towards one or more cannabinoid compounds.

40. An isolated nucleotide sequence operably linked to a promoter sequencer encoding at least one UDP-glucosyltransferases (UGT) having glycosylation activity towards at least one cannabinoid wherein said UGT comprises a UGT selected from the group of amino acid sequences consisting of: SEQ ID NOs. 1-9181, and a nucleotide sequence encoding an amino acid sequence having 90% sequence identity with SEQ ID NOs. 1-9181.

41. An isolated UDP-glucosyltransferases (UGT) having glycosylation activity towards THC and CBD, wherein said UGT comprises a UGT having a GT-A fold consisting of a single domain with a seven-stranded β-sheet flanked on both sides of the sheet by several a-helices.

42. The isolated UGT of embodiment 41, wherein the UGT having glycosylation activity towards THC and CBD is selected from the group consisting of: 5tzk (SEQ ID NOs. 1-1182), 3bcv (SEQ ID NOs. 1183-1222), 5hea (SEQ ID NOs. 1223-1805), 6h21 (SEQ ID NOs. 1806-1825), and UGTs having 90% sequence identity with SEQ ID NOs. 1-1825, that have glycosylation activity towards one or more cannabinoid compounds 43. An isolated UDP-glucosyltransferases (UGT) having glycosylation activity towards THC and CBD, wherein said UGT comprises a UGT having a GT-A fold consisting of a single domain with a seven-stranded β-sheet flanked on both sides of the sheet by several a-helices and also an additional tetratricopeptide repeat (TPR) motif that mediates the assembly of oligomers.

44. The isolated UGT of embodiment 43, wherein the UGT having glycosylation activity towards THC and CBD is selected from the group consisting of: 1g9r (SEQ ID NOs. 1826-1828), 2286 (SEQ ID NOs. 1829-1985), 3ckj (SEQ ID NOs. 1986-2453), 3e25 (SEQ ID NOs. 2454-3126), 3fly (SEQ ID NOs. 3127-3430), 4dec (SEQ ID NOs. 3431-3481), 5mlz (SEQ ID NOs. 3482-3639), 5nv4 (SEQ ID NOs. 3640-3693), 6fsn (SEQ ID NOs. 3694-4699), 6p61 (SEQ ID NOs. 4700-5259) and UGTs having 90% sequence identity with SEQ ID NOs. 1826-5259, that have glycosylation activity towards one or more cannabinoid compounds.

45. An isolated UGT having glycosylation activity towards THC and CBD, wherein said UGT comprises a UGT having a GT-B fold consisting of two distinct N-terminal and C-terminal domains that both adopt Rossmann-like folds.

46. The isolated UGT of embodiment 45, wherein the UGT having glycosylation activity towards THC and CBD is selected from the group consisting of: 2acv (SEQ ID NOs. 5260-6290), 2iya (SEQ ID NOs. 6290-6953), 3hbf (SEQ ID NOs. 6954-7484), 5g15 (SEQ ID NOs. 7485-7998), 3c48 (SEQ ID NOs. 7999-8243), 5nlm (SEQ ID NOs. 8244-8486), 5du2 (SEQ ID NOs. 8487-8612), 2clx (SEQ ID NOs. 8613-8688), 5zfk (SEQ ID NOs. 8689-8758), 4rel (SEQ ID NOs. 8759-8816), 3otg (SEQ ID NOs. 8817-8873), 5v2j (SEQ ID NOs. 8874-8921), 2r60 (SEQ ID NOs. 8922-8965), 4amg (SEQ ID NOs. 8966-9007), 4n9w (SEQ ID NOs. 9008-9046), 2pq6 (SEQ ID NOs. 9047-9082), 4wyi (SEQ ID NOs. 9083-9111), 6bk0 (SEQ ID NOs. 9112-9133), 6inf (SEQ ID NOs. 9134-9149), 3ia7 (SEQ ID NOs. 9150-9158), 5d01 (SEQ ID NOs. 9159-9165), 6ij9 (SEQ ID NOs. 9166-9170), 6d9t (SEQ ID NOs. 9171-9175), 2jjm (SEQ ID NOs. 9176-9180), 3mbo (SEQ ID NO. 9181) and UGTs having 90% sequence identity with SEQ ID NOs. 5260-9181, that have glycosylation activity towards one or more cannabinoid compounds.

47. An isolated nucleotide sequence operably linked to a promoter sequencer encoding at least one UDP-glucosyltransferases (UGT) having glycosylation activity towards THC or CBD wherein said UGT comprises a UGT selected from the group of amino acid sequences consisting of: SEQ ID NOs. 1-9181, and a nucleotide sequence encoding an amino acid sequence having 90% sequence identity with SEQ ID NOs. 1-9181.

Additional aspects of the invention may become evident based on the specification and figures presented below.

BRIEF DESCRIPTION OF THE FIGURES

FIG. 12. Shows the structural difference between UDP-glucuronic acid and UDP-glucose.

DETAILED DESCRIPTION OF THE INVENTION

Figure 1:
FIG. 1: CBD bound to Gram Positive Bacteria UDP-UGT 5tzk structure representative including a cannabinoid with the UDP co-factor of the UDP-glucose substrate.
Figure 2:
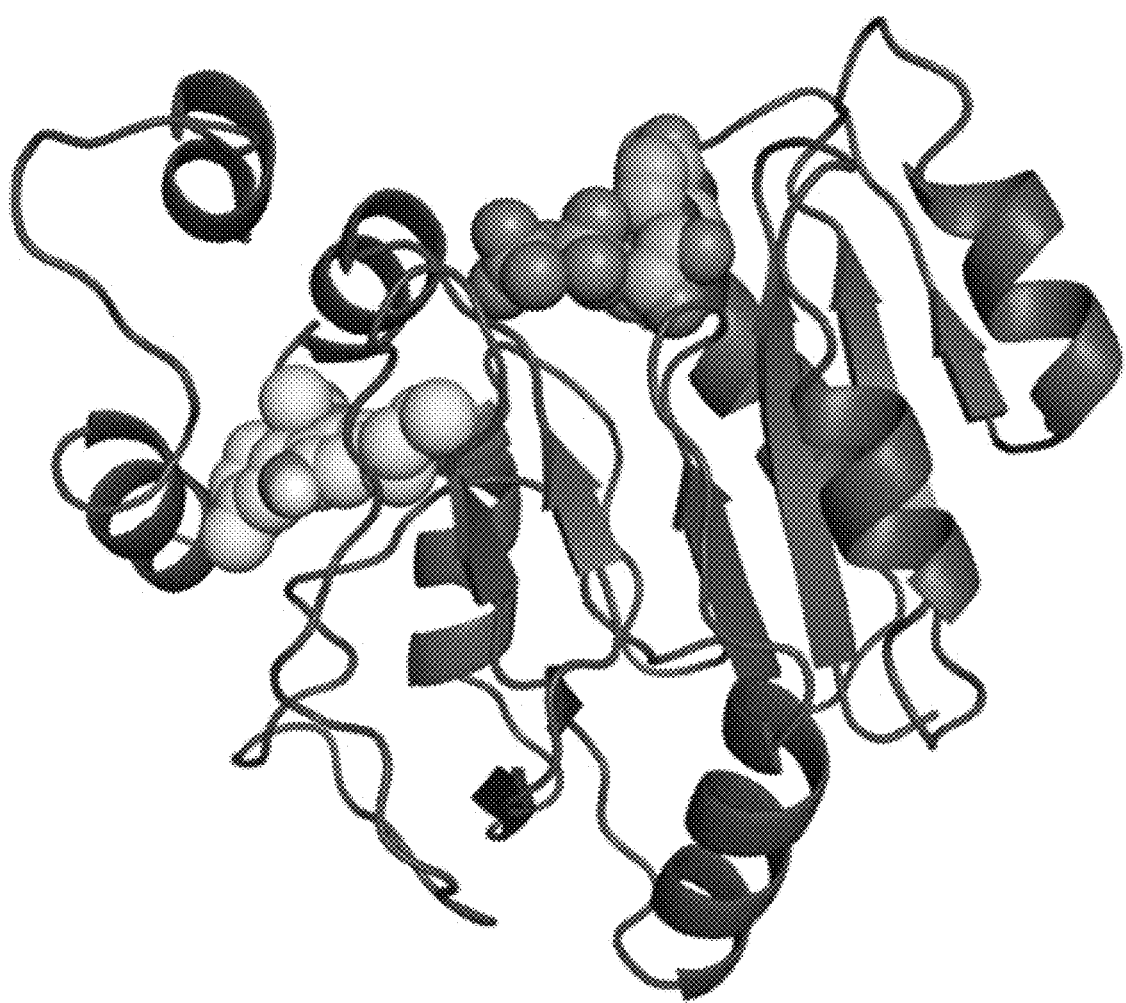
FIG. 2: THC bound to Gram Positive Bacteria UDP-UGT 5tzk structure representative including a cannabinoid with the UDP co-factor of the UDP-glucose substrate.
Figure 3:
FIG. 3: CBD bound to GT-A UDP-UGT 6p61c1 structure representative including a cannabinoid with the UDP co-factor of the UDP-glucose substrate.
Figure 4:
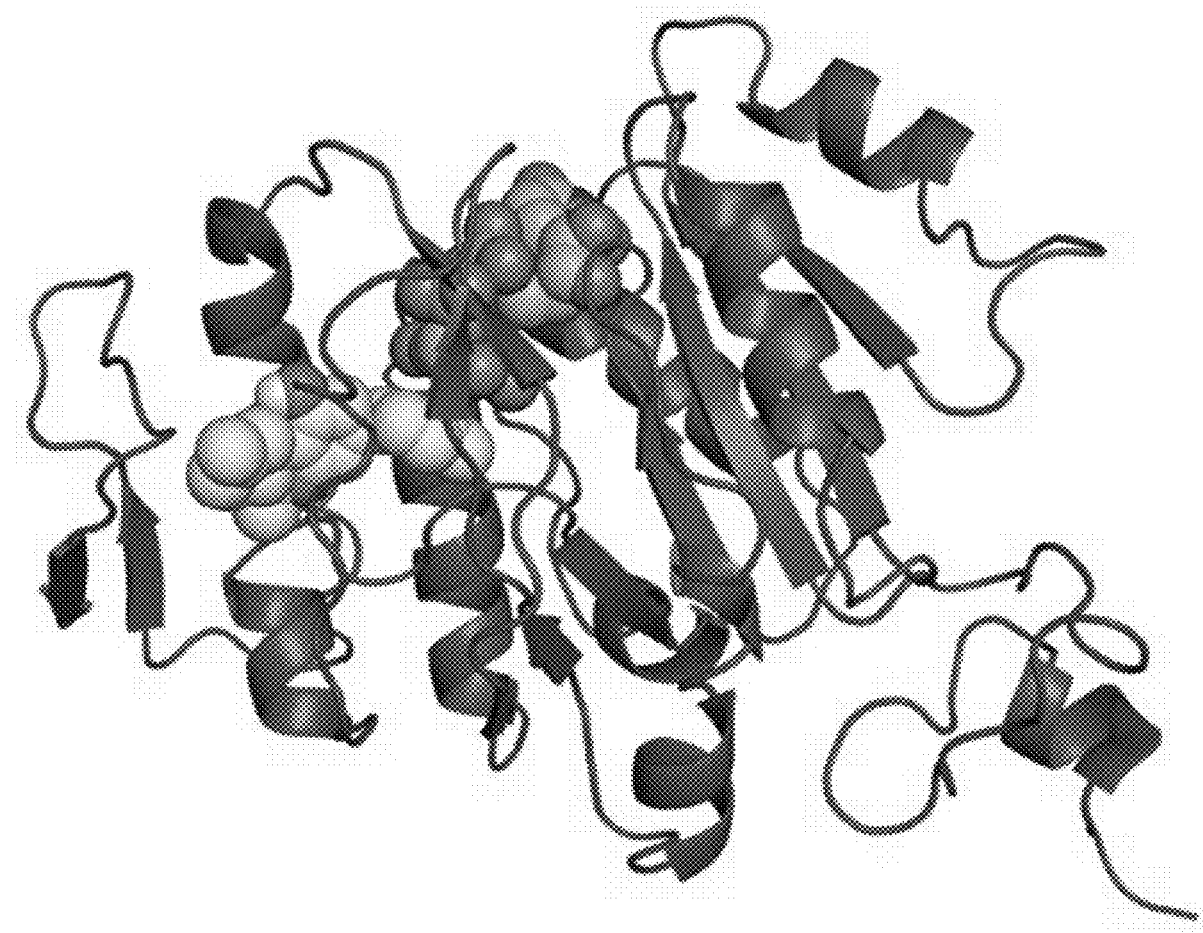
FIG. 4: THC bound to GT-A UDP-UGT 2286 structure representative including a cannabinoid with the UDP co-factor of the UDP-glucose substrate.
Figure 5:
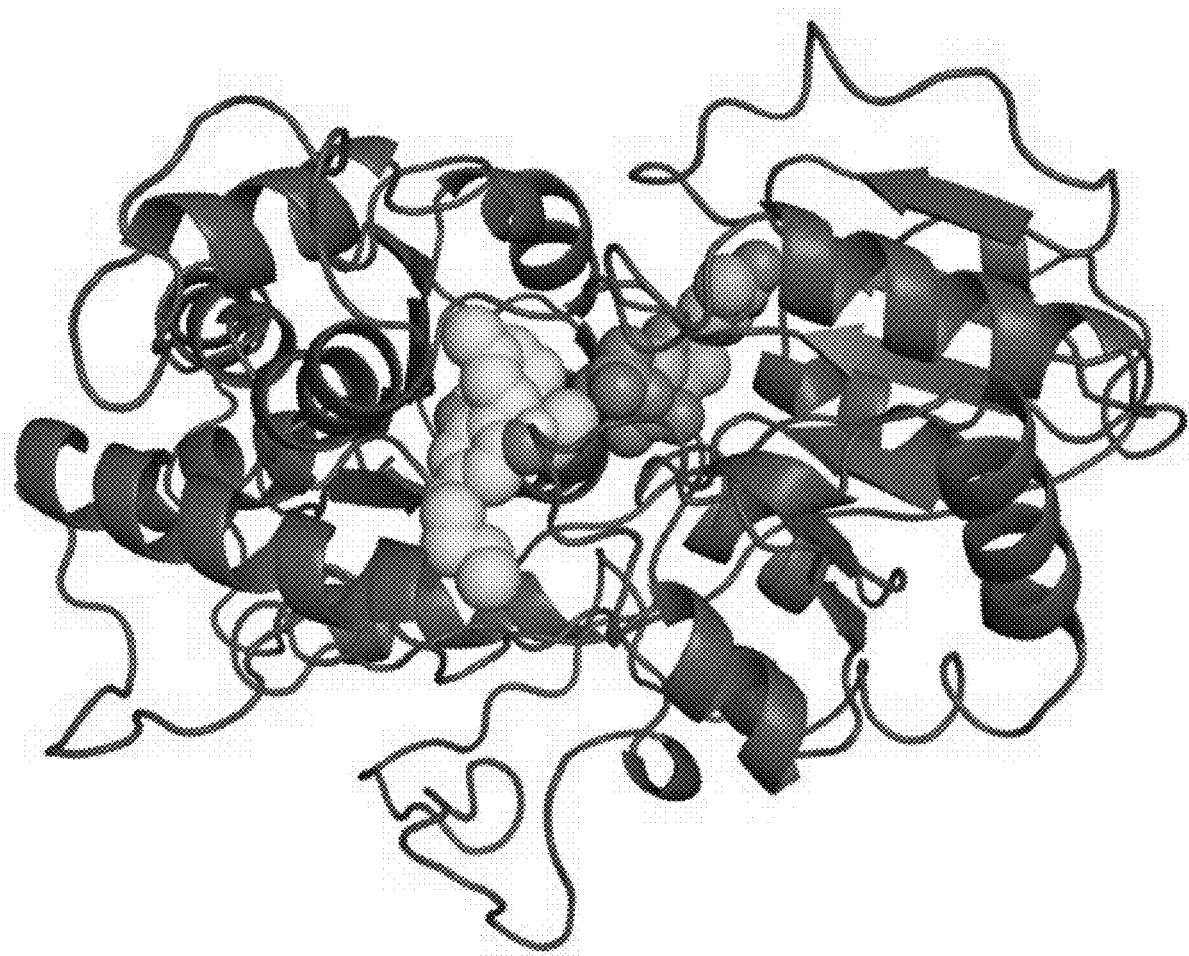
FIG. 5: CBD bound to GT-B UDP-UGT structure 3otg representative including a cannabinoid with the UDP co-factor of the UDP-glucose substrate.
Figure 6:
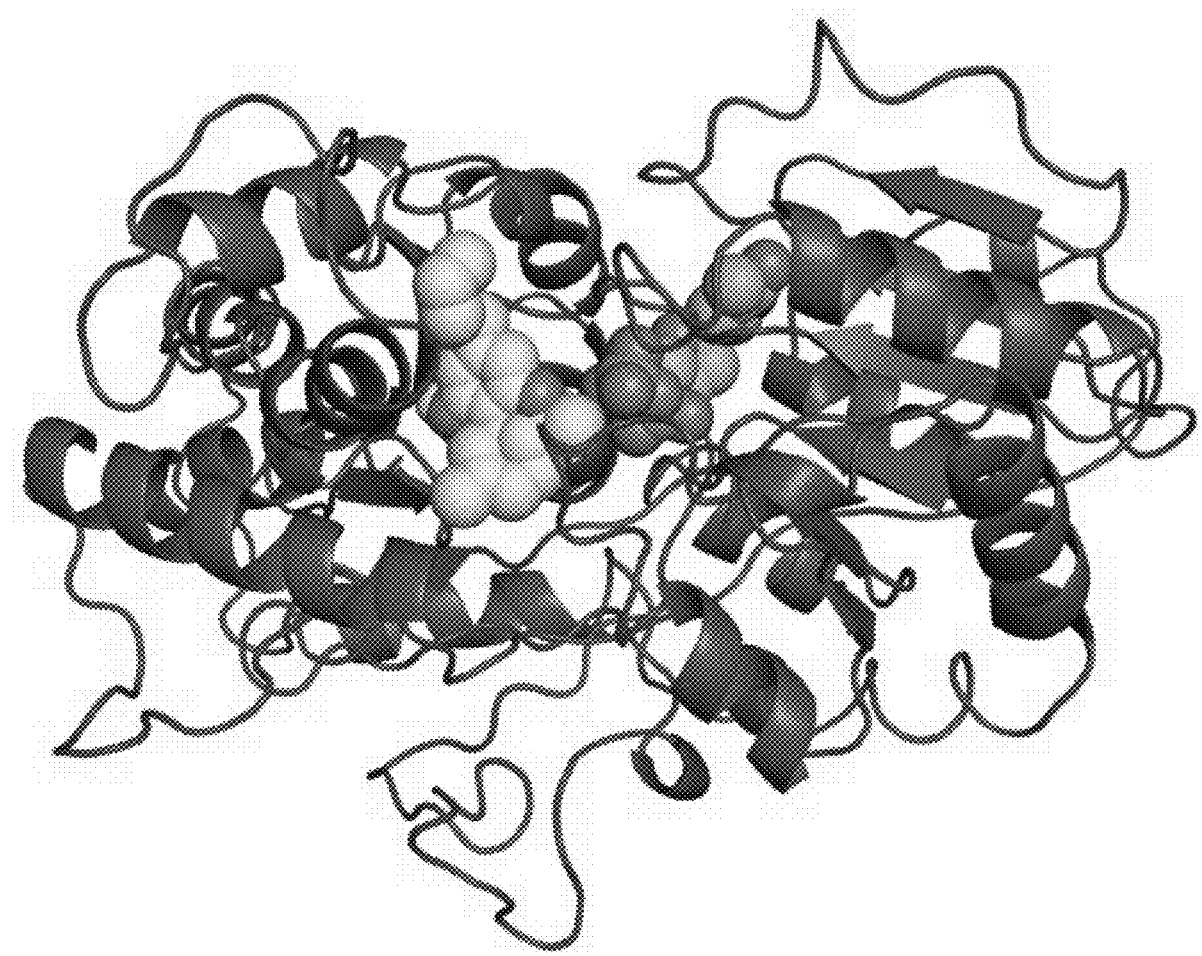
FIG. 6: THC bound to GT-B UDP-UGT structure 3otg representative including a cannabinoid with the UDP co-factor of the UDP-glucose substrate.

One embodiment of the present invention relates generally to the identification novel UDP-glucosyltransferases (UDP-UGTs or UGTs) enzymes having glycosylation activity towards one or more cannabinoid compounds. In one preferred embodiment, the present invention includes the identification of novel UGTs according to the amino acid sequences identified as SEQ ID NOs. 1-9181, and UGTs having 90% sequence identity with SEQ ID NOs. 1-9181, that have glycosylation activity towards one or more cannabinoid compounds, and preferably THC and CBD.

One embodiment of the present invention further relates generally to the use of novel UGT enzymes having specific activity towards one or more cannabinoid compounds to generate water-soluble cannabinoid glycoside compounds in in vitro, ex vivo, and in vivo systems. In one preferred embodiment, the present invention use of novel UGT enzymes according to the amino acid sequences identified as SEQ ID NOs. 1-9181, and UGTs having 90% sequence identity with SEQ ID NOs. 1-9181, that have glycosylation activity towards one or more cannabinoid compounds, and preferably THC and CBD, in in vitro, ex vivo, and in vivo systems. In one preferred embodiment of the invention, an in vivo system may include a whole organism system, such as a plant, or cell culture, such as a plant cell culture, an algal cell culture, a fungi cell culture, or a microorganism cell culture, such as a bacterial or yeast cell culture.

One embodiment of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as SEQ ID NOs. 1-9181, and UGTs having 90% sequence identity with SEQ ID NOs. 1-9181, that have glycosylation activity towards one or more cannabinoid compounds, in in vitro, ex vivo, and in vivo systems. In one preferred embodiment of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other embodiments, an in vitro system may include chemical conversion of cannabinoids into water-soluble cannabinoid glycoside compounds.

Yet, another embodiment of the current inventive technology may include the generation of genetically modified organisms configured to produce water-soluble cannabinoid glycoside compounds. In one preferred embodiment, a plant, a plant cell, an algal cell, a fungi, a bacteria, or a yeast cell, may be genetically modified to express a nucleotide sequence encoding one or more UGTs that have glycosylation activity towards one or more cannabinoid compounds, and preferably a UGT selected from the group of nucleotide sequences consisting of: a nucleotide sequence encoding an amino acid sequence according to SEQ ID NOs. 1-9181, and a nucleotide sequence encoding an amino acid sequence having 90% sequence identity with SEQ ID NOs. 1-9181.

Another embodiment of the current inventive technology includes the isolated amino acid sequences encoding one or more UGTs that have glycosylation activity towards one or more cannabinoid compounds according to SEQ ID NOs. 1-9181, and amino acid sequence having 90% sequence identity with SEQ ID NOs. 1-9181.

Another embodiment of the current inventive technology includes a nucleotide sequence encoding one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181.

Another embodiment of the current inventive technology includes an expression vector having a nucleotide sequence encoding one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181, operably linked to a promoter.

Another embodiment of the current inventive technology includes one or more organisms, such as a plant, plant cell, bacteria, algae, fungi, or yeast cell, transformed by an expression vector having a nucleotide sequence encoding one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181, operably linked to a promoter.

One embodiment of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the Gram+of class of UGTs may include the following structural groups: 5tzk (SEQ ID NOs. 1-1182), 3bcv (SEQ ID NOs. 1183-1222), 5hea (SEQ ID NOs. 1223-1805), 6h21 (SEQ ID NOs. 1806-1825), and UGTs having 90% sequence identity with SEQ ID NOs. 1-1825, that have glycosylation activity towards one or more cannabinoid compounds. In one preferred embodiment of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other embodiments, an in vitro system may include chemical conversion of cannabinoids into water-soluble cannabinoid glycoside compounds.

In another embodiment, one or more of cannabinoid glycoside compounds identified as: 10B, 10C, 10D, 11A, 11B, 11C, 11D, 11E and 11F, may be generated through the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the Gram+of class of UGTs may include the following structural groups: 5tzk (SEQ ID NOs. 1-1182), 3bcv (SEQ ID NOs. 1183-1222), 5hea (SEQ ID NOs. 1223-1805), 6h21 (SEQ ID NOs. 1806-1825), and UGTs having 90% sequence identity with SEQ ID NOs. 1-1825, that have glycosylation activity towards one or more cannabinoid compounds.

Yet, another embodiment of the current inventive technology may include the generation of genetically modified organisms configured to produce water-soluble cannabinoid glycoside compounds. In one preferred embodiment, a plant, a plant cell, an algal cell, a fungi, a bacteria, or a yeast cell, may be genetically modified to express a nucleotide sequence encoding one or more Gram+class of UGTs that have glycosylation activity towards one or more cannabinoid compounds, and preferably a UGT selected from the group of nucleotide sequences consisting of: a nucleotide sequence encoding an amino acid sequence according to SEQ ID NOs. 1-1825, and a nucleotide sequence encoding an amino acid sequence having 90% sequence identity with SEQ ID NOs. 1-1825.

Another embodiment of the current inventive technology includes the isolated amino acid sequences encoding one or more Gram+class of UGTs that have glycosylation activity towards one or more cannabinoid compounds according to SEQ ID NOs. 1-1825, and amino acid sequence having 90% sequence identity with SEQ ID NOs. 1-1825.

Another embodiment of the current inventive technology includes a nucleotide sequence encoding one or more Gram+class of UGTs that have glycosylation activity towards one or more cannabinoid compounds according to SEQ ID NOs. 1-1825, and a nucleotide sequence encoding an amino acid sequence having 90% sequence identity with SEQ ID NOs. 1-1825.

Another embodiment of the current inventive technology includes an expression vector having a nucleotide sequence encoding one or more Gram+class of UGTs that have glycosylation activity towards one or more cannabinoid compounds according to SEQ ID NOs. 1-9181, and a nucleotide sequence encoding an amino acid sequence having 90% sequence identity with SEQ ID NOs. 1-1825, operably linked to a promoter.

Another embodiment of the current inventive technology includes one or more organisms, such as a plant, plant cell, bacteria, algae, fungi, or yeast cell, transformed by an expression vector having a nucleotide sequence encoding one or more Gram+class of UGTs that have glycosylation activity towards one or more cannabinoid compounds according to SEQ ID NOs. 1-1825, and a nucleotide sequence encoding an amino acid sequence having 90% sequence identity with SEQ ID NOs. 1-1825, operably linked to a promoter.

One embodiment of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as belonging to the GT-A of class of UGTs as described herein, in an in vitro, ex vivo, and in vivo systems. In this preferred embodiment, the GT-A of class of UGTs may include the following structural groups: 1g9r (SEQ ID NOs. 1826-1828), 2286 (SEQ ID NOs. 1829-1985), 3ckj (SEQ ID NOs. 1986-2453), 3e25 (SEQ ID NOs. 2454-3126), 3fly (SEQ ID NOs. 3127-3430), 4dec (SEQ ID NOs. 3431-3481), 5mlz (SEQ ID NOs. 3482-3639), 5nv4 (SEQ ID NOs. 3640-3693), 6fsn (SEQ ID NOs. 3694-4699), 6p61 (SEQ ID NOs. 4700-5259) and UGTs having 90% sequence identity with SEQ ID NOs. 1826-5259, that have glycosylation activity towards one or more cannabinoid compounds.

In one preferred embodiment of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other embodiments, an in vitro system may include chemical conversion of cannabinoids into water-soluble cannabinoid glycoside compounds.

In another embodiment, one or more of cannabinoid glycoside compounds identified as: 10B, 10C, 10D, 11A, 11B, 11C, 11D, 11E and 11F, may be generated through the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the GT-A of class of UGTs may include the following structural groups: 1g9r (SEQ ID NOs. 1826-1828), 2286 (SEQ ID NOs. 1829-1985), 3ckj (SEQ ID NOs. 1986-2453), 3e25 (SEQ ID NOs. 2454-3126), 3fly (SEQ ID NOs. 3127-3430), 4dec (SEQ ID NOs. 3431-3481), 5mlz (SEQ ID NOs. 3482-3639), 5nv4 (SEQ ID NOs. 3640-3693), 6fsn (SEQ ID NOs. 3694-4699), 6p61 (SEQ ID NOs. 4700-5259) and UGTs having 90% sequence identity with SEQ ID NOs. 1826-5259, that have glycosylation activity towards one or more cannabinoid compounds.

Yet, another embodiment of the current inventive technology may include the generation of genetically modified organisms configured to produce water-soluble cannabinoid glycoside compounds. In one preferred embodiment, a plant, a plant cell, an algal cell, a fungi, a bacteria, or a yeast cell, may be genetically modified to express a nucleotide sequence encoding one or more GT-A class of UGTs that have glycosylation activity towards one or more cannabinoid compounds, and preferably a UGT selected from the group of nucleotide sequences consisting of: a nucleotide sequence encoding an amino acid sequence according to SEQ ID NOs. 1826-5259, and a nucleotide sequence encoding an amino acid sequence having 90% sequence identity with SEQ ID NOs. 1826-5259.

Another embodiment of the current inventive technology includes the isolated amino acid sequences encoding one or more GT-A class of UGTs that have glycosylation activity towards one or more cannabinoid compounds according to SEQ ID NOs. 1826-5259, and amino acid sequence having 90% sequence identity with SEQ ID NOs. 1826-5259.

Another embodiment of the current inventive technology includes a nucleotide sequence encoding one or more GT-A class of UGTs that have glycosylation activity towards one or more cannabinoid compounds according to SEQ ID NOs. 1826-5259, and a nucleotide sequence encoding an amino acid sequence having 90% sequence identity with SEQ ID NOs. 1826-5259.

Another embodiment of the current inventive technology includes an expression vector having a nucleotide sequence encoding one or more GT-A class of UGTs that have glycosylation activity towards one or more cannabinoid compounds according to SEQ ID NOs. 1826-5259, and a nucleotide sequence encoding an amino acid sequence having 90% sequence identity with SEQ ID NOs. 1826-5259, operably linked to a promoter.

Another embodiment of the current inventive technology includes one or more organisms, such as a plant, plant cell, bacteria, algae, fungi, or yeast cell, transformed by an expression vector having a nucleotide sequence encoding one or more GT-A class of UGTs that have glycosylation activity towards one or more cannabinoid compounds according to SEQ ID NOs. 1826-5259, and a nucleotide sequence encoding an amino acid sequence having 90% sequence identity with SEQ ID NOs. 1826-5259, operably linked to a promoter.

One embodiment of the present invention further relates generally to novel methods of generating water-soluble cannabinoid glycoside compounds, and preferably THC-glycosides and CBD-glycosides, comprising the step of introducing one or more cannabinoids to a UGT enzyme having specific activity towards one or more cannabinoid compounds according to the amino acid sequences identified as belonging to the GT-B of class of UGTs as described herein, in an in vitro, ex vivo, and in vivo systems. In this preferred embodiment, the GT-B of class of UGTs may include the following structural groups: 2acv (SEQ ID NOs. 5260-6290), 2iya (SEQ ID NOs. 6290-6953), 3hbf (SEQ ID NOs. 6954-7484), 5g15 (SEQ ID NOs. 7485-7998), 3c48 (SEQ ID NOs. 7999-8243), 5nlm (SEQ ID NOs. 8244-8486), 5du2 (SEQ ID NOs. 8487-8612), 2clx (SEQ ID NOS. 8613-8688), 5zfk (SEQ ID NOs. 8689-8758), 4rel (SEQ ID NOs. 8759-8816), 3otg (SEQ ID NOs. 8817-8873), 5v2j (SEQ ID NOs. 8874-8921), 2r60 (SEQ ID NOs. 8922-8965), 4amg (SEQ ID NOs. 8966-9007), 4n9w (SEQ ID NOs. 9008-9046), 2pq6 (SEQ ID NOs. 9047-9082), 4wyi (SEQ ID NOs. 9083-9111), 6bk0 (SEQ ID NOs. 9112-9133), 6inf (SEQ ID NOs. 9134-9149), 3ia7 (SEQ ID NOs. 9150-9158), 5d01 (SEQ ID NOs. 9159-9165), 6ij9 (SEQ ID NOs. 9166-9170), 6d9t (SEQ ID NOs. 9171-9175), 2jjm (SEQ ID NOs. 9176-9180), 3mbo (SEQ ID NO. 9181) and UGTs having 90% sequence identity with SEQ ID NOs. 5260-9181, that have glycosylation activity towards one or more cannabinoid compounds. In one preferred embodiment of the invention, an in vivo system may include a whole organism system, such as a plant, or cell culture, such as a plant cell culture, an algal cell culture, a fungi cell culture, or a microorganism cell culture, such as a bacterial or yeast cell culture. In other embodiments, an ex vivo system may include a bioreactor system. In other embodiments, an in vitro system may include chemical conversion of cannabinoids into water-soluble cannabinoid glycoside compounds.

In another embodiment, one or more of cannabinoid glycoside compounds identified as: 10B, 10C, 10D, 11A, 11B, 11C, 11D, 11E and 11F, may be generated through the step of introducing one or more cannabinoids to a UGT enzyme having specific activity towards one or more cannabinoid compounds according to the amino acid sequences identified as belonging to the Gram+of class of UGTs as described herein, in an in vitro, ex vivo, and in vivo systems. In this preferred embodiment, the GT-B of class of UGTs may include the following structural groups: 2acv (SEQ ID NOs. 5260-6290), 2iya (SEQ ID NOs. 6290-6953), 3hbf (SEQ ID NOs. 6954-7484), 5g15 (SEQ ID NOs. 7485-7998), 3c48 (SEQ ID NOs. 7999-8243), 5nlm (SEQ ID NOs. 8244-8486), 5du2 (SEQ ID NOs. 8487-8612), 2clx (SEQ ID NOs. 8613-8688), 5zfk (SEQ ID NOs. 8689-8758), 4rcl (SEQ ID NOs. 8759-8816), 3otg (SEQ ID NOs. 8817-8873), 5v2j (SEQ ID NOs. 8874-8921), 2r60 (SEQ ID NOs. 8922-8965), 4amg (SEQ ID NOs. 8966-9007), 4n9w (SEQ ID NOs. 9008-9046), 2pq6 (SEQ ID NOs. 9047-9082), 4wyi (SEQ ID NOs. 9083-9111), 6bk0 (SEQ ID NOs. 9112-9133), 6inf (SEQ ID NOs. 9134-9149), 3ia7 (SEQ ID NOs. 9150-9158), 5d01 (SEQ ID NOs. 9159-9165), 6ij9 (SEQ ID NOs. 9166-9170), 6d9t (SEQ ID NOs. 9171-9175), 2jjm (SEQ ID NOs. 9176-9180), 3mbo (SEQ ID NO. 9181) and UGTs having 90% sequence identity with SEQ ID NOs. 5260-9181, that have glycosylation activity towards one or more cannabinoid compounds.

Yet, another embodiment of the current inventive technology may include the generation of genetically modified organisms configured to produce water-soluble cannabinoid glycoside compounds. In one preferred embodiment, a plant, a plant cell, an algal cell, a fungi, a bacteria, or a yeast cell, may be genetically modified to express a nucleotide sequence encoding one or more GT-B class of UGTs that have glycosylation activity towards one or more cannabinoid compounds, and preferably a GT-B class of UGT selected from the group of nucleotide sequences consisting of: a nucleotide sequence encoding an amino acid sequence according to SEQ ID NOs. 5260-9181, and a nucleotide sequence encoding an amino acid sequence having 90% sequence identity with SEQ ID NOs. 1-9181.

Another embodiment of the current inventive technology includes the isolated amino acid sequences encoding one or more GT-B class of UGTs that have glycosylation activity towards one or more cannabinoid compounds according to SEQ ID NOs. 5260-9181, and amino acid sequence having 90% sequence identity with SEQ ID NOs. 5260-9181.

Another embodiment of the current inventive technology includes a nucleotide sequence encoding one or more GT-B class of UGTs that have glycosylation activity towards one or more cannabinoid compounds according to SEQ ID NOs. 5260-9181, and a nucleotide sequence encoding an amino acid sequence having 90% sequence identity with SEQ ID NOs. 5260-9181.

Another embodiment of the current inventive technology includes an expression vector having a nucleotide sequence encoding one or more GT-B class of UGTs that have glycosylation activity towards one or more cannabinoid compounds according to SEQ ID NOs. 1-9181, and a nucleotide sequence encoding an amino acid sequence having 90% sequence identity with SEQ ID NOs. 5260-9181, operably linked to a promoter.

Another embodiment of the current inventive technology includes one or more organisms, such as a plant, plant cell, bacteria, algae, fungi, or yeast cell, transformed by an expression vector having a nucleotide sequence encoding one or more GT-B class of UGTs that have glycosylation activity towards one or more cannabinoid compounds according to SEQ ID NOs. 5260-9181, and a nucleotide sequence encoding an amino acid sequence having 90% sequence identity with SEQ ID NOs. 5260-9181, operably linked to a promoter.

One embodiment of the current inventive technology includes improved systems and methods for the bioconversion of cannabinoid compounds into water-soluble cannabinoid glycosides, or water-soluble acetyl cannabinoid glycosides in a bacterial, yeast, or plant cell culture system. In another preferred embodiment, a preferred plant cell culture system may include a *Cannabis* suspension cell culture, or a tobacco plant cell culture.

Another embodiment of the current inventive technology includes one or more consumer products, or pharmaceutical preparations having at least one cannabinoid glycoside generated in an in vitro, ex vivo, or in vivo system by the action of one or more UGTs that have glycosylation activity towards one or more cannabinoid compounds according to SEQ ID NOs. 1-9181, and a nucleotide sequence encoding an amino acid sequence having 90% sequence identity with SEQ ID NOs. 1-9181.

In one embodiment, the invention novel systems, methods and compositions for the production of water-soluble cannabinoid glycosides in plant cells. In one preferred embodiment, a plant, such as *Cannabis* or tobacco plant or cell, may be genetically modified to express one or more heterologous UGTs, preferably a UGT selected from the group consisting of SEQ ID NO. 1-9181).

In another embodiment, the invention novel systems, methods and compositions for the production of water-soluble cannabinoid glycosides in yeast or bacteria cells. In one preferred embodiment, a plant, such as yeast or bacterial cell, may be genetically modified to express one or more heterologous UGTs, preferably a UGT selected from the group consisting of SEQ ID NO. 1-9181). In one preferred embodiment, a culture of yeast cells, such as *Saccharomyces cerevisiae, Kluyveromyces marxianus*, or *Pichia pastoris* or other suitable yeast species, may be established in a fermenter or other similar apparatus. It should be noted that the use of the above identified example in this embodiment is exemplary only, as various yeast strains, mixes of strains, hybrids of different strains or clones may be used to generate a suspension culture. In certain cases, such fermenters may include large industrial-scale fermenters allowing for a large quantity of yeast cells to be grown. In this embodiment, it may be possible to culture a large quantity of cells from a single-strain of, for example, *S. cerevisiae, P. pastoris*, or *K. marxianus*, which may establish a cell culture having a consistent rate of cannabinoid modification. Such cultured growth may be continuously sustained with the continual addition of nutrient and other growth factors being added to the culture. Such features may be automated or accomplished manually.

As noted above, cannabinoid producing strains of *Cannabis*, such as *Cannabis sativa* or hemp, as well as other plants may be utilized with the inventive technology. In certain preferred embodiments, *Cannabis* plant material may be harvested and undergo cannabinoid extraction through one or more of the methods generally known in the art. These extracted cannabinoids may be introduced into a genetically modified yeast suspension cell culture to be further modified, in some embodiment to express one or more heterologous UGTs having glycosylation activity directed towards one or more cannabinoids such as CBD or THC and the like.

As noted above, accumulation of high-levels of cannabinoids may be toxic for the yeast cell. As such, the inventive technology may modify the cannabinoids produced in a cell culture in vivo. In one preferred embodiment, cytochrome P450's (CYP) monooxygenases may be utilized to functionalize the chemical structure of the cannabinoids to more efficiently produce water-soluble cannabinoid glycosides. CYPs constitute a major enzyme family capable of catalyzing the oxidative biotransformation of many pharmacologically active chemical compounds and other lipophilic xenobiotics. For example, the most common reaction catalyzed by cytochromes P450 is a monooxygenase reaction, e.g., insertion of one atom of oxygen into the aliphatic position of an organic substrate (RH) while the other oxygen atom is reduced to water:

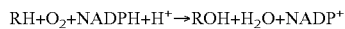

$RH+O_2+NADPH+H^+ \rightarrow ROH+H_2O+NADP^+$

Several cannabinoids, including THC, have been shown to serve as a substrate for human CYPs (CYP2C9 and CYP3A4). Similarly, CYPs have been identified that metabolize cannabidiol (CYPs 2C19, 3A4); cannabinol (CYPs 2C9, 3A4); JWH-018 (CYPs 1A2, 2C9); and AM2201 (CYPs 1A2, 2C9). For example, as shown generally below, in one exemplary system, CYP2C9 may hydroxylate a THC molecule resulting in a hydroxyl form of THC. Further oxidation of the hydroxyl form of THC by CYP2C9 may convert it into a carboxylic acid form, which loses its psychoactive capabilities rendering it an inactive metabolite.

In one embodiment, a cell, and preferably a yeast cell may be transformed with a nucleotide sequence operably linked to a promoter encoding one or more heterologous CYPs. In one preferred embodiment, genes encoding one or more non-human isoforms and/or analogs, as well as possibly other CYPs that may functionalize cannabinoids may be expressed in transgenic yeast grown in a culture. In this preferred embodiment, NADPH-cytochrome P450 oxidoreductase (CPR) may be used to assist in the activity/function of one or more of the CYPs expressed within a genetically modified cell, and preferably a yeast cell. In this embodiment, CPR may serve as an electron donor to eukaryotic CYPs facilitating their enzymatic function within the transgenic yeast strain(s) described above. In one preferred embodiment, genes encoding a heterologous CPR, or one or more non-human isoforms and/or analogs of CPR that may act as an electron donor to CYPs may be expressed in transgenic yeast grown in a suspension culture.

Additional steps may be taken to further convert the functionalized cannabinoids into water-soluble cannabinoid glycosides. In an exemplary embodiment shown below, the inventive technology may utilize one or more UGT to catalyze the UGT to catalyze the transfer of the glucuronic acid component of UDP-glucuronic acid to a small hydrophobic molecule such as a cannabinoid.

In one preferred embodiment, the inventive technology may include the generation of transgenic yeast strains having artificial genetic constructs that that may express one or more UGT, or other enzymes capable converting hydrophobic and insoluble cannabinoids into water-soluble cannabinoid glycosides. In one preferred embodiment, artificial genetic constructs having genes encoding one or more UDP-UGTs, including non-human analogues of those described above, as well as other isoforms, may be expressed in transgenic yeast cells and grown in suspension or other cell cultures. In this embodiment, one or more cannabinoids may be added to the yeast cell culture where they are introduced to the heterologous expressed UGTs, for example one of SEQ ID NO. 1-918, such that the cannabinoid compound is glycosylated and converted into a water-soluble cannabinoid glycoside. This water-soluble cannabinoid glycoside may preferably be a THC-glycoside or a CBD glycoside, or even a THCA-glycoside or a CBDA-glycoside.

The water-soluble cannabinoids may be extracted from the cell cultures supernatant/media, or from the cells. In this preferred embodiment, a transformed yeast cells may be lysed such that accumulated cannabinoid glycosides are released to the surrounding lysate. Additional steps may include treating this lysate. Examples of such treatment may include filtering, centrifugation or screening to remove extraneous cellular material as well as chemical treatments to improve later cannabinoid glycoside yields.

The cannabinoid glycosides may be further isolated and purified. In one preferred embodiment, the culture's supernatant/media, or the cell's lysate may be processed utilizing affinity chromatography or other purification methods. In this preferred embodiment, an affinity column having a ligand configured to bind with one or more of the cannabinoid glycosides, for example, through association with the glucuronic acid functional group, among others, may be immobilized or coupled to a solid support. The material may then be passed over the column such that the cannabinoid glycosides, having specific binding affinity to the ligand become bound and immobilized. In some embodiments, non-binding and non-specific binding proteins that may have been present in the lysate may be removed. Finally, the cannabinoid glycosides may be eluted or displaced from the affinity column by, for example, a corresponding sugar or other compound that may displace or disrupt the cannabinoid-ligand bond. The eluted cannabinoid glycosides may be collected and further purified or processed.

In yet another separate embodiment, the water-soluble cannabinoid glycosides may be passively and/or actively excreted from a cell, and preferably a yeast cell. In one exemplary model, an ATP-binding cassette transporter (ABC transporters) or other similar molecular structure may recognize the glucuronic acid functional group (conjugate) on the transiently modified cannabinoid and actively transport it into the surrounding media. (Examples and sequences for ABC transporters are generally described in Sayre et al. PCT/US18/24409 and PCT/US18/41710, such examples and sequences being incorporated herein by reference). In this embodiment, a yeast cell culture may be allowed to grow until an output parameter is reached. In one example, an output parameter may include allowing the yeast cell culture to grow until a desired cell/optical density is reached, or a desired level of cannabinoid glycosides is reached. In this embodiment, the culture media containing the cannabinoid glycosides may be harvested for later cannabinoid extraction. In some embodiments, this harvested media may be treated in a manner similar to the lysate generally described above. Additionally, the transiently modified cannabinoids present in the raw and/or treated media may be isolated and purified, for example, through affinity chromatography in a manner similar to that described above.

The inventive technology may also include a system to convert or reconstitute cannabinoid glycosides. In one preferred embodiment, glycosylated cannabinoids may be converted into non-glycosylated cannabinoids through their treatment with one or more generalized or specific glycosidases. In this embodiment, these glycosidase enzymes may remove a sugar moiety. Specifically, these glycosidases may remove the glucuronic acid moiety reconstituting the cannabinoid compound to a form exhibiting psychoactive activity. This reconstitution process may generate a highly purified "entourage" of primary and secondary cannabinoids. These reconstituted cannabinoid compounds may also be incorporated into various solid and/or liquid compositions for use in a variety of pharmaceutical and other commercial applications.

Another aspect of the current invention may include systems, methods and compositions for the glycosylation in whole cannabinoid-producing plants and cell cultures, preferably *Cannabis*. In this embodiment, such *Cannabis* plants or cell cultures may be genetically modified to direct cannabinoid synthesis to the cytosol, as opposed to a trichome structure as described in PCT/US18/24409 and PCT/US18/41710, by Sayre et al., being incorporated herein by reference directed to such production localization in a *Cannabis* plant or plant cell. Such *Cannabis* plant or cell culture may be genetically modified to express one or more heterologous UGTs having glycosylation activity towards at least one cannabinoid, for example SEQ ID NOs. 1-9181. In additional embodiments, a plant or cell may be further genetically modified to express one or more heterologous UGTs, wherein in said polynucleotides encoding such UGTs may be codon-optimized for expression in an exogenous system, such as in yeast. In additional embodiments, a heterologous or exogenous, the terms being generally interchangeable, cytochrome P450 and/or a P450 oxidoreductase may be expressed. In this configuration a heterologous cytochrome P450 (for example as described in PCT/US18/24409 and PCT/US18/41710, by Sayre et al., such sequences being incorporated herein by reference) may hydroxylate a cannabinoid to form a hydroxylated cannabinoid and/or oxidizes a hydroxylated cannabinoid to form a cannabinoid carboxylic acid. Further, in this embodiment, a heterologous P450 oxidoreductase may facilitate electron transfer from a nicotinamide adenine dinucleotide phosphate (NADPH) to said cytochrome P450.

As noted above, a heterologous UGT may glycosylate a cannabinoid compound and thereby produce a water-soluble cannabinoid glycoside that may be reconstituted to its original forms through the action of a glycosidase that may remove the sugar moiety.

Another aspect of the current invention may include systems, methods and compositions for the glycosylation of cannabinoid compounds in a cell cultures, preferably a microorganism cell culture, preferably yeast, bacteria, fungi or algal cell culture. In one embodiment, a yeast culture may be genetically modified to biosynthesize one or more cannabinoids. The yeast cell culture may be further genetically modified to express one or more heterologous UGTs having glycosylation activity towards at least one cannabinoid, for example SEQ ID NOs. 1-9181, as well as in some embodiments, a heterologous cytochrome P450 and/or a P450 oxidoreductase.

Another aspect of the current invention may include systems, methods and compositions for the coupled glycosylation cannabinoid compounds in a cell cultures, preferably yeast, bacteria, fungi or algal cell culture. In one embodiment, a yeast culture may be genetically modified to express one or more heterologous UGTs, for example SEQ ID NOs. 1-9181, having glycosylation activity towards at least one cannabinoid, as well as in some embodiments, a heterologous cytochrome P450 and/or a P450 oxidoreductase. As noted above, in one preferred embodiment, a quantity of cannabinoids may be added to the cell culture, and preferably a yeast cell culture, where heterologous UGTs may glycosylate the cannabinoid forming a water-soluble cannabinoid glycoside. This cannabinoid glycoside may be released from the carrier may be further isolated or reconstituted to their original forms through the action of a glycosidase.

Another embodiment of the current invention may include systems, methods and compositions for the generation of water soluble cannabinoid glycoside compounds in whole plants and plant cell cultures.

In this preferred embodiment, this N-terminal trichome targeting sequence or domain may generally include the first 28 amino acid residues of a generalized synthase and may be coupled with a UGT, and preferably a UGT selected from the group consisting of SEQ ID NO. 1-9181. Exemplary N-terminal trichome targeting sequence for THCA synthase and CBDA synthase are identified by Sayre et al., PCT/US18/41710, such sequences being specifically incorporated here by reference. This extracellular targeting sequence may be recognized by the plant cell and cause the transport of the UGT from the cytoplasm to the plant's trichome, and in particular the storage compartment of the plant trichome where extracellular cannabinoid glycosylation may occur. More specifically, in this preferred embodiment, one or more UGT, and preferably a UGT selected from the group consisting of SEQ ID NO. 1-9181, may either be engineered to express all or part of the N-terminal extracellular targeting sequence as present in an exemplary synthase enzyme.

Generally, a trichome structure, such as in *Cannabis*, will have limited substrate for a UGT to use to effectuate glycosylation. To resolve this problem, in one embodiment, the invention may include systems, methods and compositions to increase substrates for UGTs in a plant trichome structure. In this preferred embodiment, an exogenous or endogenous UDP-glucose/UDP-galactose transporter may be expressed in a trichome producing plant, such as *Cannabis* plant. exemplary sequences being identified by Sayre et al., PCT/US18/41710, such sequences being specifically incorporated here by reference. In this embodiment, the UDP-glucose/UDP-galactose transporter may be modified to include a plasma-membrane targeting sequence and/or domain, exemplary sequences being identified by Sayre et al., PCT/US18/41710, such sequences being specifically incorporated here by reference. With this targeting domain, the UDP-glucose/UDP-galactose transporter may allow the artificial fusion protein to be anchored to the plasma membrane. In this configuration, sugar substrates from the cytosol may pass through the plasma membrane bound UDP-glucose/UDP-galactose transporter into the trichome. In this embodiment, substrates for UGTs may be localized to the trichome and allowed to accumulate further allowing enhanced glycosylation of cannabinoids in the trichome.

In additional embodiments, such plants or cell cultures may be genetically modified to direct cannabinoid synthesis to the cytosol, as opposed to a trichome structure. In one preferred embodiment, cannabinoid biosynthesis may be redirected from the plant's trichome to be localized in the plant cell's cytosol. In certain embodiments, a cytosolic cannabinoid production system may be established as described in PCT/US18/24409 and PCT/US18/41710, both by Sayre et al. (these applications are both incorporated by reference with respect to their disclosure related to cytosolic cannabinoid production and/or modification in whole, and plant cell systems). In one embodiment, a cytosolic cannabinoid production system may include the in vivo creation of one or more recombinant proteins that may allow cannabinoid biosynthesis to be localized to the cytosol where one or more heterologous UGT proteins may also be expressed and present in the cytosol. This inventive feature allows not only higher levels of cannabinoid production and accumulation, but efficient production of cannabinoids in suspension cell cultures. Even more importantly, this inventive feature allows cannabinoid glycoside production and accumulation without a trichome structure in whole plants, allowing cells that would not traditionally produce cannabinoids, such as cells in *Cannabis* leaves and stalks, to become cannabinoid-producing cells More specifically, in this preferred embodiment, one or more cannabinoid synthases may be modified to remove all or part of an N-terminal extracellular trichome targeting. Exemplary N-terminal trichome targeting sequence for THCA synthase and CBDA synthase are identified by Sayre et al., PCT/US18/41710. Co-expression with this cytosolic-targeted synthase with a heterologous UGT may allow the localization of cannabinoid synthesis to the cytosol. As noted below, in certain embodiments cannabinoid biosynthesis may be coupled with cannabinoid glycosylation in a cell cytosol. For example, in one preferred embodiment a UGT (for example SEQ ID NOs. 1-9181) may be expressed in a cell, preferably a cannabinoid producing cell, and even more preferably a *Cannabis* cell and be further engineered to be directed to the cell's cytosol. Such cytosolic targeted UGT enzymes may be co-expressed with heterologous catalase and cannabinoid transporters or other genes that may reduce cannabinoid biosynthesis toxicity and/or facilitate transport through or out of the cell. In certain embodiments, a catalase enzyme may be co-expressed with a UGT of the invention. In one embodiment a heterologous catalase is selected from the group of catalase sequences identified in PCT/US18/24409 and PCT/US18/41710, both by Sayre et al., such catalase sequences being incorporated herein by reference. Such cytosolic targeted enzymes may also be co-expressed with one or more myb transcriptions factors that may enhance metabolite flux through the cannabinoid biosynthetic pathway which may increase cannabinoid production. In one embodiment a myb transcription factor may be endogenous to *Cannabis*, or an ortholog thereof. Examples of endogenous or endogenous like, myb transcription factor may include those identified by Sayre et al., PCT/US18/41710, such specific sequences being incorporated herein by reference.

Notably, in a preferred embodiment, one or more endogenous cannabinoid synthase genes may be disrupted and/or knocked out and replaced with cytosolic-targeted cannabinoid synthase proteins as described herein. The disrupted endogenous cannabinoid synthase gene(s) may be the same or different than the expressed cytosolic-targeted cannabinoid synthase protein. Methods of disrupting or knocking-out a gene are known in the art and could be accomplished by one of ordinary skill without undue experimentation, for example through CRISPR, Talen, and zinc-finger exonuclease systems, as well as heterologous recombination techniques.

In another embodiment, one or more endogenous cannabinoid synthase genes may be disrupted and/or knocked out in a *Cannabis* plant or suspension cell culture wherein one or more cannabinoid synthase genes has been disrupted and/or knocked out is selected from the group consisting of: a CBG synthase gene; a THCA synthase, a CBDA synthase, and a CBCA synthase. In this embodiment, the *Cannabis* plant or suspension cell culture may express a polynucleotide encoding one or more cannabinoid synthases having its trichome targeting sequence disrupted and/or removed which may be selected from the group consisting of: a CBG synthase gene having its trichome targeting sequence disrupted and/or removed; a THCA synthase having its trichome targeting sequence disrupted and/or removed; a CBDA synthase having its trichome targeting sequence disrupted and/or removed; and a CBCA synthase having its trichome targeting sequence disrupted and/or removed.

Figure 10:
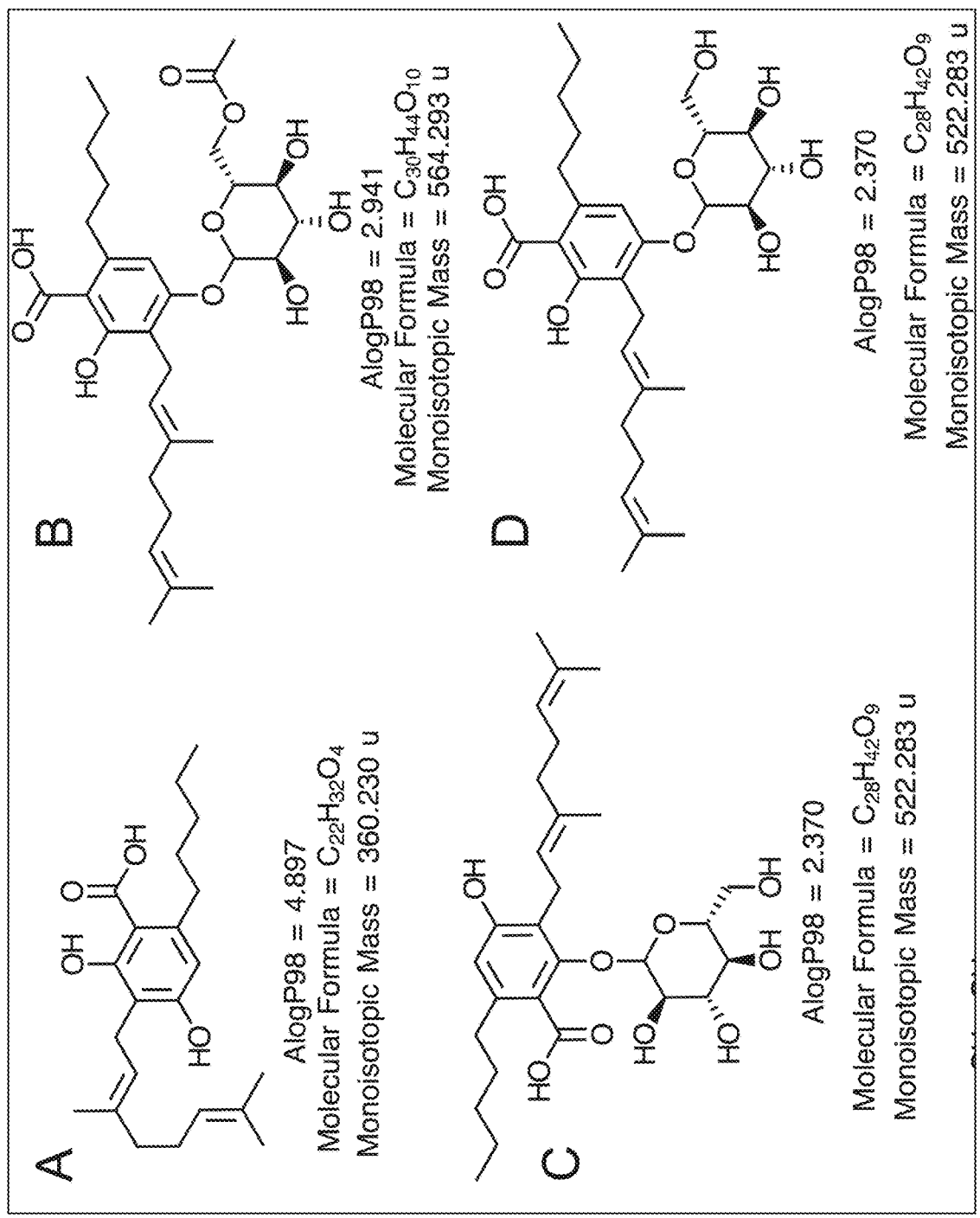
FIG. 10A-D. CBGA Glycoside Structures with Physiochemical and Constitutional Properties. A) CBGA, B) O Acetyl Glycoside, C) 1×Glycoside, D) 1×Glycoside FIG. 11A-F. CBDA Glycoside Structures with Physiochemical and Constitutional Properties. A) CBDA, B) 1×Glycoside, C) 2×Glycoside, D)O-Acetyl Glycoside, E) 1×Glycoside, F) 2×Glycoside, the disaccharide moiety can also be located on the opposite R—OH of CBDA as illustrated with the single glycoside product found in panels B & E.
Figure 11:
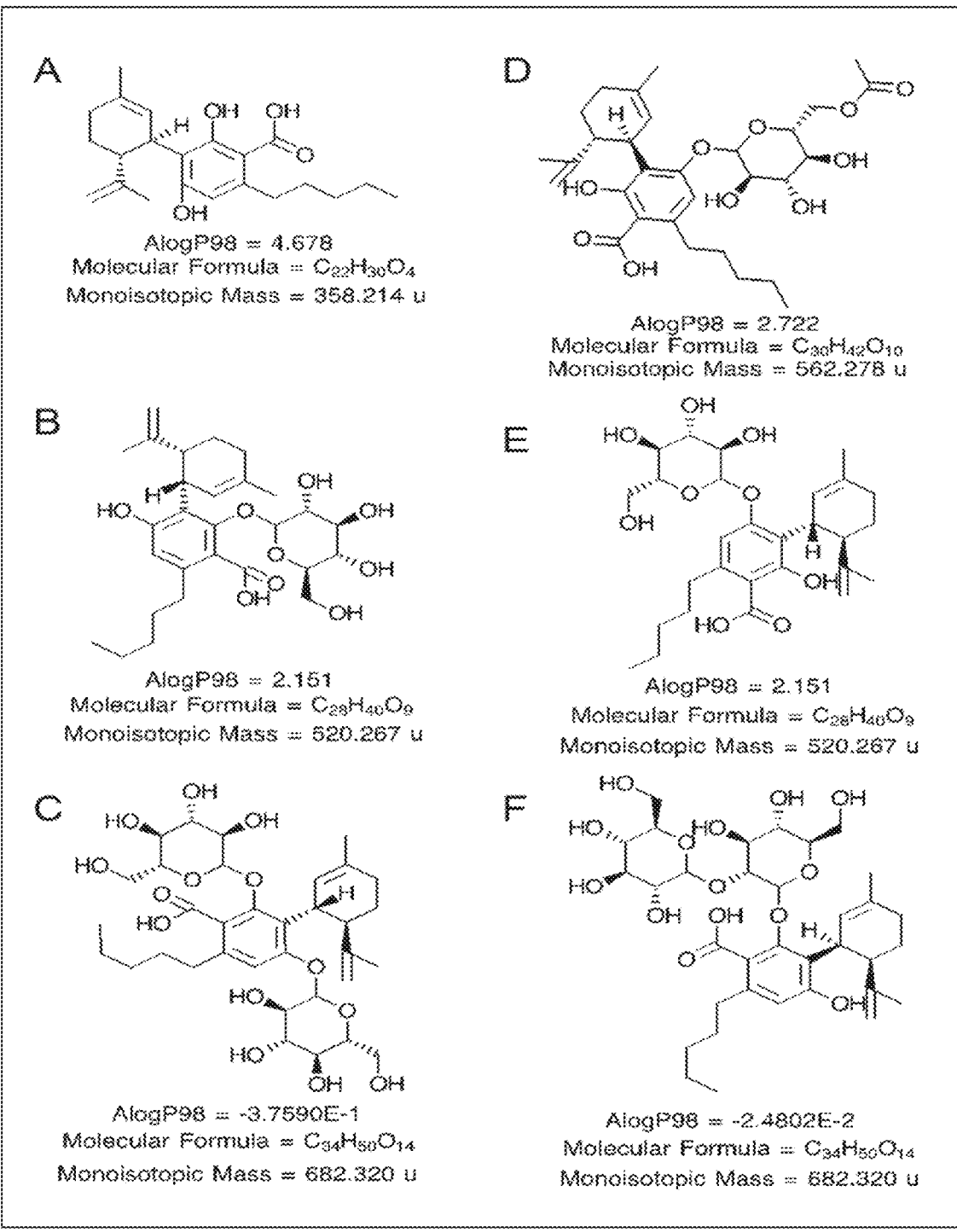
Figure 13:
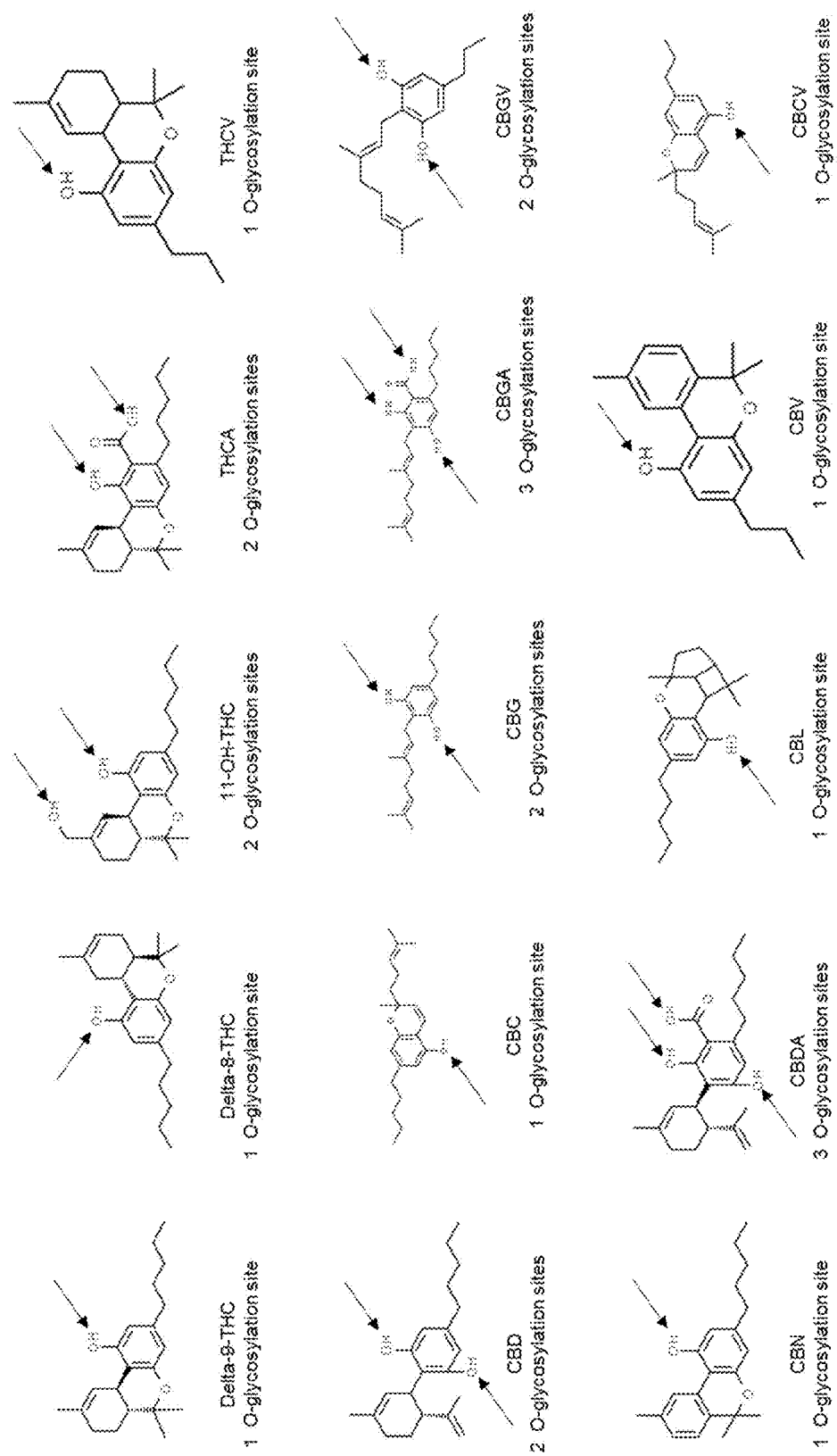
FIG. 13. Shows a representative number of cannabinoids having one or more identified glycosylation cites.
Figure 13:
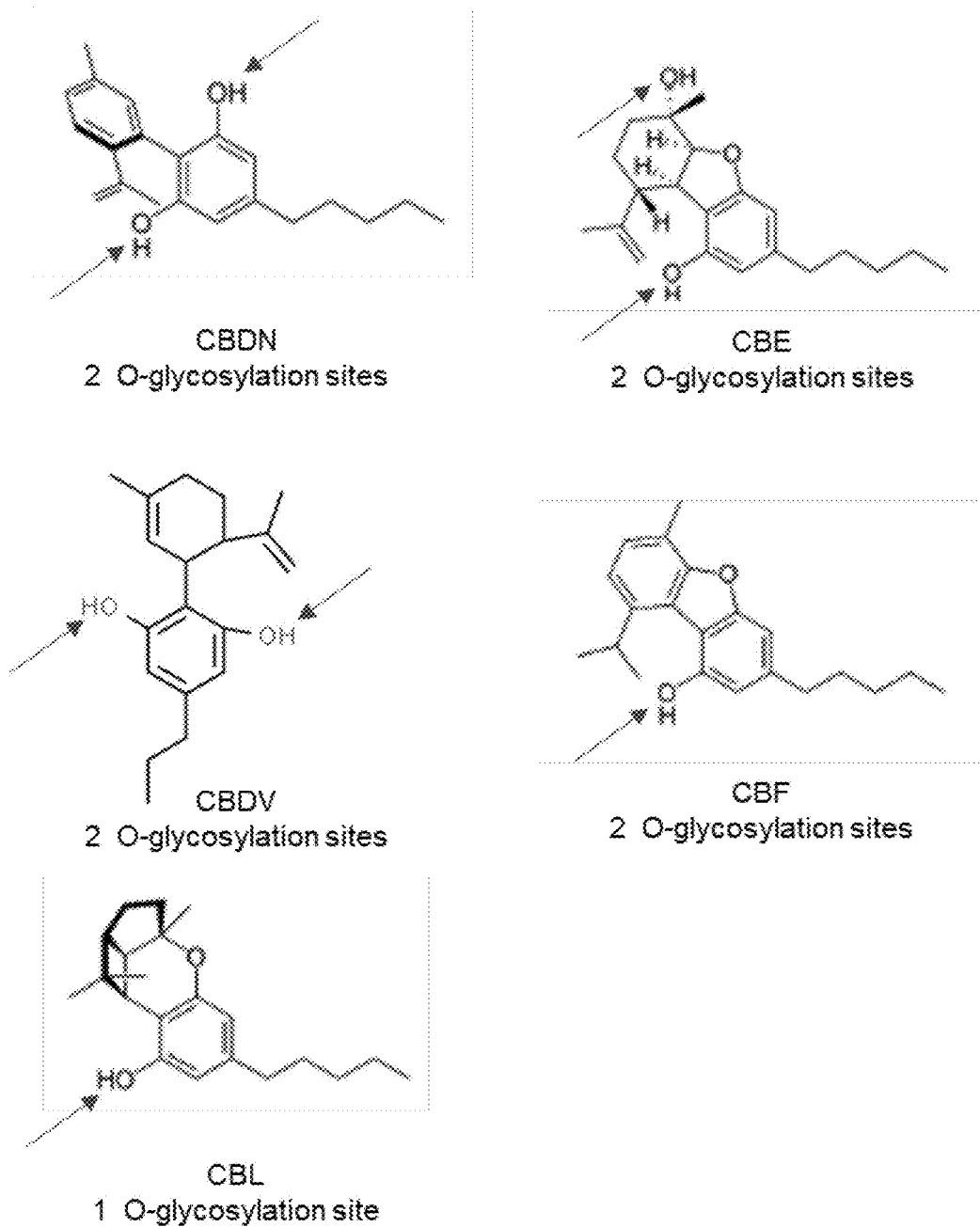

The inventive technology may further include novel cannabinoid compounds as well as their generation in vitro, in vivo, and in vivo. As demonstrated in FIGS. 10 and 11 respectively, the invention includes cannabinoid glycoside compounds identified as: 10B, 10C, 10D, 11A, 11B, 11C, 11D, 11E and 11F and/or a physiologically acceptable salt thereof. In this embodiment, one or more of cannabinoid glycoside compounds identified as: 10B, 10C, 10D, 11A, 11B, 11C, 11D, 11E and 11F, may be generated through the introduction of a UGT selected from the group consisting of the amino acid sequence according to SEQ ID NO. 9181.

In one preferred embodiment, the invention may include a pharmaceutical composition as active ingredient an effective amount or dose of one or more compounds identified as 10B, 10C, 10D, 11A, 11B, 11C, 11D, 11E and 11F and/or a physiologically acceptable salt thereof, wherein the active ingredient is provided together with pharmaceutically tolerable adjuvants and/or excipients in the pharmaceutical composition. Such pharmaceutical composition may optionally be in combination with one or more further active ingredients. In one embodiment, one of the aforementioned compositions may act as a prodrug. The term "prodrug" is taken to mean compounds according to the invention which have been modified by means of, for example, sugars and which are cleaved in the organism to form the effective compounds according to the invention. The terms "effective amount" or "effective dose" or "dose" are interchangeably used herein and denote an amount of the pharmaceutical compound having a prophylactically or therapeutically relevant effect on a disease or pathological conditions, i.e. which causes in a tissue, system, animal or human a biological or medical response which is sought or desired, for example, by a researcher or physician. Pharmaceutical formulations can be administered in the form of dosage units which comprise a predetermined amount of active ingredient per dosage unit. The concentration of the prophylactically or therapeutically active ingredient in the formulation may vary from about 0.1 to 100 wt %. Preferably, the compound of formula (I) or the pharmaceutically acceptable salts thereof are administered in doses of approximately 0.5 to 1000 mg, more preferably between 1 and 700 mg, most preferably 5 and 100 mg per dose unit. Generally, such a dose range is appropriate for total daily incorporation. In other terms, the daily dose is preferably between approximately 0.02 and 100 mg/kg of body weight. The specific dose for each patient depends, however, on a wide variety of factors as already described in the present specification (e.g. depending on the condition treated, the method of administration and the age, weight and condition of the patient). Preferred dosage unit formulations are those which comprise a daily dose or part-dose, as indicated above, or a corresponding fraction thereof of an active ingredient. Furthermore, pharmaceutical formulations of this type can be prepared using a process which is generally known in the pharmaceutical art.

In the meaning of the present invention, the compound is further defined to include pharmaceutically usable derivatives, solvates, prodrugs, tautomers, enantiomers, racemates and stereoisomers thereof, including mixtures thereof in all ratios.

It should be noted that in one embodiment, one or more UGTs may have an affinity for either of the hydroxy groups located at positions 2,4 on the pentylbenzoate/pentlybenzoic ring of a cannabinoid, compound, such a CBDA (2,4-dihydroxy-3-[(6R)-3-methyl-6-(prop-1-en-2-yl) cyclohex-2-en-1-yl]-6-pentylbenzoate) and/or CBGA ((E)-3-(3,7-Dimethyl-2,6-octadienyl)-2,4-dihydroxy-6-pentylbenzoic acid).

As noted above, present invention allows the scaled production of water-soluble cannabinoid glycosides, including acetylated cannabinoid glycosides, as well as acetylated cannabinoids through the introduction of a cannabinoids with a UGT having specific activity towards said cannabinoid, wherein said UGT is selected from the group consisting of: Gram+structural class of UGTs, GT-A structural class of UGTs, GT-B structural class of UGTs, and SEQ ID NO. 1-9181. Because of this enhanced solubility, the invention allows for the addition of such water-soluble cannabinoid to a variety of compositions without requiring oils and or emulsions that are generally required to maintain the non-modified cannabinoids in suspension. As a result, the present invention may all for the production of a variety of compositions for both the food and beverage industry, as well as pharmaceutical applications that do not required oils and emulsion suspensions and the like.

In one embodiment the invention may include aqueous compositions containing one or more water-soluble cannabinoids that may be introduced to a food or beverage. In a preferred embodiment, the invention may include an aqueous solution containing one or more dissolved water-soluble cannabinoids. In this embodiment, such water-soluble cannabinoid may include a glycosylated cannabinoid, and/or an acetylated cannabinoid, and/or a mixture of both. Here, the glycosylated cannabinoid, and/or said acetylated cannabinoid were generated in vivo as generally described herein, or in vitro. In additional embodiment, the water-soluble cannabinoid may be an isolated non-psychoactive, such as CBD and the like. Moreover, in this embodiment, the aqueous may contain one or more of the following: saline, purified water, propylene glycol, deionized water, and/or an alcohol such as ethanol as well as a pH buffer that may allow the aqueous solution to be maintained at a pH below 7.4. Additional embodiments may include the addition an acid of base, such as formic acid, or ammonium hydroxide.

In another embodiment, the invention may include a consumable food additive having at least one water-soluble cannabinoid, such as a glycosylated and/or an acetylated cannabinoid, and/or a mixture of both, where such water-soluble cannabinoids may be generated in vivo and/or in vitro. This consumable food additive may further include one or more a food additive polysaccharides, such as dextrin and/or maltodextrin, as well as an emulsifier. Example emulisifiers may include, but not be limited to: gum arabic, modified starch, pectin, xanthan gum, gum ghatti, gum tragacanth, fenugreek gum, mesquite gum, mono-glycerides and di-glycerides of long chain fatty acids, sucrose monoesters, sorbitan esters, polyethoxylated glycerols, stearic acid, palmitic acid, mono-glycerides, di-glycerides, propylene glycol esters, lecithin, lactylated mono- and di-glycerides, propylene glycol monoesters, polyglycerol esters, diacetylated tartaric acid esters of mono- and di-glycerides, citric acid esters of monoglycerides, stearoyl-2-lactylates, polysorbates, succinylated monoglycerides, acetylated monoglycerides, ethoxylated monoglycerides, *quillaia*, whey protein isolate, casein, soy protein, vegetable protein, pullulan, sodium alginate, guar gum, locust bean gum, tragacanth gum, tamarind gum, carrageenan, furcellaran, Gellan gum, *psyllium*, curdlan, konjac mannan, agar, and cellulose derivatives, or combinations thereof.

The consumable food additive of the invention may be a homogenous composition and may further comprising a flavoring agent. Exemplary flavoring agents may include: sucrose (sugar), glucose, fructose, sorbitol, mannitol, corn syrup, high fructose corn syrup, saccharin, aspartame, sucralose, acesulfame potassium (acesulfame-K), neotame. The consumable food additive of the invention may also contain one or more coloring agents. Exemplary coloring agents may include: FD&C Blue Nos. 1 and 2, FD&C Green No. 3, FD&C Red Nos. 3 and 40, FD&C Yellow Nos. 5 and 6, Orange B, Citrus Red No. 2, annatto extract, beta-carotene, grape skin extract, cochineal extract or carmine, paprika oleoresin, caramel color, fruit and vegetable juices, saffron, Monosodium glutamate (MSG), hydrolyzed soy protein, autolyzed yeast extract, disodium guanylate or inosinate.

The consumable food additive of the invention may also contain one or more surfactants, such as glycerol monostearate and polysorbate 80. The consumable food additive of the invention may also contain one or more preservatives. Exemplary preservatives may include ascorbic acid, citric acid, sodium benzoate, calcium propionate, sodium erythorbate, sodium nitrite, calcium sorbate, potassium sorbate, BHA, BHT, EDTA, tocopherols. The consumable food additive of the invention may also contain one or more nutrient supplements, such as: thiamine hydrochloride, riboflavin, niacin, niacinamide, folate or folic acid, beta carotene, potassium iodide, iron or ferrous sulfate, alpha tocopherols, ascorbic acid, Vitamin D, amino acids, multi-vitamin, fish oil, co-enzyme Q-10, and calcium.

In one embodiment, the invention may include a consumable fluid containing at least one dissolved water-soluble cannabinoid. In one preferred embodiment, this consumable fluid may be added to a drink or beverage to infused it with the dissolved water-soluble cannabinoid generated in an in vivo system as generally herein described, or through an in vitro process, for example as identified by Zipp et al. which is incorporated herein by reference. As noted above, such water-soluble cannabinoid may include a water-soluble glycosylated cannabinoid and/or a water-soluble acetylated cannabinoid, and/or a mixture of both. The consumable fluid may include a food additive polysaccharide such as maltodextrin and/or dextrin, which may further be in an aqueous form and/or solution. For example, in one embodiment, and aqueous maltodextrin solution may include a quantity of sorbic acid and an acidifying agent to provide a food grade aqueous solution of maltodextrin having a pH of 2-4 and a sorbic acid content of 0.02-0.1% by weight.

In certain embodiments, the consumable fluid may include water, as well as an alcoholic beverage; a nonalcoholic beverage, a noncarbonated beverage, a carbonated beverage, a cola, a root beer, a fruit-flavored beverage, a citrus-flavored beverage, a fruit juice, a fruit-containing beverage, a vegetable juice, a vegetable containing beverage, a tea, a coffee, a dairy beverage, a protein containing beverage, a shake, a sports drink, an energy drink, and a flavored water.

The consumable fluid may further include at least one additional ingredients, including but not limited to: xanthan gum, cellulose gum, whey protein hydrolysate, ascorbic acid, citric acid, malic acid, sodium benzoate, sodium citrate, sugar, phosphoric acid, and water.

In one embodiment, the invention may include a consumable gel having at least one water-soluble cannabinoid and gelatin in an aqueous solution. In a preferred embodiment, the consumable gel may include a water-soluble glycosylated cannabinoid and/or a water-soluble acetylated cannabinoid, or a mixture of both, generated in an in vivo system, such as a whole plant or cell suspension culture system as generally herein described.

Additional embodiments may include a liquid composition having at least one water-soluble cannabinoid solubilized in a first quantity of water; and at least one of: xanthan gum, cellulose gum, whey protein hydrolysate, ascorbic acid, citric acid, malic acid, sodium benzoate, sodium citrate, sugar, phosphoric acid, and/or a sugar alcohol. In this embodiment, a water-soluble cannabinoid may include a glycosylated water-soluble cannabinoid, an acetylated water-soluble cannabinoid, or a mixture of both. In one preferred embodiment, the composition may further include a quantity of ethanol. Here, the amount of water-soluble cannabinoid may include: less than 10 mass % water; more than 95 mass % water; about 0.1 mg to about 1000 mg of the water-soluble cannabinoid; about 0.1 mg to about 500 mg of the water-soluble cannabinoid; about 0.1 mg to about 200 mg of the water-soluble cannabinoid; about 0.1 mg to about 100 mg of the water-soluble cannabinoid; about 0.1 mg to about 100 mg of the water-soluble cannabinoid; about 0.1 mg to about 10 mg of the water-soluble cannabinoid; about 0.5 mg to about 5 mg of the water-soluble cannabinoid; about 1 mg/kg to 5 mg/kg (body weight) in a human of the water-soluble cannabinoid.

In alternative embodiment, the composition may include at least one water-soluble cannabinoid in the range of 50 mg/L to 300 mg/L; at least one water-soluble cannabinoid in the range of 50 mg/L to 100 mg/L; at least one water-soluble cannabinoid in the range of 50 mg/L to 500 mg/L; at least one water-soluble cannabinoid over 500 mg/L; at least one water-soluble cannabinoid under 50 mg/L. Additional embodiments may include one or more of the following additional components: a flavoring agent; a coloring agent; a coloring agent; and/or caffeine.

In one embodiment, the invention may include a liquid composition having at least one water-soluble cannabinoid solubilized in said first quantity of water and a first quantity of ethanol in a liquid state. In a preferred embodiment, a first quantity of ethanol in a liquid state may be between 1% to 20% weight by volume of the liquid composition. In this embodiment, a water-soluble cannabinoid may include a glycosylated water-soluble cannabinoid, an acetylated water-soluble cannabinoid, or a mixture of both. Such water-soluble cannabinoids may be generated in an in vivo and/or in vitro system as herein identified. In a preferred embodiment, the ethanol, or ethyl alcohol component may be up to about ninety-nine point nine-five percent (99.95%) by weight and the water-soluble cannabinoid about zero point zero five percent (0.05%) by weight. In another embodiment, Examples of the preferred embodiment may include liquid ethyl alcohol compositions having one or more water-soluble cannabinoids wherein said ethyl alcohol has a proof greater than 100, and/or less than 100. Additional examples of a liquid composition containing ethyl alcohol and at least one water-soluble cannabinoid may include, beer, wine and/or distilled spirit.

Additional embodiments of the invention may include a chewing gum composition having a first quantity of at least one water-soluble cannabinoid. In a preferred embodiment, a chewing gum composition may further include a gum base comprising a buffering agent selected from the group consisting of acetates, glycinates, phosphates, carbonates, glycerophosphates, citrates, borates, and mixtures thereof. Additional components may include at least one sweetening agent; and at least one flavoring agent. As noted above, in a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively.

In one embodiment, the chewing gum composition described above may include:
  0.01 to 1% by weight of at least one water-soluble cannabinoid;
  25 to 85% by weight of a gum base;
  10 to 35% by weight of at least one sweetening agent; and
  1 to 10% by weight of a flavoring agent.

Here, such flavoring agents may include: menthol flavor, *eucalyptus*, mint flavor and/or L-menthol. Sweetening agents may include one or more of the following: xylitol, sorbitol, isomalt, aspartame, sucralose, acesulfame potassium, and saccharin. Additional preferred embodiment may include a chewing gum having a pharmaceutically acceptable excipient selected from the group consisting of: fillers, disintegrants, binders, lubricants, and antioxidants. The chewing gum composition may further be non-disintegrating and also include one or more coloring and/or flavoring agents.

The invention may further include a composition for a water-soluble cannabinoid infused solution comprising essentially of: water and/or purified water, at least one water-soluble cannabinoid, and at least one flavoring agent. A water-soluble cannabinoid infused solution of the invention may further include a sweetener selected from the group consisting of: glucose, sucrose, invert sugar, corn syrup, *stevia* extract powder, stevioside, steviol, aspartame, saccharin, saccharin salts, sucralose, potassium acetosulfam, sorbitol, xylitol, mannitol, erythritol, lactitol, alitame, miraculin, monellin, and thaumatin or a combination of the same. Additional components of the water-soluble cannabinoid infused solution may include, but not be limited to: sodium chloride, sodium chloride solution, glycerin, a coloring agent, and a demulcent. As to this last potential component, in certain embodiment, a demulcent may include: pectin, glycerin, honey, methylcellulose, and/or propylene glycol. As noted above, in a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively.

The invention may further include a composition for a water-soluble cannabinoid infused anesthetic solution having water, or purified water, at least one water-soluble cannabinoid, and at least one oral anesthetic. In a preferred embodiment, an anesthetic may include benzocaine, and/or phenol in a quantity of between 0.1% to 15% volume by weight.

Additional embodiments may include a water-soluble cannabinoid infused anesthetic solution having a sweetener which may be selected from the group consisting of: glucose, sucrose, invert sugar, corn syrup, *stevia* extract powder, stevioside, steviol, aspartame, saccharin, saccharin salts, sucralose, potassium acetosulfam, sorbitol, xylitol, mannitol, erythritol, lactitol, alitame, miraculin, monellin, and thaumatin or a combination of the same. Additional components of the water-soluble cannabinoid infused solution may include, but not be limited to: sodium chloride, sodium chloride solution, glycerin, a coloring agent a demulcent. In a preferred embodiment, a demulcent may be selected from the group consisting of: pectin, glycerin, honey, methylcellulose, and propylene glycol. As noted above, in a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively.

The invention may further include a composition for a hard lozenge for rapid delivery of water-soluble cannabinoids through the oral mucosa. In this embodiment, such a hard lozenge composition may include: a crystalized sugar base, and at least one water-soluble cannabinoid, wherein the hard lozenge has a moisture content between 0.1 to 2%. In this embodiment, the water-soluble cannabinoid may be added to the sugar based when it is in a liquefied form and prior to the evaporation of the majority of water content. Such a hard lozenge may further be referred to as a candy.

In a preferred embodiment, a crystalized sugar base may be formed from one or more of the following: sucrose, invert sugar, corn syrup, and isomalt or a combination of the same. Additional components may include at least one acidulant. Examples of acidulants may include, but not be limited to: citric acid, tartaric acid, fumaric acid, and malic acid. Additional components may include at least one pH adjustor. Examples of pH adjustors may include, but not be limited to: calcium carbonate, sodium bicarbonate, and magnesium trisilicate.

In another preferred embodiment, the composition may include at least one anesthetic. Example of such anesthetics may include benzocaine, and phenol. In this embodiment, first quantity of anesthetic may be between 1 mg to 15 mg per lozenge. Additional embodiments may include a quantity of menthol. In this embodiment, such a quantity of menthol may be between 1 mg to 20 mg. The hard lozenge composition may also include a demulcent, for example: pectin, glycerin, honey, methylcellulose, propylene glycol, and glycerin. In this embodiment, a demulcent may be in a quantity between 1 mg to 10 mg. As noted above, in a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively.

The invention may include a chewable lozenge for rapid delivery of water-soluble cannabinoids through the oral mucosa. In a preferred embodiment, the compositions may include: a glycerinated gelatin base, at least one sweetener; and at least one water-soluble cannabinoid dissolved in a first quantity of water. In this embodiment, a sweetener may include sweetener selected from the group consisting of: glucose, sucrose, invert sugar, corn syrup, *stevia* extract powder, stevioside, steviol, aspartame, saccharin, saccharin salts, sucralose, potassium acetosulfam, sorbitol, xylitol, mannitol, erythritol, lactitol, alitame, miraculin, monellin, and thaumatin or a combination of the same.

Additional components may include at least one acidulant. Examples of acidulants may include, but not be limited to: citric acid, tartaric acid, fumaric acid, and malic acid. Additional components may include at least one pH adjustor. Examples of pH adjustors may include, but not be limited to: calcium carbonate, sodium bicarbonate, and magnesium trisilicate.

In another preferred embodiment, the composition may include at least one anesthetic. Example of such anesthetics may include benzocaine, and phenol. In this embodiment, first quantity of anesthetic may be between 1 mg to 15 mg per lozenge. Additional embodiments may include a quantity of menthol. In this embodiment, such a quantity of menthol may be between 1 mg to 20 mg. The chewable lozenge composition may also include a demulcent, for example: pectin, glycerin, honey, methylcellulose, propylene glycol, and glycerin. In this embodiment, a demulcent may be in a quantity between 1 mg to 10 mg. As noted above, in a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively.

The invention may include a soft lozenge for rapid delivery of water-soluble cannabinoids through the oral mucosa. In a preferred embodiment, the compositions may include: polyethylene glycol base, at least one sweetener; and at least one water-soluble cannabinoid dissolved in a first quantity of water. In this embodiment, a sweetener may include sweetener selected from the group consisting of: glucose, sucrose, invert sugar, corn syrup, *stevia* extract powder, stevioside, steviol, aspartame, saccharin, saccharin salts, sucralose, potassium acetosulfam, sorbitol, xylitol, mannitol, erythritol, lactitol, alitame, miraculin, monellin, and thaumatin or a combination of the same. Additional components may include at least one acidulant. Examples of acidulants may include, but not be limited to: citric acid, tartaric acid, fumaric acid, and malic acid. Additional components may include at least one pH adjustor. Examples of pH adjustors may include, but not be limited to: calcium carbonate, sodium bicarbonate, and magnesium trisilicate.

In another preferred embodiment, the composition may include at least one anesthetic. Example of such anesthetics may include benzocaine, and phenol. In this embodiment, first quantity of anesthetic may be between 1 mg to 15 mg per lozenge. Additional embodiments may include a quantity of menthol. In this embodiment, such a quantity of menthol may be between 1 mg to 20 mg. The soft lozenge composition may also include a demulcent, for example: pectin, glycerin, honey, methylcellulose, propylene glycol, and glycerin. In this embodiment, a demulcent may be in a quantity between 1 mg to 10 mg. As noted above, in a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively.

In another embodiment, the invention may include a tablet or capsule consisting essentially of a water-soluble glycosylated cannabinoid and a pharmaceutically acceptable excipient. Example may include solid, semi-solid and aqueous excipients such as: maltodextrin, whey protein isolate, xanthan gum, guar gum, diglycerides, monoglycerides, carboxymethyl cellulose, glycerin, gelatin, polyethylene glycol and water-based excipients.

In a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively. Examples of such in vivo systems being generally described herein, including in plant, as well as cell culture systems including *cannabis* cell culture, tobacco cell culture and yeast cell culture systems. In one embodiment, a tablet or capsule may include an amount of water-soluble cannabinoid of 5 milligrams or less. Alternative embodiments may include an amount of water-soluble cannabinoid between 5 milligrams and 200 milligrams. Still other embodiments may include a tablet or capsule having amount of water-soluble cannabinoid that is more than 200 milligrams.

The invention may further include a method of manufacturing and packaging a cannabinoid dosage, consisting of the following steps: 1) preparing a fill solution with a desired concentration of a water-soluble cannabinoid in a liquid carrier wherein said cannabinoid solubilized in said liquid carrier; 2) encapsulating said fill solution in capsules; 3) packaging said capsules in a closed packaging system; and 4) removing atmospheric air from the capsules. In one embodiment, the step of removing of atmospheric air consists of purging the packaging system with an inert gas, such as, for example, nitrogen gas, such that said packaging system provides a room temperature stable product. In one preferred embodiment, the packaging system may include a plaster package, which may be constructed of material that minimizes exposure to moisture and air.

In one embodiment a preferred liquid carrier may include a water-based carrier, such as for example an aqueous sodium chloride solution. In a preferred embodiment, a water-soluble cannabinoid may include at least one water-soluble acetylated cannabinoid, and/or at least one water-soluble glycosylated cannabinoid, or a mixture of the two. In this embodiment, such water soluble glycosylated cannabinoid, and/or said acetylated cannabinoid may have been glycosylated and/or acetylated in vivo respectively. Examples of such in vivo systems being generally described herein, including in plant, as well as cell culture systems including *cannabis* cell culture, tobacco cell culture and yeast cell culture systems. In one embodiment, a desired cannabinoid concentration may be about 1-10% w/w, while in other embodiments it may be about 1.5-6.5% w/w. Alternative embodiments may include an amount of water-soluble cannabinoid between 5 milligrams and 200 milligrams. Still other embodiments may include a tablet or capsule having amount of water-soluble cannabinoid that is more than 200 milligrams.

The invention may include an oral pharmaceutical solution, such as a sub-lingual spray, consisting essentially of a water-soluble cannabinoid, 30-33% w/w water, about 50% w/w alcohol, 0.01% w/w butylated hydroxylanisole (BHA) or 0.1% w/w ethylenediaminetetraacetic acid (EDTA) and 5-21% w/w co-solvent, having a combined total of 100%, wherein said co-solvent is selected from the group consisting of propylene glycol, polyethylene glycol and combinations thereof, and wherein said water-soluble cannabinoid is a glycosylated cannabinoid, an acetylated cannabinoid or a mixture of the two. In an alternative embodiment, such an oral pharmaceutical solution may consist essentially of 0.1 to 5% w/w of said water-soluble cannabinoid, about 50% w/w alcohol, 5.5% w/w propylene glycol, 12% w/w polyethylene glycol and 30-33% w/w water. In a preferred composition, the alcohol component may be ethanol.

The invention may include an oral pharmaceutical solution, such as a sublingual spray, consisting essentially of about 0.1% to 1% w/w water-soluble cannabinoid, about 50% w/w alcohol, 5.5% w/w propylene glycol, 12% w/w polyethylene glycol, 30-33% w/w water, 0.01% w/w butylated hydroxyanisole, having a combined total of 100%, and wherein said water-soluble cannabinoid is a glycosylated cannabinoid, an acetylated cannabinoid or a mixture of the two wherein that were generated in vivo. In an alternative embodiment, such an oral pharmaceutical solution may consist essentially of 0.54% w/w water-soluble cannabinoid, 31.9% w/w water, 12% w/w polyethylene glycol 400, 5.5% w/w propylene glycol, 0.01% w/w butylated hydroxyanisole, 0.05% w/w sucralose, and 50% w/w alcohol, wherein the a the alcohol components may be ethanol.

The invention may include a solution for nasal and/or sublingual administration of a cannabinoid including: 1) an excipient of propylene glycol, ethanol anhydrous, or a mixture of both; and 2) a water-soluble cannabinoid which may include glycosylated cannabinoid an acetylated cannabinoid or a mixture of the two generated in vivo and/or in vitro. In a preferred embodiment, the composition may further include a topical decongestant, which may include phenylephrine hydrochloride, Oxymetazoline hydrochloride, and Xylometazoline in certain preferred embodiments. The composition may further include an antihistamine, and/or a steroid. Preferably, the steroid component is a corticosteroid selected from the group consisting of: neclomethasone dipropionate, budesonide, ciclesonide, flunisolide, fluticasone furoate, fluticasone propionate, mometasone, triamcinolone acetonide. In alternative embodiment, the solution for nasal and/or sublingual administration of a cannabinoid may further comprise at least one of the following: benzalkonium chloride solution, benzyl alcohol, boric acid, purified water, sodium borate, polysorbate 80, phenylethyl alcohol, microcrystalline cellulose, carboxymethylcellulose sodium, dextrose, dipasic, sodium phosphate, edetate disodium, monobasic sodium phosphate, propylene glycol.

The invention may further include an aqueous solution for nasal and/or sublingual administration of a cannabinoid comprising: a water and/or saline solution; and a water-soluble cannabinoid which may include a glycosylated cannabinoid, an acetylated cannabinoid or a mixture of the two generated in vivo and/or in vitro. In a preferred embodiment, the composition may further include a topical decongestant, which may include phenylephrine hydrochloride, Oxymetazoline hydrochloride, and Xylometazoline in certain preferred embodiments. The composition may further include an antihistamine, and/or a steroid. Preferably, the steroid component is a corticosteroid selected from the group consisting of: neclomethasone dipropionate, budesonide, ciclesonide, flunisolide, fluticasone furoate, fluticasone propionate, mometasone, triamcinolone acetonide. In alternative embodiment, the aqueous solution may further comprise at least one of the following: benzalkonium chloride solution, benzyl alcohol, boric acid, purified water, sodium borate, polysorbate 80, phenylethyl alcohol, microcrystalline cellulose, carboxymethylcellulose sodium, dextrose, dipasic, sodium phosphate, edetate disodium, monobasic sodium phosphate, propylene glycol.

The invention may include a topical formulation for the transdermal delivery of water-soluble cannabinoid. In a preferred embodiment, a topical formulation for the transdermal delivery of water-soluble cannabinoid may include a water-soluble glycosylated cannabinoid, and/or water-soluble acetylated cannabinoid, or a mixture of both, and a pharmaceutically acceptable excipient. Here, a glycosylated cannabinoid and/or acetylated cannabinoid may be generated in vivo and/or in vitro. Preferably a pharmaceutically acceptable excipient may include one or more: gels, ointments, cataplasms, poultices, pastes, creams, lotions, plasters and jellies or even polyethylene glycol. Additional embodiments may further include one or more of the following components: a quantity of capsaicin; a quantity of benzocaine; a quantity of lidocaine; a quantity of camphor; a quantity of benzoin resin; a quantity of methylsalicilate; a quantity of triethanolamine salicylate; a quantity of hydrocortisone; a quantity of salicylic acid.

The invention may include a gel for transdermal administration of a water soluble-cannabinoid which may be generated in vitro and/or in vivo. In this embodiment, the mixture preferably contains from 15% to about 90% ethanol, about 10% to about 60% buffered aqueous solution or water, about 0.1 to about 25% propylene glycol, from about 0.1 to about 20% of a gelling agent, from about 0.1 to about 20% of a base, from about 0.1 to about 20% of an absorption enhancer and from about 1% to about 25% polyethylene glycol and a water-soluble cannabinoid such as a glycosylated cannabinoid, and/or acetylated cannabinoid, and/or a mixture of the two.

In another embodiment, the invention may further include a transdermal composition having a pharmaceutically effective amount of a water-soluble cannabinoid for delivery of the cannabinoid to the bloodstream of a user. This transdermal composition may include a pharmaceutically acceptable excipient and at least one water-soluble cannabinoid, such as a glycosylated cannabinoid, an acetylated cannabinoid, and a mixture of both, wherein the cannabinoid is capable of diffusing from the composition into the bloodstream of the user. In a preferred embodiment, a pharmaceutically acceptable excipient to create a transdermal dosage form selected from the group consisting of: gels, ointments, cataplasms, poultices, pastes, creams, lotions, plasters and jellies. The transdermal composition may further include one or more surfactants. In one preferred embodiment, the surfactant may include a surfactant-lecithin organogel, which may further be present in an amount of between about between about 95% and about 98% w/w. In an alternative embodiment, a surfactant-lecithin organogel comprises lecithin and PPG-2 myristyl ether propionate and/or high molecular weight polyacrylic acid polymers. The transdermal composition may further include a quantity of isopropyl myristate.

The invention may further include transdermal composition having one or more permeation enhancers to facilitate transfer of the water-soluble cannabinoid across a dermal layer. In a preferred embodiment, a permeation enhancer may include one or more of the following: propylene glycol monolaurate, diethylene glycol monoethyl ether, an oleoyl macrogolglyceride, a caprylocaproyl macrogolglyceride, and an oleyl alcohol, The invention may also include a liquid cannabinoid liniment composition consisting of water, isopropyl alcohol solution and a water-soluble cannabinoid, such as glycosylated cannabinoid, and/or said acetylated cannabinoid which may further have been generated in vivo. This liquid cannabinoid liniment composition may further include approximately 97.5% to about 99.5% by weight of 70% isopropyl alcohol solution and from about 0.5% to about 2.5% by weight of a water-soluble cannabinoid mixture.

Based on the improved solubility and other physical properties, as well as cost advantage and scalability of the invention's in vivo water-soluble production platform, the invention may include one or more commercial infusions. For example, commercially available products, such a lip balm, soap, shampoos, lotions, creams and cosmetics may be infused with one or more water-soluble cannabinoids.

As generally described herein, the invention may include one or more plants, such as a tobacco plant and/or cell culture that may be genetically modified to produce, for example water-soluble glycosylated cannabinoids in vivo. As such, in one preferred embodiment, the invention may include a tobacco plant and or cell that contain at least one water-soluble cannabinoid. In a preferred embodiment, a tobacco plant containing a quantity of water-soluble cannabinoids may be used to generate a water-soluble cannabinoid infused tobacco product such as a cigarette, pipe tobacco, chewing tobacco, cigar, and smokeless tobacco. In one embodiment, the tobacco plant may be treated with one or more glycosidase inhibitors. In a preferred embodiment, since the cannabinoid being introduced to the tobacco plant may be controlled, the inventive tobacco plant may generate one or more selected water-cannabinoids. For example, in one embodiment, the genetically modified tobacco plant may be introduced to a single cannabinoid, such as a non-psychoactive CBD compound, while in other embodiment, the genetically modified tobacco plant may be introduced to a cannabinoid extract containing a full and/or partial entourage of cannabinoid compounds.

The invention may further include a novel composition that may be used to supplement a cigarette, or other tobacco-based product. In this embodiment, the composition may include at least one water-soluble cannabinoid dissolved in an aqueous solution. This aqueous solution may be wherein said composition may be introduced to a tobacco product, such as a cigarette and/or a tobacco leaf such that the aqueous solution may evaporate generating a cigarette and/or a tobacco leaf that contains the aforementioned water-soluble cannabinoid(s), which may further have been generated in vivo as generally described herein.

On one embodiment the invention may include one or more method of treating a medical condition in a mammal. In this embodiment, the novel method may include of administering a therapeutically effective amount of a water-soluble cannabinoid, such as an in vivo generated glycosylated cannabinoid, and/or an acetylated cannabinoid, and/or a mixture of both or a pharmaceutically acceptable salt thereof, wherein the medical condition is selected from the group consisting of: obesity, post-traumatic stress syndrome, anorexia, nausea, emesis, pain, wasting syndrome, HIV-wasting, chemotherapy induced nausea and vomiting, alcohol use disorders, anti-tumor, amyotrophic lateral sclerosis, glioblastoma multiforme, glioma, increased intraocular pressure, glaucoma, *cannabis* use disorders, Tourette's syndrome, dystonia, multiple sclerosis, inflammatory bowel disorders, arthritis, dermatitis, Rheumatoid arthritis, systemic lupus erythematosus, anti-inflammatory, anti-convulsant, anti-psychotic, anti-oxidant, neuroprotective, anti-cancer, immunomodulatory effects, peripheral neuropathic pain, neuropathic pain associated with post-herpetic neuralgia, diabetic neuropathy, shingles, burns, actinic keratosis, oral cavity sores and ulcers, post-episiotomy pain, psoriasis, pruritis, contact dermatitis, eczema, bullous dermatitis herpetiformis, exfoliative dermatitis, mycosis fungoides, pemphigus, severe erythema multiforme (e.g., Stevens-Johnson syndrome), seborrheic dermatitis, ankylosing spondylitis, psoriatic arthritis, Reiter's syndrome, gout, chondrocalcinosis, joint pain secondary to dysmenorrhea, fibromyalgia, musculoskeletal pain, neuropathic-postoperative complications, polymyositis, acute nonspecific tenosynovitis, bursitis, epicondylitis, post-traumatic osteoarthritis, synovitis, and juvenile rheumatoid arthritis. In a preferred embodiment, the pharmaceutical composition may be administered by a route selected from the group consisting of: transdermal, topical, oral, buccal, sublingual, intra-venous, intra-muscular, vaginal, rectal, ocular, nasal and follicular. The number of water-soluble cannabinoids may be a therapeutically effective amount, which may be determined by the patient's age, weight, medical condition cannabinoid-delivered, route of delivery and the like. In one embodiment, a therapeutically effective amount may be 50 mg or less of a water-soluble cannabinoid. In another embodiment, a therapeutically effective amount may be 50 mg or more of a water-soluble cannabinoid.

It should be noted that for any of the above composition, unless otherwise stated, an effective amount of water-soluble cannabinoids may include amounts between: 0.01 mg to 0.1 mg; 0.01 mg to 0.5 mg; 0.01 mg to 1 mg; 0.01 mg to 5 mg; 0.01 mg to 10 mg; 0.01 mg to 25 mg; 0.01 mg to 50 mg; 0.01 mg to 75 mg; 0.01 mg to 100 mg; 0.01 mg to 125 mg; 0.01 mg to 150 mg; 0.01 mg to 175 mg; 0.01 mg to 200 mg; 0.01 mg to 225 mg; 0.01 mg to 250 mg; 0.01 mg to 275 mg; 0.01 mg to 300 mg; 0.01 mg to 225 mg; 0.01 mg to 350 mg; 0.01 mg to 375 mg; 0.01 mg to 400 mg; 0.01 mg to 425 mg; 0.01 mg to 450 mg; 0.01 mg to 475 mg; 0.01 mg to 500 mg; 0.01 mg to 525 mg; 0.01 mg to 550 mg; 0.01 mg to 575 mg; 0.01 mg to 600 mg; 0.01 mg to 625 mg; 0.01 mg to 650 mg; 0.01 mg to 675 mg; 0.01 mg to 700 mg; 0.01 mg to 725 mg; 0.01 mg to 750 mg; 0.01 mg to 775 mg; 0.01 mg to 800 mg; 0.01 mg to 825 mg; 0.01 mg to 950 mg; 0.01 mg to 875 mg; 0.01 mg to 900 mg; 0.01 mg to 925 mg; 0.01 mg to 950 mg; 0.01 mg to 975 mg; 0.01 mg to 1000 mg; 0.01 mg to 2000 mg; 0.01 mg to 3000 mg; 0.01 mg to 4000 mg; 01 mg to 5000 mg; 0.01 mg to. 1 mg/kg.; 0.01 mg to 0.5 mg/kg; 01 mg to 1 mg/kg; 0.01 mg to 5 mg/kg; 0.01 mg to 10 mg/kg; 0.01 mg to 25 mg/kg; 0.01 mg to 50 mg/kg; 0.01 mg to 75 mg/kg; and 0.01 mg to 100 mg/kg.

The modified cannabinoids compounds of the present invention are useful for a variety of therapeutic applications. For example, the compounds are useful for treating or alleviating symptoms of diseases and disorders involving CB1 and CB2 receptors, including appetite loss, nausea and vomiting, pain, multiple sclerosis and epilepsy. For example, they may be used to treat pain (i.e. as analgesics) in a variety of applications including but not limited to pain management. In additional embodiments, such modified cannabinoids compounds may be used as an appetite suppressant. Additional embodiment may include administering the modified cannabinoids compounds.

By "treating" the present inventors mean that the compound is administered in order to alleviate symptoms of the disease or disorder being treated. Those of skill in the art will recognize that the symptoms of the disease or disorder that is treated may be completely eliminated or may simply be lessened. Further, the compounds may be administered in combination with other drugs or treatment modalities, such as with chemotherapy or other cancer-fighting drugs.

Implementation may generally involve identifying patients suffering from the indicated disorders and administering the compounds of the present invention in an acceptable form by an appropriate route. The exact dosage to be administered may vary depending on the age, gender, weight and overall health status of the individual patient, as well as the precise etiology of the disease. However, in general, for administration in mammals (e.g. humans), dosages in the range of from about 0.01 to about 300 mg of compound per kg of body weight per 24 hr., and more preferably about 0.01 to about 100 mg of compound per kg of body weight per 24 hr., are effective.

Administration may be oral or parenteral, including intravenously, intramuscularly, subcutaneously, intradermal injection, intraperitoneal injection, etc., or by other routes (e.g. transdermal, sublingual, oral, rectal and buccal delivery, inhalation of an aerosol, etc.). In a preferred embodiment of the invention, the water-soluble cannabinoid analogs are provided orally or intravenously.

In particular, the phenolic esters of the invention are preferentially administered systemically in order to afford an opportunity for metabolic activation via in vivo cleavage of the ester. In addition, the water soluble compounds with azole moieties at the pentyl side chain do not require in vivo activation and may be suitable for direct administration (e.g. site specific injection).

The compounds may be administered in the pure form or in a pharmaceutically acceptable formulation including suitable elixirs, binders, and the like (generally referred to a "carriers") or as pharmaceutically acceptable salts (e.g. alkali metal salts such as sodium, potassium, calcium or lithium salts, ammonium, etc.) or other complexes. It should be understood that the pharmaceutically acceptable formulations include liquid and solid materials conventionally utilized to prepare both injectable dosage forms and solid dosage forms such as tablets and capsules and aerosolized dosage forms. In addition, the compounds may be formulated with aqueous or oil based vehicles. Water may be used as the carrier for the preparation of compositions (e.g. injectable compositions), which may also include conventional buffers and agents to render the composition isotonic. Other potential additives and other materials (preferably those which are generally regarded as safe [GRAS]) include: colorants; flavorings; surfactants (TWEEN, oleic acid, etc.); solvents, stabilizers, elixirs, and binders or encapsulants (lactose, liposomes, etc.). Solid diluents and excipients include lactose, starch, conventional disintegrating agents, coatings and the like. Preservatives such as methyl paraben or benzalkium chloride may also be used. Depending on the formulation, it is expected that the active composition will consist of about 1% to about 99% of the composition and the vehicular "carrier" will constitute about 1% to about 99% of the composition. The pharmaceutical compositions of the present invention may include any suitable pharmaceutically acceptable additives or adjuncts to the extent that they do not hinder or interfere with the therapeutic effect of the active compound.

The administration of the compounds of the present invention may be intermittent, bolus dose, or at a gradual or continuous, constant or controlled rate to a patient. In addition, the time of day and the number of times per day that the pharmaceutical formulation is administered may vary are and best determined by a skilled practitioner such as a physician. Further, the effective dose can vary depending upon factors such as the mode of delivery, gender, age, and other conditions of the patient, as well as the extent or progression of the disease. The compounds may be provided alone, in a mixture containing two or more of the compounds, or in combination with other medications or treatment modalities. The compounds may also be added to blood ex vivo and then be provided to the patient.

Genes encoding by a combination polynucleotide and/or a homologue thereof, may be introduced into a plant, and/or plant cell using several types of transformation approaches developed for the generation of transgenic plants. Standard transformation techniques, such as Ti-plasmid *Agrobacterium*-mediated transformation, particle bombardment, microinjection, and electroporation may be utilized to construct stably transformed transgenic plants. Examples of stably transformed yeast may be described in Sayre et al. PCT/US18/41710, such techniques for yeast transformation being specifically incorporated herein by reference. Examples of stably transformed plants, such as *Cannabis* plants, may be described by Sayre et al. 62/885,349, such techniques for stable *Cannabis* transformation being specifically incorporated herein by reference)

As used herein, a "cannabinoid" is a chemical compound (such as cannabinol, THC or cannabidiol) that is found in the plant species *Cannabis* among others like: *Echinacea; Acmella Oleracea; Helichrysum Umbraculigerum; Radula marginata* (Liverwort) and *Theobroma cacao*, and metabolites and synthetic analogues thereof that may or may not have psychoactive properties. Cannabinoids therefore include (without limitation) compounds (such as THC) that have high affinity for the cannabinoid receptor (for example Ki<250 nM), and compounds that do not have significant affinity for the cannabinoid receptor (such as cannabidiol, CBD). Cannabinoids also include compounds that have a characteristic dibenzopyran ring structure (of the type seen in THC) and cannabinoids which do not possess a pyran ring (such as cannabidiol). Hence a partial list of cannabinoids includes THC, CBD, dimethyl heptylpentyl cannabidiol (DMHP-CBD), 6,12-dihydro-6-hydroxy-cannabidiol (described in U.S. Pat. No. 5,227,537, incorporated by reference); (3S,4R)-7-hydroxy-46-tetrahydrocannabinol homologs and derivatives described in U.S. Pat. No. 4,876, 276, incorporated by reference; (+)-4-[4-DMH-2,6-diacetoxy-phenyl]-2-carboxy-6,6-dimethylbicyclo[3.1.1]hept-2-en, and other 4-phenylpinene derivatives disclosed in U.S. Pat. No. 5,434,295, which is incorporated by reference; and cannabidiol (−)(CBD) analogs such as (−)CBD-monomethylether, (−)CBD dimethyl ether; (−)CBD diacetate; (−)3'-acetyl-CBD monoacetate; and ±AF11, all of which are disclosed in Consroe et al., J. Clin. Phannacol. 21: 428S-436S, 1981, which is also incorporated by reference. Many other cannabinoids are similarly disclosed in Agurell et al., Pharmacol. Rev. 38:31-43, 1986, which is also incorporated by reference.

Examples of cannabinoids are tetrahydrocannabinol, cannabidiol, cannabigerol, cannabichromene, cannabicyclol, cannabivarin, cannabielsoin, cannabicitran, cannabigerolic acid, cannabigerolic acid monomethylether, cannabigerol monomethylether, cannabigerovarinic acid, cannabigerovarin, cannabichromenic acid, cannabichromevarinic acid, cannabichromevarin, cannabidolic acid, cannabidiol monomethylether, cannabidiol-C4, cannabidivarinic acid, cannabidiorcol, delta-9-tetrahydrocannabinolic acid A, delta-9-tetrahydrocannabinolic acid B, delta-9-tetrahydrocannabinolic acid-C4, delta-9-tetrahydrocannabivarinic acid,delta-9-tetrahydrocannabivarin, delta-9-tetrahydrocannabiorcolic acid, delta-9-tetrahydrocannabiorcol,delta-7-cis-iso-tetrahydrocannabivarin, delta-8-tetrahydrocannabiniolic acid, delta-8-tetrahydrocannabinol, cannabicyclolic acid, cannabicylovarin, cannabielsoic acid A, cannabielsoic acid B, cannabinolic acid, cannabinol methylether, cannabinol-C4, cannabinol-C2, cannabiorcol, 10-ethoxy-9-hydroxy-delta-6a-tetrahydrocannabinol, 8,9-dihydroxy-delta-6a-tetrahydrocannabinol, cannabitriolvarin, ethoxy-cannabitriolvarin, dehydrocannabifuran, cannabifuran, cannabichromanon, cannabicitran, 10-oxo-delta-6a-tetrahydrocannabinol, delta-9-cis-tetrahydrocannabinol, 3, 4, 5, 6-tetrahydro-7-hydroxy-alpha-alpha-2-trimethyl-9-n-propyl-2, 6-methano-2H-1-benzoxocin-5-methanol-cannabiripsol,trihydroxy-delta-9-tetrahydrocannabinol, and cannabinol. Examples of cannabinoids within the context of this disclosure include tetrahydrocannabinol and cannabidiol. The term "cannabinoid" may also include different modified forms of a cannabinoid such as a hydroxylated cannabinoid or cannabinoid carboxylic acid. For example, if a UGT were to be capable of glycosylating a cannabinoid, it would include the term cannabinoid as defined elsewhere, as well as the aforementioned modified forms. It may further include multiple glycosylation moieties.

The term "endocannabinoid" refers to compounds including arachidonoyl ethanolamide (anandamide, AEA), 2-arachidonoyl ethanolamide (2-AG), 1-arachidonoyl ethanolamide (1-AG), and docosahexaenoyl ethanolamide (DHEA, synaptamide), oleoyl ethanolamide (OEA), cicsapentacnoyl ethanolamide, prostaglandin ethanolamide, docosahexaenoyl ethanolamide, linolenoyl cthanolamide, 5 (Z),8 (Z),1 1 (Z)-cicosatrienoic acid ethanolamide (mead acid ethanolamide), heptadecanoul ethanolamide, stearoyl ethanolamide, docosaenoyl ethanolamide, nervonoyl ethanolamide, tricosanoyl ethanolamide, lignoceroyl ethanolamide, myristoyl ethanolamide, pentadecanoyl ethanolamide, palmitoleoyl ethanolamide, docosahexaenoic acid (DHA). Particularly preferred endocannabinoids are AEA, 2-AG, 1-AG, and DHEA.

Hydroxylation is a chemical process that introduces a hydroxyl group (—OH) into an organic compound. Acetylation is a chemical reaction that adds an acetyl chemical group. Glycosylation is the coupling of a glycosyl donor, to a glycosyl acceptor forming a glycoside.

The term "prodrug" refers to a precursor of a biologically active pharmaceutical agent (drug). Prodrugs must undergo a chemical or a metabolic conversion to become a biologically active pharmaceutical agent. A prodrug can be converted ex vivo to the biologically active pharmaceutical agent by chemical transformative processes. In vivo, a prodrug is converted to the biologically active pharmaceutical agent by the action of a metabolic process, an enzymatic process or a degradative process that removes the prodrug moiety to form the biologically active pharmaceutical agent.

A polypeptide can be expressed in monocot plants and/or dicot plants. Techniques for introducing nucleic acids into plants are known in the art, and include, without limitation, *Agrobacterium*-mediated transformation, viral vector-mediated transformation, electroporation, and particle gun transformation (also referred to as biolistic transformation). See, for example, U.S. Pat. Nos. 5,538,880; 5,204,253; 6,329,571; and U.S. Pat. No. 6,013,863; Richards et al., Plant Cell. Rep. 20:48-20 54 (2001); Somleva et al., Crop Sci. 42:2080-2087 (2002); Sinagawa-Garcia et al., Plant Mol Biol (2009) 70:487-498; and Lutz et al., Plant Physiol., 2007, Vol. 145, pp. 1201-1210. In some instances, intergenic transformation of plastids can be used as a method of introducing a polynucleotide into a plant cell. In some instances, the method of introduction of a polynucleotide into a plant comprises chloroplast transformation. In some instances, the leaves and/or stems can be the target tissue of the introduced polynucleotide. If a cell or cultured tissue is used as the recipient tissue for transformation, plants can be regenerated from transformed cultures if desired, by techniques known to those skilled in the art.

Other suitable methods for introduce polynucleotides include electroporation of protoplasts, polyethylene glycol-mediated delivery of naked DNA into plant protoplasts, direct gene transformation through imbibition (e.g., introducing a polynucleotide to a dehydrated plant), transformation into protoplasts (which can comprise transferring a polynucleotide through osmotic or electric shocks), chemical transformation (which can comprise the use of a polybrene-spermidine composition), microinjection, pollen-tube pathway transformation (which can comprise delivery of a polynucleotide to the plant ovule), transformation via liposomes, shoot apex method of transformation (which can comprise introduction of a polynucleotide into the shoot and regeneration of the shoot), sonication-assisted *agrobacterium* transformation (SAAT) method of transformation, infiltration (which can comprise a floral dip, or injection by syringe into a particular part of the plant (e.g., leaf)), silicon-carbide mediated transformation (SCMT) (which can comprise the addition of silicon carbide fibers to plant tissue and the polynucleotide of interest), electroporation, and electrophoresis. Such expression may be from transient or stable transformations.

A protein has "homology" or is "homologous" to a second protein if the amino acid sequence encoded by a gene has a similar amino acid sequence to that of the second gene. Alternatively, a protein has homology to a second protein if the two proteins have "similar" amino acid sequences. (Thus, the term "homologous proteins" is defined to mean that the two proteins have similar amino acid sequences). More specifically, in certain embodiments, the term "homologous" with regard to a contiguous nucleic acid sequence, refers to contiguous nucleotide sequences that hybridize under appropriate conditions to the reference nucleic acid sequence. For example, homologous sequences may have from about 75%-100, or more generally 80% to 100% sequence identity, such as about 81%; about 82%; about 83%; about 84%; about 85%; about 86%; about 87%; about 88%; about 89%; about 90%; about 91%; about 92%; about 93%; about 94% about 95%; about 96%; about 97%; about 98%; about 98.5%; about 99%; about 99.5%; and about 100%. The property of substantial homology is closely related to specific hybridization. For example, a nucleic acid molecule is specifically hybridizable when there is a sufficient degree of complementarity to avoid non-specific binding of the nucleic acid to non-target sequences under conditions where specific binding is desired, for example, under stringent hybridization conditions, and would fall within the range of a homolog. In another embodiment, expression optimization, for example for a mammalian lipocalin or odorant binding protein, to be expressed in yeast may be considered homologous and having a variable sequence identity due to the variable codon positions. Additional embodiments may also include homology to include redundant nucleotide codons.

The term "homolog", used with respect to an original enzyme or gene of a first family or species, refers to distinct enzymes or genes of a second family or species which are determined by functional, structural or genomic analyses to be an enzyme or gene of the second family or species which corresponds to the original enzyme or gene of the first family or species. Most often, homologs will have functional, structural or genomic similarities. Techniques are known by which homologs of an enzyme or gene can readily be cloned using genetic probes and PCR. Identity of cloned sequences as homolog can be confirmed using functional assays and/or by genomic mapping of the genes.

The term "operably linked," when used in reference to a regulatory sequence and a coding sequence, means that the regulatory sequence affects the expression of the linked coding sequence. "Regulatory sequences," or "control elements," refer to nucleotide sequences that influence the timing and level/amount of transcription, RNA processing or stability, or translation of the associated coding sequence. Regulatory sequences may include promoters; translation leader sequences; introns; enhancers; stem-loop structures; repressor binding sequences; termination sequences; polyadenylation recognition sequences; etc. Particular regulatory sequences may be located upstream and/or downstream of a coding sequence operably linked thereto. Also, particular regulatory sequences operably linked to a coding sequence may be located on the associated complementary strand of a double-stranded nucleic acid molecule.

As used herein, the term "promoter" refers to a region of DNA that may be upstream from the start of transcription, and that may be involved in recognition and binding of RNA polymerase and other proteins to initiate transcription. A promoter may be operably linked to a coding sequence for expression in a cell, or a promoter may be operably linked to a nucleotide sequence encoding a signal sequence which may be operably linked to a coding sequence for expression in a cell. An "inducible" promoter may be a promoter which may be under environmental control. Tissue-specific, tissue-preferred, cell type specific, and inducible promoters constitute the class of "non-constitutive" promoters. A "constitutive" promoter is a promoter which may be active under most environmental conditions or in most cell or tissue types.

As used herein, the term "transformation" or "genetically modified" refers to the transfer of one or more nucleic acid molecule(s) into a cell. A plant is "transformed" or "genetically modified" by a nucleic acid molecule transduced into the plant when the nucleic acid molecule becomes stably replicated by the plant. As used herein, the term "transformation" or "genetically modified" encompasses all techniques by which a nucleic acid molecule can be introduced into, such as a plant.

The term "vector" refers to some means by which DNA, RNA, a protein, or polypeptide can be introduced into a host. The polynucleotides, protein, and polypeptide which are to be introduced into a host can be therapeutic or prophylactic in nature; can encode or be an antigen; or can be regulatory in nature, etc. There are various types of vectors including virus, plasmid, bacteriophages, cosmids, and bacteria. An "expression vector" is nucleic acid capable of replicating in a selected host cell or organism. An expression vector can replicate as an autonomous structure, or alternatively can integrate, in whole or in part, into the host cell chromosomes or the nucleic acids of an organelle, or it is used as a shuttle for delivering foreign DNA to cells, and thus replicate along with the host cell genome. Thus, an expression vector are polynucleotides capable of replicating in a selected host cell, organelle, or organism, e.g., a plasmid, virus, artificial chromosome, nucleic acid fragment, and for which certain genes on the expression vector (including genes of interest) are transcribed and translated into a polypeptide or protein within the cell, organelle or organism; or any suitable construct known in the art, which comprises an "expression cassette." In contrast, as described in the examples herein, a "cassette" is a polynucleotide containing a section of an expression vector of this invention. The use of a cassette assists in the assembly of the expression vectors. An expression vector is a replicon, such as plasmid, phage, virus, chimeric virus, or cosmid, and which contains the desired polynucleotide sequence operably linked to the expression control sequence(s).

As is known in the art, different organisms preferentially utilize different codons for generating polypeptides. Such "codon usage" preferences may be used in the design of nucleic acid molecules encoding the proteins and chimeras of the invention in order to optimize expression in a particular host cell system. For example, all nucleotides of the present invention may be optimized for expression in a select organisms, such as a *Cannabis* plant, yeast, algae, fungi, and bacteria.

A polynucleotide sequence is operably linked to an expression control sequence(s) (e.g., a promoter and, optionally, an enhancer) when the expression control sequence controls and regulates the transcription and/or translation of that polynucleotide sequence.

Unless otherwise indicated, a particular nucleic acid sequence also implicitly encompasses conservatively modified variants thereof (e.g., degenerate codon substitutions), the complementary (or complement) sequence, and the reverse complement sequence, as well as the sequence explicitly indicated. Specifically, degenerate codon substitutions may be achieved by generating sequences in which the third position of one or more selected (or all) codons is substituted with mixed-base and/or deoxyinosine residues (see e.g., Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)). Because of the degeneracy of nucleic acid codons, one can use various different polynucleotides to encode identical polypeptides. The Table below, contains information about which nucleic acid codons encode which amino acids.

Amino Acid Nucleic Acid Codons

| Amino Acid | Nucleic Acid Codons |
| --- | --- |
| Ala/A | GCT, GCC, GCA, GCG |
| Arg/R | CGT, CGC, CGA, CGG, AGA, AGG |
| Asn/N | AAT, AAC |
| Asp/D | GAT, GAC |
| Cys/C | TGT, TGC |
| Gln/Q | CAA, CAG |
| Glu/E | GAA, GAG |
| Gly/G | GGT, GGC, GGA, GGG |
| His/H | CAT, CAC |
| Ile/I | ATT, ATC, ATA |
| Leu/L | TTA, TTG, CTT, CTC, CTA, CTG |
| Lys/K | AAA, AAG |
| Met/M | ATG |
| Phe/F | TTT, TTC |
| Pro/P | CCT, CCC, CCA, CCG |
| Ser/S | TCT, TCC, TCA, TCG, AGT, AGC |
| Thr/T | ACT, ACC, ACA, ACG |
| Trp/W | TGG |
| Tyr/Y | TAT, TAC |
| Val/V | GTT, GTC, GTA, GTG |

Moreover, because the proteins are described herein, one can chemically synthesize a polynucleotide which encodes these polypeptides/chimeric proteins. Oligonucleotides and polynucleotides that are not commercially available can be chemically synthesized e.g., according to the solid phase phosphoramidite triester method first described by Beaucage and Caruthers, Tetrahedron Letts. 22:1859-1862 (1981), or using an automated synthesizer, as described in Van Devanter et al., Nucleic Acids Res. 12:6159-6168 (1984). Other methods for synthesizing oligonucleotides and polynucleotides are known in the art. Purification of oligonucleotides is by either native acrylamide gel electrophoresis or by anion-exchange HPLC as described in Pearson & Reanier, J. Chrom. 255:137-149 (1983).

The term "plant" or "plant system" includes whole plants, plant organs, progeny of whole plants or plant organs, embryos, somatic embryos, embryo-like structures, protocorms, protocorm-like bodies (PLBs), and culture and/or suspensions of plant cells. Plant organs comprise, e.g., shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like) and cells (e.g., guard cells, egg cells, trichomes and the like). The invention may also include Cannabaceae and other *Cannabis* strains, such as *C. sativa* generally.

The term "expression," as used herein, or "expression of a coding sequence" (for example, a gene or a transgene) refer to the process by which the coded information of a nucleic acid transcriptional unit (including, e.g., genomic DNA or cDNA) is converted into an operational, non-operational, or structural part of a cell, often including the synthesis of a protein. Gene expression can be influenced by external signals; for example, exposure of a cell, tissue, or organism to an agent that increases or decreases gene expression. Expression of a gene can also be regulated anywhere in the pathway from DNA to RNA to protein. Regulation of gene expression occurs, for example, through controls acting on transcription, translation, RNA transport and processing, degradation of intermediary molecules such as mRNA, or through activation, inactivation, compartmentalization, or degradation of specific protein molecules after they have been made, or by combinations thereof. Gene expression can be measured at the RNA level or the protein level by any method known in the art, including, without limitation, Northern blot, RT-PCR, Western blot, or in vitro, in situ, or in vivo protein activity assay(s).

The term "nucleic acid" or "nucleic acid molecules" include single- and double-stranded forms of DNA; single-stranded forms of RNA; and double-stranded forms of RNA (dsRNA). The term "nucleotide sequence" or "nucleic acid sequence" refers to both the sense and antisense strands of a nucleic acid as either individual single strands or in the duplex. The term "ribonucleic acid" (RNA) is inclusive of iRNA (inhibitory RNA), dsRNA (double stranded RNA), siRNA (small interfering RNA), mRNA (messenger RNA), miRNA (micro-RNA), hpRNA (hairpin RNA), lRNA (transfer RNA), whether charged or discharged with a corresponding acetylated amino acid), and cRNA (complementary RNA). The term "deoxyribonucleic acid" (DNA) is inclusive of cDNA, genomic DNA, and DNA-RNA hybrids. The terms "nucleic acid segment" and "nucleotide sequence segment," or more generally "segment," will be understood by those in the art as a functional term that includes both genomic sequences, ribosomal RNA sequences, transfer RNA sequences, messenger RNA sequences, operon sequences, and smaller engineered nucleotide sequences that encoded or may be adapted to encode, peptides, polypeptides, or proteins.

The term "gene" or "sequence" refers to a coding region operably joined to appropriate regulatory sequences capable of regulating the expression of the gene product (e.g., a polypeptide or a functional RNA) in some manner. A gene includes untranslated regulatory regions of DNA (e.g., promoters, enhancers, repressors, etc.) preceding (up-stream) and following (down-stream) the coding region (open reading frame, ORF) as well as, where applicable, intervening sequences (i.e., introns) between individual coding regions (i.e., exons). The term "structural gene" as used herein is intended to mean a DNA sequence that is transcribed into mRNA which is then translated into a sequence of amino acids characteristic of a specific polypeptide. It should be noted that any reference to a SEQ ID, or sequence specifically encompasses that sequence, as well as all corresponding sequences that correspond to that first sequence. For example, for any amino acid sequence identified, the specific specifically includes all compatible nucleotide (DNA and RNA) sequences that give rise to that amino acid sequence or protein, and vice versa.

A nucleic acid molecule may include either or both naturally occurring and modified nucleotides linked together by naturally occurring and/or non-naturally occurring nucleotide linkages. Nucleic acid molecules may be modified chemically or biochemically, or may contain non-natural or derivatized nucleotide bases, as will be readily appreciated by those of skill in the art. Such modifications include, for example, labels, methylation, substitution of one or more of the naturally occurring nucleotides with an analog, internucleotide modifications (e.g., uncharged linkages: for example, methyl phosphonates, phosphotriesters, phosphoramidates, carbamates, etc.; charged linkages: for example, phosphorothioates, phosphorodithioates, etc.; pendent moieties: for example, peptides; intercalators: for example, acridine, psoralen, etc.; chelators; alkylators; and modified linkages: for example, alpha anomeric nucleic acids, etc.). The term "nucleic acid molecule" also includes any topological conformation, including single-stranded, double-stranded, partially duplexed, triplexed, hair-pinned, circular, and padlocked conformations.

The term "sequence identity" or "identity," as used herein in the context of two nucleic acid or polypeptide sequences, refers to the residues in the two sequences that are the same when aligned for maximum correspondence over a specified comparison window.

The terms "approximately" and "about" refer to a quantity, level, value, or amount that varies by as much as 30%, or in another embodiment by as much as 20%, and in a third embodiment by as much as 10% to a reference quantity, level, value or amount. As used herein, the singular form "a," "an," and "the" include plural references unless the context clearly dictates otherwise.

As used herein, "heterologous" or "exogenous" in reference to a nucleic acid is a nucleic acid that originates from a foreign species, or is synthetically designed, or, if from the same species, is substantially modified from its native form in composition and/or genomic locus by deliberate human intervention. A heterologous protein may originate from a foreign species or, if from the same species, is substantially modified from its original form by deliberate human intervention. By "host cell" is meant a cell which contains an introduced nucleic acid construct and supports the replication and/or expression of the construct.

EXAMPLES

Example 1: Identification of UGT Enzymes Having Activity Towards Cannabinoid Compounds The present inventors identified 171,569 UDP-UGTs from the literature and as characterized in publicly available databases. The sequences contained a total of 52,613 unique, characterized UDP-UGT sequences. Using proprietary filtering and unsupervised machine learning, it was established that these 52,613 sequences may be represented by 23,062 high potential representative sequences protecting groupings of 90% homology around each sequence. The large number of representative sequences is indicative of extreme diversity in sequence homology within the protein class. Due to this diversity, representative sequences were further grouped based on homology to known characterized structures of UDP-UGTs with a 30% sequence homology threshold to the structural template, a value well within field standards for structure homology. Structural homology of the enzymes appears to be much better conserved within the proteins than sequence homology. This allowed the present inventors to capture 9299 representative sequences in 40 structural groupings classified further into 3 larger structural groupings (Gram+Bacteria, GT-A, and GT-B). The representative sequence for each structural grouping was then docked in silico with both THC and CBD and ranked by strength of predicted interaction.

The present inventors have identified 9299 representatives (representing 90% homology to a larger number of sequences) UDP-UGTs predicted to have some action on cannabinoids including THC and CBD. These can be further represented in 40 structural groupings including primarily GT-A and GT-B fold enzymes but also including a few other unique structural groupings from gram positive bacteria that do not fit within GT-A/GT-B classification. While each sequence homology representative assigned to each structural group is expected to have some activity on cannabinoids based on known or computationally predicted activity of the structural representative, efficiency variation from sequence to sequence is expected and each sequence may be either more or less effective in glycosylation that the tested structural representative sequence. All predicted binding affinities presented here are representative of acceptably strong molecular interactions.

All 90% sequence homology representatives are provided as amino acid sequence in the appropriate structural grouping identified below. Structural groupings Identified by 4-digit RCSB PBD ID code representing best structural template with number of sequences in group:

GRAM+
- 1182 sequences_30/5tzk_sequences (SEQ ID NO. 1-1182)
- 40 sequences_30/3bcv_sequences (SEQ ID NO. 1183-1222)
- 583 sequences_30/5hea_sequences (SEQ ID NO. 1223-1805)
- 20 sequences_30/6h21_sequences (SEQ ID NO. 1806-1825)

GT-A
- 3 sequences_30/1g9r_sequences (SEQ ID NO. 1826-1828)
- 157 sequences_30/2z86_sequences (SEQ ID NO. 1829-1985)
- 468 sequences_30/3ckj_sequences (SEQ ID NO. 1986-2453)
- 673 sequences_30/3e25_sequences (SEQ ID NO. 2454-3126)
- 304 sequences_30/3fly_sequences (SEQ ID NO. 3127-3430)
- 51 sequences_30/4dec_sequences (SEQ ID NO. 3431-3481)
- 158 sequences_30/5mlz_sequences (SEQ ID NO. 3482-3639)
- 54 sequences_30/5nv4_sequences (SEQ ID NO. 3640-3693)
- 1006 sequences_30/6fsn_sequences (SEQ ID NO. 3694-4699)
- 560 sequences_30/6p61_sequences (SEQ ID NO. 4700-5259)

GT-B
- 1031 sequences_30/2acv_sequences (SEQ ID NO. 5260-6290)
- 663 sequences_30/2iya_sequences (SEQ ID NO. 6290-6953)
- 531 sequences_30/3hbf_sequences (SEQ ID NO. 6954-7484)
- 514 sequences_30/5g15_sequences (SEQ ID NO. 7485-7998)
- 245 sequences_30/3c48_sequences (SEQ ID NO. 7999-8243)
- 243 sequences_30/5nlm_sequences (SEQ ID NO. 8244-8486)
- 126 sequences_30/5du2_sequences (SEQ ID NO. 8487-8612)
- 76 sequences_30/2clx_sequences (SEQ ID NOs. 8613-8688)
- 70 sequences_30/5zfk_sequences (SEQ ID NOs. 8689-8758)
- 58 sequences_30/4rel_sequences (SEQ ID NOs. 8759-8816)
- 57 sequences_30/3otg_sequences (SEQ ID NOs. 8817-8873)
- 48 sequences_30/5v2j_sequences (SEQ ID NOs. 8874-8921)
- 44 sequences_30/2r60_sequences (SEQ ID NOs. 8922-8965)
- 42 sequences_30/4amg_sequences (SEQ ID NOs. 8966-9007)
- 39 sequences_30/4n9w_sequences (SEQ ID NOs. 9008-9046)
- 36 sequences_30/2pq6_sequences (SEQ ID NOs. 9047-9082)
- 29 sequences_30/4wyi_sequences (SEQ ID NOs. 9083-9111)
- 22 sequences_30/6bk0_sequences (SEQ ID NOs. 9112-9133)
- 16 sequences_30/6inf_sequences (SEQ ID NOs. 9134-9149)
- 9 sequences_30/3ia7_sequences (SEQ ID NOs. 9150-9158)
- 7 sequences_30/5d01_sequences (SEQ ID NOs. 9159-9165)
- 5 sequences_30/6ij9_sequences (SEQ ID NOs. 9166-9170)
- 5 sequences_30/6d9t_sequences (SEQ ID NOs. 9171-9175)
- 5 sequences_30/2jjm_sequences (SEQ ID NOs. 9176-9180)
- 1 sequences_30/3mbo_sequences (SEQ ID NO. 9181)

Example 2: Functional-Structural Grouping of UGT Enzymes

Figure 7:
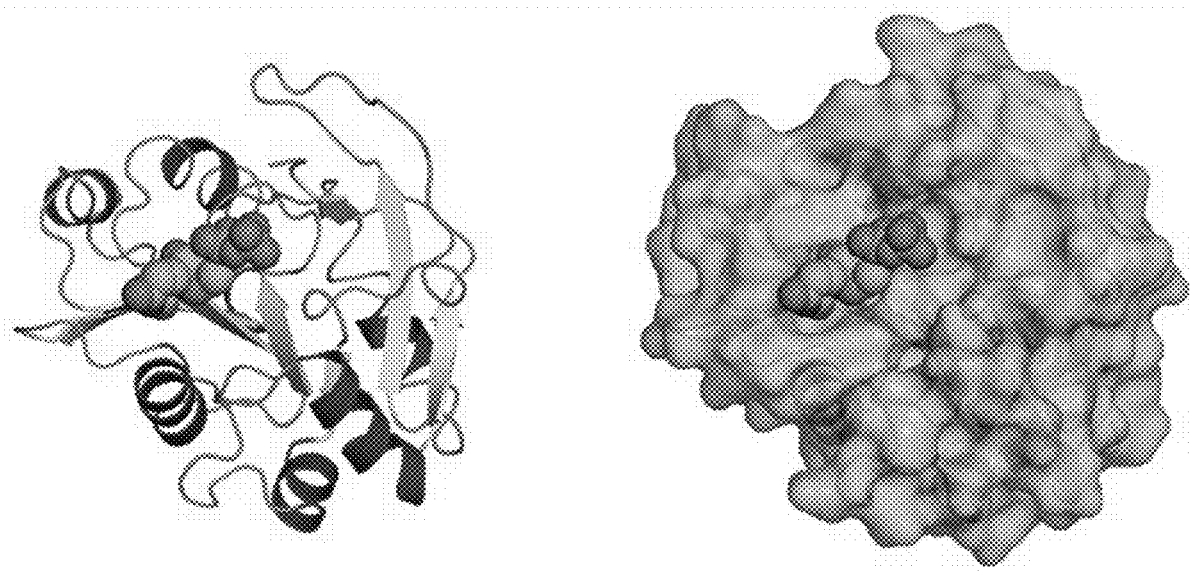
FIG. 7. Example of a GT adopting the GT-A fold (PDB ID 6P61). In the left panel, the enzyme is drawn as cartoons with the α-helices, β-sheet, and loops. Bound UDP is shown. In the right panel, the same protein view is shown but with the protein surface. The binding site for substrates is found on the surface pocket to the right of the UDP moiety.
Figure 8:
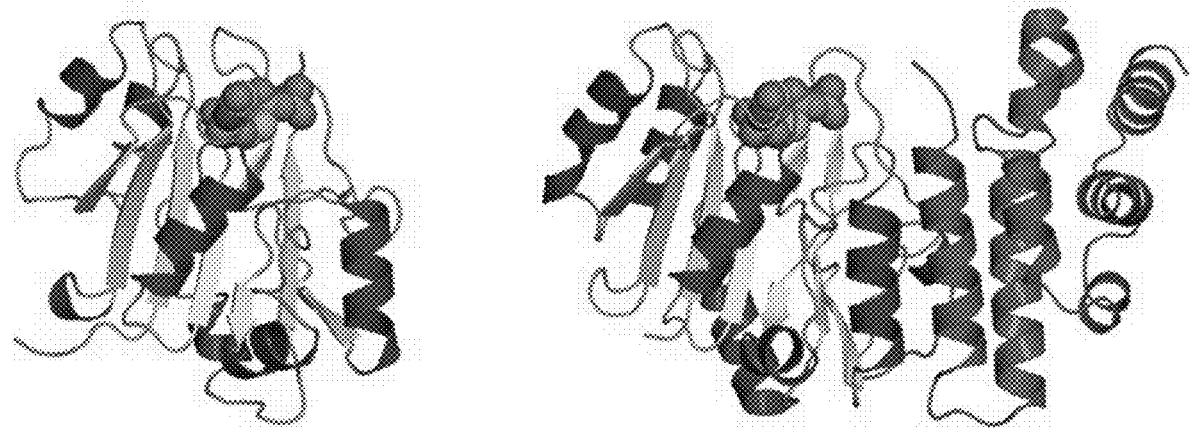
FIG. 8. Comparison of GT-A folds. The left panel shows the same enzyme (PDB ID 6P61) as in FIG. 1 but at a different orientation. The right panel shows another enzyme (PDB ID 5TZK; from *Staphylococcus aureus*) that has been structurally aligned with the protein on the left to highlight the similarity of their GT-A folds. The bacterial enzyme additionally contains an α-helical TPR motif that is involved in oligomerization.
Figure 9:
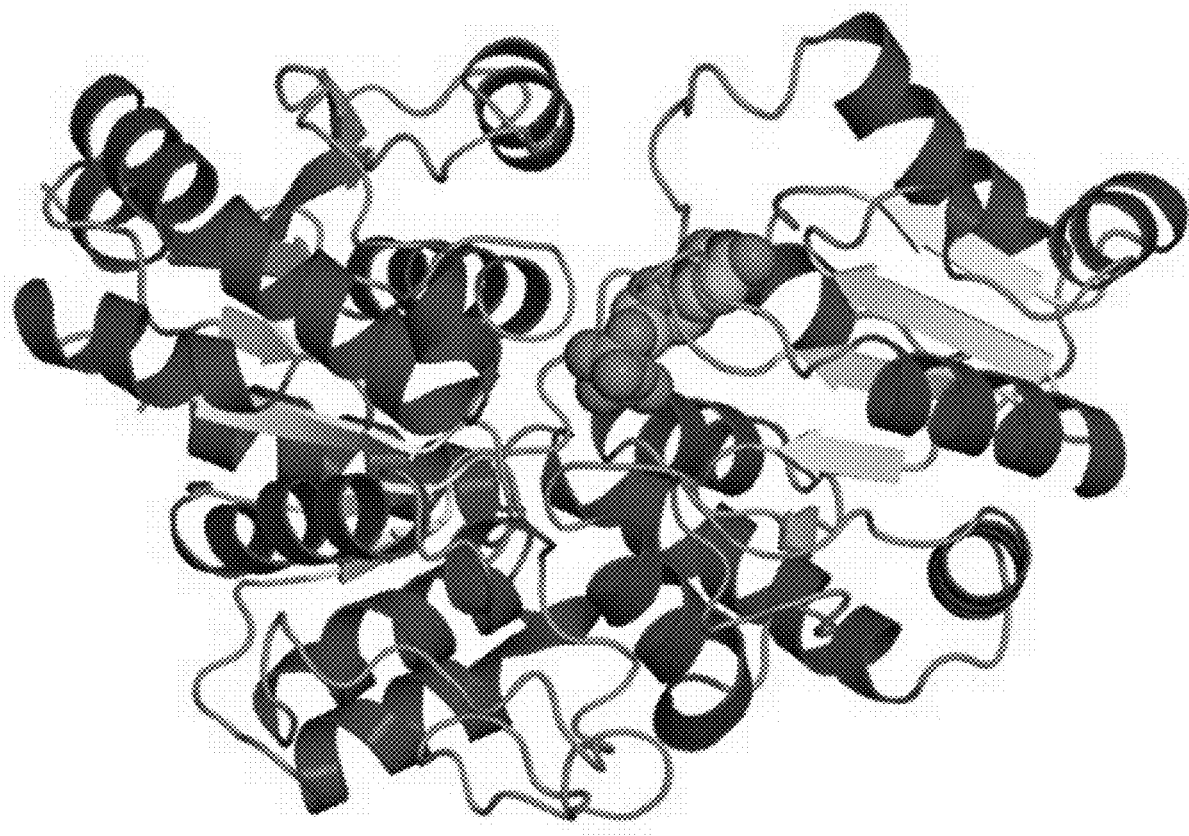
FIG. 9. Example of a GT adopting the GT-A fold (PDB ID 2ACV). The enzyme is drawn as cartoons with the α-helices, β-sheet, and loops colored red, yellow, and green, respectively. The N-terminal and C-terminal domains are on the left and right sides of the protein in this view. Bound UDP is shown in contact with the C-terminal domain. The binding site for substrates is found to the bottom-left of the UDP moiety, closer to the N-terminal domain.

The Carbohydrate-Active enZyme database (CAZy) currently groups UGTs (GTs) into 110 functional families comprising the so-called Leloir GTs (dependent on sugar nucleotides like UDP-glucose) and the non-Leloir GTs (non-sugar nucleotide-dependent). The Leloir GTs, which are the focus in this application, have been found to adopt one of two structural folds, termed the GT-A and GT-B folds. The GT-A fold consists of a single domain with a seven-stranded β-sheet flanked on both sides of the sheet by several a-helices (FIG. 7). Some bacterial GTs that adopt the GT-A fold also contain an additional tetratricopeptide repeat (TPR) motif that mediates the assembly of oligomers (FIG. 8). The GT-B fold consists of two distinct N-terminal and C-terminal domains that both adopt Rossmann-like folds (FIG. 9). The substrate is bound closer to the N-terminal domain while the sugar nucleotide is bound closer to the C-terminal domain. Of the 110 functional families listed in the CAZy database, 21 and 18 of these were respectively found to adopt the GT-B and GT-A folds.

TABLES

TABLE 1

UDP-UGT Structural Representative Cannabinoid Predicted Binding Affinity Tables:

| Structure | Affinity | Units |
|---|---|---|
| Gram+ Bacterial UDP-UGTs CBD Binding | | |
| 5tzk/min_ligand_CBD_01.pdbqt.log | −9.18445 | (kcal/mol) |
| 3bcv/min_ligand_CBD_01.pdbqt.log | −8.87895 | (kcal/mol) |
| 5hea/min_ligand_CBD_10.pdbqt.log | −8.58535 | (kcal/mol) |
| 6h21/min_ligand_CBD_10.pdbqt.log | −8.02499 | (kcal/mol) |
| Gram+ Bacterial UDP-UGTs THC Binding | | |
| 5tzk/min_ligand_THC_04.pdbqt.log | −10.76935 | (kcal/mol) |
| 5hea/min_ligand_THC_01.pdbqt.log | −9.44755 | (kcal/mol) |
| 6h21/min_ligand_THC_04.pdbqt.log | −8.46399 | (kcal/mol) |
| 3bcv/min_ligand_THC_01.pdbqt.log | −7.63992 | (kcal/mol) |

TABLE 1-continued

UDP-UGT Structural Representative Cannabinoid Predicted Binding Affinity Tables:

| Structure | Affinity | Units |
|---|---|---|
| GT-A UDP-UGTs CBD Binding | | |
| 6p61c1/min_ligand_CBD_04.pdbqt.log | −10.94076 | (kcal/mol) |
| 2z86c1/min_ligand_CBD_05.pdbqt.log | −10.7412 | (kcal/mol) |
| 5nv4/min_ligand_CBD_08.pdbqt.log | −10.473 | (kcal/mol) |
| 3fly/min_ligand_CBD_04.pdbqt.log | −10.18567 | (kcal/mol) |
| 3ckj/min_ligand_CBD_03.pdbqt.log | −8.43406 | (kcal/mol) |
| 6fsn/min_ligand_CBD_1.pdbqt.log | −7.49086 | (kcal/mol) |
| 1g9r/min_ligand_CBD_01.pdbqt.log | −7.3355 | (kcal/mol) |
| 3e25/min_ligand_CBD_03.pdbqt.log | −6.68012 | (kcal/mol) |
| 5mlz/min_ligand_CBD_2.pdbqt.log | −6.35057 | (kcal/mol) |
| 4dec/min_ligand_CBD_05.pdbqt.log | −4.73222 | (kcal/mol) |
| GT-A UDP-UGTs THC Binding | | |
| 2z86/min_ligand_THC_01.pdbqt.log | −10.78944 | (kcal/mol) |
| 3fly/min_ligand_THC_04.pdbqt.log | −10.65424 | (kcal/mol) |
| 6p61/min_ligand_THC_03.pdbqt.log | −10.64424 | (kcal/mol) |
| 5nv4/min_ligand_THC_10.pdbqt.log | −9.39469 | (kcal/mol) |
| 3ckj/min_ligand_THC_08.pdbqt.log | −8.40829 | (kcal/mol) |
| 6fsn/min_ligand_THC_2.pdbqt.log | −7.73952 | (kcal/mol) |
| 3e25/min_ligand_THC_10.pdbqt.log | −6.95711 | (kcal/mol) |
| 1g9r/min_ligand_THC_02.pdbqt.log | −6.65493 | (kcal/mol) |
| 4dec/min_ligand_THC_01.pdbqt.log | −6.05658 | (kcal/mol) |
| GT-B UDP-UGTs CBD Binding | | |
| 3otg/min_ligand_CBD_01.pdbqt.log | −15.46188 | (kcal/mol) |
| 3hbf/min_ligand_CBD_06.pdbqt.log | −11.14495 | (kcal/mol) |
| 5nlm/min_ligand_CBD_07.pdbqt.log | −9.32883 | (kcal/mol) |
| 2c1x/min_ligand_CBD_06.pdbqt.log | −8.6653 | (kcal/mol) |
| 6d9t/min_ligand_CBD_02.pdbqt.log | −8.23633 | (kcal/mol) |
| 5v2j/min_ligand_CBD_07.pdbqt.log | −8.21936 | (kcal/mol) |
| 4rel/min_ligand_CBD_05.pdbqt.log | −7.98206 | (kcal/mol) |
| 6inf/min_ligand_CBD_10.pdbqt.log | −7.9467 | (kcal/mol) |
| 5gl5/min_ligand_CBD_05.pdbqt.log | −7.8509 | (kcal/mol) |
| 6ij9/min_ligand_CBD_06.pdbqt.log | −7.61328 | (kcal/mol) |
| 2jjm/min_ligand_CBD_05.pdbqt.log | −7.52191 | (kcal/mol) |
| 5du2/min_ligand_CBD_04.pdbqt.log | −7.32558 | (kcal/mol) |
| 2pq6/min_ligand_CBD_05.pdbqt.log | −7.27422 | (kcal/mol) |
| 2iya/min_ligand_CBD_07.pdbqt.log | −6.92545 | (kcal/mol) |
| 3ia7/min_ligand_CBD_02.pdbqt.log | −6.76971 | (kcal/mol) |
| 4amg/min_ligand_CBD_09.pdbqt.log | −6.72897 | (kcal/mol) |
| 5d01/min_ligand_CBD_09.pdbqt.log | −6.55769 | (kcal/mol) |
| 3c48/min_ligand_CBD_3.pdbqt.log | −6.52731 | (kcal/mol) |
| 2r60/min_ligand_CBD_07.pdbqt.log | −6.43231 | (kcal/mol) |
| 4wyi/min_ligand_CBD_01.pdbqt.log | −6.3941 | (kcal/mol) |
| 6bk0/min_ligand_CBD_06.pdbqt.log | −6.0637 | (kcal/mol) |
| 3mbo/min_ligand_CBD_02.pdbqt.log | −5.92157 | (kcal/mol) |
| 2acv/min_ligand_CBD_02.pdbqt.log | −5.37595 | (kcal/mol) |
| 4n9w/min_ligand_CBD_09.pdbqt.log | −5.32776 | (kcal/mol) |
| 5zfk/min_ligand_CBD_10.pdbqt.log | −5.1177 | (kcal/mol) |
| GT-B UDP-UGTs THC Binding | | |
| 3otg/min_ligand_THC_4.pdbqt.log | −15.36588 | (kcal/mol) |
| 3hbf/min_ligand_THC_02.pdbqt.log | −10.84724 | (kcal/mol) |
| 5v2j/min_ligand_THC_08.pdbqt.log | −9.85188 | (kcal/mol) |
| 4amg/min_ligand_THC_02.pdbqt.log | −9.13889 | (kcal/mol) |
| 2c1x/min_ligand_THC_02.pdbqt.log | −8.50937 | (kcal/mol) |
| 2jjm/min_ligand_THC_09.pdbqt.log | −8.32614 | (kcal/mol) |
| 6d9t/min_ligand_THC_08.pdbqt.log | −8.12303 | (kcal/mol) |
| 4rel/min_ligand_THC_07.pdbqt.log | −7.83388 | (kcal/mol) |
| 2pq6/min_ligand_THC_01.pdbqt.log | −7.68854 | (kcal/mol) |
| 2r60/min_ligand_THC_01.pdbqt.log | −7.60612 | (kcal/mol) |
| 5nlm/min_ligand_THC_08.pdbqt.log | −7.58146 | (kcal/mol) |
| 6inf/min_ligand_THC_09.pdbqt.log | −7.08419 | (kcal/mol) |
| 5gl5/min_ligand_THC_01.pdbqt.log | −7.03571 | (kcal/mol) |
| 5d01/min_ligand_THC_5.pdbqt.log | −6.98384 | (kcal/mol) |
| 5du2/min_ligand_THC_01.pdbqt.log | −6.78902 | (kcal/mol) |
| 6ij9/min_ligand_THC_1.pdbqt.log | −6.60719 | (kcal/mol) |
| 2iya/min_ligand_THC_07.pdbqt.log | −6.36888 | (kcal/mol) |
| 2acv/min_ligand_THC_01.pdbqt.log | −6.26508 | (kcal/mol) |
| 6bk0/min_ligand_THC_04.pdbqt.log | −5.81022 | (kcal/mol) |
| 4wyi/min_ligand_THC_1.pdbqt.log | −5.72502 | (kcal/mol) |
| 3ia7/min_ligand_THC_02.pdbqt.log | −5.70649 | (kcal/mol) |
| 3c48/min_ligand_THC_3.pdbqt.log | −5.65728 | (kcal/mol) |
| 5zfk/min_ligand_THC_1.pdbqt.log | −5.63526 | (kcal/mol) |
| 3mbo/min_ligand_THC_02.pdbqt.log | −5.544 | (kcal/mol) |
| 4n9w/min_ligand_THC_02.pdbqt.log | −5.3822 | (kcal/mol) |

TABLE 2

Amino Acid sequences of cannabinoid-binding UDP-UGTs according to structural groupings

| | SEQ ID NO. |
|---|---|
| GRAM+ | |
| 5tzk | (SEQ ID NOs. 1-1182) |
| 3bcv | (SEQ ID NOs. 1183-1222) |
| 5hea | (SEQ ID NOs. 1223-1805) |
| 6h21 | (SEQ ID NOs. 1806-1825) |
| GT-A | |
| 1g9r | (SEQ ID NOs. 1826-1828) |
| 2z86 | (SEQ ID NOs. 1829-1985) |
| 3ckj | (SEQ ID NOs. 1986-2453) |
| 3e25 | (SEQ ID NOs. 2454-3126) |
| 3fly | (SEQ ID NOs. 3127-3430) |
| 4dec | (SEQ ID NOs. 3431-3481) |
| 5mlz | (SEQ ID NOs. 3482-3639) |
| 5nv4 | (SEQ ID NOs. 3640-3693) |
| 6fsn | (SEQ ID NOs. 3694-4699) |
| 6p61 | (SEQ ID NOs. 4700-5259) |
| GT-B | |
| 2acv | (SEQ ID NOs. 5260-6290) |
| 2iya | (SEQ ID NOs. 6290-6953) |
| 3hbf | (SEQ ID NOs. 6954-7484) |
| 5gl5 | (SEQ ID NOs. 7485-7998) |
| 3c48 | (SEQ ID NOs. 7999-8243) |
| 5nlm | (SEQ ID NOs. 8244-8486) |
| 5du2 | (SEQ ID NOs. 8487-8612) |
| 2c1x | (SEQ ID NOs. 8613-8688) |
| 5zfk | (SEQ ID NOs. 8689-8758) |
| 4rel | (SEQ ID NOs. 8759-8816) |
| 3otg | (SEQ ID NOs. 8817-8873) |
| 5v2j | (SEQ ID NOs. 8874-8921) |
| 2r60 | (SEQ ID NOs. 8922-8965) |
| 4amg | (SEQ ID NOs. 8966-9007) |
| 4n9w | (SEQ ID NOs. 9008-9046) |
| 2pq6 | (SEQ ID NOs. 9047-9082) |
| 4wyi | (SEQ ID NOs. 9083-9111) |
| 6bk0 | (SEQ ID NOs. 9112-9133) |
| 6inf | (SEQ ID NOs. 9112-9133) |
| 3ia7 | (SEQ ID NOs. 9150-9158) |
| 5d01 | (SEQ ID NOs. 9159-9165) |
| 6ij9 | (SEQ ID NOs. 9166-9170) |
| 6d9t | (SEQ ID NOs. 9171-9175) |
| 2jjm | (SEQ ID NOs. 9176-9180) |
| 3mbo | (SEQ ID NO. 9181) |

SEQUENCE LISTING (9181 sequences)

SEQ ID NO: 1 - protein, 256 aa, Unknown
  Description of Unknown: Fusobacterium necrophorum sequence
MSLSVAMITYNEEKILEKTLRSIADLANEIVIVDSGSTDGTREIAEKYGAKFVHQNWLGYGPQRNKAIQLCQSEWILNIDADEEISPKLYDKIQKILQEPVKYKVYKISFTSVCFGKKIYHGGWSGAKKVRLFYRGSGAFNHNTVHEEFETLEEIGSLQEEIFHHSYVNLEDYFTKFNRYTTEGAKDAFQKRKKVGALKIVLEPFYKFIRMYFFRLGFLDGLEGFVLANTSAMYSMVKYYKLHELYEREKESHGSS

SEQ ID NO: 2 - protein, 256 aa, Unknown
  Description of Unknown: Flavobacterium sp. 270 sequence
MNKEKQKLSVLIITLNEELHIQSLLEDLDFADEIIVVDSFSNDKTVSIIEGFQNVKLIQNKFVNYTSQRNFALDQAKYSWILFLDADERLTPDLKSEILSKINDSNPASAYLIYRIFMFKNVKLNFSGWQTDKIFRLFNKSKCRYAEERFVHEKLNVDGTIAVLKHKLIHYSYADYADYKLKMKNYGILKAQEKQKKGQKSSFLLMAFHPLYSFLYRFLIRLGFLDGIKGIIICYLNAYSIFIRYKELRRLTSSRI

SEQ ID NO: 3 - protein, 274 aa, Cystobacter fuscus
MIGPDNPRVLLSAAVMTKDSLRTLPECLDSLDFCDEIVVVDDHSTDGTWEYLQSRGAKVRAFQRKLDTFASHRRAMCAQARGEWVLIVDADEKALPGLGEEIRALLGRGSPRHDAYHVPQKNTLPDHWPRPVYFWTSQKRLLRLAKVRWEDSEWIHVPALHEGKAGRLEHGLSHRSYDSVSHLLRKQISYAQSGAKHFHARGRRASLASAVSHTVGAFFKFYLLKGLCRFGMGGLTVATALAFHVFAKYALLWEMNSGRASAGERARVPGDTHV

SEQ ID NO: 4 - protein, 251 aa, Unknown
  Description of Unknown: Sphingobacterium faecium sequence
MNQKLSALVITYNEEKNILDVIKCLDFANEIIIVDSFSDDQTVTLAKKNPKVRVYQHKFEDFTKQRNLAISYATNDWILFLDADERLTVPLQKEIQNIINDSTAHDAYYVYRTFFFCNKKIRFSGTQNDKNFRLFRKSKAKYRELKKVHETLDVNGTIGILKHKILHYSFSDYQSYKNKMIHYGILKGQELQLSHKKYNLVTHIAKTSFKFFKAYIIKLGILDGKEGWEISYLQSLSVHHTYLSLKRKKQI

SEQ ID NO: 5 - protein, 676 aa, Halovibrio sp.
MPTPAPARIGSFVFSALFLVTLTGGLIVDSLLSGGVYLLSLCGLVLIGYSRLRGRRPIATGDREVKLIGFALAFFAVVSLASWVINGFGYEGFKDLGKHGRLLLFWPLFIIFSWTRLKDTALFWGLALASMAAGLIAVEHTMWGVSGGRAEGATNPIPFGNLSLLLGTMLLAVLPVLRRERLWGGALAALAAIFFAFTAAYLSGTRNNLIAFPVLLLFLIIAGKPHQRWLSGALGGLTLALFVGLDSRMSSGFSGLLGGMVDNGIQFRFDIWQKALKLFLEAPILGVGSQGYADAIHQGVASGNLNEGLIGCCDNHAHNDLLQVLATRGLLGALSWSLLLLIPFVQFARLTRHENGRVSAMATAGCLIPLAYLLFGLTEATFMRGIYLSFYLLTVTTLTYVVWRTVAENLQGRREQYLSTIIITYNEADNIRDCLASVQPVSDEIIVVDSGSTDETVTIAKEFTDNITVTDWPGFGLQKQRALEQASGDWVLSIDADERLTSYLAREINHELSHQPRADAYKLPWAVTLYGKRLDFGRSGRAPLRLFRREGVRFSDAMVHEKILLPEGRRTVTLRGRLTHYTHRDFGHALEKSAKYAWLGAQERYRKGRRTKTLIYPTFRAIVTFVQVYILRLGFLDGPVGFLVAMTYTQGAFNKYAGLWTLTRAESTKPRGKTAK

SEQ ID NO: 6 - protein, 257 aa, Prevotella dentasini
MEKKDISVVINTYNAEKFLQRVLDSVRGFDEVVVCDMESTDHTVEIARRNGCKVVTFPNNHVCAEPARTFAIQSAQGKWVLVVDADELVTPELKDYLYGRINRPDCPEGLYIPRRNRFMNIMKKGLPKDYQLRFFIREGTVWPPYVHTFPQVKGRTEYIDNHLKNVVLVHLIENYIDDRLEKYNRYTTGEVEKKKGKRYGVGALLFRPFWRFFKSYFMDGEIRNGITGFIDSVMTGFYQFILVAKVIEHRLKEKDER

SEQ ID NO: 7 - protein, 422 aa, Cellulosilyticum ruminicola
MKLSLCIICKNEEKKIARCINSVKEKVDEIIVVDTGSTDETIQIVKKLGAKVFEIPWENDFSKARNYAIDKSKGNWIIFLDADEYLMDMDLKGLRNQILTAENMKGEAIFCNIINENSDSIQNIFKTIRIFKRDPKIRYTGKIHELLNKEDGQIQLVDLADYIRIRHDGYSQDTVVEKNKMDRNLEMLLKEYELNPTSSDLCYYLMETYHGTREFEKAWSFGQKVLEYNNDTLSGIRQNTYNRLLELAPRIKKTSEEIKNLYEEAIQYDNSYPDFDFRYACYLYEQEKYDQVIEYIQVCLEKMETYSGTAASKTMGNLVGVLKILVQSYIVKERFQEAVPLLVKILRIDLYDYTTLYAFIQILDKTESGAAIGEFLCKLYDYTNIKDQMVLLKVVHKIGNLELLEYLMKRANPTVLQKIGLK

SEQ ID NO: 8 - protein, 251 aa, Polaribacter sp.
MTKISAIIPTLNEEIHIANAIKSVSFADEIIVIDSYSTDKTLEIAEKLNVKIIKRKFDDFSSQKNFAIQQATYDWIYILDADERVTPEVEKEISEAVKKPGNFVGFYVRRSFYFANQKVNYSGWQRDKVVRLFLKDKCHYRGVVHETIVSKGELGFLKNKIDHFGYRNYNHFIAKINHYSILKAQELHKKGKKVNAFHLLIKPTARFFIHYVIRLGFLDGLTGLILSKILAYSVFTRYIKLWLLNKGIEEN

SEQ ID NO: 9 - protein, 271 aa, Gimesia maris
MFDSPVNRDSFLSSIKVSFMSLSIIVIVKNEESSIRECLASVAWADEIIVLDSGSSDQTVAICREYTDKVYETDWPGFGPQKNRALEYATKDWVLSIDADERISYDLQTEIKRVIQMPARFDAYTMPRRSNYCGRYMKHSGWWPDRVVRLFRRGKASFSDDLVHERIVVAGKTGKLREPIIHESLLTLEQILNTMNSYSTASAKMLAEEKQQAGLCKAVMHGMWTFIRTYFLRAGFLDGKEGFMLAISNAEGTYYRYLKLMVINKANQKEV

SEQ ID NO: 10 - protein, 270 aa, Unknown
  Description of Unknown: Calditrichaeota bacterium sequence
MIPVSVILITKNEEENIQRCLNSVSWADEIVVVDTGSSDRTVEIALRYTDKVYVTDWQGFVKTKEYAIAKARNQWIFWIDADEEVTVELRNSILNLTDDQLQANRAFAMNRRTYFMGRWIKHCGWSPEIVVRLFYKNWARFSRDSVHERLIVEGKIGHLSGDLLHYTDQNFKHYFKKFHHYTELAAQDLFVKGVTVRWWAVTLRALAAFFKIYFLKRGFLDGIQGFQIATLTSFYIFVKYFKLWELQRTHGSAHFRPGLRQSKTKECAGS

SEQ ID NO: 11 - protein, 1200 aa, Selenomonas ruminantium
MPYISACVIVRNEEKNLPRWLACMSELADEMVVVDTGSTDNTMEIAEQAGARLFSFPWINDFAAAKNYALEQAKGDWIIFLDADEYIKPQDHACVRELIRQNDQRKDILGFVNPLINVDQDKDNAYISTIYQIRVFRNLSDLRYVGAIHEILQYRGQAEKNMPLLEYYAIYHTGYSARLMPDKYQRNLQMLELSVKKYGWRLLDDFYFADCYYGLQQYERAIKHAKSYLTAKERVLGEESRPYGILLQSMIFLSYPLSEILAWGQKALEEFPYGAEFKILEGYAREATGDEQGALRCFDEADRLYSEAGKNGAGKMLSDEAGGVMSAMHARREALQKRMQQRKQERQTGGVKDMVYTSACVIVRNEEKNLPRWLACMSELADEMVVVDTGSTDNTVELAKQAGARLFSFPWINDFAAAKNYALEQARGQWIFFLDADEYWTEKDFAIIHKNLRQYDQQKNVIGFVCRLVNIDVDNDNRILNENMHIRIFRNLSQLRYTGAIHEQLVYSGTGQKEMKLLPKAVIYHTGYSASTDLYKAKRNLQILLELQENGKGQESDICYITDCYYSLKDYAKAAEAAQEAIRRQVVLPGRETRMYCTLIQSLHLLGHKWQEILPWVEQGERDFPHVPDFRALLGFAAWHDGAKTEARQFFQQSKALYQEFLAHRQDVTAAFADEMQGFLPKMEAYLAEDNNSSAIKISAAVIVKNEEENLPQWLSCMQALAGEIIVVDTGSTDNTVAIARQAGARVVHFEWVDDFAAAKNFAINQTNGDWVLLLDADEYIPKEDYGGLQAAIARVHADSNVIGLASEWINVDKTKNNAYINKGYQIRVFRKMPELRYVHMIHERLQYNGNEKKSMPVTNDFRIYHTGYSTGQMAAKYKRNLRLLQLSAEKYGKRPEDEAYMADCYFGMQEYEQAMAHAQAYLESTGRTDGAENRPYGVWIQSLIFLQRPLEEIAAVVNKALTEFPYSAEFKIMEGGTREDKGDFSGAEICYREAARLYAYAKQHDIWRQNLLSDEAGTVMPEVYARLCRLLMWQGNGEEAWEYLQKSLAMDKYIPLACRLLGRFLAERDDVDWIEVFNQLYDKQRDAAFILEHLPHTGRDKVRLYYQRQLGMSEQSAYIMAGRLEAAGAALAEDTAALLQLGIRGFAHDVGTMDKIGVLLSQNYRMVATGQAKTAAERSLARKTARIQGWLAKQDGLAE

SEQ ID NO: 12 - protein, 254 aa, Unknown
  Description of Unknown: Chryseobacterium taichungense sequence
MTEHGVMNVSGLIITYNEEKNIQEVLECFDFCDEIIVVDSFSTDKTVEIAQKFPKVRVIQNRFEDFTKQRNIALDAAKNDWVLFLDGDERITAPLKKEIIEELKKPVPKDAYYFYRKFYFAEKPIHYSGTQTDKNFRLFRKSKARYITGKKVHETLHVNGTTSEMKNKLLHFSVNDYESYKTKMIHYGVLKGQELAARGKKYNRITQYSKTAFKFFKAYILRLGILDGKEGYQLSYLQSLSVFETYESLKKEQN

SEQ ID NO: 13 - protein, 249 aa, Unknown
  Description of Unknown: Candidatus Amesbacteria bacterium GW2011_GWA1_47_20 sequence
MLTSIIIAKNEESMIGECLLSLAFSDEIVVVDSGSTDATVDIAESHRAKIVTCREDSYATRRNLGLKAARGSWILYVDADERVTPLLKKEIEQIMSSPDSVQVYQIPRKNIYLGREMHFGGWGGDRVIRLFKKSALQRYVGELHEQPVFSGELRTMNHELVHYSHRDLTSMLNKTLDFTTYEARLRLATGHPRMSWWRFVRVMFTEFWLRFVKLFAWRDGVEGVIDGVFQVFNSFVIYARLWEMQLVKK

SEQ ID NO: 14 - protein, 252 aa, Unknown
  Description of Unknown: Phascolarctobacterium succinatutens sequence
MNNNLTVVVLTKNEEKNIVAVVQNAKKVAAEVLIVDSGSTDKTVQLAEENGAKVVYRAWDNDFAAQRNFALQHVETEWVLYLDADERMNDELLASVKNAVGNDKTCQYSIKRKSVAFGQEFNYGVLKPDFVPRLFKTKNVHWVNKVHEKPMCKDELKVLGGYIEHYTYTGWQQYFNKFNQYTTIWAQNAYENGKKVGYFTAYGHAFFSFIQMLLLKKGILDGRLGITLSVYHFMYTLTKYIKLIDLQRGKEK

SEQ ID NO: 15 - protein, 313 aa, Prochlorothrix hollandica
MVNIPTKIPVSVLIPAKNEEKNLPACLNSVACADEIFMVDSHSDDRSVAIAQDYGAQVVQFAFNGHWPKKKNWALENLPFRNPWVLIVDCDERITPELWQDIDRAIQSPDYSGYYLNRRVFFLGRWIRHGGRYPDWNLRLFRHAQGRYENLDTSDTPNTGDNEVHEHVILDGKVGYLKHDMLHEDFRDIFQWLARHNRYSNWEARVYYNVLRGQGNRGTIGAKLLGDAVQRKRFLKRIWVRLPFKPLLRFVVIYILQLGFLDGRAGFIYACLMSQYEYNIGVKLYELRRFGGTLNTKATVAANLKQRDTQELF

SEQ ID NO: 16 - protein, 615 aa, Paenibacillus sp.
MKISACLITKNEEANIRRCIDSFKEIVNEIILVDTGSTDNTVEIAKELGAKVFFFEWNNSFADARNYALDQASSEWIVFLDADEFFYKDTAKTIPPVLQKINNNKNIDALLLKHLSIDGREEKVIQTNSLVRVFRGNTNIRYKGNIHESVFKEGDTVKLFNSTNLDLKIYHTGYSGEIISTKAERNLELLLIELANNSKNKLNYLYLSDCYITLGQYDDAIKYGQMFIESGASAVGLNSKPYHNIIRSMKQLGYSYEEKKRTIFKAIDRFPSHPDFYKYLAVEYFNNKEYIRALEAFNKVIELQSKYKDIELNTIPGLLTDIYYYMGILYEYKNDAGSAFDHYFNSLSENKYNENSFYSLINLIKKENPEDIILLLNRIYHKSVEEDVRFLVTKLSTVKLGKVLLFYWKIWNSQYRYEDSTLMFALLSNGNYEAAYSCFYKCYLEERTDWTALFTVVSSILSNSTIEVDQTEDFPISYKKIILLYTGQATDQILLKEELLVYMNLITEMILLDNRQVVNALLNLKSNFEIDISTAIGSTLMDYRIYDLAIEHFAEALDNTSEDMQKSKLYFNIGYCHFKLVNYSLAKESFMMAQRHGYNANNVYDYMTWVNNLIK

SEQ ID NO: 17 - protein, 638 aa, Sporomusa silvacetica
MTKISACIITKNEAMCISRCLQSVKDIVDEIIVVDTGSTDATVTIAEQFGTKVFHYSWGNDFAAVRNYALDQAKGDWIIFLDADEYIAAERIKNVRPIIEKVHGNRKIDAVRCQMKNLEGVNGSLRSSNPSMRIFRSSKAIRYIGKVHEYILKREKPVSAINVDSQMLVIYHTGYSKTTITEKIRRNTALLEEELKQGIVRRLTYYYLSDGYFQAGEYEKAIDFAQKAIKDMAQMNRDCDYKPYGILIESITHLKTFSEQEAIAICNEALGRFPHHPEIWLHQAYYYRSIGWYEKSLTSLLKAVETNACYNDFNRSNDFYQCSSMAYFDIAQIYEMKNQSAQALDYYVKALQQEKSNQAAFGGLISIIRNQEPAHVIYFLNTLYEIADERDIRFLVENLSRLKVKIVLDYYHKILRDKFDDKQLNGLMLLSNCKSDEVFPIFAELFRKHGNYGMELLAVIALLISEKPQWVDLLEANLQHSCRKVVAAYFQTEQDIQLSADEFPLFCDLLRELVYLGSSKQTETFLQIGKCFFSEKACTKIATILLEHGSFFCALDMYLHCINKTSSEAKQLSDLYCDAGYCCYRLKDFAGAASYFSQALKFGFNQNRIFDFLEWSYQQCPEEAIKEKFKMMKALHRN

SEQ ID NO: 18 - protein, 265 aa, Moraxella nonliquefaciens
MNQHSKQYPLSVVMIVKNEAKNLAISLPALDGLADEIIILDSGSTDNSRQIAEQYGAKWHVNTDWQGFGRQRQLAQSYATGEWILALDADEEISEELKNSILAVTKTKPNNTVYGLKRLDFILGHQIDNPYWGVKSYWRLYPKRFNFNNLLVHESLGTQNANTQSLSGFLNHHTAPNLEFLLNKRLEYAKIWAEDRHKKGKKSSLLKIISNPLWQFIRQYWIDGRFLQGRYGLIYSLIFTQYTFNKYLFLWQYNQRIKNNENIYY

SEQ ID NO: 19 - protein, 251 aa, Arcobacter sp.
MQKNITATIITLNEEKHIREVIENVQKVCDEVIVVDSCSTDKTIEIAESLGAKVIKQKYLGDGGQKAWCEQYAKNDWILSIDADERFEDEALEMIESIDLEKTQYEGFSFRRKSFIGKKYIRQWYPDRVVRLYDKSKCGYNTEGEHGAVQTKNFQELDVDMLHYSFTDFGMLVRKADRFAVNLAHVRYKEGKRASWYDPFLHGMGAFFKGMIIKGGILGGLHEWHVGFASAYNAYMKYVIMLELQENENNE

SEQ ID NO: 20 - protein, 252 aa, Arcobacter thereius
MSIKNISVAVLTKNNENTIINTLNSLTEFEDVVVYDNGSKDKTMEIAKSFPNVNLVQGEFKGFGWTKNQAASFTKNDWVIIIDSDEVVNKDLIDELKIKNLEDNTVYRLNSNGYYKDIQVKYCGWTLTVKRLYNKRITSFNSKDEVHEHVLSNDLKEEVLKGSINHYSYHSISEFIIKADRYSTLFARNNAGKKVSSPTKAFFNGVYSFFRTYILKQGFKDGYVGLIIAFSHMVTNFYKYIKLYEANKELKK

SEQ ID NO: 21 - protein, 1319 aa, Mitsuokella sp.
MKLTACYMVKNEARNLPRSLASIRGAWDELIVVDTGSTDATKEIAASFGAHVLDVPWCDDFSAPRNAALEQARGDWILFLDADESFEKSKDLRAQLDGLMQESVDAWLLPLKNVEEGSAGAAAGNVQYLLRLFRNRADLRYRGRIHENIVRRDAELVWKYAPQKLLLLHTGYASHISREKAERNIRILLQEAKREGDAVTYSAYLADAYHGLGEYERAKYYAMLAIDNGVVTIGNRTGLYHLVQECMRHLGYPLEEQLAWAQKTKKQFQNHPDSLAECGIVLSSMGRLAEAKKNLSAALQHYEAKDYDKGYGSFFYDGIAEQIADRLKTIAVIEKDEAEAAHWEAQAMRYKKRQRGECESVRISACYIVRDEAEELRRSLESVAGEVDDIVLVLTGKDSAAAEVGQSFGARCQTFDWCDDFSAARNAAIEAARGDWIVFLDADEYLSEKTRGNLRSMIEREAEKGTQQLLFPIRNIEAGTGETLLVSCATRAFARKEGRAYVGRIHEEIRDDAKGTPRLVEPMRRIAETELMLIHTGYSAARSKEKAERNLRILLKELVTAAYPESLYMYLAEAYDGIGDAEHAIYYAKRDLATGGHKGVAYASRSHRILLRLYAESRQYEARMKVAEQAVHDFPDLPDFHAEYAECLADALDYETALTESERAAKLAAAYHGIEPSMLDPAALSVMERRRAVWQAICVRAAEMKLFACLIVRDAGKDFAIWAENAKAYADALIVVDTGSKDGTRERAVEAGARVITLAWQDDFAAARNTALAAAKEAGADWVTVLDADETFFDPSKVRLFAARTDLSMETIDAVQLPILHVDEDDGGREIKRQPYIRLLRMGRGLFYEGRVHEQLRKAGGEPAIWTEGRHLSIRHTGYSMGRIREKVRRNLALLLQEIAEGGKKPYHDRYLADCYYGLGDYEKALAHARAARRSPVHSIGAESDLFRLMLDAMRELSAPRTEQAALAREAVAAFPLLPDFYGRLGILLAPSAPTEALPLLQKAIALAETGTDGKEASQFADEAAETHAALAACHFACGAREAAEREALMAISLDGHEAQALDVLCALHADGGEGELAALLVSILGEGDAVRPYLLRFAESYGHIALYRQLSKDWQTECEIGAFYDKAKEEEAASLLAKLAPEAAQHIREAPAVLLMLERQETPEAAHLALRLAALMPPAMQALWQAYRGADLPHGAWADGWNLFALAFVRWGSDAQVVRVLPLVSALGDAEKAAFFHQLVMGRRFAAAVSSAGLVPADSPAANGKFWYDLGRAFFAMDERKTARECWERAISLDPAHGGACAYLVWTAQDDGEKEGRA

SEQ ID NO: 22 - protein, 251 aa, Nitrospira sp.
MSKLSVYVIAYNDEPNMRACLESVAGWGDELIVVDSHSTDQTAAISCEFTNKVYQVDFKGFGDLRNQAVALTTHEWVFSLDSDERMTPELREEIRQLLDRGPEADAYFVPRKNYFLGRWIEHCGWYPDYRQPQLFRKGRFRYREELVHESFDCDGPVGFLKSPALQYPFRDIDHYVAKQDRYSDLMARRMTEQGRRFSSHQLITHPLGAFLKMYVQRAGFLDGMPGLILSGLYAYYTFIKYAKFWELTKKG

SEQ ID NO: 23 - protein, 254 aa, Parachlamydia sp.
MISVTILTKNSEKYLNQVLSALSLFDEVLIFDNGSTDGTLAIAAQFANVVIHQGIFQGFGPTHNLASSLAKYDWILSIDSDEIVTPELAAEIKQTVLSTACAYSFPRHNYFNGKFIKWCGWYPDRQVRLYNRTTTAFSEAQVHEAVETAHLTKKQLNFPLKHYSYESITDFLTKMQSYSELFALQNQGKKSSSISKAILHGFFAFFKSYLLKRGFMGGYEGFIISTYNANTAFYKYLKLREVNKEMCNNNLHTS

SEQ ID NO: 24 - protein, 248 aa, Unknown
  Description of Unknown: candidate division KSB3 bacterium sequence
MQTRQKLSVAIITFNEENRIRDALESVTWADEIVVVDSMSTDRTVDICCKYTEHVYQIPWHGHVKQKQIATDKTSHDWVLSIDADERVSPELAKEIQQALIGTPRYAGYYMPRKTYYLGDWIRHCGWYPDYKLRVFQKQKGGWAGKDPHDKVEVQGLTTHFRGNLYHYTYRDISHHVQTLNSYSSISAGLKTGSVSGAGIFFHTVFTFFKKYILKQGFRDGTRGLIVCLLASFTVMLKYAKLWERRNT

SEQ ID NO: 25 - protein, 274 aa, Unknown
  Description of Unknown: Candidatus Omnitrophica bacterium CG11_big_fil_rev_8_21_14_0_20 _43_6 sequence
MPETISIITNTKNESQALPKFFERHTWVDEILVMDSFSTDATIEICKKYGHNFHQAELAGNSNIRNNLALTLFKSDWVFFIDPDEFVSDELKQQIQSFLLAADNKYAAYEFPRINFFMDRPLRHGGWSGNTVRIFRKNRVEFKGDAYHDHPIVKGQIGRLSGVIYHYPNPNIYWIIQKFNYISEFDAKEYYNKFGVLSKRKYKWLLLTKPLKNFWKGYIKKKGYLDGWHGFIYAALIWAFDVIRICKYAEKYITKNPNILTPDKLADPWESRKA

SEQ ID NO: 26 - protein, 270 aa, Unknown
  Description of Unknown: Candidatus Woesebacteria bacterium GW2011_GWF2_46_8 sequence
MTKISAIILTKNSEKLIPDCLTSVSWTDEIVVIDENSSDKTREIAGKAGGKVFTFSGNFSEKRNFGAKKASGDWLLYVDVDERVTPLLRKEIRSRLAKREAPSSAYHQSPYVAYAIPRRNFVFGKELKYCGFWPDYVKRLFKKDKFRGWTGELHEEPNFEVDSEVVTGGKGKIGHLERPLTHLKHNNLSEMVAKTNEWSEIEARLMYEAKHPPMNLFRFSTAMFREFWLRMIKQKAFLDGTVGIIYAVYQVYSRFISYAKLWEMQIKTKK

SEQ ID NO: 27 - protein, 301 aa, Unknown
  Description of Unknown: Candidatus Pacebacteria bacterium CG_4_9_14_3_um_filter_40_12 sequence
MQNTPSLSVVVNTMNSEKFLELALASAAFADEIIIVDMHSTDATQKIAKKFTNKIFMFEDIGYVEPARNFAIEKATSDWILILDADEEIPNGLQLKIKDILTEPTFDAYYIPRSNEVFGYEMRKTGWWPDHQLRLFKKGVVTWSDKIHSVPTVAGTSEYLQAMPEIAIKHHNYQSVSQFVDRMNRYTDIEANNDSDVPMTTAMVITSFRDELLRRLFSHDGIQEGMHGVGLSFLQSFYQVLVILKKWEQRGFKQHSATEKETLTALKEFQRSLVYWTYAYEIEHGSPIQKVIARIKRKIGI

SEQ ID NO: 28 - protein, 290 aa, Acuticoccus yangtzensis
MRDLPVSVVVPVRNEEANLAACLARLNRFAEVLVVDSASTDRTLGIAREAGARIVQFEWNGRYPKKRNHVLMNERLAAPWVLFLDADEHVPNAFCDALAGVLPDTSHAGFWLNYTNYFQGVELKHGVPQRKLALMKVGAGLYERIEEDGWSSLDMEIHEHPVLAGSLGEIPVRIDHRDFRGLEKYIARHVDYAKWEARRYAVLHEAGLDKAGHLTGRQRFKYRNLSRWWYPWFYFAVTYGAKRGFLDGAAGFSHAFYKAWYFHTIRGLIAEARRVGAAAPSASSREDMAA

SEQ ID NO: 29 - protein, 241 aa, Chlorobium phaeobacteroides
MAENITVTILTKNSEKHLKECLEALELFDEIVVLDNGSTDDTIRIAGSFPNVRIFKHEFIGFGPLKVLAARNASHDWVLSIDSDEIVTRELVEEIRALRLEKKTVYAIRRDNYYNRSKIIGCGWENDWVNRLFNRQEAGFNTKLVHESLELKNEICVKRLHNPIKHYTFDNASHLIKKMEHYSTLWAEDHKGKKTSSPLKAVSRGMFTFFKSYILQRGLLSGYSGMVISVSNANGAFYNLN

SEQ ID NO: 30 - protein, 243 aa, Unknown
  Description of Unknown: Chlamydiae bacterium SM23_39 sequence
MITPVILTKNSEKTIKNTLNSIKSFEEIIILDTGSSDKTLQIAINFKNTKIFKSEFKGFGLLRNEAANKTKNDWILALDSDEIITENLLKELQNIELNENIVYSIPFFNFYNKKLIKCCGWHNKRHIRLYNKKTTKFDNSLVHEGVIYKNLQIKKLKNPIHHFPFNSISDFIKKIEKYSSLFAEENIYKKSSINKAIIHSLFSFFKSYFIKRGIFSGKEGLIISIYNSNTAFYKYLKIAERWF

SEQ ID NO: 31 - protein, 271 aa, Unknown
  Description of Unknown: Patescibacteria group bacterium sequence
MNNNSVPCTVAILTKNSGHTIARALESVKNFSDIVICDGGSTDDTLNIAEQYGARVIHQNPLLLDTEGRIADFGAVRNQTLDASREPWFFFLDSDEYISKELENEIRRVTTTQAEGVYALYRRYVVGGEEVMCATTYPNLSMRLFAKASVKRFIKKVHERIELKPGVVTEKVVGTLYVPVDGTQGPSPSKMDYYIQLQVNQEVLGASFWRQFFHTIWWHARVSLFYLLQLVKVRLFCRGKKMPLKIELSRHVYHVRLIRALWRRRKEFRKI

SEQ ID NO: 32 - protein, 233 aa, Sulfurovum sp.
MHKLSAVLISYNEEKHIAKALASLSFADEIVVVDNGSTDGTVEIAQSMGAKVIHHEWMGYGKQRQIAVSHASYDWIVTIDCDEQISPQLATSMQKELENPRYFVYRIANLNKFFGKYIRRAGMYPDYHMRFFHKGHATYNDKAVHEALVTQEVVGTLEGDILHDAYESIEQFIAKQNRYSTLNKRHNMVKAILNPYWTFFKIYFLRLGFLEGWRGFVIAKIYAQYTFWKYIKR

SEQ ID NO: 33 - protein, 260 aa, Unknown
  Description of Unknown: Candidatus Omnitrophica bacterium 4484_70.1 sequence
MEKVKLSVVILTKNEEDQIADCIKSVVDWVDEVVVVDDESSDKTVEIAKSLSARVLVKKMDIEGKHRNWAYQQAKNEWILSLDADERVTEELKEEIVTVLSKNIFDALAIPRKNFIGNYWIKGGGFFPSPQLKLFRKDKFRWEEVEVHPRAFLEGKCGCLRNALLHYTYKDWEGYLRKLNRQTTLEAWKWYKLSQVNPKKAGYKMNLLHTLWRVVDRFIRTFIIKKGYKDGFIGFMIAYFSSFYQLVSYAKYREFSKKQK

SEQ ID NO: 34 - protein, 278 aa, Unknown
  Description of Unknown: Candidatus Microgenomates bacterium sequence
MAEKGNFGLLQRKFRKRILEMKKELKLSVIILTKNEEDIIGDCLESVKWAPEVVVVDHYSTDQTLKIVKEHGINKIYVADEKSSFSERRDLGAQKAQGEWLLYVDADERVTPVLRKEVEEVIKDSNFSAYAIPRRNVRLTKELHFGGWWPDYVLRLMRKDKLKTWKGDLHEQPEIEGETGYLKEALVHFSHRGSLEHKFKNTINWSKIEAQKMFDAGHPPMNVKRFVSAMFREFYKRAVKLQAFRDGTEGIIEAFYQVFSVFISYARLWEMQIESKKK

SEQ ID NO: 35 - protein, 249 aa, Unknown
  Description of Unknown: Candidatus Aerophobetes bacterium sequence
  MOD_RES (117)..(117): Any amino acid
  MOD_RES (157)..(157): Any amino acid
MISAIVLTKNSSKTLGETLRSLRNFDDVVVLDTGSSDSTIEIAKSFPNVTLHHHSFSGFGHLRNLASNYTKNEWVLSLDSDEVLTDEAFEEIKSKKLEDTKVYSFPFDNYFNNKHIXWCGWYPDRHVRLFNKTSTSFSPDFVHERVLDEDMQEESLXFSIKHYSYGCVSDFLEKMQRYSTLFAQQNKYKKRSSIGKALLHSHFAFFKSYFLKRGFLGGKEGFIISMYNAQTAYYKYLKLWEANQEATCS

SEQ ID NO: 36 - protein, 356 aa, Bacillus sp.
MKISLAMIVKNEQRYIERCILSVNGYVDEIVVVDTGSTDNTLQILEKYKHVKVYQFQWTDDFSKARNYSIEKASGDYILILDADEYIIEGTRAELESVVQDNLIGRIKINSRFRKDNEIQIASAYISRFFPKNTRYEGEIHEQIISNLNRKKLKIKVGHDGYMDMNKGDRNIPLLIKALKKRPNDAYYLFQIGKELRIKKQYNEAYKFLIKSYHFSDKQSLFYEELVIEIINSGKECGDLKVLQVIDDNEYLLQNVSDYHFAKGLFYLDFCLSNIGETGRYLHKIESCFLACINLNEREHSEYLNGTSSFLAAYNLAVFYEVIGDFNNAIQYYNFSAKLGYNLARERLALLNKNDK

SEQ ID NO: 37 - protein, 260 aa, Thiohalomonas denitrificans
MSSVRPHTLSVCIITLNEADRIERCLRSVREIADEIIVLDSGSTDGTIDIVKRYTDKVWVTDWPGYGPQKQRALDKATQEWVLSIDADEALDETAQQALKTLLEQPIIEEVAFKLQWAVIRHGARLRFGRSARAPLRLFLRENASFTMDQVHEAIQHKHGKVGKLQGYLLHYTARDYGHALEKNAKYAWLGSQKYYDRGKRNRSLSLVFMRAIWTFFWIYVIRGGFLDGRIGFIVAMNYAQGNFNKHVGLWLLTRENKSD

SEQ ID NO: 38 - protein, 276 aa, Unknown
  Description of Unknown: Candidatus Nealsonbacteria bacterium CG_4_10_14_3_um_filter_36_ 16 sequence
MKLPISVIILTYNEEINIENCLRSVADWANEVIIVDSFSTDKTLEIARKYTNKIAQRTFVNQAQQFNWALENLDIKSDWILRLDADEYLTQELKNEIRVNPLLNNQDPRQSASIVNGFYIKRRVYFMGRWIRHGGYYPTWILRLFRKGKARSELRAMDEHIVLSEGKAEKLKNDFIDDNRKGLEDWINKHNNYSSREAADVLSGNYGRGKKKFYYWLPLFCRAFLYFIYRYFFRLGFLDGKEGLIFHFLQGFWYRFLVDAKLFEIKRVGIEKSIKV

SEQ ID NO: 39 - protein, 344 aa, Oscillatoria sp.
MTSTSSKIPVSVLIPAKDEEVNLPACLDSLTRAVEVFVVDSQSTDRTVEIATSYGVEVVQFYFNNCWPKKKNWSLENLPFRNEWVLIVDCDERIPPELWEEIAEVIQDPNFDGYYLNRKVLFLDTWIRHGGKYPDWNLRLFKHKKGRYENLGTEAVPNTGDNEVHEHVILAGQVGYLKNDMLHEDFRNLFHWIERHNRYSNWEARVYYNILAGQGDSGTIGANLFGDAVQRKRFLKKLWVWLPFKPMLRFLMFYIFQLGFLDGKAGYIYARLLSQYEYQISAKLYELRYCNGQLNKAEKTKGGDSAKGNLKPNSSFEFDLEKAEADISQSPLPNSPSQINSPNS

SEQ ID NO: 40 - protein, 264 aa, Unknown
  Description of Unknown: Nitrospirae bacterium sequence
MDKTTPKVSAVVIAYNDEPNMRGCLESLTWADELIVVDSFSTDGTAQISQEYTNKVFQHEFHGFGRLRNEAVAHATYDWIFSLDTDERATPEVRDEIRQKLREGPDADAYFIPRYNYFLGRRIMHCGWYPDYRQPQFFHRHRMRYKEDLVHEGFSVNGRVGYFRAHVEQKPFRDIDQYLQKMDRYSTLRAQAMYQRGARFHLHQLVTHPLFTFLKMYILRLGILDGMPGLILSGLYTYYTFVKYAKLWELEKNPCLTEKPLRGF

SEQ ID NO: 41 - protein, 260 aa, Cupriavidus sp.
MKISVVLITKNEAHNIRECLESVSWCDRAIIVDSGSTDGTVETARAMGAEVYETATWPGFGPQKNLALSKVQSEWVLSIDADERVTPELRDEILAAIASGQADAYDMPRLSRFCGRFIRHSGWYPDRLIRLFRAGKARFTDDLVHENVVTDGPVAHLQNPLLHYTYDNFSQVLRKVDQYSTLGAQQAFQRGKTASPASAWLHGSWAFLRTYVLRRGFLDGPQGVAIALMNGQASYYKYIKLWLLQQQARQPVASGDPQAH

SEQ ID NO: 42 - protein, 258 aa, Taibaiella soli
MIQISAVIITFNEERNIARAIESVRKVADEVIVVDSFSKDGTVAIAEKMGARVIQHPFNGYGEQKGFAETQATYDWVLNMDADEALSPELEKSIREMRNNPQFDAYEFNILTNYCGKWIRYCGWYPNPKLRLWNKTKGRMTTDKVHEGWHLHDKNGKIGFLKGDALHYSYYTISDHLKKIEQYSEIGAQFDVARGKHCSFLKLWLWPKWEFIKLYIMRQGIRDGYYGYLLCKNSAYAAFVKYQKIRQYTELKKQGISF

SEQ ID NO: 43 - protein, 252 aa, Veillonella parvula
MATVSVIILARNEEHNIHDCIESVQFADEVLVIDDFSTDDTIKIAEEMGARVVQHAMNGDWGAQQTFGIEQATSDWILFLDADERISEPLAKEIQAIVVNEPNKAYWIQRRNKFHHNHATHGVLRPDYVLRLMPKEGSYVEGYVHPAIITPYPTEKLQHPMYHYTYDNWHQYFNKFNNYTTLSAEKYRDNGKSCSFIKDIILRPTWAFIKVYFLQGGILDGKMGFILSVNHYFYTMTKYVKFYYLLKSKGKL

SEQ ID NO: 44 - protein, 309 aa, Unknown
  Description of Unknown: Cyanobacteria bacterium J069 sequence
MFSIYILTHNEELDIAACLESALLSDDVVVVDSISDDRTLAIAAGYAEKHPIRIVQHAFESHGKQRTWMLESIPPKHPWIYILEADERMTPALFQECCRVIQSDERVGYYVAERVMFMNRWIRRSTQYPRYQLRLLRHGQVWFDDYGHAEREVCDGATGFLQETYPHFTCSKGFSRWIEKHNRYSTDEAVETVRQLQQGTVNWRSLFWGASEIDRRRALKDLSHRLPGRPLLRFLYMYFGLGGWRDGGPGFTWCVLQAFYEYLILLKVWELRQEPSAQGFEVQSVERRVVEIAAEPVESLETGDRSAPL

SEQ ID NO: 45 - protein, 259 aa, Hymenobacter sp.
MPILLSVVIITYNEERNIGRCLLALQDIADEVVVVDSFSSDRTVEICREHNAKVVQHAFAGYVEQKNFATAQARFDHVLQLDADEVLTDTLREHIRQVKTNWRAAGYTLTRLTNYCGTWVKHGGWYPDRKLRLYDRRCGQWQGLLLHERYELRPEHQVAALTGDLLHYSYDSVEQHVAQLNRFTSIAADELALRGKYRITVFHLLLKPWWKFVHGYFFRLGFLDGFAGLCIAAISAWGVFLKFAKLRTKNHRLNLTSGS

SEQ ID NO: 46 - protein, 268 aa, Unknown
  Description of Unknown: Microgenomates group bacterium GW2011_GWC1_44_23 sequence
MKLSVIILVRNVAHEIIPAIKSSQFADEIIVVNTGSTDSTLDICRKFGTKIVHTTGDSFAKWRNDGAKTAKGEWLLYLDSDERVPVKLAKEIIDTINKPEHSAYTISRYEIFLGKHLDHWPDPRVLRLMKRVALKRWEGRLHEQPKLTGTTGKLKQQMVHLSHKNIDEKLSNTLEWSKTEANLLLDAHHPPMAGWRFIRIILTEFWSRAVKQRLWRDGTEGWVEIIYQMFSKFITYERLWEMQRKPTLKETYDNIDKQILAEWEEKKS

SEQ ID NO: 47 - protein, 252 aa, Kaistia granuli
MPVNSNRPRLSAIIITKNEVKDLPACLASLAFCDEIVVVDSGSTDGTLEIAERVASRVIVRADWAGFGRQKQRALDAATGDWVLSIDADEVIPPELALEIRTAIESETHVGYRLNRLNAFLGKFMHSGGWTPDRPLRVVRRDAARFSEDVVHEILIVDGTIGDLPTPMPHLSYRDFDEVLDKLRRYALAGAEQRRNSGRGGSVGKAIIRSITTFLKLYIGKRGFLDGQHGFVAAVASSQEIFWRYLAAGWNR

SEQ ID NO: 48 - protein, 258 aa, Unknown
  Description of Unknown: Chloroflexi bacterium sequence
MAYPKISILLPTFNCADILRPTLESIKWADEILVVDSYSTDATLDLCREYGARILQHEYVQSAKQKNWAIPQCAHEWVLQIDSDEVLEVGLSAEIRASLESASAEIDGFRIPFKHHILGEWVRVCNLYPEYHLRLFRRDKGRFEDKEVHSHVKVPGRVETLQHHILHHGMKSLSNQLRNLDRYSRYQADELRKRGKKFHWHQLLIRPFGIFVYFYVVKKGFTAGYRGVWIAAINTTFDFWSYAKLWELETLGLTASPK

SEQ ID NO: 49 - protein, 533 aa, Unknown
  Description of Unknown: Thiotrichales bacterium 16- 46-22 sequence
MTLLPAAYSHPKSRPWVFALVLLLTLSLLAVPIVETTPNALAFETFYNAGMHCLQGLNPYAAYEGFDYYKLSPTFLLPLIAFAQLPFVVSGVIWQLISTVLFFAAMLWLLRELPLARPLGLGLSLFLPFLLLTDFQLNGTYLQSNTLVVALMTLSLLFYIRGQWLVSALLLAWIANTKLYPLVLTLLLFVDMRWRFIVATLLAHVFLFALPYVVWGQAQANAFYSDWMNLLAMDKTLTYGEPWGHFFLGLKAFLEVNFGWVLQQGYVWVLLVSAALVGLPACWLRWKAGVFQHETLMLLLVTALAWILLFSTRTEGPTLVLIAPIYGYALWWIMKIDAVQFRRIALSALVLVFILTSLSTSDLFRGTIVHELLATQPAHCGSDDYLYLYHYSIVACSFGYTSIFVERILMSHKITAFVLTYNGEKYIEDCLKSLMWADEVMIVDSGSKDRTVEIAQALGVRVETNSWAGYGNQLNYALSVASHDWVFFTDQDEVVLPELAQNIRRELNGEMNYLAYKTGGQNSLFGHYGPHHD

SEQ ID NO: 50 - protein, 254 aa, Unknown
  Description of Unknown: Chryseobacterium shandongense sequence
MAEELMKNVSGLIITYNEEKNIQEVLKCFDFCDEIIIVDSFSTDKTIEIAKQFSKVKVIQNAFEDFTKQRNIALDAAKNDWVLFLDGDERITASLKNEILEELEKPVQKDAYYFYRKFYFAHKPIHYSGTQTDKNFRLFRKSKARYTGDKKVHETLHVNGTIGVLKNKLLHFSVSDYESYKSKMIHYGVLKGQELAAKGKKYSLAAQYSKTAFKFFKAYILRLGILDGKEGYQLSYLQSVSVFETYESLKKEQN

SEQ ID NO: 51 - protein, 251 aa, Unknown
  Description of Unknown: Gammaproteobacteria bacterium sequence
MLQPLSAVLITRNSAAVLPACLKSLRFADEIVIVDSGSTDTTLDIARHFNAKIVHQEWLGYGKQKQFAVAQAAHDWVLCVDTDERVSEPLRESILRELQAPRFHAYQMPRRNRFLGRWLKHGEGYPDLSLRLFDRRHANWSDDPIHEKVVTAGPVGRLAGDLLHESEQGLADYLAKQDRYTTLQAEALHARGKRASIARQLLSPPLRFIKFYFFRLGFLDGIPGLMHILVGCRNSFTKYAKLRALRRRDRH

SEQ ID NO: 52 - protein, 949 aa, Selenomonas sp.
MEGSSLKISACYIVKNEEVNLEKSLNSIKNKVDELIVVDTGSTDNTVGIAKKFNAKIFCIPWKNDFSEARNVAIAQATGEWILFLDADEYFSDNPSVDLHEVILSLQPADVMLVSMDNIDADSRENLLTFYAPRIFRNVEGLCYEGRIHEELRYRGKQVEKIVYVPEEQLKIVHTGYSVSISHEKAERNLQLLLYELENTEKPDVLYPYLAEVYAALDNAEKAKYYAEQDIKNGRRRITFASKSWRILLDYAVKENDKRKRREIAASAVFNFPEIPEFHAELAESLAADYIYTDAIREAEKAEKLFHNYDDIEPMQFTTDMLIMLKKRLNDWKVLQKNSEKLYITACVIVRNEEKNIAAWLANTQQYADQQVVVDTGSKDKTVEIVKKSKAYIYDFNWQNDFSQAKNYALSKAKGNWVFFLDADETFANPQQLRGYLAGIEKYKKNIDAIMVPIINIDTDMNNQEISRFLNVRIFRNLPGIHYEGYVHERLVMAEGKPLQLYKEEHDLQIIHTGYSSHIIAGKVERNWKILQDDIEKNGEQPVHYRYLADCYYARGNMEQALKYAILALGSTVQAVDSASDMFDIALTCVEKMDCKVAECLALAKKAQALFPKKAAYFIKAGHYLFSVGKTDDAAKEFGKALVCLRENNNNTGDTYTSIAEQSLLYQDMALIYHQKREWEKAALCLQKAKQFSSLDDGIIRMILNSNKEKNIAEQVKALQSYMGNETINQHYIAQWLEEKGFLKHWQIFTGENKQEYVLAQNEDLIVLYKKIEQDMANNIVGLCRILIKLHQERDSLIKGVQIANLSQALPEAMYAVWECWQKYEPVNDFHWDGYKVWLRQMIVWGSAEQLQDFVELAAGLSDSCLWEMAEELFQGEKWLIAWNVYSRIPAASKYVKGKFWCHAGICQFSLGNNEIAGECFANATAYDDTDEECRSYITWNERRLKNDA

SEQ ID NO: 53 - protein, 282 aa, Lucifera butyrica
MRKPISVIIHTFNEEKNIRNCLECVKWADEIIVVDMYSDDKTIEIAQGYTDKIFMYERSGYADPARKFALEQASSEWILVVDADELVPMKLQRVLIDIAESDKYDAVLIPHLNYFFGYPMKGTGWGPLQDMHIRFFKKQYMYYSDKVHDFAHLSKDARLFRLLDKDCAFVHFNFLTVEHYIEKFNRYTTIEAQGKYKHDIPFDLKKIVISSAKEFIRRFLFCKGYSDGFRGLSLSLLMVTYQLVINLKLKIMYECSNLNYDEVIRLKYNKIAEQIRAEYSEE

SEQ ID NO: 54 - protein, 254 aa, Nonlabens agnitus
MQKYKISAIVPCYNESHNIVEVLKSVEFCDEVILVDSNSTDNTVALAQPYIDKLLVREYEHSASQKNWAIPQARNEWILLVDADERVTPALKEEILNLFEKIDEQPHVGYWIGRLNFFMGKQVRYSGWKNDKVIRFFRKSKCRYADKHVHSEIIANGSVGYLKNKLTHYKYIGIDAHMRKLQRYASHQALDYDQKTGKITFFHIIVKPIWSFTKHYFIQRGFLDGFVGLTIAYLRGYMVFMRYVKLWLLRRGID

SEQ ID NO: 55 - protein, 251 aa, Polaribacter sp.
MTKISAIIPTLNEEIHIADAIKSVSFADEVIVIDSFSTDKTVEIAEKMNVKIIKRKFDDFSSQKNFAISQAKHPWIYILDADERVTKPVKAEILESVKNPNGFVGFYVRRTFYFAGKKINYCGWQRDKVVRLFLKEQCKYVGVVHETITTNGQLGFLKNKIDHFGYRNYNHFISKINYYSSLKAKELHAKGKKVNAFHLLVKPAARFFIHYIIRLGFLDGLAGLILAKILAYSVFTRYIKLWLLNKGIKEH

SEQ ID NO: 56 - protein, 484 aa, Sporomusa malonica
MAKGWSLTVCLIVKNEEHCLGDCLDSIRAWADQIVVVDTGSTDNTVQVARQYDAQIEYFQWENDFAKARNYCLQFAVSDWILVLDADERLAGNSETLPDLVAKDYEGYYLTIVSPLGAGKIEAEDHVVRLFRNGRGYKFSGAIHEQIAGSIKELEGQDAIGFSGIIVRHRGYEPEEILCKQKIVRNSQIIKSQLAERQDDTFMLYSLGTELIQQEQYGEACNVLMKALKHMTGGEGYFREVILLALMASLKNSAYVEDEGLFVKALATMPADSDILFLAGLRQAALGNFSLAGEMLAQGGINTVLVPPQLINAIVGELFYRQKSWQAALQKFKLSLEAGPSLYSAVRMIEVLRKGEAGAVKALAYAVGEDAVKLAHEAVLIGDYYAAAVICLAAAERDVGESFNQWKDLYQSIIKQAGSMPAIIKDYLGILCQQMEICKVALATDKECLVVQSYLEKAVNRSLGVWLTLWPEHVVPINIWECCL

SEQ ID NO: 57 - protein, 492 aa, Selenomonas infelix
MKISACVIAKNEAENLPRWLASMRVFADEMIVVDTGSTDATVEIARAGGARVCHFDWINDFAAAKNFALDQAQGDWVVFTDADEYFTEESAPRVRPLIEEYDGRRKFDGFIVHLVNIDMDTGELLGTSAEVQRIFRRAPHIRFVGSIHEHVENLSGDTGREMALAPGLTLYHTGYSPRIIKGKSRRDLELLLARRARGEHKKLDDYHLMDCYYSLEDYPQAAHYARLARDSTDRPVGSENRPHAVLLQSLILMGAADNEIRAAYETARAALPEKADFPLIYGTYAWDHGFLATACAAYRDGIRLHEEYYRAGDFSGILAPTAYARLGEAARLRGDAEEALRLHEHALRLSPHSAPVLIRFIRMLHAVGADDAAVIETLNAFYREAADPAFLAAVLAGSPFRLAALYYDRKSALQFSQRRQFLLAGDVSSAAASLIEEVERTAAVAAACGAEFAPEQQGALALLLPRSCRERSAAPEDARMLRRIGRLAEGHR

SEQ ID NO: 58 - protein, 293 aa, Spirobacillus cienkowskii
MDDNKRNIIQETYELYQKVRSYDISKFVPEIEKLTAVIITKNEEKNIARCLDSLKFVDEIIVVDSGSTDKTKEIVYSYKDVILIETEWYGFVQNKRIGIEKSSNNWILWVDADEVVPEELANEWKTRIHQGTFHETGAIDCPRKTFFLGHWVKHSGWYPNRVIRFFARHRSDLSDNILHESVIPRKGYVVEHFKTDLLHYSYNSLYQYFDKMNKYGYAGAKELIRKKKFILFPHLFFEPIWTFFKFYILKRGFLDGRIGIIICMGAAFSNFIKYANYFFLKKYKYVDIEEKKD

SEQ ID NO: 59 - protein, 260 aa, Unknown
  Description of Unknown: Vibrionales bacterium C3R12 sequence
MITGVVITLNESKNIVECIQSLQQVCSEVVVVDSNSTDNTCELAEQAGAKVVIQSYLGDGFQKNVGLDYTDNHWILSIDADERLTKEIVSEIKQLNLNTTEHDAFAFRRRNYIGSRWIKQCGWYPDFCLRLYDKTKTRFAEVKQHAAVQARNPKRINADLIHYSFENLGQLFAKPGRDFSGRAAKIMYQKGKRVNAMSPFLHGLNAFIKSYLIKKGFLGGSDGLTVSISAAMSSYLKYARLLEFQRDPTVLEKEDFNKVW

SEQ ID NO: 60 - protein, 249 aa, Unknown
  Description of Unknown: Candidatus Roizmanbacteria bacterium CG22_combo_CG10-13_8_21_14_ all_38_20 sequence
MKITAVILTKNEEKNIQKCIESLAWIDEVVIIDDYSYDNTVKIAKKNGAKIYKRELSGNFADSRNFGLESASNEWVLFIDTDEIVSQELALEIMKLETTDMFGYAIKRIDHLWGRELKHGDVGNVWLTRLVKKNTGKWERKVHEVWKSNDSSKTSKLRGVINHYPHQTISEFVERIRSYALLHAKVLEDQGIRVSIWQVVLYPVGKFLYIYIIKLGLLDGTAGFVHAMMMSFHSFIARSELLVQQNEAS

SEQ ID NO: 61 - protein, 259 aa, Dyella sp.
MAREPLSVVVITYNNGGTLDACLRGVTWAEEIVVLDSGSTDDTVAIAERYGARVSVHPFDEFGPQKQRAYDLATHDWILNLDADETLSAGTREVIEQALVAPRYAGFRLPRRELLFWKVQHRWGRRNGLLRLFDRRRGRMNHVEVHSAVEVDGPVKTLWRADFINHGDVDIATRMNKINSYTTRMVAHKLRKGQRFTGLRMVFYPPWFFLRQYLGKRYFLDGWAGFVASMTGAFYVFLKYAKLHEAQRKVGPDKGMRSR

SEQ ID NO: 62 - protein, 586 aa, Carboxydocella thermautotrophica
MADISLCLIVRNEAESLATCLSSAQPWVAEIIVVDTGSTDDTRAIAARFTDKIYTFPWQDDFAAARNFALDQARGEWILVLDADEYLEPESAAFLPQLVTNASGVDAYLLPVKNLLVPDGSDWHLSWVLRLFRQDPWMRFQGQIHEQIMVPSGYRTEIASKGPLIIHSGYLPERRQNKHQRNLDLLQRALAAQPDNPYYHYYLGVEYLYIRNYQAAWEEFSLALAQIPPAVILFRTATVMNAFQCLSALERWQEALNMLEAEIKVYPDFPDYHYALGLCYRALDDHRQAASAFQTALARTGPAFGGTSRAGVTGFRSLYYLGLSYRALRQHWQAVIAWTKALLDNPTFAPALKELVTCWLELADGLTVLRWLYYHFNLNNPAATLLVCRIFLEHFQTAALNLLLENTSCVALADKFLLMGEAAMLEGEFSKALAYFQQIPAKNHRRPAALIWSCLAAYLSRQELTPILTELNSIPDGQANASLLNWLLEQQSVSPSGEGIARDLAVQVYQTLCRLGCSEPALRLANWLNEQQNFPVRELAWQAALTRMIEISNRLLAASPPLEVARFYQELSQYWLNRLPLIAGGD

SEQ ID NO: 63 - protein, 651 aa, Brevibacillus nitrificans
MRISACVITKNEEKNLPTCLNSMRSIVSEMIVVDTGSTDQTVAVAESLGAKVFHFTWINDFSQAKNYAISKATGDWIIFLDADEYFTDESVPLIPLVIKEANENDCDIIVSLLCNIDISTKQTINTVHHSRIFRNHSEIRYEGAIHERLMKSGKAPRGLMASEGLAIIHTGYSSDIEISKRKSERNIKLLAAEFEKSPQSGELCFYLAESHMAAREFEQALEYAYRSADLDNCTLLGVKQKNYLNIITCMIHLNKEKNEIKQWINKGIEGFPDYPDFYLLLADLLTQECRYQDALEAFSVGIKFIDNALKSQSAAPHQAPKILTLMGELQHKIGQNHDAVKHFVSALNIDKFHYAALIQLLKLLTRFESINDTKKFLNKMYDISNKKDLLYLTRACLEVKNHLLGGYYLSLFSEQDFLLMAEENAEYRLLAGDFKHASTLFDKIYEEKQSTEAMIKALCALFLSGDSATLLEHLQKYKSVESKEIEEGLTSLTDAECLLFISCLIKLQKVDKAMELKHLYEGKNIILDVANLLYDNEKFKEAEVLYAELIAKKNFEEKSRAILLSKQGECLWRIGKYEVAKKLGYEARNLNSQEYQSHSLLMSVTSETGEINELTEIVREAIGQFPDSAFLQSVQAVINNQIENNHQTISY

SEQ ID NO: 64 - protein, 250 aa, Nitrospira sp.
MSKLSVYVIAYNDEPNMRACLESVAGWGDELIVVDSHSTDRTAAISREFTDKVYQLDFHGFGRLRNEAVALTTHDWVFSLDSDERMTPELGKEIQLLLDREPDVDAYFVPRKNYFLGRWIEHCGWYPDYRQPQLFRKGRFRYRQELVHEGFDCDGPVGHLKSPALQYPFRDIDHYITKQDRYSDLMAKRMVEQGRQFSSHQLITHPLGAFLKMYVQRAGFLDGMPGLILSGLYGYYTFMKYAKFWELTKR

SEQ ID NO: 65 - protein, 274 aa, Leptospira sp.
MEQANSTKLSVSIITFNEEKNIQDCIESVSEIADEILILDSFSKDRTKEIAIQNPKVRFLEHPFYGHVQQKNKAMEYCANEWVLSLDADERVDMILREAILDWKKQKSSDIVGFKISRLTWHMGRFIHHSGWYPLYRYRLFQKSKATWVGENPHDYIEIIGKGSKIAGNIIHFSFKDLSDQIETINKFSSIVAHTRFEKGNKFSLLSTILKPIGKFWEIYIFKRGFLDGFPGFAIAASSAFSTFLKYAKIYELHHKIIQRPSNLRESYGEKETK

SEQ ID NO: 66 - protein, 259 aa, Paenibacillus tyrfis
MDHSEVKRISVTIIAQNEEQRIAKAVVSCQDFADEIVVIDGGSKDATVEIAESLGCKVFFNPWPGFAKQRNFAAEKATHDWIFFIDTDEFANEELKNSIKQWKAGKTADADIYNIYRIGNFMGKWLDKGEHLPRMYNRKVTSIKETEVHEGPEPEGRKIGFMPGILWHDGYRSIDDHVIRFNKYTALEAQKALSSNQSFSLMRLLFRPVLRFGQKYFVHGLFKKGLAGLTVATLWAYYEYLTQIKLYELKRVQNSGVAE

SEQ ID NO: 67 - protein, 300 aa, Unknown
  Description of Unknown: Candidatus Pacebacteria bacterium CG_4_10_14_0_8_um_filter_42_14 sequence
MKANMRLSVVVQTKNAAKTLEKALQSVAFADELIVVDMESSDATREIALKFTDNVVSTKDVGYVEPARNKAIEKASGEWILLLDADEEISVSLGEKIETLVATESDVSCYFLPRKNIIFGNWVKDTGWWPDFQPRLFRAGTVTWKDEIHSRPLINGKTDKLPSDESLAIIHHNYSTVSEYIDRLNRYTSITAKFDSKEKSVTTAGLISSYRSELLRRLFLQGGIDGGYRSVLLSFLQANYELVVSAKKWEIAGRPEDDSTSITEMEKFNSELAYWIADWHTKKDGLFRKLFWKIRRKLRV

SEQ ID NO: 68 - protein, 252 aa, Lebetimonas sp.
MKSEFYSSGCLKNGHDEKLSVVILTKNSQKYLEKVLKSVEFADEVIIYDSGSDDNTLKIAKKFKNTKIFIDNKWEGFGVQKQKAVNKAKNRWVFVLDSDEVFTENLKNEVLEVIKNPKYNAYKVARLNNFFGKWIRHCGLFPDYSIRLFNKEKCKFNERKVHESVECERVGELKNYFLHYAYESVEEFIEKQNRYSSLGAKPNKLKAIFSPYWTFFKIYFLKLGFIDGWSGFVIAKLYSEYTFWKYVKKMDN

SEQ ID NO: 69 - protein, 301 aa, Unknown
  Description of Unknown: Candidatus Roizmanbacteria bacterium CG22_combo_CG10-13_8_21_14_ all_38_20 sequence
MNKISVVISAYNEEKLLEDCLKSVTWADQVIVVDNNSTDDTAKIAKKYADEVYSRPNNLMLNVNKNYGFSKATGDWILSLDADERATDELKKEILKELQVTSYELRGDVSGYWIPRKNIIFGKWIQHTGWYPDYQLRLFRRDRGKFAQKHVHEMVEVKGKTEQLKGHIQHYNYETVDQFFQKLLVVYSHSEADNLLKDGYVFNWKDAIIMPLREFFNRYFAHKGYRDGLHGLILSLLMSVYHLVVFLRLWERKKYVEQDVNLGEVASEVGVYRQTWKYWVKHAKVDLANNGVAKLVAKYFG

SEQ ID NO: 70 - protein, 259 aa, Unknown
  Description of Unknown: Deltaproteobacteria bacterium sequence
MVDISACMITFNNDRTVERALKSIAPWVQEIIVVDSFSTDATPDIVKRYTDKFEQRKWPGFRDQYNYCISKASNDWVIFVDADEEISKELGQEIQDRLMQEGDVYDAYIAHRRTFYLGRWIMHGGWVPDYEIRVFKKSRGRFEGDLHAKVRVEGRVGELRNFYYHYNYRDIADQIDTINTYSEQAAIDMRKKGKRFSWLDLMFRPGLRFIKEYVLKRGFMDGMAGLVIAVSTMYYVFVKYAKLWELEKGLKEGNGSGLR

SEQ ID NO: 71 - protein, 259 aa, Unknown
  Description of Unknown: Chryseobacterium sp. NBC122 sequence
MGVSVAVITYNEEENIKRFLDSVNDIADEIIVVDSYSKDKTKERCSEYSQVKFYEKKFNGYGEQKNYALDLCTNEWVLFLDADEIPDEELKKSIRKIVDSGNSKFEVYDIKFNNYLGTHLIEHGGWGRVFRERFFKRNAAKYSPDRIHEYLMTDNDKGSIKGSINHYTYRNIHHYLSKMNNYSDMMAEKMFESGRKVNQLKIIVNPPFQFFKTYFLKLGFLDGFAGFYIARTMAFYNFMKYIKLYSIIKRSKLEKKSAR

SEQ ID NO: 72 - protein, 257 aa, Unknown
  Description of Unknown: Candidatus Thermofonsia Clade 1 bacterium sequence
MLPEKVSVLIPTFNNEALLPDLLDDVKWADEIVVVDSFSTDQTVAICQARGARILQRRYTVSAEQKNWAIPQCTYEWIFAVDSDERVPLALQAEIQALLANGIPNDVDAFRVARRNFFLGHWMRTMSLYPDYQVRLFRKSVCRFEEKAVHAHMQVPGKVLTLQTPLDHYATPMLSKQINVLDRYSTYKAGELYAQGKRFRWHNVLIRPLAVLLYMFLWQGGFREGFRGFFVAFHTAAYVFFTHAKLWELEWRDGKRR

SEQ ID NO: 73 - protein, 243 aa, Hippea alviniae
MSLGCAIITLNEEKKLERTLKSLSFCDEIVVVDSGSSDKTVEIAKRFTDKVFFQKWLGYGKQKNFAISKLSTDWVLSVDADEVVSDELKDEILKELKNPSADAYAVNIQLVFLGRPLRFGGTFPDYHVRLFKKGKYWFEETDIHEGVRAEAKRLKGVMLHYSYDSLSEYFEKFNRYTSLLAEKNYEKGRRITKFSPYLRFGFELFKRFVLKGAFLDGYEGSLYAFVSSFYAFVKYAKLLELQK

SEQ ID NO: 74 - protein, 262 aa, Unknown
  Description of Unknown: Candidatus Roizmanbacteria bacterium CG_4_10_14_0_8_um_filter_36 _36 sequence
MKISAVILTKNEETNIERCLKTVDFCDEIVIVDDFSEDKTVEIAHKVLNAQKVYKVLQRRLNGNFSSQRNFGMEKTNGDWILFVDADETIPDELKKEIKQLLSSDPETKDYTAYYIKRRDFFWGRELKFGEIRKARARGVIRLVKRNSGYWVGNVHEEFKTIGFVTKLTNFINHYPHPTLKEFIEDINFYSSLRAEELYQSGKKFCLGEAILLPFSKFILTYFIYGGFLDEVPGFTYAFLMSLHSFLVRAKLFQLYENKKNR

SEQ ID NO: 75 - protein, 249 aa, Gallaecimonas xiamenensis
MRLSAVIITKNVAQDLPQCLASLDFVDEIVVLDSGSSDQTLALAEAAGAKVFQSQGWPGFGPQRQLAQQHAQGEWLFWIDADEVVTPELKAAILAAIEDSTPGVVYRANRLSDFFGRFIKTSGWYPDRIVRLYRRSEYRYDDALVHEKVACQGAKVKDLPGHLLHYTTGDFTSYLQKSVRYANDWAEGKAKRGKKAGLLSACLHGLAAFLRKFVLQRGFLDGKHGFLLAMFTAHYAFNKYAALWIKSRR

SEQ ID NO: 76 - protein, 261 aa, Marinomonas sp.
MKISGNIITLNEEANIADCIKSIKKVCDEVIVVDSGSTDRTIEIAESLEARVIHQAYLGDGFQKNVALKEVKNEWVLSLDADERLTDEMVRDIQSIDFKNSKFDAFAFRRKNMIGSRWIKQCGWYPDYCTRLYNHNKTKFKEVKQHSSVPASSLKKFNSDIIHFSFKNIGELFAKPGRNFSGRAAKIMYAKGKKANAFSPFLHGLNAFIRKYIFQKGFLGGVDGMTVALSSAVNSYLKYAKLLEYQRDKSVTEQNDFKNIW

SEQ ID NO: 77 - protein, 294 aa, Unknown
  Description of Unknown: Myxococcales bacterium sequence
MPHARAKSKIVTDIAVIILTYNEESNIAQALESVQGWSRQVFLLDSYSTDRTLEIAGRYPCTIVQNRFENYSKQRNFALEHLPIVSEWVFFLDADEWIPPELREEISTLIASNPPENGFFVKWRLFWMGRWIRRGYYPTWILRLFRFGKARCEDRSINEHLVVEGGTGYLKNDFIHEDHKGVTDWVAKHNGYATREASELLIRSSSDLQIDVRLWGTQAERKRWLRYRLWNNLPPLVRPFLYFVYRYVFRGGFLDGKAAFVYHFLQGLWFPMLIDIKYLEMKYGRENQAEVINV

SEQ ID NO: 78 - protein, 249 aa, Polaribacter butkevichii
MTKITAIIPTLNEEIHIEEAIQSVKFADEIIVIDSFSTDKTLEIAEQYNVKIIKRKFDDFSSQKNFAIQQAKNPWIYILDADERVTPEVEKEVLDAVKKPNGVVGFYVRRSFYFCERKVNYSGFQSDKVIRLFLKENCKYTGLVHEKITANGEIGFLKNKIDHFSYRSYDHYISKLNHYAAIQAKELHQKGKRVNIYHVIVKPTARFFIHYFIRLGFLDGFTGFLVAKIQAYGVLTRYIKLWLYNRKIK

SEQ ID NO: 79 - protein, 269 aa, Unknown
  Description of Unknown: Candidatus Omnitrophica bacterium 4484_70.2 sequence
MEKLKLSVVILTKNEEVRIVDCIKSVIDWVDEVIVVDDESSDKTVEIAKSLGAKVLIKKMEVEGKHRNWAYNQARNEWILSLDADERVTEELKGEINAVLSKDTVYDAFTIPRKNFIGNYWIKGGGLYPSPQLKLFRKDKFRWEEVEVHPRAFLKGKCGHLKSPLLHYTYRNWEDYLRKLNRQTTLEALKWYKLSLKNPKKARYKMNLIHALWRAVDRFIRVFIVKKGYKDGFIGFMIAYFSSLYQIVSYAKYREYTKRKIDICSDMKC

SEQ ID NO: 80 - protein, 253 aa, Unknown
  Description of Unknown: Candidatus Levybacteria bacterium GW2011_GWA2_37_36 sequence
MKICISAIVLAKNEEKNIADCLKNLKWCDESIVIDDNSTDETVKIAEKNNAKVYSRSLDNFSNQRNFGITKASGEWMLFVDADERVSGALAFEISNVLSSWTNEIDNEYKGFYIPRFDVIWGKELRYGDSGVKLLRLAKKNAGKWEGLVHEKWKINGKIGSLKNRIIHYPHQTISEFLSEINFYTALRAKELYSRKIKVNILSIILYPSCKFVLNYFLKKGLLDGIPGLMQALLMSFHSFLVRGKLRLMWNSK

SEQ ID NO: 81 - protein, 359 aa, Legionella beliardensis
MLSVIIISKNEEANIKRCLESVSFADEIVVLDSGSTDKTIEIAQKYTENVYTSEDWYGYGVQKQRALNLATGDWVLNLDADESVSEHLRTAIEEAMESDEADAYRIPICMNFYGKPLRYSSSPTRHIRLFKREGARYSDDIVHEKIILPAEARISKLTLPIMHHSFRDVSHALYKINRYTSYSAKIRSQKGDPPGIVKILFSTGWMFFRCFYLQRGFMDGVAGFLLAVFNAQGTFYRGIKQLYPDVRHTISMSPDRKDIQAVPSLPDKSADEVEDKPLPQEQLTTESESIIEVTEPNQEATDNDEKLPVEEVIEHDAFLQREQDEPLEEDVIEPEDIFEEEEAIEQDKLLVNKQSSEEK

SEQ ID NO: 82 - protein, 248 aa, Nitrospina sp.
MISVTLMVKNGEKNLADCLESLRPFDEVLLVDTGSTDRTLEIARTFENVKIVEHDFIGFGPTKNLAAGLARNDWILNIDSDEVLTAELARALLALEPSPNAVGRFPRQSYYNGKWIRGCGWYPDKIIRLYNKTHTAFNDNLVHESIRVKPGMAVTDLEWPVKHYPYDSAASLVDKFQFYSTLYADQNKGKIRSSPLKAVTRGGAAFFKGYFLRRGFAEGYEGFLIALCQGLSTYFKYIKLHEANKNAH

SEQ ID NO: 83 - protein, 335 aa, Cohnella phaseoli
MARCLCSAAAMVDEIIVVDTGSTDQTREIALEYGAKLFHFEWCDDFSAARNYALKQASGDWLLVLDADEYFVEESADAIRAFTRSTSRRIGLIEIVSKFVEDGHTFEGIHSNPRLFPRGVTYEGRIHEQPTPILPMVETGLRLLHDGYYMTDKSDRNIPLLLKALKDKPGSAYLNFQLGRQYQGMKQHELAVQYLEKAYALLRQTDPIAIENITELLQAYTKCKRYDKAMELVGDEVAWLERSPDFCFAVGQFLLDYAIDSQDYSVIENIENSYLKCLELGRRGVSETVVGSSTFLAAYNLAVFYESVGNKTEAQQYYGLAASYRYGPAVARVKG

SEQ ID NO: 84 - protein, 252 aa, Pseudodesulfovibrio indicus
MRETVTGLVLTYNGERWLEQCLKSLDFCDELLVVDSESTDRTREIAERCGARVLVRAWPGPVDQFKFALKEVSTTWVVSLDQDEILTDELRESIRTALGRKEHLAGYYVPRSSFYFNRFMKHSGWYPDHLLRVFRCGQMEVSASGAHYHFKPRGETKKLAGDILHYPYESFRQHMDKINYYAEEGATALRAKGVSSGPGKALLHAVMRFIKLYLLKLGFLDGTAGLCNALAGFYYTFQKYIRVNEKGKWGDA

SEQ ID NO: 85 - protein, 278 aa, Pontibacter korlensis
MPLLDLTIAIPVRNEEKNLPGCLRSIGKDLAQKVVVIDSGSTDKTKEIAKHFGAEVLEFCWNGKFPKKRNWFLRNHRPKTKWVLFLDADEYLTQKFKEELRQALARDDKVGYWLSYTVYFLGKQLKGGYPLFKLALFRVGAGEYEQVDEEQWSQLDMEVHEHPILQGEIGTIRSKIDHQDFRGVSHYMLKHIDYAGWEAARFLRSSGKASLAANVNLTWRQRLKYRLMRSVFIGPAYFCGSFFLLGGFKDGARGFAFAVLKMSYFVQVYCKIRESKNV

SEQ ID NO: 86 - protein, 253 aa, Unknown
  Description of Unknown: Fusobacterium perfoetens sequence
MKLSVAMITLNEEKILEKTLKSLENIADEIVIVDNGSTDNTKNIAEKYGVKFFQEEWKGYGPQRNSSIDKCSHEWILNIDADEEISPKLAEKIKEIKENETEKKVFEINFSSVCFNKKLKYGGWSNQYHIRLFRKEAGRFNYNEVHEGFETKEKIYRLKEEIYHHSYVSLEDYFNKFNKYTTLGALEYYQRGKKPSNFQIIFNPIFKFLRMYIIRLGFLDGIEGLMIATASAMYSMVKYFKLREIYRNGSYKK

SEQ ID NO: 87 - protein, 250 aa, Unknown
  Description of Unknown: delta proteobacterium MLS_D sequence
MSLSVVIITKNEETAIEACLDSVAWADEIIVFDSGSTDRTVEICHRYTERVYETDWPGFGPQKNRAMAQATGDWILSLDADERIPRELQEEIQQAVADPDAPEAFEMPRLSSFCGRPIRHAGWWPDYITRLARNGSARFSDDLVHERLIIEGTTGRLTNPILHEAFESLEDAIETMNRYTTAGALMMRRRGGSSSLWKAVSHGLWSFVYSYIGRGGFLDGREGFLVALYVAEHTFYRYAKRLYLKDDQTQ

SEQ ID NO: 88 - protein, 260 aa, Unknown
  Description of Unknown: Chryseobacterium viscerum sequence
MTLSLAIITYNEEENIVRLLDSLVDIADEMIIVDSFSTDRTKEIATQKYPQVQFFEKKFNGYGEQKNHALSLCSHEWILFLDADEIPDETLKRSIQKIVSSANPEFNVYKAKFNNHLGSHLIKYGGWGNVYRERLFRKKYAMYSDDKVHEFLITDEKTGVLEGRLDHYTYKSIHHHVSKINKYSDMMAEKMFERGKKINRFKIIVSPIFEFIKVLIFKRAFLDGFPGFYIAKTMSYYTFLKYIKLREKIRLMELEKKRLK

SEQ ID NO: 89 - protein, 257 aa, Unknown
  Description of Unknown: Candidatus Thermofonsia Clade 2 bacterium sequence
MHKLSVLIPAFNNISLMPDLLDDVAWADEIVVVDSFSTDGTVEYARERGAKVIQHEYINSASQKNWAIPQCAHEWVLIVDTDERLPPELQDEIRALLKNGIPDDVDAYRVARKTIFIGEWLRVMRLYPDYQTRLFRRDKARYEDKEVHADIRVPGRVETLNVPLIHNSTPTLSKQINLLDRYSRYQADELAKRGVRFRWYNVTLRPLAVFAYLYLFQGGWSAGMRGLFIAFHTMAYVFFTHAKLWEKEWQAKQTSAR

SEQ ID NO: 90 - protein, 265 aa, Kosakonia oryzendophytica
MFKVSVCLLTYNSARLLREVLPPLIIVADDFVVVDSGSTDATLDICRDYGVNVHQRPYDMHGQQMNYAIQLAAHDWVLCMDSDEILDDRVVDFILKLKAGHEPLRDHAWRLPRYWYVLGQEVRTLYPISSPDFPVRLFNRQCARFNDRPVDDQVVGALTCAKMPGRVRHDTFYTLHEMFNKLNGYTTRLVKYNPVRPSITRGIISAIGAFFKWYVFSGAWREGKVGAATGLYATLYSFMKYFKAWYAHAEEKSSARTKEHNKRVV

SEQ ID NO: 91 - protein, 245 aa, Unknown
  Description of Unknown: Methylococcales bacterium sequence
MLSVIIITKNEAVHIGRCLESIAWADEIIVLDSGSDDDTVSICRRYTDKVYETDWPGFGLQKQRALDKATGDWVLSIDADEMVTAELRAEIERVMQENKLQAYEIPRLSSYCGRQMRHGGWWPDYVLRLFRRDVGRFSEAAVHEKVLVEGKVGQLVSPFHHETAVNLEEILDKVNSYSSLGAQMLHEKGVRSSVSKAVLKALWMFNRTYWLKAAFLDGRQGLMLAVSNAEVTYYKYLKLLELQDK

SEQ ID NO: 92 - protein, 265 aa, Maribacter sp.
MPQGKEKLSALIITYNEMGYIEKCIESVSFADEIIVVDSYSTDGTYEYLLNHPKVRVIQNPFKNFTAQKSFTLKQANNDWVLFLDADEIVPANLQNEISNTIKSSPKHVAYWFYRKFMFQNERLRFSGWQTDKNYRLFRKSKVNFSDKRIVHETLDIDGTTGKFKNKLTHFCYKNYETYKNKMLMYGRLKAKEAHNKDNRFSYALLLIKPMWKFFNGYVIRLGFLDGIKGITICHLDALCDLERYRELQRLEREEQWSTVFKTMP

SEQ ID NO: 93 - protein, 970 aa, Selenomonas ruminantium
MFALTNKYICIYFLTDICMEKSAMKISACYITKNEEKNLSRSIDTIAAAVDELIVVDTGSTDKTRNVAKSYGAKVYDYVWQNDFSGPRNFAIEQATGDYILFIDADEYFSAETCGNLRKVLEDNKAYDALLIKRYDIDHNEDDIMGEIFVLRAFKHKSNLCYQGRIHEELRDDGRIINNIAMLGPDLLKLYHTGYETAVNQAKAERNLHILQEEIKVADNPGQYYMYMAEACRGVGDYVAMEHYARLDIAQGRRQVAFASRSYRMLLAYLAEQGRNTERYKMAAEAVKEFPELPEFWAELAACQAEIYEYEAAIKSMTEALERDKIFPTLSLEPKEFSTDMSVVAAEKIYEWQELVKATGKLKITTCLIAKNEAQEIGAWLANAAVFSDEIIVVDTGSEDRTVEIAQKAGAKVFSFVWQDDFAAARNYALTQVRAEADWVVFLDADETFYEPQRLRGALAYVAQFGSDSEGIQVPIVNVDVDAWGREIQRFRALRIWRNNSAFRYQGAIHEALYNKCGEIKQLYMAELAVCHTGYSSGRIQQKLNRNLQLIMKEMQEKGEQPLHYRYLADCLYGLHEYELASAYAQRALAAEVPTIAGDGELYRLWLHCARKLKQPAETQLHIIATAHSRGLDDMELIGWQGIICTEMGAYQQAKPLLEQFLQRATSQNLTAGSNAVQGMLAEAYAAKASCHAYLGEKKAADVAWQQAVRENPYNEEILHAFYEWLHLSPQAFLKQVLPYFSDREQGKKYIAEWAVKFGYGKVMQVLAVYLPQNQQKLLKQWLDGDKGTVGKQAWLEATVCVQELLAALVAMPAEKRKTQSVDCHEWAAMLPPGWQRIIGRLYGWQEQLSAGDWPDYLAGLTAIQGFVGDDSYQEYARLALDFSWEKVCEIADKLTEQQYWQAAYSLLAEIPNASIPDDAAFWYQTGRCLYHLQEMTAAGECFARAAEAGSRQPDLSAYQDWVARRERRQ

SEQ ID NO: 94 - protein, 260 aa, Unknown
  Description of Unknown: SAR86 cluster bacterium sequence
MTEHKPIPVSVYVITKNEEENIVGLLDKLQNFAEVIVVDSGSTDRTVELAEAYSNTKVSFNQWPGFGEQKSHALSLCTFPWVLNLDADESLSDSFVEELEEFITQDKLVALRSTRILLRWGSQPRSFGKAEKLIRLFKKEHGYYESRQVHESISINGGIKESEVAILHHENLSYSQRIEKTVFYAKLKAQDKFNKGDEISILVVLLIFPLTFIRTYLFKGHFLDGFGGILTSVNVALYNYMKYANLWDMNKKSSENSTKE

SEQ ID NO: 95 - protein, 258 aa, Unknown
  Description of Unknown: Candidatus Roizmanbacteria bacterium CG07_land_8_20_14_0_80_34_ 15 sequence
MRISAVILTKNEENNINRCLKSLDFCDEIIVIDDYSTDKTIDIINNVGNKNICSLHKRKLNNDFASQRNFGLKKASNEWVLFIDADEEVTNELAKEVRSYVLDGDWKESEAFYIKRRDFFWEKELKYGEIKKVREQGIIRLVKKNSGHWMGEVHEVFYPANKKVGQLNGFLNHYPHQASTEFINDVNRYSSIRAEELFNRGTRTNVFQIIFFPLGKFLYNYFFNLGFLDGPAGFTYSFMMSFHSFLVRAKLYQMTNKK

SEQ ID NO: 96 - protein, 264 aa, Arenibacter algicola
MLDQKEKISALIITYNEMGYIEKCIDSIEFADEIIVVDSYSTDGTYQFLQKHPKVKVIQNPFVNYTVQKTFALKQATHDWILFLDADEVVPDNLKKEIKTKAVPHSEHSAYWFYRKFMFQNNRLHYSGWQTDKNYRLFRKSKACFCDKKIVHETLIVNGTSGVLREKLVHFCYKNYSDYKLKMLKYGRLKAKEAFYREKKFYYAPLILKPIWKFFHNYFLRLGFLDGKKGITICYLNALGDYERYRELKILWKKNEIARYLAMP

SEQ ID NO: 97 - protein, 252 aa, Unknown
  Description of Unknown: Chryseobacterium sequence
MKNPKISALLIVFNEEKNIEEALNSVEFADEIIVLDSFSTDKTVDIIKNQFPKVKLYQNKFEDFTKQRNLCISYAKNDWILFLDADERITPELKNEILKEIKKPITQKAYFFKRKFFFMGEKVNYSGTQNDKNIRLFKKEVAHYDENKRVHEGLSNVDNPGTLQNYLLHFSFDSYEAYYKKVIHYAKLKAKDLHEKGVHYQIIKQLSKSAFNFFKMYFLKLGILDGKKGLILSYLSALSSFKTYEFLKKEYS

SEQ ID NO: 98 - protein, 338 aa, Desulfamplus magnetovallimortis
MRGFSTLPIHSRSPVATDYGNKISIPTVNQNEKKAPMVKISVYIIAYNQETKIRPALESVTWADEIIVADSFSSDRTAEIAEEYGAKVIQIPFKGFGDLRNKAIFACSHEWIFSLDSDERCTPEARDEILSIIQRFSLHNSDYSNSLSEEEEKKRRSEEDRGKEKDRGNRKSVGEKLHDLYYVPRKNFFMGKWIRHSGYYPDYRQPQLFRKGTLVFKSDPVHERYDIISENRAGRIRSPIHQIPYLTIEEMLAKKNRYSTLGAIKLEKEGKSCGMFTALMHGIWSFIRTYFLKAGFMDGWPGFVIAFGNFEETFYKYVKLYEKNMKLGHLDSNSHGQG

SEQ ID NO: 99 - protein, 295 aa, Pedobacter miscanthi
MNPNFSFIILTFNEEIHLTRLLDSIKQLSAPTFILDSGSTDKTLVIAAAYNAQVQHHPFENHPKQWDFALKNFKINTPWIIGLDADQMVTPELFAKLSDFKNEEYSDVNGIYFNRKNIFQGKWIRYGGYYPMYQLKMFRKGIGFSDLNENMDHRFIVSGNTQIWKDGHIIEENLKENDLSFWYAKHQKYSELVAKEEFERLMGLRTSALHPTLLGNPDERKAWLKKLWWQLPLYIRPYLYFTYRMLFQLGIFEGKNGIKFHYMQGLWFRLQVDKKLNILKKRNKVPYERNQSKRS

SEQ ID NO: 100 - protein, 264 aa, Unknown
  Description of Unknown: Candidatus Roizmanbacteria bacterium CG_4_10_14_0_8_um_filter_39 _9 sequence
MQKITSIILTKNEETNIERAIKSLAFCDEIIVVDDGSTDMTVEKCQMTNHQSQINSKIQIIKHESNGDFATQRNWAMKQASYEWILFLDADEEVSDELQKEIISSIGAPENDTSSYFLKRRDYFWSQELKYGEILKLRNRGLIRLIKKGSGKWGGKVHEEFIPDRPLVHRVGGPLAYINHYPHPTLKEFISDINVYSGIRAQELHEAHVQAGAFEMVIYPVFKFILNYFVYLGFFDGPQGFVYSFLMSFHSFLVRAKLYQLNTD

SEQ ID NO: 101 - protein, 251 aa, Unknown
  Description of Unknown: Candidatus Rokubacteria bacterium sequence
MTRLGVSAVVITFNEEERLRDCLESLAWADELIVVDAESSDKTVQIAREFTDRVWVRPWPGFASQKNFALEQATRDWVLSVDADEEVSPELRAEIGRVLEGRGEAADGYRIPRRNIFWGHWVRHGGLYPDWQLRLFQRGRGQFVDHAVHESVKVTGTVGRLGAPLVHRSYRGVTDFLARADRYSTLAAEAWVRSGRPVRLSDLVLRPAGRFLGMYVARAGFLDGWRGFLLAALYAYYVFVRSAKVWERARG

SEQ ID NO: 102 - protein, 330 aa, Unknown
  Description of Unknown: Candidatus Shapirobacteria bacterium CG10_big_fil_rev_8_21_14_0_ 10_48_15 sequence
MAKLSVILATYNEEANIGACLKTVQGLADEIIVVDGFSRDQTVALAKKAGAKVFVKPNLLMFHQNKQLAIEKATGEWILYLDADERVSPELKKEILAVIGSCSTLEEASSATSQEELGLNNSSAGGRRPPPRSCAGYWLPRKNIIFGKWLKHTGWWPDRQLRLFKNGSAKLPCQSVHEQPELKGEAGELKNPLIHQNYQTVTQFINRLNHYTDNDKNVFLKTGREIHWIEAVIWPAQEFLRRFFQQKGYQDGLHGLVLSLLQAFSSLVTFAKIWEAKKFPEAALDLDKLAKTKNNLAGEWRYWFLTSKIDQTDNYLKKIIHQFERRLIGV

SEQ ID NO: 103 - protein, 292 aa, Unknown
  Description of Unknown: Candidatus Woesebacteria bacterium GW2011_GWA1_37_7 sequence
MTKTEKHINIKTKKPKISAIIIAKNEEEKIAECLNSLQWCDEIIVVDTGSTDRTKEIALKHKTLVREYNGGSYDDWRNTGLKFAKGEWVLYIDADEGVSPELREEILNIINYPKGKYNAFAIPRKNIVLGKELRHGGFGKFDYVKRLFIRKKLVKWTGELHEEPNFYYNGRLTIGRSNELGYLSNKLIHLKASTISEMVEKTNKWSDVEAKLMYTADHPPMNILRFLSAMAREFWFRFIKEKAFMDGGVGIIHGIYQIYSRFISYAKLWEMQMYNTNNSNSTNLRTISKTKL

SEQ ID NO: 104 - protein, 259 aa, Unknown
  Description of Unknown: Candidatus Kentron sp. FM sequence
MGAIADVAIVDSFSSDETLPLAETVRPDVRVFSHAFKDFGDQRNWALEHCAPRHPWVLFVDADEYCTPAFLEELAAFVAAPGNYAGAFIAGKSHFLGRWVKYSSLYPSYQLRLLRLGQVRYRKEGHGQKEVTDGALCYFTEGWRHEGFRKGVYQWIERHNRYGTEEVGSILELRKEPIGWRELFSHEPIKRRRCLKRIGAKLPLRPLVRFCYVYVLKRGFLDGMPGLLYCLLYLCNDIHLIVKIREQRYRGNGELGIRN

SEQ ID NO: 105 - protein, 255 aa, Legionella sp.
MLSVIVIAKNEEANIENCLQSVQFADEIIVLDSGSSDKTVSIAKQYTDKVFETDWQGYGIQKQRALDKATGDWVLNLDADETVSIELQQEIKKVTARDEADAYRLPIQMVFYNQPLKYSYSPKRHARLFRRQGAAFSSDIVHEKVILPSHARIKKIKIPLLHHSFQDVSHVLYKLNKYSSYSAKIRIANKKTPGLIKILLATSWMFIRCFILQRGFLDGRLGFLFAVFSAQGTFYRGIKQIYQDANLHHLPELNT

SEQ ID NO: 106 - protein, 288 aa, Unknown
  Description of Unknown: Candidatus Cloacimonetes bacterium HGW-Cloacimonetes-2 sequence
MARLWVVVATKNLWAVANGISICTGCSSNHRGSVKHSVSAFVLTQNNEATIRACLDSVTWCDEIVIIDSFSTDRTLEIAREYPRLKIYQNEYTTAAEQRIWGNPHVTSEWVFIIDSDEECPPDLRDKFISILEQDKIENDGFVIRIRTRFMGRLLEHHDYISAKGKRLVLKEVATRYKKTASVHATIKLDHIAFIEPKYYLIHNPIRSLDLHYQKMIRYARWQAQDMHVSGRKAHWWHILLRPIGKFMQFYLVYGGFRDGLQGLLICLLAAYSIFLKFSLLYDLQRQD

SEQ ID NO: 107 - protein, 255 aa, Unknown
  Description of Unknown: Candidatus Hydrogenedentes bacterium sequence
MRKKLTILIPTYNEERNIRGAIECSRWADEILVVDSFSTDATPQIAAEMGARVLQHEYVNSAAQKNWAIPQASCEWVMVLDADERIPPALRDEILAFLENPGDVAGLRIYRDNHFMGRRIRYCGWQDDSVLRVFPRDRGRYLEREVHADVVVDGPVKVLRNKLYHNTFESFDQYMRKFDRYTTWAAGDRAKTTRKVTAVHLFLRPAWRFFRQYFLRFGFLDGRAGLIICMLAAFSVFLKYAKLWERQEREQRERK

SEQ ID NO: 108 - protein, 253 aa, Campylobacter hominis
MIKASVYAIVMNEEKHIERMLKSVADFDEIIIVDSGSTDKTLEIAKKYTDKIYFHKWQGEGFQKNYAFNLCKNEWVLNLDADEEIEPALKIEIGNFINQSEFNGLDIKFQEYNMGFIVSPFVKKNTHIRFFKKSSGKYENMGVHAQISINGKVKKSKYSIHHFSDKFIYELVVKNNNYSTLRAKSDFEKGKKPNFLKLIFIFPFMFFKSYFLRRSVFNGKRGFITSVINAFYAFLKEAKLYEISYLKEKNEKK

SEQ ID NO: 109 - protein, 457 aa, Clostridium celerecrescens
MFFGGIFYKSGGTYMKSSIRLSQCMIVKDEEQNIQRALSWGKGIVCEQIVVDTGSTDRTVEIAEALGAKVFHFSWNNDFSAAKNFAIEQAGGNWIAFLDADEYYSDEDAKKILPLLRQIEKDFPIALRPHTIRSLLVNLDDAGRSMTTGVQDRIFRNIPKLRYRNKIHEHLDLPGTQQFRHYDATEILAIFHTGYATKIFKEKDKEERNISMIKKELEENPENYVMWSYLGDSLLCANRLEEAEEAFLHMAENPDVTMTVDRKSLNFTNLLKTKYHRYIDSDEGFMAIYQKAKDCGCVTPDIDYWAGEWFCRRGDEEKARLYFEQALRMLEKYEGNDPLNISSRLFNIYQWLFLSYSKLKNPSEMIRYGILALRVEPYQVSILKEILLLLKGEPGEEETAVNTFGFLSKLYDLTSFKNKVFLVKVSEQVSFSALEKQVYSLLSDREREYLSKAGDIF

SEQ ID NO: 110 - protein, 275 aa, Unknown
  Description of Unknown: Candidatus Beckwithbacteria bacterium CG23_combo_of_CG06-09_8_20 _14_all_34_8 sequence
MNHIKLSVVLATYNEESNIKDCLSSVKDIADEIIVVDGKSVDKTAQIAQQLGAKVISVANNPQFHKNKQMAINSATGEWILQLDGDERVSPELAKEIRKVINDKQNKLDAYYLPRKNWFLGRFLTKGGAYPDPVLRLFRRGKGNFTHTKIINNGITTSNVHAQIEVGGQTGRLNYNLIHYGDISFSKYLMRLNRYTQLEAENLVLLKFKPNFLHLINYMICKPIYWFTKRYIRHRGYVDGYQGLLFALLSAMHYPVIYLKLLEHQHQEKYVTKTK

SEQ ID NO: 111 - protein, 268 aa, Unknown
  Description of Unknown: Microgenomates group bacterium GW2011_GWC1_44_37 sequence
MKLSVIILTYNVEDEIIPAIKSSQFADEIIAVDTGSTDGTLDICRKNGVKIVHTTTDSFSKWRNDGAKVAKGEWLLYLDSDERIPVKLAKEILATIQSPQHSAYTISRYEVFLGKHLNHWGDPRVLRFMKRSALKRWEGKLHEQPKIDGTIGDLRQQMVHLSHKNIDEKLPNTLLWSKTEAKMLYDAGHPPMVGWRFIRIMFTEFWNRAVRQRLWRDGTEGWIEIIYQMFSKFVTYERLWEMQRKPSLKETYDNIDKQILNEWSDKKL

SEQ ID NO: 112 - protein, 302 aa, Phycisphaera sp.
MSSPDTSRSNIEFLILTKDEEINLPHTLEALLPWADRVHVVDSQSTDLTREIAEEYNQKHPGKVNTVIQPWLGYAKQKNWALDNLPFESDWIFIVDADEIVLPELRDELLDIAAKNPDVVKESGFYINRYFIFLGKRIRHCGYYPSWNLRFFKRGKARYEEREVHEHMIVEGEEGYLKGHMEHNDRRGLEVYMAKHNHYSTLEAREIHSVITGASEQSEHLDAKLFGNNLQRRRWIKHHFYPKLPCKWIFRFLWMYFLKLGILDGVTGFRFCLFISAYEMLIGLKIMELQIEERERRAGSAK

SEQ ID NO: 113 - protein, 254 aa, Unknown
  Description of Unknown: Muribaculaceae bacterium sequence
MAHISVTIITYNEEHRIEACLKSLQDIADEIIVVDSFSTDRTVEICNAYGCKVTQRRFPGYGAQRQYATSLTSYSYVLSIDADEVLSPALRSSLIKLKEEGFAHRVYEMSRLNFYCGQPVKHCGWYPDIQIRLFDKRYANWNLRDLSERVIFPDSLKPVLLDGDILHYRCSTPDEYRKVQNRHAALSSGIIKARRSAVPFFTPYIKGVKAFLECYISKGAILDGPEGRAISRESYRTAYMAYDLARRSLRKKQQ

SEQ ID NO: 114 - protein, 261 aa, Unknown
  Description of Unknown: Verrucomicrobia bacterium sequence
MREKISACVIAFNEERKIRRCLQSLTWCDEIVVVDSFSTDRTVEVCREFTDRVYQHEWLGYVGQRNTVREMARFPWILFLDSDEEVSPGLREEILGHFARGPGETVGYEFPRQVYYLGRWIRHGEWYPDLKLRLFRKDCGRTEGQEPHDKVVVNGPVKRLRNAIWHYTYDDLRDHFETLNRFSSITAQQKFVQGGRFRWRDLLLRPPLRFLRGYFLRAGFLDGTHGFIIALASAYGAYMKYAKLWELTLREQKPFKDLPED

SEQ ID NO: 115 - protein, 351 aa, Unknown
  Description of Unknown: Clostridiales bacterium Marseille-P2846 sequence
MIVRNEHRHLMRCLKSAEEAVDEIVVVDTGSEDDTREIARGFTPWVYDFEWQDDFSKARNFSFSKASQDFILWLDADDMIEPEDAQKLIELKKTIGKTADVVMLPYRIGFDDRGIPTMTYYRERLLRRSMNFRWEGAVHEAITPAGRILYADAAVSHRKEGTGDSDRNLRIYEKLLAQGKQLGPREQFYYARELSDHGRFAEALAAFEAFLEQPDGWIENRIDACRGAARCLSALDRKEEAQAMRFRSFAMDVPRAETCCEIGAAFLEAQNYRAAAYWYERALTCQADTRSGAFVQPECYDYVPLLQLCVCYDRMGERMLARQINERVGERWPDDPSYLYNKAYFERAGRA

SEQ ID NO: 116 - protein, 284 aa, Methylacidiphilum kamchatkense
MYISVVILTYNSEKTISSTLQSALAVSDDIHIVDSYSTDNTLKILNAYPVHIIQHPFENYAKQRNYAIENLPIKNNWELHLDADEKLTPGLIQELKDPTLFNQEQIDGYYLPRIVRFLGKIIKHGGISPTWHLRLFRRGKGHCEDRLYDQHFYVRGQTAKLSGTMIDDIQMDLTEWIQRHNRWASLEAQEIYYNLNNGKNIKAKWQGNPVEQKKALKQLYYKLPLFIRPFLLFGYRYFIKLGFLDGFEGLIFYVLQTFWFRFLIDAKLWEYSKKEKFPNHLVKQ

SEQ ID NO: 117 - protein, 260 aa, Legionella pneumophila
MLSVIIITKNEEANIRRCLESVHFADEIIVLDSGSTDNTLAIAREYTDKVFSTDWQGYGIQKDRALRKAKGDWVLNLDADESVSPELRQEILQAISSDTADAFRIPIQMIFYNQVLKYSGSPKRHIRLFKRENASYSKDIVHEKVLIPANARVGKLKKPIWHHSFQDVHHVLYKLNKYSSYSAKIRIESNENAGLVKTFFSALWMFVRCLFLQKGFLDGKAGFLFAVFGAQGAFYRGVKQIYKDKDINKLPGVNLIEEEK

SEQ ID NO: 118 - protein, 305 aa, Helicobacter fennelliae
MIDVKINNAKKISICILVKNAQGTIKECLKALKDFDEIILLDNESTDSTLEIARGVSEEWTRDSRIVGNLEHEDSKDSKNSAKPAKPATIRIFSSPFLGFGALKNLAISHARNEWVFVVDSDEVIEQGIYAELETLDLSCVRAIYALPRKNLYAGEWIKACGWSPDFVLRIFNKSYTHFNENLVHESVILPSDSKKHYLKTALKHYAYDDVAHLIDKMQHYSNLYAKQNLGKPSSPTKAFVRGTWSFVRNYFFKKGILYGYKGFIISVCNALGTFFKYIKLYELNTHTHTQFVRSSLRHIIKKRD

SEQ ID NO: 119 - protein, 245 aa, Lacinutrix mariniflava
MIKLSVIIPTYNEEMYLEKALRSVRFADEIIVVDSMSTDKTVAMAEKYNCKVLHRKFDNFSNQKNHALQYATGEWVLFIDADERIPNPLQQEILAAMASGKHAGYKLNFPHFYMNRFLYHHSDSVTRLVIREKCHFEGSVHEKLIVDGTISKLENPVLHFTYKGLQHYISKKDSYAWFQAEQMLKKGKKATYFHLAFKPFYRFFSSYVLRGGFRDGVPGLTVATINAYGVFSRYVKLMLLERGIR

SEQ ID NO: 120 - protein, 603 aa, Massilibacillus massiliensis
MKISACIIAKNEEYNIGKCLKSMKPIVDELIVVDTGSTDQTLEVARSYGAKVYAYTWKNDFAKAKNYAIEQAKGDWIIFLDADEYFSEDTVKNVRSYIEKLHLNKKCHAICVRIINIDVDQDNRELSSFVNLRIFRNAPHFRYRYELHEELYNTKGRLEIFILSDVIEVYHTGYSSHIVEKKLERNLAIIQEEVKKHGESPRYYRYLCDCYHGLQKYDEAVKYGRLHIQSNISSIANESTVYTKVIDSLIRSNAEPSEIKNEIEQTIQIFPSIPDFYALYGRYLCEQKEYEASIQYFLKALEINKKKDIYEADSFHGKLTNLYCALGELFFLKNQYDKAVQYYCESLIAYKYNASALQRLYFLICRYESIEIISILNRVYARTKRDIKFIVDNLQHYRMNKVFVYYSNILNQEFSVASEYMWQNQMIGLKNYAKLYEKSADGLSERMLLLAVTLIVSDDESKVNQYKMILPNRYESIIIRFYDETVQLDENNFEGYKEILQELCTLDTERLDHYISCGEDFGKEKKVEIAQILTDHSFYKQALRLYQSLFDNDKTKYDIAKKIGYCYYKQFMYKEAMVYFEQAIENGCKDQEIVQLYKWSREK

SEQ ID NO: 121 - protein, 256 aa, Unknown
  Description of Unknown: Chitinophagaceae bacterium sequence
MRISVVIITYNEEKHIERCLRSVGKVADEIVVLDSISADRTVEIARRYGAVVYSQPFAGYVAQKNRALELATNDYVLCLDADEALSEELAESILRMKEQDKAGTWKMNRRAFYCGAYITHGAWYPEPKLRLFDRRRMKWGGYDPHDRVIPPAGVNVGKMKGDLLHYICETVEEHERRSRNFSTIASRSLYKAGIKTNWLKMIGSPAWFFISDYVFRGGFLGGWRGWKIATIQTKYHFEKYRKLYRLHKQQDLNKPV

SEQ ID NO: 122 - protein, 249 aa, Arcobacter trophiarum
MNISTVVLAKNSEKTIEKTLKSLVDFDDVIVYDNGSTDETINIAKKFSNVNLIQGEFKGFGWTKNCASSFALNDWVLIIDSDEVVDRELLNELKTKKLDKNIVYRLNFKAFYKDIQVKHCGWNNQKIKRLYNKTITKYNSNDVHEDIITDGLNIEEIKGNVEHYSYHTISEFIIKADRYSTLFATNNTGKKASSPTKAFLNSIYSFFRTYIIKQGFRDGYVGLVIAYSHAVTNFYKYIKLYELNKELKK

SEQ ID NO: 123 - protein, 347 aa, Unknown
  Description of Unknown: Eubacterium plexicaudatum ASF492 sequence
MLSVCIITKNEKENLERCLKQLSGYGFEIVVADTGSDDGTVQMAQQYTNAVYEFEWCGDFAKAKNYAVSMAKNNTVLVIDSDEYMRTPDLDKLKQQIAEHPTAVGRIEIINQIRQDHEIRESREYVNRLFDRRYYHYEGRIHEQLVANDGSEYPVYYTVIIIDHSGYLLSEQERSAKAQRNIRLLENVLEEDGPDPYILYQLGKSYYMIHAYEDACDFFARALSYDLDPELEYVIDMVECYGYALLNSGKADQALALEGIYEQFGRSADFQFLMGFIYMNNERFDRAIEEFLKASEHKESRMKGVNGYLAFYNAGVIYECTGNKEKARELYRKCGDYEPAKKRMREI

SEQ ID NO: 124 - protein, 259 aa, Unknown
  Description of Unknown: Candidatus Omnitrophica bacterium 4484_70.2 sequence
MKVPLSVIIITKNEESRIKDCINSVKDWADEVIVVDDYSQDKTRDIACSLGAKVFLRRMDIEGRHRNWANSQARNEWILSLDADERVTPQLKEEISQVLKNPQFDAYTIPRKNFFHNYWIRYSGQYPSSQLKLFKKDKLKWEEAEVHPRAFMDSNPGRLKNPLLHFTYKDFSDMLYKLNKQTTLEAIKWAKISEHNPQKASYKMNLIHALWRTLDRFIRVFIVKKGYKDGFIGFIIALNSSLYQIISYIKYWEIKKFRK

SEQ ID NO: 125 - protein, 317 aa, Calothrix sp.
MSNKVPVSVIIPAKNEEANLPACLASLQRASEIFVVDSQSTDKSAEIAQSYGASVVQFHFNGRWPKKKNWSLDNLPFRNEWILIVDCDERITPELWDEIALSIQNNQPNQPQFDGYYLNRRVFFMGKWIRHGGKYPDWNLRLFKHKLGRYENLNTEEIRNTGDNEVHEHVILKGEVGYLKNDMLHEDFRDLFHWLERHNRYSNWEARVYYNILTGQDDDGTIGASLFGDAVQRKRFLKKIWVRLPFKPLLRFILFYIIQRGFKDGKAGYIYGRLLSQYEYQIGVKLYELRNCNGQLNTAKKQAKSSAPKLQQKQEAI

SEQ ID NO: 126 - protein, 293 aa, Unknown
  Description of Unknown: Candidatus Shapirobacteria bacterium CG03_land_8_20_14_0_80_39 _12 sequence
MKISTVINTYNEEKNIGRCLESIKNFSEEIIVVDMHSTDKTVEIAKKFKAKIFFHEYTRYVEPARNFALSKATGDWILLLDADEELSQSLFKELIKIAKENTVDFVEIPRKNIIFNKWILHSRWWPDYLVRFFKRGKVKFSEEIHVPPVTSGKGQKLLATEENTIVHYNFQTISQFIERFNRYSDIESEQLISKGYDLDWKDIIFRPANEFFSRFFAGDGYKDGLHGLVLSLLQAFSEFVVYLKIWEKDGFKENSIPEIENVFKKVAHDFYFWQGKSTSGLFMRIRLKIKSKI

SEQ ID NO: 127 - protein, 319 aa, Aphanocapsa montana
MTSKLPVSVLIPAKNEEENLPACLTSVARADEVFVVDSQSEDRSIEICEEYGAQVVQFHFNGRWPKKKNWSLDNLPFKHDWVLIVDCDERITDELWDEIAEAIQKPGYSGYYLNRRVFFLGKWIRFGGKYPDWNLRLFRHAHGRYENLHTEEIRNTGDNEVHEHVVVESGEVGYLKNDMLHIDFRDLFHWLQRHNRYSNWEARVYYNILNGMGEDGTIGANLFGDSVQRKRFLKKIWVRLPFKPTLRFILFYFLRLGFLDGRAGYIYGRLLSQYEYQIGVKLFELQEFGGQLNVQKSDAAEPTAEAEQSPAIASAKAQS

SEQ ID NO: 128 - protein, 259 aa, Unknown
  Description of Unknown: Deltaproteobacteria bacterium sequence
MGMGIGISGVVVCFNEEENIERCLKSLTWTDEIVVVDSYSTDNTVSICKKYTDRVYQREWPGINKQKEYAVSLAKNEWVFILDADEVVSEELKEEIIKRLSSDKGKYDGYMVKRHTYYLGRWINHGGWYPDYKLRLFKKQKGYFVGKDPHDKIAVSGDVAKLNGEIYHFTYKDIAHHIRTINSFSDVVANNEKEKERFIIPKMLFKPAIKFLETYVYKLGFLDGIPGFIISVLSSYYVFIKYAKLWEKRFVWHKGLSHS

SEQ ID NO: 129 - protein, 263 aa, Unknown
  Description of Unknown: Flavobacterium degerlachei sequence
MEKVKSTESVPTDIHLSALIITYNEEHNIKQLLQDLDFADEILVIDSFSTDKTVEIAQSFSNVKVSQHVFENYALQRNYALSLAKGTWILFLDADERLTPALKDEIIQTIQNKAEFNSYYFKRTFMFANEKLHFSGWQTDKIIRLFRKENTTYSLQKTVHEKLNTVGDIGKLNNRLIHYSYTDYFSYKEKMTRYGKLKASEEFIKGTKPHFFHFYLRPSFQFINQYLLRLGILDGKKGIIICYLNAFSVYIRFQELKRMKLKN

SEQ ID NO: 130 - protein, 278 aa, Hormoscilla sp.
MFSIYILTYNEEIDIAACIESALLSDDVVVVDSLSSDRTIKIAERYPVKIVQHAFESHGRQRTWMLKEVPAKHEWVYILEADERMTPELFAECVEATKTSEFVGYYVAERVMFMNRWIRHSTQYPRYQLRLLRVGKVWYSDYGHTEREECDGPTGFIKETYPHYTCSKGLSRWVEKHNRYSTDEAAETLRQISAGQINWRDLFCGKSEVERRHALKDLSLRLPFRPIVRFVYMYFLLGGWLDGSPGLAWCTLQTFYEYLIVLKVWEMNHMPPPKLDID

SEQ ID NO: 131 - protein, 259 aa, Frateuria terrea
MRESLSVVVTTYNSEDTLGACLASAAWADEIVVLDSGSSDATIDIAQRHGASLHTQPFAGYSAQKQAAIDLARHRWVLLLDSDEALPADAAAAVQRVLESPCCAGYQLWRREWVFWRWQSPRARLNHYVRLFDRERARMSGHSVHETVQVDGPVGRLDVVLDHYGEPDIAGRVDKANRYSSLQGAEDARRQRAWLGWRLVAYPTIAFLRYYLLRGHWRAGWAGFIAARVHAFYAFLKYAKLHEARVRAAQGTPRHPRQR

SEQ ID NO: 132 - protein, 256 aa, Unknown
  Description of Unknown: Candidatus Omnitrophica bacterium sequence
MKENLSVVILVKNEEQRIAKCLDSVRWADEIIVVDDESTDRTVEIARQYTSKVFTDKKKDIEGRHRNWSYSLARNTWVLSLDADEIVTPELKEEIIQAIRSNPVENGFTIPRRNYIGNYWVRHGGWYPSPQLKLFKRDKFKHEEVEIHGRAFMDGPCGHLKYDIIHYSYRDIEDLIRKLNNQTTWEAQKWHRLHKPMRFGRFFYRSIDRFIRTYIAKKGYKDGFMGFVVAFNGALYQIVSYLKYREIILNEKEKNK

SEQ ID NO: 133 - protein, 258 aa, Unknown
  Description of Unknown: Paraphotobacterium marinum sequence
MNEISLYILTYNSEQYLSKILDKLKNVVDEILIVDSGSSDSTQQIVERYKNTRFIFNKFENFKQQRMFAEKNCKFDMILFLDSDELPCDQLVESIRNIKKSGFEHHAYRIARYWNVLQKDVRAIYPICSPDHPIKLYNRKFCSFKNSALNHASPSGYLSQSIVKGKLSHFTFETKKILKNKVEHYSDMDAKELIRKGKKSNNLKIIFNPVGAFVKWYLIKGGYKDGITGIHLGKYAYDYTKKKYLKAKNYRKNFHTHK

SEQ ID NO: 134 - protein, 267 aa, Unknown
  Description of Unknown: bacterium F16 sequence
MPKLSATMLTCNSERTVEAALKSLAFADEIVVIDSGSTDSTLDIVRNYTDKVFSRDWTGMEDQYNYAQDKCSFDWVFGLDSDEDVPEGLALEIKQTIERQDEASADRKCWGFEMQRRTFFLNRWIRHGSWVPDRITRLYHKDHGRWEGNPHCGVKVHGKIGVLTSYVYHYSYTGISDQLKRLDRYSSDIQDSYARNHKSFSVVNLLLNPMACFIKEYFLKRGFMDGIPGLVIAFNDSCYVFNKYAKLWERKHCNPEKVADSKQRNRP

SEQ ID NO: 135 - protein, 626 aa, Phycisphaera sp.
MSGGRDVRIQTVQVLRGALEHRGETSLDSLAVSIRLLRYGDVPELPRPGDRLIDVLIITKNEEANIGFCLAALHGWTRKIFVVDSGSTDRTREIVESTEAQFVHHDWAGYAAQKNWALNNLPFEADWTLIIDADEVVTPALRAEIEAVLAKGVDEVPESAFYLNRLFYFLNRPIRNCGYFPSWNLRLFKRGTAQYEDRAVHEHMVVDGEVAYLEEPMIHDDRRGMEHSIAKHNSYSSLEAQEILRGREAAGPPASGLESSFFGNALQRRRWFKQKIYHLLPAPWLFRFLYMYVWRRGFLDGSTGLRFSLFISAYEFLISLKIRELRLNRAPRLPKPMDPALPSKDLPVTVVVPVLNEEKNLPACLSRLGRFAKVVVVDSGSTDRTCEIAAEHGAEVVDFRWNGQFPKKRNWVLRNHEFDTPWILFLDADEYVTEDFCDELAARLPETPHDGMWLSYHNYFMGRYLRHGTAFTKLALIRTGSGEYERIDEERWSHLDMEVHEHPVLQGSTGKIAASIDHDDYKGLESYISKHNEYSSWEAKRYSKLVEDGGAGQSYFTRRQRWKYGAIRRWWLAPGYFLVSYFLRFGLLDGFPGFGFALLKWIYFFQIRLKIIELENARDEPPPSVG

SEQ ID NO: 136 - protein, 256 aa, Unknown
  Description of Unknown: Flavobacterium sp. 83 sequence
MKYNHNTKISVLIITLNEENQMKALLADLDFADEIIVVDSFSTDNTEVICKSFENIKFIQNKFDNYSSQRNFAISQAKNDWILFLDADERLTPELKNEILVTVKNNETSAAFLFRRTFMFENKILHFSGNQSDKIFRLFHKNHAEYTSEKLIHEKLKVNGKIGILKNKLIHYSYANYDSYKLKIIRYGKFKAQEKFIKKQKKSNLLHLLHPTYNFLYNYFVRLGFLDGKKGVIICYLNAYCIHIRYTELNKLWKKK

SEQ ID NO: 137 - protein, 255 aa, Seonamhaeicola sp.
MVKLSGVIITYNEERNIEKCLQSLIPVVDEIVVVDSFSTDRTKAICQKHNVTFIEQAFLGYTEQKNFAINQAKYDYIVSLDGDEALSEQLQKSILELKINWVFDGYYANRFNNFCGQWIKHSDWYPNKKLRIFNRQKAKWVGNKVHEVVALTNKNSPVGHLKGDILHYTYQSYSEFNLKTEQFSSLSAQAYFKLGKKAPIWKIILNPTWAFFKSYILRLGFLDGLNGFIICVQTANITFLKYTKLRELYSKTPNN

SEQ ID NO: 138 - protein, 299 aa, Unknown
  Description of Unknown: Candidatus Curtissbacteria bacterium GW2011_GWA1_41_11 sequence
MKISVVISAYNEEKQINDCLISAKKIADEIIFIDNQSTDATEELAKKYTNKIFKKVNDPIMIDKNKNYGFSKASGDWIFSLDADERVSDALASEIKRAVQNTKISGFEIPRKNIIFGKWIRNSIWWPDYNLRLFKNRSGRFPLNKVHEKIIIHGEVSRLKNPIIHYNYQTISQFLIKLDNYTESEAMDFIRLNKEIKWYEILRWPVADFLKTFFSQRGYRDGMHGLALSMLQAFYQLVVFLKVWEKKENYKDLSPKAFLKEAVSELSKISKDTRYWVYEALSKERPKMKIIYKIKKKLS

SEQ ID NO: 139 - protein, 261 aa, Unknown
  Description of Unknown: Candidatus Aminicenantes bacterium sequence
MNVKISAVVVTYNNEKKIEGCLESLEGIADEIVVVDSLSTDGTRKIATQFTDKIIKHSSTDYAFLKNLGQKASANEWILSLEPYERLSTRLRLELLKLRSQSVEVDGFYIPRRSFYIYRWIRHSGWYPDYRVRLYQKEKGSWKKEKNRIFLDFSGRAKKLKSPVEHLGFSSISEQVIHINRIAERRAQELYARKKKTRLDHLFFWPAAKFLYVYLLKLGFLDGFAGLVISTLSAYSVFLKFAKLKEIWKKGEKIEFMPGCR

SEQ ID NO: 140 - protein, 297 aa, Unknown
  Description of Unknown: Candidatus Pacebacteria bacterium CG10_big_fil_rev_8_21_14_0_10 _45_6 sequence
MKLSVVITTKNAATTLERTLESVKFADEIVVVDMMSTDETVRIARKFTDNIFTTPDVGYVEPARNFSLSKARGEWILVVDADEVISETLRDYLLELLATDSDIASYSLARKNLIFGDWVQTAGWWPDYQPRLFRRGKVIWSDLLHSKPAIDGKSEKLPDKAELAIEHHNYESLTQFVQRMDRYTSIAARMGAQKTESLEHPVIVFRREFLQRLFSLRGIDGGYRGILLAFLQGLSEVVQTAKFWESKHTELYGSKIETLNELSELRAQLAYWIADEELLTARGLQTLVWRVRRKIRI

SEQ ID NO: 141 - protein, 313 aa, Cylindrospermum stagnale
MSSKIPVTVIIPGKNEEANLPACLTSLQNADEIFLVDSQSSDKSVEIAESYGANVVQFDFNGQWPKKKNWSLDNLPFRNEWVLIVDCDERIPPELWEEIDQVIRNDEYAGYYLNRRVFFLGKWIRHGGKYPDWNLRLFKHQKGRYENLNTEDIPNTGDNEVHEHVILQGKVGYLKNDMLHEDFRNLYHWLERHNRYSNWEARVYLNLLTGKDGSGTIGANLFGDAVQRKRFLKKIWVRLPFKPLLRFILFYIIQRGFLDGKAGYVYGRLLSQYEYQIGVKLYELRNCGGQLNTAITPKSATPSLTQEIEQTAT

SEQ ID NO: 142 - protein, 248 aa, Unknown
  Description of Unknown: Proteobacteria bacterium ST_bin11 sequence
MLSVVVITKNESRHIARCLASVAWADEIIVFDSGSDDDTVAICQQYTDQVFVTDWPGFGLQKQRALAKAQHDWVLSIDADEEISAALKIEIQQALQNSEAQGFEIPRLSSYCGREIKHGGWWPDYVLRLFRREAGHFSEVVVHERVVVHGKIDRLRNPILHESYIDLEEVLNKTNSYSSLGASKLFAQGESASLGLAIAKGFWTFFRTYFIKLAILDGPQGLMLAISNAEVSYYKYLKLWDMHRLSKQ

SEQ ID NO: 143 - protein, 274 aa, Paludibacter jiangxiensis
MTSKIAVTVIVPVKNEEVNLPGCLDKLDGFEQLIVIDSGSTDRTPEIAKEYGAEYVNFQWNGQFPKKRNWALRNLKIRNEWVLFVDADEYLTPEFIEELKVKIQDPTKNGYWVVFKNYFMGKQLNHGYEFKKLPLIRKGKGEYEKIDEDSWSHLDMEVHEHPIVEGETGQFQEAILHNDYKGLEHYIARHNAYSTWEARRFLHLEKEGFSKMTFHQKIKYNLMKTPFLPVIYFFGAYILMRGFMDGRAGFYIALYKAHYFFQIKTKIEEFRKTK

SEQ ID NO: 144 - protein, 260 aa, Unknown
  Description of Unknown: Geobacter sequence
MAKVSVYIIAYNEEQKIEPALQSVTWADEIVVVDSFSTDRTAEIARKYTDKVVQVPFEGFGKLRNSAIAATSHEWIFSLDTDERCTEEAKNEILAIIDSPDALDAYYVPRRNIFMGRWVRYSGWYPDYRQPQLFRRGAQVFTDEVVHESFTTIGRVGHMKNAIWQIPFRNFEQMISKIDRYSTLGAAKMAAKGVRPGMGKALFHALFAFFRMYILRRGILDGWAGFVIALYTFEGTFYRYAKQVEAARGWVMTRPEELER

SEQ ID NO: 145 - protein, 267 aa, Unknown
  Description of Unknown: Rhodanobacteraceae bacterium sequence
MAREKFSLVIITYNNADTLERCLAAANFADELVVLDSGSTDATVAIAERYGARVAVHPFDDYGPQKQRAIDMARYDWVLNLDADEILAPGTCAVIERALEHPRVAGYRLPRRERMFWSVQHPWSHRNGHLRLFDRRRGHMNDVPIHAAVEVDGPVQTLVRADFVNMGDDDIAARVAKINRYSSGMVADKLARKQRFAGSMLLLYPPIFFVRQYVFKRYFLSGWAGFVASALGAVYVFLKYAKLLEARQHRPARPSAPPAQPPSHRGQ

SEQ ID NO: 146 - protein, 260 aa, Cupriavidus sp.
MKISVVLITKNEAHNIRECLESVSWCDRAIIVDSGSTDGTVEAARAMGAEVWETTTWPGFGPQKNLALSKAQSEWVLSIDADERVTPELRDEILAAIDAGQADAYDMPRLSRFCGRFIRHGGWYPDRITRLFRRGKARFTDDLVHENVVTDSTVGHLRTPLLHYTYDDFSQVLRKIDQYSTLGAHQAFQRGKTASPAGAMLHGSWAFLRTYLFRRGFLDGPQGLGVALMNGQASYYKYVKLWLLQQQARQQPQSGDPQPR

SEQ ID NO: 147 - protein, 316 aa, Microcystis aeruginosa
MFSQSEKIPVSVLIPAKNEESNLPACLESVARADEVFVVDSQSSDRSIEISTNYGANVVQFHFNGRWPKKKNWSLDNLPFRNEWVLIVDCDERITPELWDEIATVIQDPNYNGYYLNRRVFFLGQWIRYGGKYPDWNLRLFKHKSGRYENLNTEDIPNTGDNEVHEHVILDGKVGYLKNDMLHIDFRDIYHWLERHNRYSNWEARVYYNILTGNDESGTIGAHLFGDAVQRKRFLKKIWVKLPFKPLLRFILFYFIRLGFLDGKAGYIYGRLLSQYEYQIGVKLYELRRFGGKLNVNTHTNPPIKPSEPQPAEMIK

SEQ ID NO: 148 - protein, 252 aa, Unknown
  Description of Unknown: bacterium sequence
MINLSVVILTKNEERNIQECLKSVSGWADEIIVVDDESTDKTREICAKFAHKILVRRMDVEGRHRNFAYAQAKNLWVLSLDADERATEELKKEIEEALEAEVKYNGFTIPRRNFIGDYWVRHGGWYPSPQLKLFRKDKFSYEEAGVHPRAFMDDPCGHLKSDIIHYSYKNIEDFLSKMNNQTTREAQKWFNQNKPMRLGRFIWRAYDRFFRSYFGKKGYKDGFIGFTIAYFAGLYQFLSYLKYREIIRSKAQ

SEQ ID NO: 149 - protein, 273 aa, Larkinella rosea
MKIPVKAPLSVVIITLNAERTLKLALESVVEWVDEVIVVDSGSTDATLTIASDFNCRVTYRKFNGFGPQKQYAIDQAKNDWVLVLDADEIVTEQLANEIAALFVGEPIHAGYTLPRNLIFLGRILRHSGQNRQPVLRLFNRHHGRMTPVPVHESVQVEGSIGQLSGILIHYSYGSLHDYVLKMNHYTTLSAEEMALRHKKANIPLQGLRFLFTFLKIYFFKGGLLDGYPGFVWALLSAIYPVIKYSKLQELHDNDEKPKTKPVLAFGQTPGFR

SEQ ID NO: 150 - protein, 250 aa, Halanaerobium sp.
MNELSALVLTYNEESNIAECLKSISWIEQIVVVDSFSEDQTEEICRQYDNVDFYENKFKDFASQRNFGLDKIESEWVFVIDADERVTEELRDEIIETLNQPEAEGYEIARKNYFLGKWIKYCGWYPDYTLRLFKSKYKYSGLVHESPQINGKIKKLENDFIHYTYKDLASYAAKMNQYTTLDAEKKYRAGKTVSISYILLRPFLEFIKKYLLKKGFLLGSQGLILSALSAYYQFLKAIKLWELNNFGDEN

SEQ ID NO: 151 - protein, 291 aa, Unknown
  Description of Unknown: Verrucomicrobia bacterium sequence
MEGINRVGLTAIILTQNEEKNIAACLESLSWVSQVIVVDSGSRDATLEVARGTRPDVEIHTHPFADFGQQRNWALENTPVRNEWVLFVDADERIPAACAREIGDRIADPQGCVGFYLCNRYWFMGRWIRHCTLFPSWQLRLLRKGRVRFVREGHGQREVADGPLGYIREPYDHFGFSKGISEWVSRHNRYSSMEVELILRLRREPVVVGDLLRRDPVRRRRAVKRLAARVPCRPLIRFAYTYFFRRGFLDGRPGLVFCLLRLAHEIHVWAKLQEAEWTHRTTGTYSGDRRG

SEQ ID NO: 152 - protein, 255 aa, Shewanella putrefaciens
MKKHSLSVMLITKNEADRVERCLASIADIADEIIVLDSGSTDNTLAICQKYTDKITVTDWPGFGKQKQRALDQTSCDWVLSIDADEALDDTMRNALVALLSQEQIKESAFCLPWGVTLYGKTLKYGRSARAVLRLFKREGARYTLDEVHETVIPADGNIGKLKGLLLHYTHRDYGHGLNKAAQYAWLGSQKYHRKGKKSHGLMLALLRGLWTFLHIYFLRRGFLDGRVGFIVAMTYAQVNFNKYVGLWLLENKRC

SEQ ID NO: 153 - protein, 261 aa, Mariprofundus sp.
MRTDSKLSVYIIAYNEEEKIADAVNSVLWADEVIVADSHSKDRTAEIASALGARVEQLDFEGFGKLRNDAIAACTHDWVFSLDSDERCTPEAAEEIRDIINRPDAAGAWYTPRRNWFMGRWINHCGWHPDYRQPQLFKKGALVFNNHDEVHEGFEIHGSIDHMQQAIWQFPFKDLSQIQDKGMRYSTLGALKLERNSVSAGMGKALARGLWAFFRIYILKLGMLDGWAGFVIAFANLEGTFYRYAKLTERQKGWSNPPKSP

SEQ ID NO: 154 - protein, 250 aa, Unknown
  Description of Unknown: Chryseobacterium sp. VAUSW3 sequence
MSFTEHISGLIITFNEEKNIQEVLECFDFCEEIIVVDSFSSDNTVEIASRNPKVKIIQHRFEDFTKQRNIALDAAKNDWVLFLDADERITPELEKEIRETISRPDAKDAYYIYRIFFVGKKKINFSGTQNDKNFRLFKKSKASYVKHKKVHETLGVKGTTGVLKNKLLHYSFENYTSFKSKMLYYGRLKGEELAETGKKYLIAVHYIKVIFKFVKTYFLKLGILDGVDGLRISYLQSLYVNETYRTLRDL

SEQ ID NO: 155 - protein, 254 aa, Unknown
  Description of Unknown: Gammaproteobacteria bacterium sequence
MLNQISIVIICKNSDSTLQKTLESTLGFDEVVVYDNGSDDETLAIASKFENVSLHQGSFVGFGPTKNLAVSLARHDWIVSLDSDETISPELTAYLRQWKPESNLVVGFVRRKNFFMGQYVKHGSWGNDWLLRVFNRTTHQFNDAPVHEKVDLSKQSIKQRLPYPIEHNAIQEISQLLIKLDRYSEIRRTQGGKTFHPWFIVLRSLFAFFRSYIIRAGIVDGWRGLVIAWNEADHVFYKYMKRYVDKVTHTQKNQ

SEQ ID NO: 156 - protein, 263 aa, Unknown
  Description of Unknown: Acidobacteria bacterium sequence
MKISACIITFNEEKNIERAINSVKWADEIIVVDSESTDRTREIAESLGAKVFVQKWLGFGKQKQFAVDKAQHDWILSLDADEEVSESLRDEILSLKNSDQLIADGYKIKRLSIYMNRPIRHGDWYPDWQLRLFNRKKGKWKDVPIHESFEMNPNTKIEKLKNQIFHYSVENFTHHNRMITERYAPLAALMMFQNGKRTSIPKIILSPLLAFCRSYFLKLGFLDGFAGFCIAYFTAHHNIMKNLLLWEMQQNNKEKSQDYQKSS

SEQ ID NO: 157 - protein, 252 aa, Selenihalanaerobacter shriftii
MGLLGALVLTYNEEENIIDCLESINWIDELVVVDSYSEDETVELAKQHTEKVYQREFDDFSSQRNFGLDQIESEWVLVVDADERVTFELKEEVLERLNNPQAEGYRIPRKNYFLGKWIKYCGWYPDYTLRLFKVADNRYSGLVHEGIKIDGRVDKLDNAFIHYTYRNLKHYLDKINQYTTLDAEDKYQAGKKKGLAYILLRPVVEFIKKYFLKKGFLLGFQGLILSILSSYYQFLKYIKLWEKHEVDSRGDE

SEQ ID NO: 158 - protein, 258 aa, Selenomonas bovis
MATLSALILAKNEEKNIADCIKSVAFADEVVVVDDFSTDETAAIAARLGARVVRHALAGNWGAQQTFAIEQAHGDWIFFIDADERATRKLAAKAREIVDADDRRYAYLNARLNYFWEQPLRHGGWFPDYVIRLLPKKGTYVTGFVHPAFHHGYEEVRLPEDACMIHYPYRDWNHYFSKLNFYTMLAAEKMQQQGKSACLADFLLHPAWASFRMYILRGGWRDGRIGFVLAAFHYFYTMAKYVKLYYLDKTNRHVGDEA

SEQ ID NO: 159 - protein, 308 aa, Aphanothece hegewaldii
MFSIYILTYNEETDIADCIKSALRSDDVIVVDSYSTDQTLEIASLYPVRMIQHRFESHGKQRTWMLETIPTKYEWVYLLEADERMTDELFAECVKATQQEQIIGYYVAERVMFMGKWIRYSTQYPRYQMRLFKKGKVWFTDYGHTEREVYDGKTSFLKETYPHYTCGKGLSRWIDKHNRYSSDEAQETLKQLTNGQVEWTKLVLGNSEVERRRALKDLSLRLPFRPLLRWLYMYFLLGGILDGRAGFAWCTLQAFYEYLILLKVEEIQKKLLPESPFIETKELQNGHRNHHANAISAIPISSSTECEK

SEQ ID NO: 160 - protein, 258 aa, Selenomonas sp.
MKLAVIILTHNEERHIEACIRSASFADEILVIDDDSTDRTAEMARAAGARVISHPLAGDFAGQRNFALTQTDADWVLYVDADERVNEGAEAELRRVMAENARAAYEIKRINVAFGQEMHYGAHRPDYPRRFLPRDAVRWEGLVHERTVSNLPVRRLKGSLLHYTYTDWDQYFQKMNQYATLMAKRRLAEGERPSFLKILFDPPFAFFRSYVIQRGFLDGRLGFILGIFHGFYTMMKYVKLYYLEEGNRAESPQVPDHT

SEQ ID NO: 161 - protein, 258 aa, Nostoc sp.
MLEEITPLILTYNEAPNIGRTLQHLTWAKTIIVIDSYSTDETLEILSSYPQVKVFQRKFDTHAQQWNFGLAQVASQWVLSLDADYIITDELTAEIATLQVDEQINGYFARFKYCIVGKPLRGTILPPRQVLFRKDKAIYIDDGHTQLLQLTGKSAMLSNYIHHDDRKPLSRWLWAQDRYMVIEGKKLLETPVSELSFGDRIRKQKVLAPLIILLYCLILKGGIWDGWPGWYYAFQRMLAEILLSIRLIELEKLPNQQQ

SEQ ID NO: 162 - protein, 315 aa, Calothrix sp.
MSSKVPVSVLIPAKNEQANLPACLASVERADEIFVVDSQSSDRSEEIAQSYGAKVVQFNFNGRWPKKKNWSLENLPFRNEWVLIVDCDERITPELWEEIDQAIANPEFNGYYLNRRVFFLGQWIRHGGKYPDWNLRLFRHEKGRYENLSTEDIPNTGDNEVHEHVVLDGKVGYLNNDMLHEDFRDLFHWLERHNRYSNWEARVYLNLLTGKDDNGTIGASLFGDAVQRKRFLKKIWVRLPFKPFLRFILFYIIQRGFLDGKAGYIYGRLLSQYEYQIGVKLYELRNCGGQLNTKKSQPQTDEIKIKPSLPQEMSC

SEQ ID NO: 163 - protein, 317 aa, Moorea producens
MKSPNTKLPVSVLIPAKNEEANLPACLESVNRADEVFVVDSQSSDRSIEIVEEYGANLVQFYFDGFWPKKKNWSLDNLEFRNQWVLIVDCDERITPELWDEIAVAIDNADYNGYYINRRVFFLGKWIRFGGKYPDWNLRLFKHEKGRYENLKTEGIPNTGDNEVHEHVVLQGKAGYLQNDMLHIDFKDIYHWLERHNRYSNWEARVYLNLLTGKDDSGTIGGNLFGSAVQRKRFLKKIWVRLPFKPILRFILFYFIQLGFLDGKAGYIYGRLLSQYEYQIGVKLYELQKFSGKLNVEKTEPAQTPVTPKPSVVSPNP

SEQ ID NO: 164 - protein, 266 aa, Unknown
  Description of Unknown: Chitinophagaceae bacterium sequence
MNNNFSIVIICKNEKGNIERVLQSLAGVSSDVVVYDSGSTDGTLESLQTFPVRVVQGPWHGFGKTKRHAVSLAQNDWVLCLDADEAIDTELQQTLKTLQLANNQVAYRIVFKNLLGEKHLRWGEWGGDQHVRLFNRTVVNWDEAIIHERLIIPSSVTIQQLKGHVLHRTMKDTVEYSQKMVQYALLNAEKYFRQGKRSTWVKRWLSPPFAFAKHYVFGLGFLDGWEGLLSARMTAFYTFLKYARLRELEKRETSNGRRETEETLPL

SEQ ID NO: 165 - protein, 244 aa, Xanthomarina gelatinilytica
MKLSVIIPTFNEEAYLKNALRSVSFADEIIVIDSLSTDKTVEIAETFGCKVLHRKFDNFSNQKNHALQYATGNWVLFIDGDERITYKLKQEILQAMETGKHAGYKLNFPHFYMNRFLYHHSDNVTRLVLREKCRFEGSVHEKLIVDGSIGKLKNPVLHFTYKGLMHYISKKDSYAWFQAKQLLNKGKKATYFHLAFKPFYRFFSSYILRGGFRDGIPGLAVASINAYGVFSRYVKLILLQKGMK

SEQ ID NO: 166 - protein, 257 aa, Prevotella fusca
MNGTQHISVVINTYNAEEHLKAVLEAVKDFDEIVICDMESTDQTLDIARSYNCKIVTFPKGNLRIVEPARQFAIDKASSPWVLVVDADEVVTPELRKYLYDAIQKDDCPDAIAIPRKNYFMGRMMHSSYPDYILRFLRRSKCSWPPVIHAAPKVDGNILKIPASRMELAFEHLANDSVADIIRKNNTYSDYEVPRRRKKNYGCMALIYRPAFRFFKSYFLKRGCRDGIPGLIHAVLDAGYQFAIVAKLLEEKQAKQG

SEQ ID NO: 167 - protein, 291 aa, Niastella sp.
MISVVILTKNEEHDLQACLLALAWCNDIYVLDSGSTDKTCDIARQFGAKVFVNAFESFGKQRNVALDQFSFLYEWVLFIDADEIVTPRFREVIQDTVKKAGNDVAGFYCCWKMMLEKKWLKHCDNFPKWQFRLLKRGMARFTDFGHGQKENLLCGHIEYIKEPYLHYGFSKGWSHWVDRHNKYSGQEATARLANRPPLRNVFSAHGSTRNPALKSWLSTIPGWPLLRFCYAYFINLGFTEGMPGFIYCANIAWYEFLIQVKMREIKKGNCPPQPANVNEPQLDPGQVKYAS

SEQ ID NO: 168 - protein, 263 aa, Prevotella sp.
MNEQNKISVVINTRNAEEHLAQVLEAVKDFDEVVVCDMESTDRTLDIARQYGCKIVTFPKADHKSAEPARTFAIQSADYSWVLVVDADEIVTPELRDYLYRRIAEPDCPAGLYIPRLNRFMGRYTKSLSYDHQLRFFRREGTVWPPYVHTFPKVEGRTEKIPASLRHVRFIHLADETIGDLVRKTNAYTDGEQQKRGEKNYGLGALIGRPVWRFFRNYILKMGFRDGLPGLVHAGMDAFYQFVLVAKIIEKRTRNDKSSRKNG

SEQ ID NO: 169 - protein, 260 aa, Unknown
  Description of Unknown: Candidatus Eisenbacteria bacterium sequence
MSGGGGGAREPLSVLVTTRNEERAIRACLESVRWAEEVVVVDSGSTDGTLPIAHSIADRVLDHAYESPAAQKNWALPQLTHRWTLILDADERVPPPLRREIESVLADAARKEGYWIYRENYFYRRPIRSAGWQRDKVLRLFDRTKGAYRPVPVHEEIQLRGREGVLHERLLHEPYRDLDHYFEKWDRYSRWSAEDLRRRGIPASGGRLLLRPWLRFLRMYALEGGFREGRRGVVLCWLAAFSVFAKYARRWEHEIRDEGR

SEQ ID NO: 170 - protein, 254 aa, Owenweeksia hongkongensis
MAKLTAIIPTGNEEHNIEAVLQSVSFADEVMVVDSFSTDKTVELARKHTDFIIQREYGNSASQKNWAIPQANNEWILLVDADERISDALRDEIQGILKNGTDKDAFWIKRQNYFMDQKVNYSGWQGDKVIRLFKKSKCRYEDKQVHAEVLVDGKTGVLKNKLDHFTYKNLEHFLAKSYRYSTWSAYDRLPKTKPVGLWHLVVKPAFGFFKNYILRLGILDGKAGLIVSLENANYLFIRALKILSLQRNEKVKKE

SEQ ID NO: 171 - protein, 300 aa, Unknown
  Description of Unknown: Acidobacteria bacterium sequence
MKISAVVHTCNSEETLEKALQSIAWADETIVVDMQSVDRTLEIARNFTDRIFTAPKRPRVDGIRNEYNAKATNEWILVLDSDESLPADAKEEIEALIDKHGKRYDAFAIPRLNYIAGQIMKGTGWYPDHQIRLFRKETVQWQDAIHVPPEISTGKHKLYELVPPHCLHIHHFNYRDLRHFIQKQMEYALNQCYPPDFDFARYIAEAHEQLAREDRNLDGDLSHALSLLMACDSVVRGLIHWDSLQPRPPLGSGAELFSNNRDTRVSIKKRTWLAEHASFHYFVRRFREKFRSLFMKRKIS

SEQ ID NO: 172 - protein, 262 aa, Unknown
  Description of Unknown: Candidatus Roizmanbacteria bacterium CG_4_10_14_0_8_um_filter_ 35_28 sequence
NTLSALILTQNSEETIRATLESVKSLANEVVIVDGYSKDKTIEIVYKVYKVNKVCKVYKKKFTEIGEQRQFGLKHVTGDWVLILDSDEIISSQLREEIRLKIKSEKLKIEENAFWVPFQSYYLGKLLEHGGERYHQLRLFRREALKILPSLIHNKFEIVNNKIGYLRKRIIHHSYRSLKQIFNKFTDYGIRMAKEKYYAKEKSSLKKIIFYPLHMFWARFIKDKGYKDGMFRIPLDIGFMYMEWLIYISLFIFNRKKLKIKN

SEQ ID NO: 173 - protein, 238 aa, Campylobacter sputorum
MSKISIVILTFNSEKYLKEVLQSAKFADEILVIDSGSTDKTEEICSKFQAKFIYEPWRGFGKQKRFGVNLAQNEWVFILDSDEIIINELKDEISQILINPKFMAYKVARLNFFFGKAVKKMGLYPDYSVRLFNKNFANFNQRDVHESVEMFDKTLNFGTLKNHFIHKAYENIDEFISKQNRYSSLGAKKNRLKALFSPFWTFFKLYFIKGGFMEGWYGFVIAKLYSQYTFWKYIKGEK

SEQ ID NO: 174 - protein, 258 aa, Thiomonas intermedia
MNDSVKFSVIVITKNEANNITDCLQSVKMLADEIIVFDSGSTDGTQEICVSLGATVYETDWPGFGSQKNRALGQATGEWVLSIDADERLTPELAAEIKTVIRQHSSLHVYTLPRISSYCGQFMRYGGWYPDRVARLFRRGSAQFSNDIVHESLITDASLGALHNPLLHISYRSLDEVLEKINFYSSAGAEKLAKSGRKTSLTAAIARGFWAFIRTYFLKLGFLDGKLGLLLAISNAEGTYYKYIKLWLISQQEIRDGQ

SEQ ID NO: 175 - protein, 594 aa, Unknown
  Description of Unknown: Hydrogenoanaerobacterium saccharovorans sequence
MQTLSLCMIVKDEEKYIEKCLNSVADAVDEIIIVDTGSTDHTLDIAKRFNPKIFSYKWDDNFSNARNEALKKATGDWILVLDADEVVYKDDLKILTEKIQTTKANGLTLVFHNLTNENSEEFYNMHTGLRLFKNKTFHYEGAIHEQLVPIRKSIDFQIELTDIRVLHYGYLLSNLIHKNKHERNIPIIQKLLDYNPNDAFQLFNMGNEYISQHDHNKALEYYEKAYANKDITLAYCPHLLFRRAVCLNCLQRNEESLLALSEALKIYPACTDYEYYKGIIYKMLKRYTLAIESFKKCIEMGAAPQNLTFLNDIHNFKPLIDLGQIYYLLDDWANCLDCYIRALQINSKRYDIIYKIGQILNKMLPNKQDVGKNLENLFSDSYYITNVLVIVDVLIHEGLYDEAERYFKRIENQSDYQNDKNFLQGKLLFYKKDYKSAYTEFLKIIEASSHQGILPNRTEKLLEYLTLCCFAGKLNTKKCNGIIQSLTNETEKQVLLYFLNKKSCSFDKTASQKIFNILSELLKVKELDIFETSLPILNLIDSNRVLLDLANVYYANGYKDMAVKNILESIKKFGAIDGEALYILNKEILQFTSS

SEQ ID NO: 176 - protein, 313 aa, Unknown
  Description of Unknown: Armatimonadetes bacterium CG_4_9_14_3_um_filter_58_7 sequence
MKEFIPAVFTKCSQSNCATTQQRIVNSRAREQMSDAFHRPDAPTRPTTLSVVITTYNEAEHIGPCLDSVAWADEKIVVDGESTDHTREIAEGRGARVFVQPNYPMLNHNKNYGMEQAKGDWVMSLDSDERVSPGLRDEICAALSCSPVDGYRIPLRNFFWGKQLRRAGGYPGVVTRICRRGNGRFGTEYVHQGLEIEGAVESLASPLHHYPARNLYELIAKLNFNTTMTANHFGRKGTRGSIPRACLHAFGDFIYRYFCRGAFIDGAAGFVLCAVRAMYVFTWQMKLWERKKVDNRGSPALPASLPQLPLGRY

SEQ ID NO: 177 - protein, 250 aa, Psychroflexus tropicus
MPKISALIITLNEANNIGFLIENLSFADEIIVVDSYSEDKTVSIAESYPNVKVFLKQFTDFTTQRNFALEKANHEWILFMDADERLTDPLIAEIQATVNQNSTADAYYFYRKFMFKGKPLHFSGWQTDKNIRLFKRNKATYTSQRLVHEVLKVEGEVSYLKHKLIHYSYSSYASYKSKMINYAQLKAKELHQKGVKPNAFHYFIKPTYKFLYDFIIRGGFLDGKKGIIICYLNALSVYKRYPYLKQLSKQ

SEQ ID NO: 178 - protein, 357 aa, Paenibacillus senegalimassiliensis
MIVKNEEARLPVCLQSVSDLVDEIVIVDTGSSDGTKKIAQAYTEQIYDYVWRDDFSSARNFAFSLASQEFILWLDADDVITESNRQQLKDLKQNLEPDVDSVIMNYVLQTDETSGEPLAMTRRNRLVRRSRNYRWIGIIHEYLDVAEGRRMLSDIAITHRGTSGPGHSSRNLHIIERWLAAGHELTGRLRFHLACELADANRHEEAAVHLKDFLADQEATRDDLVMACSRLADCSRKLGRGEEELQALLQSLYYDVPRPEICCSLGKWFEERQQWRQAIYWYSQALQTSELSAWNAIVQTAARTWLPHSRLCLCYAQMGQLRQAYDHNKEALRYLPQDPGLKANDQKLEEALKALPD

SEQ ID NO: 179 - protein, 360 aa, Unknown
  Description of Unknown: Criibacterium bergeronii sequence
MEFSICMIVKNEEKHIENCLRPLSKLGYEIIVVDTGSTDKTVELSKKYTDKVYFFEWVNNFAKAKNYAISMATNDYIFVIDADEYIIEFDKKSIEDFFAKNPDKVGRLKRIEHIIMDNGDINTSTSYTNRFFNKNLYEYAGAIHEQLVKKANSRFKYETKVMNAVADHVGYNTTEEDKLLKAKRNIKILESELKKYMTKEQEKEYAPYILYHLGKSYYYIKDYEKAVDYFNKAMYYDVDTKLEYVNDMVISFGYCLLNLQRHEDALLLEKVYDAFSNSADFVYLMGHVYMNNAMFVQAVEEFKKATTFKTSNVRGVNSYLSYYNMGVIYEVAGDLDSAIKFYKKASNYIPAMKRLQNIKN

SEQ ID NO: 180 - protein, 274 aa, Robiginitalea myxolifaciens
MPVSVIIPAKNEEKNIKSCLEALQDFSQIIVVDSNSTDGTKTIVESLGAAYVNFEWNGKFPKKRNWILQNFDFKHDWVLFLDADEIITPKFQDELSRAINNSHFDGYWLKYTNHFMGKRLRFGDSMRKLALFKRQVGAYERIDEEHWSNLDMEIHEHPIIEGKVGKINSPIIHNDYRGLAHYISKHNSYSSWEARRYLQLKRDSQNSLNFRQKVKYRLLSLGLLPIVYFISSYVIKGGFLDGKEGLAFAKLKANYFYQIQLKIAEFSYNNLNIK

SEQ ID NO: 181 - protein, 301 aa, Chroococcidiopsis sp.
MKKQIVLNNIVQAKHEYSKLVIIILTFNSENSIGEVVNSCYEIASKILVVDSYSSDNTVEIAKDLGCEVVQHEFENYSKQRNWAQSYASLSPEEWVLHIDSDEVVSPELASSIRTVMSSPDKEYDGYLVRRLSYFLGHPIRFGHINPSWHLRLYKAGKGICEDRLYDQHFIVPGKTGKLQGMLLDLQLTTIEKWTASHNKWSSAEALEFIYSRNVDKTQTLPASLQGDLRMQKRWLKNNLYYRSPVLLRAFAFFIYSYFLRLGFLDGKVGLIYHVLQAFWFRFLTDAKIVERQMSISKKDN

SEQ ID NO: 182 - protein, 257 aa, Unknown
  Description of Unknown: Candidatus Omnitrophica bacterium CG11_big_fil_rev_8_21_14_0_20_ 43_6 sequence
MAKLSVMILTKNEESCIADCLESVKWADEIIVVDDESTDKTVEIVKRYNAKLFFRKMDIEGKHRNWGYAQASNRWVLSLDADEVVTPELRVEIERAIVAEEFAAYDIPLRNFISNYWVKYGGWYPAAKVRLFQKDKFKYEEAQVHPRVFIDGACGHLKSDIIHRGYPDLEHFLNSVNRQSTLEAQKWLETGRKMTLFWATWRVVDRFFRRYFRKKGYKDGMYGFVIAFFDTLYQILSYLKFREMQNSLKVKVEDNIK

SEQ ID NO: 183 - protein, 272 aa, Unknown
  Description of Unknown: Candidatus Peregrinibacteria bacterium CG10_big_fil_rev_8_21_14 _0_10_49_10 sequence
MSETKKLPISVHVLTLNSAKTLERTLRSVQICEEILVVDGGSTDATLDIAKKYGARIVLQHPDNAGGKPIDDFSAVRNLALREATQPWIFSLDSDEYASEELCAELQDASHDRAAAYYVPRKYILADGRIVDFATTYPNERLYFFHRDTVEQWVKPVHERPQLRTGTGTKHFRGASLAPIGVLQEYKEKNLRYLRIEAKKSAGKGWGHWFAHRVLHTVRSRCIAFVKLLLIWLLPHRGTRLPLRHELVRFWYGWKLIVETCPLHSRRVLTNR

SEQ ID NO: 184 - protein, 302 aa, Beggiatoa leptomitoformis
MAESNLIPLSVLIPTKNEERNIVACINSVAWADEIVVFDSYSDDQTIPLAESLDAKIVQRRFDNFSTHKNWAMENINFKHKWLLIVDADERITEELRIEIQTLFEQQPECDGYYIARKNYFWNTWVKRGGRFPDWQLRLLKVGYGHYEQRIVHEHMLLQGKAGFLKHALINYDYKGIDRYFDRQNTYSSMEAVEVFNMLYGTVNAQQIKPSLFAKGPERNRFLKNIAYRYLPFRPLIKFIWMYFIKLGFLDGKIGFRYSVLQMFYEYQVSLKLEELQDPDSPIAKKYQAYLQPTTQQPTKKG

SEQ ID NO: 185 - protein, 237 aa, Neisseria sp.
MNPKIPATAAMLVKNSERYLHEVLTALQDFDEVLLLDNGSTDRTFEIAERFTNVSYYKYDFIGFGPMKNLAARLAQNNWIFSIDSDEVADSELIAAIRKAVAENKEQNIFSLSRLNHYNGRLIKACGWYPDIIPRLYHRRFTRFSDRQVHESLILPPDANVRPLEGRLKHYSFENAEGLIQKMQQYSSLYAEENRYKKDSSPFKALLHGSVSFVKNYLLKRGFAYGADGLTISIANA

SEQ ID NO: 186 - protein, 262 aa, Unknown
  Description of Unknown: uncultured bacterium sequence
MKISAIVLSKKPEVNHFLLESLSFADEILIIVDSSSRHRERSVAIQKGDGLLQLEYETRNDIKKKNKIFFHPLINDFSSQRNFGLQNAKGDWVLFVDDDEYVGTELRKEITEAINLDQYSGFLLKRQDVVHHQPLRHGETGNIKILRLGRRHSGRFNRQVHENWDIEGRVGELQSPLYHIKDHFVSEFIPRLDQYGQIDSKILVSEGKPFSWFRLLVYPMAKFKLNYIFKAGFLDGTTGLFLAYLMAVQSLSIRVFQWENKN

SEQ ID NO: 187 - protein, 256 aa, Unknown
  Description of Unknown: Flavobacterium araucananum sequence
MTLAKKQALTALVITYNEEQNIKTVLDHLAFADEIIVVDSFSSDKTFEIASSFKNVKVVQRAFDNFASQRNYALSLATNLWILFIDADEILTPELEQEISFTINQQNSAAAYFMYRTFMFENKKLHFSGWQTDKIIRLFKKENAIYNHEKIVHEKLIVKGEIKKLKNKLIHYSYSNYANYKQKMVLYGQLKAQEELQKRTNPNFFHFYIRPVYQFLYQYIVRLGILDGKKGIIICYLNALSVAVRFQELKKIKQKI

SEQ ID NO: 188 - protein, 251 aa, Unknown
  Description of Unknown: Chryseobacterium sp. OV259 sequence
MKLSVAIITFNEERIIEKNLNTLQDLADEIIIVDSFSKDRTEEICRKFPKVKFIQQKFQGFGKQKNFALEQCQGEWILFLDSDEIPDEEAKNSIRKIISENHSEFNVYEIAFNNIFLGETLKYGGWGNIKRERLFKKGFGKYSEDIVHEEFVTQESKGKIKGKINHYTYKDIYHHIEKSNKYTSMMAEKMYKNGKKSNIFKIIFKPLYQFIKSYFLRLGFLDGLVGYYAAATAAFYTFLKYKKLHEIHKFK

SEQ ID NO: 189 - protein, 369 aa, Clostridium sp.
MITISLCMIVKDEENVLDRCLSSVADLVDEIIIVDTGSTDKTKQIAEKFTHKIFNFQWIDDFSAARNFAFEKAEMDYILWLDADDIIIREDQEKFMALKKELTLETDVVMMHYNVGFDENGKVTFSYFRERLVKRSNKFKWVEPVHECLQFWGNIVHADVGITHAKLEESRSDRNLKIYEKLLKDGKELSARGTYYYARELKDHKRYEDAILMFTKFLDSGLGWMEDNIVACSELAKCYQITENPQKVLQSMFRGFWYDSPRGEMCCQIGMYFKEAGKYRQAAFWFELVFSLEKPEDSWGFHQEDYWGYIPALECCICYDKLGEYEKAEAFNNLAENLKPGSAAVLYNKQYFENKRRDVTTFKKSSQYQ

SEQ ID NO: 190 - protein, 251 aa, Unknown
  Description of Unknown: uncultured bacterium sequence
MPTISAIIITKNEEKNIAACIDSVLWVDEIIVLDCGSTDQTQEICRKYAPKVKLRETDWPGFGEQKNRALALATSDWILSVDADERVTPQLKQEILQKLDNPNYVAYKTPRLNYFLGKPIRYCYGDKSDAPIRLAKKNACKFSDDIIHEKIIVNGTIGKLQNKLDHFSFNNIEDLINKINSYSTLGATKLYKNNKKTSHTKAFAHALWAFIRIYFLKRGFLDGWPGFIIAFSNFEGTFYRYVKLIEKNRSN

SEQ ID NO: 191 - protein, 251 aa, Unknown
  Description of Unknown: Candidatus Microgenomates bacterium sequence
MKISVVIIAKNAQDQIKECLSSVSFANEVLVVDSGSTDNTIEIAKGMGAKILGCKTADFSEMRNIGLEKAAGEWVLYIDTDEVISPELEADIKLKISSNEPNIAAYKVKRKNFYLGKHEWPKIEKLERLFKRNFLKGWYGSLHESPIIKGEIGELEGFLLHYTHRNLTLMLAKTIEWSKVEAQLRFKANHPKMSWWRFPRVMFTAFFDSYVKQGGWKVGTAGLVESIYQSFSMFVTYARLWEMQAKKDKKL

SEQ ID NO: 192 - protein, 252 aa, Veillonella montpellierensis
MAKISALILAKNEEENIKDCITSVSFVDEVLVIDDFSTDRTKEIAEQLGARVIQHSMNGDWGAQQTFAIKEATYEWVLFIDADERISTPLAEEILSVVDKGEEKAYWIRRENKFHNNHAVHGVLRPDYVNRLFPAKGSYVTGFVHPQIVTPYTNSKLKHVMYHYTYDNWNQYFNKFNNYTTLAAAKYKENHKPCHFVRDIILRPLWAFFKVYILNGGFKDGKMGWVLSVNHYFYTMTKYVKLYHLYKDNGKL

SEQ ID NO: 193 - protein, 261 aa, Geobacter uraniireducens
MVTSNKPKITVTVRTFNEENNIRDCLESVAWADEIIVVDAQSTDDTVAIAREYTDKVIVRPWAGHIATSQFVTDQAANLWVFSIDADERVSPPLRDEILALDLDSTTHDAFDMPRFHYFMRRWIKHSGWYPDRNIRLFRKDRCHWGGYAPHDKIQVPGSLGTLKGDLFHYIYRDLAHFAATKNSYSTLTSIDHNRNGRKATLLHVTLRPLHAFMSRYFIRLGFLDGLAGFTICVMEAHCVFMKYMKLYEIQHRLMRFPDKS

SEQ ID NO: 194 - protein, 211 aa, Unknown
  Description of Unknown: uncultured bacterium sequence
MAKLSVIIPAKNEEVVIKDCLESVNWVDEVIVIDNNSSDRTVEIAREFKVNIYKYAKGNYSDRRNFGLKFAHGEWVLFLDADERITPLLRNEILKIITDEKLQMSNSAYAIPRKNIIFGKEFKHGGWWPDYNKRLFKKDSFEKWEGELHEEPIFRGILGHLINPMTHFKNMTMAEMVDKTNKWSEAEAKLMFEAGHPPMNIIRFTTAVFRE

SEQ ID NO: 195 - protein, 296 aa, Pseudohoeflea suaedae
MVPGTCLELPCDALSPDVAERFSRPRPPQGAPGVTHSGAFIPVSVFIICFNEERVIEASLRALSRFQEILVVDSGSTDRTVDIVEGLSRDGLPVRLIHHDWTGFGAQKQFALEQCSLEWAFNVDADEIAEPTLVDAIAKNVASPGENAGFSVERRHWVPGYGYAHPWVKHDRIVRLVRRAKSYYDTKQTIHESLRVDGATGRVAGGYLLHASIIAPALEFEKQNSYTSLKASERSARGRRTSPSKMLTAPIGYFVKFYLLKRYFLCGWGGFAMAAGAASYAYQTEYKSWRAGLDPR

SEQ ID NO: 196 - protein, 261 aa, Unknown
  Description of Unknown: bacterium (candidate division B38) B3_B38 sequence
MEMLKISAVIITKDEEKRIIPTLQSLHWVDEIVVVDAHSQDRTRELCRKYTDKVYVREWNGYVEQKNYALQFASHDWVLSLDADERVSEELRMEIEELRRRGQDCDGYYIPRKVFYLGRWIKHCGWYPDYKMRLFRKSRARWVGGSVHESCQVEGKVGYLRSPLLHFTYRNITEHLSRNNLYAKLSAQDKFRQGERAGIVKMVFFPMATFIKTYFIKLGFLEGVAGLIISVLSATYVFLKYAKLWDMRRREKEGKTSPGIK

SEQ ID NO: 197 - protein, 264 aa, Unknown
  Description of Unknown: Xanthomonadales bacterium 15-68-25 sequence
MPREPLSVVVITYNNADTLDACLREVDWADEIVVLDSGSTDDTVAIAERHGARVAVHPFDDYGPQKQRAIDMARHHWVLNLDADEVLSPGTRAVIERALEAPRHAGFRLPRRERMFWTVQHRRSWRNGHLRLFDRRRGRMNDVEVHAAVEVDGPVKTLHAADFVNDGDGDIATRVDKINRYTTGMVAHKLRKRQRFTGLRMVLYPPVFFLRQYVGKRYFLNGWAGFIASVTGAFYAFLKYAKLHEARQRQRASARRRSEPVEPR

SEQ ID NO: 198 - protein, 647 aa, Desulfotomaculum hydrothermale
MKLSACVITKNEEKNIVSCLESVKSLVSEMIVVDTGSTDKTVDVAKGLGAKVYHYEWCNDFSKARNYAISKAKGQWIIFLDADEYLTRESINKLKLVVIEANNRKADFLVCMLTNYDKKSKKAINSVPVIRIFRNDNNIEYYGAIHEMLIRKDCNPKILDATNYIKIIHTGYSLDDIRDKNKMHRNLELLLKELEKNPQDSNLCFYISESYAIGGCYDKTIDYALKAIKYNNGTLLGMYQKNYLNLINAMVQLKYPKEEVINIVKEANKAFPEFPDFYFYLADFYEQDKRYYDAIDAYERGIQNFENGLIGQSSAHFNLANITRLMGDIYFKKGNFHKSIEMYIESLKTDYDNYISLKQLLFILSKFESAKEIIKFLGNMYDYSNLKHLLLLLKASLQANSPNLAEYYYFLIQNLSQGDKLTKESADIDMLNDKYDSAAMKFNQLYLHAYDTRFAIKGTIASILAKDEESLCRLKKIVKPSLKRFIQWYLKEDVSFLKSDKYVLLDVFQEMIKLSKIDKLTIFNDIIENMDIIQEVAELCYYYGQYSYAVEMFHKYIEKDNILPSHKLADILVKMADCLYKTGQLDLALEFFIDALKINPMDFRVYETPIEICKKLNNQQLLKELVDKAILYFPDSKYIMSYKKVVN

SEQ ID NO: 199 - protein, 267 aa, Flagellimonas sp.
MAVLSTPNQKLSALIITYNEIGYIEKCIDSIAFADEIVVVDSYSTDGTFEYLKNHPKVTVIQNPFENFTAQKNFALKQASNDWVLFVDADEVVGNKLQKEIIDTVNNPNACEAYWFYRKFMFQNKPLHFSGWQTDKNHRLFKKSKVKFTDKKLVHETLEVDGKSCILKEKLTHYCYKNYEDYKGKMLRYGQLKAKESFYKEKQFNYLLLVVKPLWKFFNHYVIRLGFLDGKKGVIISYLNALSVLERYRELKRLEKKNQITYYLVMP

SEQ ID NO: 200 - protein, 238 aa, Leptolyngbya sp.
MFSIFILTHNEERDIAACIESALLSDDVIVVDSCSSDRTRAIATQYPVRFVEHPFASHGQQRTWMLENVPYRHDWAYILEADERMTPELFAECLTVIAQDRAQSSDQSSDQSSDQTRNQEHTQDGQSASPGSPVGYYVAEQVMFMGTWIRRSTQFPRYQLRLLRRGKVWFDDYGHTEREVVDGATAFLQATYPHYTCSKGLSRWIEKHNRYSADEAKETLRQLQGGRVDWRGVVWGKS

SEQ ID NO: 201 - protein, 253 aa, Aggregatibacter actinomycetemcomitans
MPTISVAMIVKNEAHHLASCLDTVKDWVDEIIILDSGSTDDTQRIAEQYHAKFYQNTNWPGFGKQRQLAQRYVTGDYVLWLDADERVTPALRQSIQNAIAQDAPNTAYKIPRLSEVFGSKIRHSGWYPDYVIRLYRTDFARYGDQLVHEKVELPANADIQKLNGDLLHYTYQDIHHYLVKSAGYAKAWAEQREKAGKKATLWQGVSHAIGCFVKMYFIRLGFLDGKAGLLLAILSAHSTFVKYADLWVRTRGK

SEQ ID NO: 202 - protein, 257 aa, Unknown
  Description of Unknown: Candidatus Erwinia haradaeae sequence
MQQIQKLSVVIITHNSEEVLAQCLESVNWADEIILLDFKSSDKTLDIAVRYGVIIYHSNVWYGYGKQRQIAQNYANHDMILMIDSDERVTPELQKSINLILKKPPKKIVYSIARCNLFLGKAMRHGGWYPDRVIRLYPSFCVYNDNLVHESLNVSKIPIQLLYGDLLHVTSRDFCDFQFKQCTYARAWAKQRYQQGKHYGRIKILYHSFWSFIRTLLIRRSFLDGTRGWLLAIVVFQYTFNKYTALWALNCTSRDKN

SEQ ID NO: 203 - protein, 250 aa, Halomonas alkaliphila
MSMDVSVVIITRNAAATLSRTLDALTCYDDVVVYDNGSTDETCSIVQAYSNTTLHHGEFLGFGPTKRAAVSLAKYDWILSIDADEAPTKELNAAINDWVATATPQQAGKILRENWMLGKPVHHSGWGNDWLVRLFNRNTCNFNDAAVHESVNLEKNTEVSPLNGKIEHLAINDLSQFLDKINRYSDLRASSKKLKHHPFSLIFLKALFAFIRTYFFRLGILDGWRGLTISVANANGVFWKYAKNNVNNRL

SEQ ID NO: 204 - protein, 272 aa, Parapedobacter luteus
MKLDLTIVIPAKNEEKNLPGCLEAIGQDFAQQVVLVDSGSTDRTRTIAENYGATYINFQWDGQFPKKRNWYLRNHTPATEWVLFLDADEYLTPTFKRAVEKALADTTKVGYWLNYTVYFMGKKLKGGYPLKKLALFRVGTGEYEYIDEKQWSHLDMEIHEHPILTGDVGIIKAKIDHRDFRGVAHYVNKHNEYSSWEAARYLKMMTAANKALLTKKQRIKYRLLRTPLIGPAFFFGSFFLMGGFLDGARGFAFAVLKMAYFTEIYCKIKEKS

SEQ ID NO: 205 - protein, 296 aa, Unknown
  Description of Unknown: Candidatus Pacebacteria bacterium CG10_big_fil_rev_8_21_14_0_10 _42_12 sequence
MRLSVVVQTKNAEQTLEQALRSVAFADELIVVDMESSDTTREIALKFTDNVISVKDVGYVEPARNDAIAKATGDWILLLDADEEISVSLGEKIQTLIATESDVACYFLPRKNMIFGEWVSDSGWWPDYQPRLFRSGVVTWKEEIHSRPLITGKTEKLPIDESLAIIHHNYATVSDFVDRLNRYTSITAKLSKAESPTTKAGLISSYRSEFLRRIFMQGGIDGGYRSVLLSLLQANYELVVSAKRWENAGRPEDKSSSIKEMEKFNSELSYWIADWHEKRSGFLSKLFWRIRRKLRV

SEQ ID NO: 206 - protein, 252 aa, Unknown
  Description of Unknown: Chromobacterium violaceum sequence
MRVAISAVLITKNAGKQLEQCLQSLSFADEIVVVDSGSSDSTLAIASAYKAKVIHQEWLGFGPQKQFAVSQASHDWVLCLDADEYLSEELSLSINKIRENPQAAAYRFPRCNRFMGRFLKHGEGYPDWSLRLFNRRRARWSDDAVHEYVICDGPVEKLAGDLMHESGEDIALYLSKQNRYTSLQAEQLHARGKKVGAGKLLFSPLLRFFKFYFVRRGFLDGLPGLVHISIGCFNSYIKYAKLIELRRLDKDR

SEQ ID NO: 207 - protein, 252 aa, Unknown
  Description of Unknown: Chryseobacterium taiwanense sequence
MKNPKISALLITYNEEKNIEEALKSVDFADEIIVLDSYSTDKTIEIIKTKFPAVKLYQNKFEDFTKQRNLCLSYANFEWILFLDADERVTPALKAEILQEIENPKAKDAYYFKRKFFFMGEPVHYSGTQNDKNIRLFKKSVGSYDENKRVHEGLQNLNNPGTLKNYLLHFSFDSYQAYYHKVIHYAQLKAKDLREKNVPYLFVKQISKSIFNFFKMYILKLGILDGKKGIILSYLSALSSFKTYEYLKEEYI

SEQ ID NO: 208 - protein, 290 aa, Unknown
  Description of Unknown: Chloroflexi bacterium sequence
MSSPCTVILLTYNEEANLERCLNSLKDFTDDIVVVDSFSTDRTLEICKQYGCRIYQNKFVNHAVQFNWALDHLPLDRPWILRMDADEVLPAQLKQELRELVRSCDPEITGIYLNRRMYFMNRWLKHGGIYPHHILRMFRRGMGRYEEKTEEHLVLAGGRAIYAEHDFLEDNRQNHLKYWLRKHDELSDGEIRDTLLETHDPKNDLPPALFGSKVQRTRWLKVHVYAKTPLFVRAFLYCVYRYVFRLGFLDGIPGLIFHVLQGFWYRFYVDARIYEIRSRWQSTTEEFRNI

SEQ ID NO: 209 - protein, 326 aa, Leptolyngbya sp.
MTTVSSKVPVSVLIPAKNEEENLPACLESVARADEIFVVDSQSEDRSIEICDRYGAQVVQFHFNGRWPKKKNWSLDNLPFRNDWVLIVDCDERIPPALWDEIEQAIQNPAYGGYYLNRRVFFLGKWIRYGGKYPDWNLRLFRHAQGRYENLKTEGIRNTGDNEVHEHVVIEEGAVGYLKNDMLHEDFRDLFHWLERHNRYSNWEARVYYNLLTGMADSGTIGANLFGDSVQRKRFLKKIWVRLPFKPTLRFVLFYFLRLGFLDGRAGYTYGRLLSQYEYQIGVKLYELRQFGGRLNVGTPAAPVASPEDSQGQADMEPATPAKIKG

SEQ ID NO: 210 - protein, 258 aa, Hymenobacter elongatus
MPAISLSVVIITFNEEANIGRCLDALQDIADEVLVVDSFSTDRTVEICRKHGVRVIQHAFEGYVEQKNYATAQACHDHVLQLDADEVLTEELRHSIRAAAASWQHAGYTLARLTNYCGTWVRHGGWYPDRKLRLYDRRLGQWEGLLLHERFEVCAGQRIGALAGDALHYSYHSVEQHVSQLNRFTSIAAAELALRGRSQVTLFHLLLKPVWKFVHGYFFRLGFLDGFAGLCIATISAWGVFLKFAKLRTKPTAASATV

SEQ ID NO: 211 - protein, 253 aa, Unknown
  Description of Unknown: Acidobacteria bacterium sequence
MKISVTIITLNEEDRLADALQSVTWADEIVVVDAGSTDRTVAIARQYTDRVITHSWSGYAAQKNFADDQASCEWILSLDADERVSPELKRSIERLKREGPRYDGYRIARRAWYLGRWINHSGWYPDYQLRLYRRDRARWQGDYVHESVRVNGRVGTLAGDLWHFTRRNLAEHHDVLGRYTTLAAEGDFAQGKRVGWLSLLVKPPLAFLRSYILKQGFRDGIPGLVIASFAGYYVFLKQAKLWEKQRFPEGWKK

SEQ ID NO: 212 - protein, 294 aa, Mucilaginibacter sp.
MISVIILTKNEETDLPACLNSLTWTDDIHVMDSFSTDKTCEIARQHGAKISMNAFESFGKQRNFALENIVLKHNWVLFLDADEVSTPAFANAIKLAIDNADEETAGFYCCWKMMLEGIWLKRSDNFPKWQLRLLRKGRVTFKDFGHGQKEDKVIGNVLYIKEPYTHFGFSKGWSHWIERHNRYSSLEAIARLDICPPFKNIFSKHGSTRNPALKSWMIKVPGWPLLRFIYTYIFSLGFTEGLPGLIYAINLSFYEHMIMIKTREILSQRHKTSKDIGQNSIAISKQESPELELI

SEQ ID NO: 213 - protein, 245 aa, Kordia jejudonensis
MPTLSVIIPTYNEALYLKDALYSVQFADEIIVIDSLSTDETVAIAEAHGCKVISRKFDNFSNQKNHALQFATCDWVLFLDGDERITYQLQKEIIAAMNSGKHTAYKLNFPHFYMNRFLYFHTNDVTRLVEREKCHFEGNVHEKLIVDGTVGKLKNKVLHYTYKGLLHYISKKDSYAWFQAERMLEKGKKATYFHLAFKPLYRFFHEYVVKRGFMDGVPGLAVAGINAYGVFSRYVKLILLQKGIR

SEQ ID NO: 214 - protein, 290 aa, Unknown
  Description of Unknown: Alphaproteobacteria bacterium sequence
MNQKDQTANVSVLIPTKNEEKQLARCLDNVKGWAKEIVVVDSGSTDNTLAIAEQYGATVLNFDYRGGWPKKRNWALKTHSWKADWILLLDADEILTEAVKSEIKQVIESGKHDGYWINFEIVFLGRQLRHGDTSLRKLSLFRAGKGMYERRLENQDQSMLDMEVHEHVVVDGSVGRLSSSIRHENIQSLSHYIQKHDAYSNWEAHTWVFGDEGSLTPRLFGNQAERRRWLRKSLMNMPGFPVIVFVYTYFLRLGILDGKPGFFYALFRMVQFFHIKAKIYELSIQPVDSQ

SEQ ID NO: 215 - protein, 294 aa, Unknown
  Description of Unknown: cyanobacterium G8-9 sequence
MPEDEAIRTVLNASQKHKDKKNRKKKLLKYIKPKKISGKKMEAIKKGINHISVVIIAKNAEETIADSLDSLTLFDEVVLYMNNSTDKTKEIAKNYSNVKIVEGEFLGFGKTKNEAAKHSKHNWILSLDSDEILNKTLLNEIAQLDFSDIKNLYKLKRDNYFLGHETQNSNFIVRIYNKKYTHFDNSIVHEKIVIPGDASVITLKNSFQHLYVLNINQTLKKIIHYTDSGSEGKKTCFFSVVIAKSIFAFFKTYIIQGNIMKGWVGYALAVNSANKRHYKYLKQFINCQDEKKNR

SEQ ID NO: 216 - protein, 258 aa, Pseudobacter ginsenosidimutans
MEKLSVVIITFNEQKNIGRCIDSVKGVADEVVVVDSLSTDKTKAICLEKNVRFIEHAFEGYGRQKNFALQQASYDHILSLDADEALSEVLKQSIERVKKDDFPHSGYTMNRCTNYCGQWIYHGDWYPDRKMRLFDRRRIRWSLDDVHESTMAEEGASFGHLSGDLLHYSYNSLEEHISQNNKYSSISAELYYRKGKRSGWFRMLVNPAWAFVHSYLIRLGFLDGFSGYVIAKNIAHGTFMKYYKLYALQKGIPVKPVA

SEQ ID NO: 217 - protein, 256 aa, Unknown
  Description of Unknown: Flavobacterium sp. RB1R5 sequence
MKYNNNTNLSVLIITLNEEAQMNGLLADLDFADEILIVDSFSTDNTESISKSFKNVKFIQNKFENFTTQRNFAIAQAKNDWILFLDADERLTAELKNEILDTIKTNETYTAFLFYRTFMFKKTILRFSGSQTDKIFRLFHKNFAKYTTERLVHEKLEVEGKIGILKNKLIHYSYSDFDSYKAKMIIYGKFKAQEKFIKNLKPSLLLQLFHPMYTFLYNYIIRLGVFDGKKGITICYLNAYSVYVRYQELGNLWNKK

SEQ ID NO: 218 - protein, 255 aa, Unknown
  Description of Unknown: Bacteroidetes bacterium SW_9_63_38 sequence
MKLSLITPLLLTYNEEANINRTLDRLTWADRIVIVDSYSEDATVEIVRSYENVDLLQREFDHFDAQCNYGLEQIDTEWVLSLDADYLCSEELISEIRSLPASPAFDGFSVEFIYCVHGHPLRGSLYPPRTVLYRRKQAKYHRDGHSHRVRIDGNAGKLETPIYHDDRKPLSEWLDNQRRYCRLEIDKLEETSEVTLVDRVRKTGVLAPILIPFYCLFVQGLILDGWPGWYYALQRTYTELLLALKLIDRNIRRQE

SEQ ID NO: 219 - protein, 290 aa, Unknown
  Description of Unknown: Deltaproteobacteria bacterium sequence
MQLENKIGLTVIILTFNEELNLPYALDSVIGWADQVFVVDSFSTDGTLEIAKNYNVPVYQNPWTDWATQRNWALSNLPVRNEWIFFLDADEQVTRELKKEIEVKIKNASPEVAAYSVRQAFVFLGRYLKHAHDAPPLIRLVRRGRVKWFCKGAREYCEVKGKVKQLKHRLWHEDHKGISEWIQKQNLNATREALAILNAQNDIKEKKKISAERPLRTWIRENIYARLPRWLRPFFHFTYRYFLRMGFLDGYPGFVFCFLHAFWLPLLIDAKVYEIKRKNSRQKAFGAECT

SEQ ID NO: 220 - protein, 246 aa, Tenacibaculum sp.
MTKLTVIIPTLNEESNIQRALDSVFFADEIIVIDSYSSDKTVTIVKKNNVTLLQRKFDDFSSQKNYAIQKASNDWVLIVDADEEVTDELSKEIKEIFSKELNYVGFYIRRNSYVENKRLQFGGYSSKIVRLFNKKYCFYEGIVHETIKTTGKLENLVGRLNHYTYKDYTHFKKKMNYYAKLRAQELFAKEKKVTIFHLYIKPFIRFLIHYIFKLGFLDGKEGIIFSYLMAYGVAKRYKELTLLNNK

SEQ ID NO: 221 - protein, 285 aa, Pontibacter virosus
MISVVILTKNEELDLPRCLESVNWSDDVHVLDSGSTDKTVEIAYLYGVKFWENSFESFGKQRNHALDHLALRYDWVLFLDADEVVTDEFRAAIIHAINNANSDVAGFYCCWKMMLEGRWLKHCDNFPKWQFRLLRKGKARFIDFGHGQKEGEIVGRIEYVKEPYLHYSFSKGWSQWIDRHNKYSSQEAVARLHALPPFANVFSRHGSVRNPALKSYLSRIPGWPILRFIHAYVINLGFIEGIPGLIYCINMGYHEFLIQIKMRELKKVHSASRHTHAKRIVQTER

SEQ ID NO: 222 - protein, 277 aa, Unknown
  Description of Unknown: Deltaproteobacteria bacterium sequence
MLRRITQPRRTRAGFRHFRHLVMTISICIICFNEEKNIRRCLESSKWAEEIVVVDSMSQDRTVEIAREYTDKVYQREWPGYIDQKNFALSKAKNDWILSVDADEEISQSLQYEIKAEIEKQDAKDGYRIPRRSFYQGRWIKHSGFYPDRQLRLFRRNKGYWVGKRVHERVHINGEVGLLKNDLLHYPYNGTISGQVQTVDRFSSLLAENRFQEGERYSLFLLLLRPPIKFIEVYFFRLGLLDGLAGFIIALTSAYAMFVRYVKLRELCNRVGNQPSL

SEQ ID NO: 223 - protein, 275 aa, Unknown
  Description of Unknown: Candidatus Omnitrophica bacterium sequence
MGATTDTRDTLTKGAQMEKIPLSVVVMTRNEEKNIAECLESVKGWAQEIVIVDDYSLDRTLDIARKYTDKIFQRKWDMEGTARNFAYSKANNEYVLSLDADERVSHELRDELIALFSVPLTFNGYNIPHRNHLGSYWIRFGGWYPNAKLKLFRRDKFRYEEAEYHPRAFMEGKTKTLTHDIIHYTYADFHSVFAKVNHATDFEARKWLRDKRKMSLGICFWKSITRFFKFYFIKQGFRDGFIGFFLALYSGTYQFYTYCKYWEAKTKSTKGGKAC

SEQ ID NO: 224 - protein, 261 aa, Unknown
  Description of Unknown: Flavobacterium antarcticum sequence
MHPQPSTKISVLIITLNEEIHMYELLSDLGFADEVIIIDSFSTDRTKAISESFENVRFLENKFENYTTQRNFAIDQARNNWILFIDADERLTPSLKAEILETVQRDDDVSAYLFFRKFYFKNKVLRFSGWQTDRIYRLFKKDKCRYTHRRLVHEKLDVDGKIAYFKNRLVHYSYADYNSYKGKMIAYGKLKAMEKYQIGFKPTVFHTYGHSAYNFLYQYLIRLGILDGRKGIIICYLNALSVNARYTELKRLYQKSDSNVQ

SEQ ID NO: 225 - protein, 250 aa, Unknown
  Description of Unknown: Chryseobacterium arachidiradicis sequence
MQQLNEKISGLIITFNEEKNMREVLECFDFCDEIIVVDSFSTDKTIEIASTFPKVKIIQNKFEDFTKQRNIALDAAKNDWVLFLDGDERITSELQEEIIKTVKDSNAKDAYYFYRTFFLGKKKINFSGTQNDKNFRLFRKSKAHYSKNKKVHETLEVNGTVGILKHKLLHYSFENYDQFKNKMLSYGRLKGLELQLKGKKYSFLAQWGKVIFKFFKTYFLKLGILDGVNGLKISYLQSLYVYETYRTLKQ

SEQ ID NO: 226 - protein, 258 aa, Marivirga tractuosa
MKIKLSAVVITFNEEKNIRRCLNSLVKVADEIIVVDSFSSDRTVEICKEFGCDFRTNPFEGHIQQKNFALQQASNDFILSLDADEELSQKLIESILEIKADWKYDAYYFNRLSSYCGKFFPHGSWYPDQKIRLFDRRLAKWGGTNPHDKIVLSTNSKEFLKGDLLHYTYHTIEEHIKQINYFSGIAAKAAHDKGKRFNILKLVFKPFWRFFRDYFLKHGFLGGIRGLTICLLTAVETYSKIIKLWELERAEKLNQKPS

SEQ ID NO: 227 - protein, 255 aa, Xenorhabdus koppenhoeferi
MSDKKRLSVVMIAKNAADVITDCLLSVSWADEIIVLDSGSTDATCQIANEMGAKVYTNTQWPGFGRQRQLAQSYASGDYIFMIDADERVTPELKASIEQILANPDDSKVYSCARLNLFMGRFMQHSGWYPDKVIRLYCRARYQYNDNQVHESLDTQGASIVTLKGDLHHLTCRNLMEFQQKQLNYARDWAKHRYEQGKKTRYFSVWSHMLGAFFKTWLFRAGFLDGKQGLMLAVVNAQYTFNKYAALWELSQRKE

SEQ ID NO: 228 - protein, 263 aa, Unknown
  Description of Unknown: Ignavibacteria bacterium sequence
MRTPLSVIIITLNEEERIVDCLKSVEWADDIVVVDSGSTDRTVELAKQYTQKVLAAGWMGFPQAKTFALRHAANEWVLWLDADERVSPELAGEIRDILRRGSAAYAGFEVARRAYFIGKWIRHCGWYPGYVVRLFRKDAGAFTGSRVHEKLEVRGPVGRLRHDLFHFTDENLYHYFGKFNTYTSLAAEDARDAGKRFSYYNLLVRPPYLFFKMYILRLGFLDGMHGFTLSLLSAAYVFVKYAKVWELSSGGGPLAGTGAGRGQ

SEQ ID NO: 229 - protein, 259 aa, Niastella sp.
MTPFSVVIITFNEEKNIGRCLESVKGIADEIIVVDSLSTDGTKAICATHGVTFIEQPFLGYSEQKNFALNRASHEYALSLDADECLTEELRKSILAEKQKGFTFDCYRMNRLSSFCGQWIKHGTWYPDRKVRLINRKKGQWGGVNPHDKIVMQEGSSMKQLRGDMLHYTYDTIDQIMDQTNKFTTIQSKAMYERGKRANLIKIVINPLVAFISGYIFKRGFLDGYNGFIIARYASHATLAKYSKLLHLQRKMKKLAANS

SEQ ID NO: 230 - protein, 248 aa, Ferriphaselus amnicola
MPSLSIIIITHNESANIRDCLASVAWADEIIVVDSGSTDGTLEVAHEFTPNVYSHLDWLGFGVQKNRALAYATGDWVLSLDADERVSPQLHAEIKAVLASPQAEGYRLPRSSSFCGRFIRHSGWYPDYVLRLFQRGAGRFSEALVHESVQLQGRVESLSQPLIHYTYRDVESVISKLNHYSSAAAEQMDAKGKRGGLAQAILHGSWAFYRTYVLRAGFLDGREGFMLAVMNAENSYYRYIKLWLKQKS

SEQ ID NO: 231 - protein, 256 aa, Phaseolibacter flectens
MNLTVCLLTHNSQRTLEQVLEPLNSIADEIILLDSGSTDETLNIAKKYAITPHFSPYQTHGSQMNKAIAMASHDWVFCLDSDEIIDNDTLNFIQSLKQQPSEPDINQVWRISRYWYVLGQQVRAIYPVSSPDYPVRLFNRNNALFNDRPVDDKVENLDGSQPVYHVIPGHIRHDTFYSLHEMQNKLNSYTTRLNQYHKLKPSLWRGVFSAIGAGFKWYLIKGAWRDGSTGVATGLYALQYSFIKYFKAWYQAQNKS

SEQ ID NO: 232 - protein, 473 aa, Clostridium botulinum
MISLCMIVKNEEKNLKSCLEKAALFVDEIVIVDTGSKDRTIDIAKKFTDKIYNFSWCNDFSKARNFSIEKASKDWILILDADEFITKFDIKEVEEFIKEENIVGRVNVINLFENESIINKSNFRLERLFNRNYFKYIGKIHEQLTPIHNQAYEKKNINIEIEHIGYIKSEIKRKNKIERNISLIKNSIKEDGENPYLYYQLGKIYYTDKNYKEASNAFAKAIEMPLNLKECYVQDLMESYGYTLINIKNYNEALKIKKFEGCYKNSVDFQFLMGLIFMNNNRFTEAAKRFYKCLELEEGKIEGLNSFLPNYNLGVIFETLGYVKEAEDCYKKCAQYDLAKERLKNIDNFNRSPKGIKKEIERLINLNYIEKARKILEDNKEKLREDIDIFSMKAIMSIMENNLEEAEKLIFQGLNKDKKNFDLNYNLAYIYEIKGLYKEAISKYKESIKLCNNEKLKDNIITKIEEIKKIIEN

SEQ ID NO: 233 - protein, 254 aa, Unknown
  Description of Unknown: Paraphotobacterium marinum sequence
MTKISFYVLTFNSEMYIESILNKIQHIADEILIIDSGSTDKTKEIVSTFANTAFIFNKFEDFKQQRIFAEKSCKFDMILFLDSDEEPNDELINSIKHLKSTGFVYDAYRIKRLWNVLKKDVHSIYPICSPDYPIRLYNRKSCNFNDSPLCHEQVSGYSSEGIISGHIKHITFENFKTLKRKLKLYTNLAANDLILKNKKPSNLKIVFNPIGAFIKWYVFKSGFKDGIVGVQLGVYAYLYTLKKYNKAQKFLNQH

SEQ ID NO: 234 - protein, 248 aa, Unknown
  Description of Unknown: Bacteroidetes bacterium sequence
MKISATIITYNEEENIGDCIDSLKEVADEIIVVDSFSNDATEKICKGKNVKFIQHKFEGHIQQKNFALEQATNNFVLSLDADERLSDELKKEIRDCVICHAEPFEAYIMNRLNNYCGKWIKHGVWYPDKKIRLWNKQKGKWGGSNPHDKVLMDTNTLTKTFSGNILHYTFRTPEQYKSQMEKFSTIAAQSMLHEGKKSNLIKAYSAGAFAFVRSYILRAGFLDGNSGYQIAKGYAQYTRMKYEKMLKK

SEQ ID NO: 235 - protein, 273 aa, Parabacteroides goldsteinii
MEKIPVSVIVPVKNEEKNLPNCLALLNDFSEVIVVDSHSTDKTPEIVAKFGYRLIDFSWNGQFPKKRNWVLRNVPLKNDWVLFLDADEFLTESFISCLRKAIQHTTADGFWIYYDDHFMGKQLKHGVKMRKLALFKKDKGEFERIEENAWSKLDMEIHEHPVIDGKIEYLPVKIVHMDYKGIEHYIARHNSYSSWEAQRFIQTGKQKDQFTFRQKVKYTLLDTWFLGFIYFIYSYFIRLGALDGKAGLLFALFKMQYFFHIKCKIVELRRMVF

SEQ ID NO: 236 - protein, 257 aa, Parabacteroides distasonis
MGISVVINTYNADLHLDKVLSAVQDFDEILLCDMNSTDKTIQIAQKHNCRIIYHEHTGIVEPARNKTIQAASQEWVLIIDADEIVTPQLKEYLYQQINLPNPPDAIRIPRKNYFMGKFMRATYPDYLLRFSRKEAIDWPPFVHAIPHITGKTATIPAHKTELALIHLANESVADFIRKINTYSDKEVERRKNKKYALFDIAMQVSFRFFKQYILKKGILDGTPGFCYAILSAYYKFATMAKVYEYHHKKQPAPRTGL

SEQ ID NO: 237 - protein, 258 aa, Unknown
  Description of Unknown: Flavobacterium sp. HMWF030 sequence
MILSEKQPLTALVITYNEEQNIKTVLDHLAFADEIIVVDSYSSDKTFEIASSFQNVKVVQRKFDNFASQRNFAINLATNSWILFMDADERLTAKLQDEIVYIISLKNSATAYFMYRTFMFKGRKLHFSGWQTDKIIRLFKKENAFYNHEKIVHEKLIVKGEIGKLRNKLTHYSYSNYEDYKKKMILYGQLKVQEELQKKTNPNFFHFYIRPAYQFLNQYIVRLGILDGKKGIIICYLNALSVAVRFRELKKVKTLKQQ

SEQ ID NO: 238 - protein, 272 aa, Unknown
  Description of Unknown: Candidatus Magasanikbacteria bacterium GW2011_GWC2_41_17 sequence
MDKIFCTVGILTFNSANTLRRALESIKDFAEIIVCDGGSADATLEIAKEYGCKIIFQNSQFKDPDNRIKDFAGARNQCLDEANFDWFLYIDSDEAISPGLKLEIEQIVASDVGAHIYNVPLGLWIHGKLMRYSSNYPGYQNRFFNKKSGARFFKTVHERIKFDESVNSVKCLKNPWYVFCTDEEADHYFRETRKYLKIEAQRYQNLPFIDSLRRCSRYLKNVLKIIIKSFRNYFLHGFRYSVPPQMEIGRALYQLAVVYILLINQVRRLFKF

SEQ ID NO: 239 - protein, 352 aa, Paenibacillus sp.
MIVRDEEETLGGCLASVQGLADEIIIVDTGSVDGTRRVAEAYNGRVAAYDWQDDFAAARNYAFSLANGTFILWLDADDRIAGEDLKKLLALKRELTAEVSGVVMPYCLAEDAVGRPLVADRRLRLVRRESGCRWSGRVHEYLEFPRKGEIRVWDAMIRHTGRADHSRRNLRILRRWIAEEPGVSGRRLLWYAHICYERGHYGQAAKGYRKLLLEPSGFREDRLIACFRLADCCRRLGDGRGRLESLLGSFHYGPPQADFCCQLGEWFEERADWRTAAYWYTQAIAVSGLDTGLRPVASAALTWLPHARLAAVCLRLGDAGAAYRHNEQALRHLPDDPGLLGNRARLEAALRS

SEQ ID NO: 240 - protein, 255 aa, Unknown
  Description of Unknown: Microgenomates group bacterium GW2011_GWA2_40_6 sequence
MSNISLLLITKNESENLKRWKDWLPKLKKVDELVVVDDNSTDDTKKIVNNFQSEKLKINLFNRGMEGDFSAQRNFAISKAKNDWVLFVDADEEPSDKLIKFLNIEELNPNICFAFKRNLIYIDQVVTHGQAQNDYPIRFFTKDSGKYINSIHEIWETDNCVVKINKPLYHYSAPNLKIFISKLNLYSTLRAQELFQKHASVNLFQIVFYPLAKFLQTYIWHLGFLDAIPGIIICTSLSFYSFLVRSKLWRLYHAS

SEQ ID NO: 241 - protein, 255 aa, Unknown
  Description of Unknown: Chryseobacterium humi sequence
MNNTIAKISGLMITYNEEKNIHEVLKCFHFCDEIIIVDSFSTDKTVKIVQKFPKVKIIENKFEDFTKQRNLALENAANDWVLFLDGDERITPELEKEIITELAKPNKKNAYYFYRQFFFAGKALNYSGTQNDKNFRLFRKSQCHYIADKKVHETLAVNGEIGVLKNKLLHYSVNNYKSYREKMLHYGELKGQELFSKGKRFSLLAQYLKTTFKFFKSYILKFGILDGKEGYQLSYLQSLSVFETYESLKRVENKS

SEQ ID NO: 242 - protein, 219 aa, Unknown
  Description of Unknown: Deltaproteobacteria bacterium sequence
MASRDKISIVLVTFNEEKNIEECLDSAKWADEIILVDSFSSDRTVEIARKYGARIFERSWPGFGKQKNFALQQASMDWILLLDADERIPEELRREIENLLVSQSKRPAAYRVARKNYFYGHWLKWGGQYPDWQTRLSKKGVGSYDNTEPHESFIYEGELGTLENPLIHYTERRISDHFPKLNNYSSLAAAQRAQTCKKVHGYDLVFRPLIAFYQFYLRK

SEQ ID NO: 243 - protein, 258 aa, Unknown
  Description of Unknown: Marinilabiliales bacterium sequence
MDKISVVIITLNEERIISRCLESVKEIADEIVVVDSFSTDKTIEICKSYGAKIDKHEFHSYIDQKNYALSQSSNNIVLSLDADEELSDELKKSILNLKSEGINFSAYSMNRLTRIGNKWINHSGWYPDTKIRLFDKTKGKWEGLNPHDEFVILNNNGVYKLKGNILHHSFYSFKELKTQTKRFAKLSAEAYFHKGKKAPILKVVFNPFLRFIRDYFFNRGILHGKTGIKVCYNNAQSTYLKYKYLHDLYSKNPDLMEN

SEQ ID NO: 244 - protein, 249 aa, Luteitalea pratensis
MPPISVILITKDAAAHVERALQSVAWAAERIVVDCGSRDATLALAEPLATRVETHPWAGYGAQKNHAASLARHDWVLSLDADEAITETLRDQIAALPTNPGAAAFRMPRVTWYLGRWMRTTDWYPDRAVRLYDRRRAHWDDRPVHESLVVSGDVADLGGEIEHRPYADVAQHLARMNHYTTLAAAQMQAQGREARAWHLLLHPLAAFLRNYVARGGFRDGAPGLIVSMLGGVYVLQKYVKLWERQRQAP

SEQ ID NO: 245 - protein, 278 aa, Unknown
  Description of Unknown: Flavobacterium sp. AT- 3-2 sequence
MRIDFNNLSKIPVTVIVPVKNEEKNLPECLGRLKDFSEVIVVDSKSTDRTPEIVKDFGFQFVQFDWNGKFPKKRNWVLRNVEMRNEWVLFLDADEFVTKDFLEELRNKIIADEYSGFTIMYENYFMKKKLNYGDKMKKMPLFKVGSGEYEQIKEGSWSHLDMEIHEHPIISGKIGFIKSPIIHNDYKGLEHYIARHNAYSSWEANRYVSLNSSNYGLLTSRQKLKYKLMKIGLLPIVYFIATYFFKFGFLDGKEGFYFAKYKSQYFFQIKTKIIELQS

SEQ ID NO: 246 - protein, 245 aa, Ulvibacter antarcticus
MSTLSVIIPTFNEADYIEDALQSVAFADEIIVVDSYSSDDTKTIAQSLATKVLERKFDDFSAQKNYALEHATGDWVLFIDADERVTRSLEAEIKSVLINPKHSGYKINFPHFFMNRFLYFQSNDVLRLVKREGANFTGLVHEKLHCNGSVGKLRQKMIHYTYKGLHHYITKKEKYAWFQAEQRFEKNKKTTYFQLFFKPTYRFFDSYIKKGGFRNGVPGLTLAAIDSYGVFSRYAKLILLNRGMK

SEQ ID NO: 247 - protein, 297 aa, Mesorhizobium sp.
MTKQKLTVIILTYNEEIHIARCLESVASIASKVVVVDSGSTDSTRAIALKLGAAVYTNKWRNYSEQFNWALDNTGPHTEWILRLDADEIVSKELAKTLEAVLNGEVAERGFTITRRIYFLGKWIRWGGIYPARMLRLWRSGFGRCESRWMDEHILVDGLVGHIAGDLYDKNLNNIGWWTAKHNSYASREALDLLLSEHGVDHELDRGFNKQAKAKRWLKIGVYSRLPLGWRSMAYFVFRYFVLLGFLDGSRGFAFHFLQGFWYRFLVDAKICEVRLRMTRDRISFEEAVAVSLDIKL

SEQ ID NO: 248 - protein, 258 aa, Rhodoferax sp.
MRLSVIVITRNECANISDCLLGLDFADEVVVLDNASTDGTADIARSLGARVAISDDWPGFGPQKNRALDLVSGEWVLSIDADERVTPELRNEILAVISTAPLNDAYCFPRLSSYCGQFMKHSGWQPDLVVRLFRRGKARFSDDLVHERLISREPIGKLRSPLRHLSFPDFESVLDKVNRYSTAGALGMARKGASASLWGAIGHGVWAFFRTYVLRRGFLDGQLGLALAISNAEGTYYRYAKRWLMSQAQAPTAKASGK

SEQ ID NO: 249 - protein, 265 aa, Raoultella sp.
MFKLSVCLLTCNSARLLREVVPPLLKVADECIVVDSGSTDATLDICQQFGLTVHHHPYTTHGAQMNYATALASHDWVLCMDSDEILDSEVVAAILRLKAGQGSDPGCAWRLPRYWYVLGEAVRTIYPVSSPDYPVRLFNRTVAAFNDRPVDDRVVGHSRSSKLPGRVRHDTFYSLHEVFNKLNSYTTRLVQYQKVRPSLSRGIVSATGAFFKWYLFSGAWRNGKVGVVTGLYAALYSFLKYFKAWYADQDKREPVADKRPDSRSV

SEQ ID NO: 250 - protein, 256 aa, Unknown
  Description of Unknown: Flavobacterium sp. KJJ sequence
MILAEKQPLTALVITYNEEQNIKDVLDHLAFADEIIVVDSFSTDKTFEIASSFNNVKVVQRAFDNFASQRNFALSLSSNSWILFVDADERLTPELQKEISLVINQKDSASAYFVRRNFMFQNKKLRFSGWQTDKIIRLFKKESAIYNHEKIVHEKLIVNGKIGQLTTKLIHYSYSKYEDYKQKMVFYGKLKAQEELLKNTKPNFFHFYIRPVYQFLNQYILRLGILDGKKGIIICYLNALSVAVRFQELKKIRSNN

SEQ ID NO: 251 - protein, 258 aa, Unknown
  Description of Unknown: Sphingobacterium sp. HMA12 sequence
MSQKISALIITYNEENNIDEVLQSMEFADEIILLDSFSTDQTLERARLHPKVKIYQNKFEDFTKQRNLALTYANNDWILFLDADERLPAASQAEILSTVNDPQAKDAYYMYRLFFFCGERINFSGTQNDKNFRLFKKSKVTYDTKKKVHETLIVNGTIGSLKNKIWHYSFADYASYKEKMVHYGELKGKELYAKNKRYSLLSHLAKVSFKFFKAYFLKLGILDGRRGYQLCYLQSLSVHETFMSLKREEKNEDLYYKL

SEQ ID NO: 252 - protein, 258 aa, Budvicia aquatica
MDKKRLSVVVIAKNEAELISDCLISAEWADEIILLDGGSTDDTVQIAQRLGAKVYTNTQWQGYGKQRQIAQSYAGGDYIFMIDADERITPELRLSIEKIITSPTQEKQVYSCARRNFFLGKFMRHSGWYPDRTIRLYQNKLYGYNDNLVHESLDYSDAQVIRLDGDLLHLTCRDYFVFQRKQFSYAESWAFQSYQRGKSASMTSAVGHGLGAFFKTLVIRRGFADGKHGFLLACINAQYTFNKYAALWTLGQQKKAEK

SEQ ID NO: 253 - protein, 279 aa, Unknown
  Description of Unknown: Acidobacteria bacterium sequence
MSLSRLEVVILTKNEEAHIEDVLTSLDGLDCHVLIVDSGSTDSTLEICEKYGAEIVFYEYVTEAKTRNWVLAERADVDWILFLDADERLTPELNKELRELPDPSDGVVGFYIRREMWFLGRPLRYGGHQNNYLLHLLHPPVSQVVEQTRTLEYVNVEGQTGRLKHHMIHENKKPLRDWVMKHDFYAQREAEDRRSGVKRDKSVTEGRARAFTHKHVLSRLPPLLLPFAFFIYRYFLRFGFLDGRVGFIYYVMHDFWYPTLIAAKLVELEVYPAGDDEGS

SEQ ID NO: 254 - protein, 258 aa, Moritella sp.
MNKKISVCIICKNEENKIEACLQSVSWADEIVVVDSGSTDRTLDIVKKYTDKVFVLEDWPGFGEQKRRAEALASNDWIFSIDADEVVPETLALEIQAALNSANVEQVFSVNRLTHFCGKFVYHSGWYPDKLPRIYNRSRYRYNQNMVHESLECKGAPIIDLKHNLLHYTFSDLSVYLQKRTGYAEAWAEERYKKGKKGSLLNGSFSAVFAFIRHYFLRRGFLDGRIGFLIAAIQFQYTFNKYALLKFKNINTKPEPKD

SEQ ID NO: 255 - protein, 277 aa, Persicobacter sp.
MNKLPISVVIPVKNEGKNIKKCIERVMGSFSEIIVVDSNSSDDTLQIINSYSSVRCVNFSWNGHFPKKRNWVLRNIEIKTDWVLFLDADEFVDEAFIDELRQIFISEPKEVGFWLNYSNYFMGKQLRFGDKMRKLALFNRRFGEYEFIAEDSWSHLDMEVHEHPILDGKVGFVKAQIEHNDYRGLTHYIKKHSDYSDWEVNRFLSLANNYASLTKRQRLKYWLLSSGFLPTVYFLGTYFFKLGLLDGKIGYYFARFKANYFLQIQAKLGEAKRGSNA

SEQ ID NO: 256 - protein, 247 aa, Sulfurospirillum sp.
MVKISVTILTKNSEEHIKQCLEALQSFDEIIILDNGSMDDTLQIAQQYPNVKIVKHEFIGFGPLKNLAISYAKNDWIFSIDSDEIATPSLVQEIHALNFDKNTLYAIKRSNFYGMKKMQCCGWDNDFVKRIFHKQSTKFSDDLVHESLLNNGLKIKKLHNELEHYSFKSADELIDKMQKYSSLWAQDKKGKKSASPLQAVVRAFFTFIKFYFLKKGFLNGYEGLVISISNANGTFYKYIKLYENNKR

SEQ ID NO: 257 - protein, 257 aa, Empedobacter brevis
MSTKISALLITFNEEKNIQRYLNDVSFADEIIIVDSYSTDKTEQFALQNPKVKFVKRKFDNFTNQRNYAISLANNEWITFFDADEGISNELKEEIVSIIDNQPKFDAYYVYRKFFFKNKHIKYSGMQSDKAIRIFRKSKSKYKLDRMVHEIIECGGEVGALKNKLDHYTYDNEQEYLDKLNSYSKLRAQELRLKNLVPTFFHYKIKPAYRFFNYFIIRFGFLDGVSGYKIAKLHAISVANRYKYLDEIYRKENLNLG

SEQ ID NO: 258 - protein, 361 aa, Paenibacillus aceti
MVKNEEHNIKDCLNSVAQYADEILVVDNGSTDKTLDILKDFGCKVIYSDEYYFDRARNLYLEQATGEWILAIDADERLTSEGMKQIRKFISNAPQIIMGAYLPFYQYLGTGRWAYIEMMRLFRNHDQIRYNDKKIHPSPRPSIDKLGGVIHRGLYSPIHHMDSLDGKRTSKKREKYIKLSMEEIKDPGIQVLLGNEYIAVGEYKKAEVNLEKVILSQAPSDIRNRAALHLAQLYILQDDFDKASFVLDNIKTANVQFQSKIHTASAMNYMKFGLFEKALSASFRAIEKDPNAAHNYLNIGVIYDRLGDSKADEYYYSALKLNPYLLNPVIYCDGDSPNPYLHQNVVIESNLERILACMKNK

SEQ ID NO: 259 - protein, 250 aa, Halanaerobium salsuginis
MADLTALVLTYNEEKNIAGCLSSLDWVKNIIIIDSFSTDQTKEICLSYNNVQFYQHEFNNFAEQRNFGLKKLKTDWVLVVDADERVTEALQLEITKTLKSPAAPAYKIPRKNYFLGKWIKYCGWYPDYSIRLFKSSYHYQGLVHESPIIKEPILALQNDFIHYTYSDLASYLAKINQYTTLDAAKKFARNKKIGPLYLLIRPILEFIKKFILKKGFLLGSQGLILSVLSAYYQFLKAAKLWELNNLKDEK

SEQ ID NO: 260 - protein, 250 aa, Unknown
  Description of Unknown: Candidatus Rhabdochlamydia sp. T3358 sequence
MITVIVLTKNSQETLEDTLSSVRGFPEVLVYDTGSTDTTLDIAKQFPNVKINQSEFIGFGPTRNKAAKLATYDWVLALDSDEVLSSNLSQEILNISLDPNFVYQIDRHNFFNGKWIKSCGGWYPDPIIRLYHRKKTQFTDSMVHEKVSSQEMQIYSLSYPLLHTPYRNIHDFLKKMQVYSDLFAAQKKDSKPVSLTQAILHGSFAFFKSYFLKKGLKQGVEGFIISAYNGHTAFYKYLKLREAQKNQDTL

SEQ ID NO: 261 - protein, 256 aa, Unknown
  Description of Unknown: Flavobacterium sp. HYN0086 sequence
MILTEKQRMTALIITYNEEENIRDVLYNLAFADEIIIVDSFSVDKTYEIASSFPNVKVVQRAFDNFASQRNFALSLASNSWILFVDADERLTQELQKEISFVTSQKDCASAYFVRRNFMFKNKKLRFSGWQTDKIIRLFKKENAIYNDEKIVHEKLIVNGKIGQLKTKLIHYSYSNYENYKQKMVFYGKLKAQEELLKNTNPNFFHFYIRPAYQFLNQYLLRLGILDGKKGVIICYLNALSVAVRFQELKKIRCRN

SEQ ID NO: 262 - protein, 275 aa, Vibrio crassostreae
MRKHTLSVIVITKNEEDRIETCLKSVVDIADELIVLDSGSTDATVEICQKYTDNVTITDWPGFGKQKQRALDKATCDWVLSIDADEALDKEMSDALVELLKQDQIKHTAYKLPWGVTLYGTTLKHGRSARAVLRLFKREGSRYTLDEVHETVVPEQGSTGVLKGFLLHYTHRDYGHGLDKAAQYAWLGSQKYHRKGKKSHGLFLALLRAIWTFFLVYIIRRGFMDGSVGFIMAMTYAQVNFNKYVGLWILENRSDDRSDDRSDDRSDDRSNDQAK

SEQ ID NO: 263 - protein, 259 aa, Odoribacter sp.
MKISVVIQTYNSELYLGRVLESVKSFDEVVICDMYSTDRTLEIAQRYGCKVVYHEKIPFCEPARNFAIQSASYEWILVVDSDEVVPEDLRSYLYERIERKDDLQGLWIPRKDYLFGKFMHGDYPDYILRFFRKDNVFWPPYVHAIPRIEGNVEKIPRKKKNLAFIHLINNPLELKLQKMNTYSTMEIPKREGQNFSLWKMFYAPAYRFIKAYFIKGGFRDGKAGLVNAGLDAFYKFLTIAKIWESRIRPEDMDRELRDS

SEQ ID NO: 264 - protein, 265 aa, Unknown
  Description of Unknown: Candidatus Erwinia haradaeae sequence
MSARQKLSVVMITKNSEKLLSDCLESVAWADEIIILDANSSDATITIAAKYGATLYQSSVWSGYGKQRQIAQSYASYTMIFMIDSDERVTPELRKSIDFVLQQPPEKIVYSVSRCTLFLGRFMRHSGWYPDRVIRLYPRSFQYNDNLVHESLECFQTTVKPLHGDLLHLTDRDFCSFQLKQCAYATAWAKQRYQQGKNYGFLNIFYRTIWAFIRTLLVRASFLDGKQGFLLAVVIAQYTFNKYTALWALHYTSSHDRPSNKSNES

SEQ ID NO: 265 - protein, 252 aa, Halanaerobium sp.
MNNLTALVLTYNEEDNIAECLDTLKWVPKVVVVDSLSSDKTDEICLRYKNVSFFAREFDDFSSQRNYGLEQINTEWVLVVDADERITDSLQDEIKKILSNPKAEGYNIARKNYFLGKWIKYCGWYPDYTLRLFKSIYRYQGLVHESPEIKGKVDNLENDFIHYTYSNLKEYVSKMNQYTSLDAEKKYQKSKKIGVSYILIRPVLEFIKKFFLKKGFLLGVQGLILSLLSSYYQFLKSIKLWELNNISEDEVK

SEQ ID NO: 266 - protein, 252 aa, Dokdonia pacifica
MEKLTAIIPTGNEEHNIREVLESVTFADEIMVVDSMSTDNTISIAKEYTDTILRRKYHYSASQKNWAIPQAKHEWILLVDADERVTPDLRDEIIEILKNPPSDGTVAYWIYRTNHFMGKRVRYSGWQNDKVIRLFRKSKCAYEDKMVHAEIVADGNVGFLKNRFHHNTYITLNSHITKLNRYAAWQARDYDKKTGRLHIYHFVIKPFWGFFKHYVVQMGFRDGVVGLIISYLHAYAIWMRYAKLWLYRRGLK

SEQ ID NO: 267 - protein, 228 aa, Unknown
  Description of Unknown: Photobacterium aphoticum sequence
MDIADEIIVLDSGSTDETVAICQRYTDNVTLTDWPGFGKQKQRALDKATCDWVLSIDADEALDDTMAEALNTLLTQETIPHNAYKLPWGVTLYGKTLKYGRSARSVLRLFKREGARYTLDEVHETVIPAEGSVGTLPGYLLHYTHRDYGHGLDKAAQYAWLGAQKYHRKGKKSHGLGLALLRAIWTFFLIYIIRRGFLDGSVGFIVAMTYAQVNFNKYVGLWLLERDR

SEQ ID NO: 268 - protein, 548 aa, Unknown
  Description of Unknown: Microgenomates group bacterium GW2011_GWA2_46_16 sequence
MTKQSTIYDLPSKISVIIPTVNAHEELDLAIKSIKKNSDCSIEFVIVIDPDLNTGKVSGDILKVCKKHHVKAWVNKENLGPYGNWNRGAEVASTDWLVFATDDQYFAPHWDSNLLKYWEPKRLIAGRLIEPGIIPVYKTNIQQDFGVLPSGFKEAEFIAWCKNRQERGYTPDGFFIPMLQKREDYDALSHYPIAGKFGTSTAVSNDYLYVQAALKKGYQFGTAQDSYSYHFQASSWKKKTLEPTIVAVVLTKNEQKDLDNCLKSLAWVSEIVVVDSLSTDKTLTIAKKYKAKVFFRDLDNFSGQRNFALSKVTDSDWVLMVDADEVVEPALAKELQFFAKDIYLGGVQIPRKNYIFGKWIEHTDWYPDHRLVFFRPKIVQYTGAVHETASFIKGNETVAVASGHLVHHNYDTIREFVVKNLVDYPLQYAKVLDGDKVHFTALDLLSKPLGEFMRRFFLTDGYKDGLYGLILSALMGVQTLVAYCYLWEIQGKRADLTTQETQTLFRSLRGKSSELTYWLLTLTIESATGLTKLAHRARRKILKLANGL

SEQ ID NO: 269 - protein, 254 aa, Nonlabens xylanidelens
MPKYPITAIIPAYNEAHNIVEVLKSVSFCNEVILVDSNSTDNTVELAQPYFDKLLSREYIHSASQKNWAIPQATNEWILLVDADERVTPALKEEIINLLPNLETNGHTGYWMGRRNFFMGKQVRYSGWKNDKVIRLFQKSKCKYVDKHVHSEIETNGSLGWLDNKLLHYKYVNIDHHVNKLQRYASLQARDFDKKVGKITLFHVVVKPFWGFFKHYIIQLGFLDGFVGFTIAYLRSYGIFMRYVKLWLLRRGIN

SEQ ID NO: 270 - protein, 267 aa, Dinghuibacter silviterrae
MLVQQERLVSLRVTGNSLRRTLPVSAVLITYNETENIRRTLSRLFWCDEIIVVDSYSTDDTVDACRLFGAKVFFKEFEGYGAQKRFAISKATNDWVLCLDADEVLSDALIDEICREWEDGPRGAGYLLPMNLVFLGREFTHGRESGRHFLRLFNRRHGNVNEALVHEKIELDGTVRKLRHHILHYSYRDIHQWYVKCDRYTTLAAREAVRRGKRKSRLAVFFSFPYYFIHYFVINGNWLNGMEGFYWSAYSALYHFTKYLKIRELQK

SEQ ID NO: 271 - protein, 252 aa, Ferriphaselus sp.
MPTTLSVILITRNEAANIRDCLASVSWADELIVVDSGSTDETLTMAREFTDRVFSYDWPGFGPQKNRALGYATGEWVLSLDADERVTPELRQDIEAAIREGRCDGYRMPRLSQFCGKFVHYSGWYPDPVLRLFRRTQGRFSDSLVHERVELPGKAGMLEHPLLHYSYLSRQDVERKVEHYSSAAAQQMFQNGRSAWPMTAPLRGAWAFVRTYLFKLGVLDGWTGWQIAAMNARTTYLKYHKLARLRSGQTSA

SEQ ID NO: 272 - protein, 259 aa, Unknown
  Description of Unknown: Fusobacterium sp. oral taxon 370 str. F0437 sequence
MTLTVSIITLNEEKNLERTLKSVEDFADEIVIVDSGSTDRTEEIAKKFGAKFVYQKWLGYGAQRNKAIDLATSDWVLNIDADEEISPELAKRIKAIKENSRYKVYKINFMSVCFNKKIKHGGWSNSYRIRLFKKDSGRFNENNVHEEFETTQEIAKLHKYIYHHTYSDLEDYFDRFNKYTTLGAIEYYKKGKKASLISIVLSPIYKFLRMYIVRLGFLDGLEGFLLATTSSLYTMVKYYKLREIYKNKSYIEKEGNNGN

SEQ ID NO: 273 - protein, 255 aa, Arcobacter cryaerophilus
MNISVVVLAKNNEKTIENSLKSLVDFDDVVVYDNGSTDETISIVKRFPNVNLIQGEFKGFGWTKNHATSFALNDWILIIDSDEVVDSELLRELKNKKLDEKTVYKLNFKAFYKDIQVKHCGWNNQKIKRLYNKNITSYNSNDVHEDIITDGLNIEELKGNVEHYSYHTISEFIIKADRYSTLFATNNVGKKSSSPTKAFFNGIYSFFRTYILKQGFRDGYVGLVIAFSHMVTNFYKYIKLYEKNLELKNRYNDKK

SEQ ID NO: 274 - protein, 261 aa, Roseivirga sp.
MTSTRNKVTAIIPTYNEEVNIGQAIESVLWADEIIVVDSFSKDRTVEIAESYDNVNVIQHEYVNSATQKNWIIPQAKHEWVFILDADEVVTSELEQEILNTLRNPNKTAYWIKRRTVFMGEEVKYGSWRSDKVVRLFLRDECRYQDKKVHSEIETEGEIGILNNHLRHYTWKGINEFIVKVNWYSTWKAYDKIENGKPTGFFVTTVIKPFWRFIYEYLVRFGFLNGKVGFHIAILSAYDVYSRGLKIQLIKNGEAIAKDRI

SEQ ID NO: 275 - protein, 249 aa, Halobacteroides halobius
MVSIGVLVLTYNEEDNIEECLESVSWVDEIVVVDSYSQDDTLELARQYTSNIYQREFDDFATQRNYGLDQMESEWVLVVDADERVTSDLQEEVLNKLSNPEASGYKIPRKNYFLGKWIKYCGWYPDYTLRLFKVADNRYSGLVHEGLKIEGTVEKLEGTLIHYTYRDLEHYLNKINHYTTLDAQKKYQAGKRKRLLYILMRPVLEFIKKYILKKGFLLGSQGLILAILSSYYQFLKYIKLWEKYNSDES

SEQ ID NO: 276 - protein, 245 aa, Mangrovimonas sp.
MPTLSVIIPTFNEEHYIADALHSVQFADEILVVDSMSTDKTVQIAKSFGARVLPRKFDNFSNQKNHALSYATGDWILFVDADERITFPLKKEIYDAMEKGTHTAYKLNFPHFFMNRFLYHHDNDVTRLVLREKCHFEGLVHEKLIVDGSIGKLKTPVLHFTYKGLAHYIGKKDSYAWFQAEQLLKKNKKVTYFHLAFKPFYRFFSSYILRGGFLDGIPGLAIASINAYGVFSRYAKLMLLKKNMS

SEQ ID NO: 277 - protein, 245 aa, Unknown
  Description of Unknown: Candidatus Levybacteria bacterium GW2011_GWA2_36_13 sequence
MKISAVIIAKNEEKMIAEAIDSVAFCDEVIVIDNSSNDKTSEIALEKNAKVTKIESNNFSEIRNLGKDLAKAEWIFYIDADERVTTELRKSIQENIEKEEFSAFKVLRQNFYMNRKWPNIEEMERLFRKEALKRWTGKLHETPDYEGKIGILDGYLLHYTHRDLSQMLDKTIEWSDAEALERFSSNHPKMSWWRFLRVMLTSFIKSYFIERGFRAGTVGIIESLYQSYSSFITYAKLWEMQEKKK

SEQ ID NO: 278 - protein, 248 aa, Thermosinus carboxydivorans
MTLAVLILAKNEEKNIGDCITSADFADEVIVIDDFSTDNTALIAEKLGAKVYKHALNGDWGAQQNYALEKATADWVFFLDADERITPGLAKEIKDAVTDGRHYAYQVPRLNHLMGQPIRHGGWYPDYVLRLFPRGHVRVEGVVHPRMVHDLSVRTLKNDIVHYTYPSWEHYFNKLNLYTTLAAEKNAQKGVKVSFIRDIILRPIFAFFKMYVLRSGWRDGKAGFVLAAFHYTYTMAKYTKLYWRQRGA

SEQ ID NO: 279 - protein, 259 aa, Unknown
  Description of Unknown: Candidatus Schekmanbacteria bacterium sequence
MTGKNKKISAVVITFNEEENIEECLKSLLWTDEIIIVDSFSNDNTVEIAKRYTSKIYQKVFSGHIEQKNFALSLTNYEWIISLDADERISNGLKNEIIETINSPSSCNGYFIKRENYYLGKKINHSGWNPDYKLRLFKKEYAKWDGINPHDSISLEGKKGYLKNPIIHYTYKNLTQHFSQIDYFSSIGAKEYYSKKKQCRFYHLLLLPFITIFKKLIIKGAFLDGSRGIMISMATVFSEFLKYAKLWELNERERRSKKT

SEQ ID NO: 280 - protein, 228 aa, Unknown
  Description of Unknown: Armatimonadetes bacterium CG_4_10_14_3_um_filter_59_10 sequence
MSDAFHRPDAPTRPTTLSVVITTYNEAEHIGPCLDSVAWADEKIVVDGESTDHTREIAEGRGARVFVQPNYPMLNHNKNYGMEQAKGDWVMSLDSDERVSPGLRDEICAALSCSPVDGYRIPLRNFFWGKQLRRAGGYPGVVTRICRRGNGRFGTEYVHQGLEIEGAVESLASPLHHYPARNLYELIAKLNFNTTMTANHFGRKGTRGSIPRACLHAFGDFIYRYFCR

SEQ ID NO: 281 - protein, 267 aa, Unknown
  Description of Unknown: Chloroflexi bacterium sequence
MERIVKKLSVLVPTYNNESIIRECLESVKWADEILICDSYSTDRTLDICREYTDCILQHEYINSASQKNWAIPQCSHEWVLVIDTDEQLEPQLEEEIRAFLVDPPSDVDACRMPRKNIILGQWLTAMNLWPDYVTRLFRRDASRYQDKEVHADIEVRGSVLTFERSFIHHGTPSLSKQIGQLDRYTRYQADEFVKRGRHFSWARLLLRPPAAFFYYYFLKRGFTAGFRGLFLSAHASMYSFCTYSKLWEKERQVEGQITSRRVVDRG

SEQ ID NO: 282 - protein, 256 aa, Unknown
  Description of Unknown: Flavobacterium aurantiibacter sequence
MLHPHKGKLSVLIITLNEERNMKELLTELAFADEVIVVDSYSTDRTKEICMSFPYVKFLENKFENYTSQRNFAMDQAQNDWILFIDADERLTPELKKEVLETIVSEHPKSAYLLYRTFMFKNSKLRFSGWQTDKIFRLFHRGKARYKNERLVHEKPDVIGEIGKLKSKLIHYSYSDYQSYKAKMVAYGRLKAIEAKNRGIVPNFFHFVIKPLYKFVYQYLIRLGILDGGRGIVICYLNAYSVYVRYQFLKEMTAKN

SEQ ID NO: 283 - protein, 297 aa, Unknown
  Description of Unknown: Verrucomicrobia bacterium sequence
MSGRSNVRAPLSVLIPVKNGAANLSECLATVAFADELVVVDSASTDGTQEIATAARARVVQFTWNGKFPRKKNWSLENIPWRHEWVLIIDADERITPELEREIISAIRRSDVDGFYLNRRFWFLDGWINHCGYFPSWNLRLFRHRKGRYERVEAGSEFDSGDNEVHEHVLLDGRAEYLSTPMEHYAFPDITTFIEKHNRYATWEAAVRAQLCRRSDEETLRPNAFGTALQRKRWLKRLARRAPFRPTLRFLYHFVWRQGFRDGYRGWILCRLLAWYELISAAKARELAICRVRRESC

SEQ ID NO: 284 - protein, 265 aa, Unknown
  Description of Unknown: Candidatus Schekmanbacteria bacterium sequence
MREKLTALIPCCNEEENIRDCLESVKWADEIFVVDSFSNDRTVEIAKEYTSRVIQHEYINSATQKNWAIPQASNEWVLIVDSDERVTPDLRDEIINILSSNPRYDGYYIPRKNFFLGREVKYGGWGYENDLNIRLFRRDKGRYEDKEVHADIIIDGKVGRIKEPFLHYSYNSLEQYMKKMSRYTNWAAMDLCKKHKRIGVTHLLFRPFFTFLKMYVLKFGFLDGIRGIILAFLSSYYVYIKYAKAWEMINAENIKKPEAHPRSEK

SEQ ID NO: 285 - protein, 255 aa, Cellulophaga tyrosinoxydans
MAKLSVFIITYNEERILDKCLNKLSWVDEIVVVDSGSTDATLDICKKYHVKVFHNDFQGFGAQKQFALEKTSNDWVLSLDADEILSNELIDEIKEVLIENTYIAGYFINRQHVFLDKVFNYGQDSKKCVLRLFKKSKGKFDGKMVHETIVVNGNTGNLKNSFLHFTARSLEHYLEKINTYATIFAEGQYLKNKKYSILEIALKVKLEFLKKYFLNLNILNGKEGFYWSFLAAYSSGLKYIKTNEQYKKVKKQLMF

SEQ ID NO: 286 - protein, 273 aa, Unknown
  Description of Unknown: uncultured bacterium sequence
MSITVIIHSFNEEKNIHDCISSAKLLTDKIILVDMASTDKTMEIAKNLKVPIFNFQIKSNYVEPAREFGIKQATTEWVLILDADERITNELANEIKSVIGQSRLNRSESVKSVTDSTDLTDSTYYKVPRRNIFAHMKWLKHGGWWPDYQIRLINKKFFVNWPKRIHSTPQIKGNFGYLNNPLTHYFHGNLSNMIKKTIIFEDIESELLYKAGRKTTNMTFFRKFFAELYRRLIKNLGFLDGPLGIIESIYQAFSKTITYLFLYEKQIKKNRPL

SEQ ID NO: 287 - protein, 256 aa, Motilimonas sp.
MKKQHSLSVILITKNEADRVEKCLQSVAHVADEIIVLDSGSTDDTVAICQRYTDKVTITDWPGFGKQKQRALEQATCDWVLSIDADEALDEVMQQSMTQLLCQTDIECTSYRLPWGVTIYGKTLKYGRSARSVLRLFQREGARYTLDEVHETVVPAEGKKGKLAGLLLHYTQRHYGHGLEKTAKYAWLGAQKYHRKGKKARPFPLIVLGGGWTFILIYFIRRGFLDGAIGFIVAMSYAQANYNKHMGLWLLQNRKP

SEQ ID NO: 288 - protein, 264 aa, Unknown
  Description of Unknown: Candidatus Levybacteria bacterium CG_4_10_14_0_2_um_filter_36_ 16 sequence
MKTQTLLLQKNIMTNISAVILVKNEEKNIKNCIKGLIKLDEIIVVDDDSTDDTIKRIKSFRNKKIKIFYRSLNCNFAKQRNFAMEKAENDWVLFVDSDETVSEKLLSEILRIVENNTDTNGYYIKRLDYAWKKKLKYGEAGNIKLIRLGMKSRGLWKGKVHEKWIIKGKIGVLENEIIHCPHQTVREFIKEINEYSNLRARELHESRYSSNVLSIIFYPFTKFTLNYFIKLGFLDGVPGLVYALIMSFHSFLSRSKLYLYDKKK

SEQ ID NO: 289 - protein, 271 aa, Unknown
  Description of Unknown: Candidatus Accumulibacter sp. SK-11 sequence
MADRTRLSVIVTTYNNDRTLRACLESVRWADEIVVLDSLSSDDTLVIARSYNACIKQHPFMGYGPQKQMALELTSNDWVLLLDADEALSPGLQNEVRRLLQDGPLVDGYEIPRQEQLFWRMCHPATRMNHFLRLFDKRRGGIDDMPIHAAPKVQGRIGRLKSLLYHFGETDVHAKVEKINAYSTGLVKEKLKKERWGIPLIMIFYPPFFFLRSYFFKRNFLNGWAGFINSVVAAFYVFLKYAKLYEHDQFAKHGTRLFPEGAPPVPAARQD

SEQ ID NO: 290 - protein, 255 aa, Unknown
  Description of Unknown: Pectobacterium brasiliense sequence
MEIRNKLSIVIITKNASELLDECLRSVEWADEIIIVDSGSTDNTVEIAENYGARIYHTNDWLGYGKQRQKAQRYANGDYIFVIDTDERVTPELRDSIEKILAKPDIDNKNVYYCARRNLFLGRFMRHSGWYPDHVIRFYANNCFTYNDNTVHESLNYGNASLKKLSGDLLHLTCREFSSFQKKQLHYALAWAEERHSRGKRCRYSDILIHTAFAFLKTWVFRAGFLDGKQGLLLAIVNSQYTFNKYTELWSLQKK

SEQ ID NO: 291 - protein, 247 aa, Unknown
  Description of Unknown: Microgenomates group bacterium GW2011_GWC1_39_12 sequence
MISAVVLTHNNEDVICKTLESVSWCDERIIVDDNSTDRTLEVVKPYDVIIIQHALNDDFSTQRNIGLAKAKGEWVLFVDSDEIVPIALQKEILSLPKDDKYIGYYVNRKDILFGRELRYGETANVKLLRLAKKGTGVWVRPVHETWNVRGPVASFTTPLLHYPHKSVSAFLSQINRYTTINAKVFFDQGIRTSALQIIMYPIAKFIQNYIFRLGFLDGVAGLVIAIMMSFHSFLTRGKIWELQQKNI

SEQ ID NO: 292 - protein, 249 aa, Unknown
  Description of Unknown: Candidatus Collierbacteria bacterium GW2011_GWB1_44_6 sequence
MKVTAVVITNKEELNKQLLESLSFSDEILVVVDAPVIPAKAGNHQITPKNKKIKDLFHALRDDFSSQRNYALSKAKGGWIFFVDDDEYVGTELQREILDKVNNPGYSGYYIRRQDVVYHQPLKHGETGKIAILRLARRTAGRFVRPVHEVWKVKGKIGKLQSPLYHIKDHLVSDFIEKMSFYSQIDSLALAKEGKPFSYFRLLLFPIAKFNLNYLFKRGFLDGTAGLFLAYLMAVQSLTVRVAQWENQN

SEQ ID NO: 293 - protein, 245 aa, Nitrospina sp.
MEKISVAIITLNEEKNIERCLESVRWADEIVVVDTFSTDRTVEICRRFTDRVFQETWQGYGPQKNLCASRAANRWILNVDADEVITAECAEAIRNLLAGEPERPVYRFPRKNFFGKRWVRHAGWYPDRIARLYDKSRAAFSESMVHERLIPDDDAGLIDFPILHYSFAGMEDYIRRQNRYSSIYAEEKIRNGWRANWTHLYLRPPWVFFKTCFLRQGFREGFLGVFLSLAMAFYTYLKYAKTRSV

SEQ ID NO: 294 - protein, 256 aa, Unknown
  Description of Unknown: Fusobacterium ulcerans sequence
MKLSAAIMTFNEERNLERTLKALADICDEIVIVDSGSTDRTKEIAENYKARFIHQPWLGYGKQRNTSIESCNGKWILAVDADEELSPELKQKILEIINGNEDKKVYEINRLSVCFGKQIKHGGWGTSYAVRLFLKTAGRFNDNTVHESFVTQEEVYKIKEDIYHHSYLTLEDYFSKFNRYTTEGALEYYKKGKKASIGQIIFNPMYKFIRMYIIRLGFLDGVEGFLLASTSSMYSMVKYFKLREIYKNGSYINKKN

SEQ ID NO: 295 - protein, 256 aa, Desulfovibrio alaskensis
MKSGITGLVLTYNGGRLLDKCLASLAFCDRVLVVDSFSTDSTVEIARNRGADVLQNPWHGPAAQFEFALAQIDTEWVVSLDQDEICTPALSQAVQKTVRTAPAGLAGCYPRRRNWYHDRFMKHSGWYPDRLLRVFRPALMQVHVSGAHYSFHPQGPTQNIDADILHYPYESFFQHLEKINAYAQQGADDLRRKGKKGGIAAGMAHGFARFFKLYVIQRGMLDGRAGFINATHGAFYAYLKYVRVQEGDWGAPYDHS

SEQ ID NO: 296 - protein, 251 aa, Microvirgula sp.
MKKLSVCVLTFNSERLLEACIEPLTRIADELIVVDSGSSDGTLAILEKFGLTPLYRPYSTHGSQMNFAIDHASHDWVLCMDSDEVIDEATVNAILKLKQELDDPTLAYRITRHWFVLGQEVHAIYPVSSPDYPVRLFNRSIARFNDAPVDDRPAGFADTRIIAGFVRHDTFYTIHEIFKKLNDYTTRLVKFKKVSPSLARAFASSIASFWKWYVVKQAWKDGRVGLVTATYASWYAYLKYMKAWFQARHKP

SEQ ID NO: 297 - protein, 297 aa, Unknown
  Description of Unknown: Acidobacteria bacterium sequence
MQVLEELRQSRPRPAAVYLPVTVIIPTRNEARNLPRCLESLRGAGEVYVVDSNSTDETPEIARTFGAKVVQFHYHGGWPKKRQWALDTLPIAYDWVLLLDADEALTPRLAEEIREAIKDSRYQGFYVRLHVVFLGRPLRHSGARFHKLSLFRRGKGHFECRLREQHESMCDMEVHEHVIVDGPTAKLKNPLLHCNADSLFQYIAKHNEYSNWEARVWLKEKGNATELPPALLRTQAQRRRWLRRNCFGLPGSPVLFFLYKYFFRLGFLDGIPGLIYCGLQGIQFFHIKAKIHELAKG

SEQ ID NO: 298 - protein, 252 aa, Unknown
  Description of Unknown: Calditrichales bacterium sequence
MHTVKLSAVIITFNEEKNIVRCLDSLIDVVDDIVVVDSFSTDQTPALCAQYKVNFVQRPWLGYAAAKNHANAIAKYDFLLSIDADEALSAELKEAIIKIKSDMRLDAYYISRLTNYCGKWIKHCGWYPEYKIRLWNRTCGEWRGVIHESLVFHNTVRSGTLKGDLLHYSFYSISDHIHTADKFSEIAAEEKVKEGFRVNIIWHLILNPLFTFFQKYILKRGFLDGYYGFVISIISAFSNFLKYAKIKQKSQT

SEQ ID NO: 299 - protein, 252 aa, Megasphaera sp.
MPKITALILAKNEESNIRDCIESVQFADEVLVIDDFSTDSTKEIAESMGARVLQRSMNGDWGGQQTFAIQNAASEWVLFIDADERISGPLAEEILEVVKRGEKCAYWIMRENKFHHNQATHGVLRPDYVNRLFPAAGSYVTGYVHPTIVTPYPNKKLNHIMYHYTYDNWDQYLNKLNNYTRLAAEKYKEQNKKCSFIKDVMFRPLWAFIKVYFLNLGFLDGKMGWVLSVNHYFYTMNKYVKLYYLYKDNGKL

SEQ ID NO: 300 - protein, 247 aa, Unknown
  Description of Unknown: Chryseobacterium sp. YR460 sequence
MNVSGLIIAYNEEKNIQEVLECFDFCDEIIIVDSFSTDKTLKIAEKFPNVKIIQNKFEDFTKQRNLALDAAKNDWVLFLDGDERITPELRKEIIEELNKPEQKDAYYFYRKFFFAKKPIHYSGTQTDKNFRLFRKSKARYIAGKKVHETLEVNGTIGELKNKLLHFSVNDYESYKKKMIHYGVLKGQELALKGKKFSSLTQYSKTAFKFFKAYILRLGILDGKEGYQLSYLQSLSVFETYESLKEQN

SEQ ID NO: 301 - protein, 251 aa, Unknown
  Description of Unknown: Bacteria sequence
MEDMHKISVAINTYNSAKYLPEVLDSLKGFDEVVVCDMESTDDTVDIALAHGCRVVTFPKGNINICEPARNTAIRSASNEWVLVLDDDELVTPELHKYLHGRVMSPDCPEGIDIPFVNKYMGEFDRHVSEYHVRFFRRDKVDWPPVIHARPVVDGRVGRVSRKNACILHINDACIADRITKLNRYSDNEVPKRVHKNYGVVSMLMRPFWFFFKCYILKGNIRYGRRGVVRAYFESMYQMSIMAKVTECRLK

SEQ ID NO: 302 - protein, 253 aa, Helicobacter valdiviensis
MNKISAVILTKNSARLLKKVLEALKELDEVVILDNGSKDETLTIAKSFSNVSIHFHEFIGFGAMKALGSKLAKNSWILTIDSDEIASKTLIDEILNKDLSPTFCYSYDVKNYFQDTYIYSCGWGNDRCIGLYHKDFYEFNQNKVHEAIVPLSNKPLKVIDLKGHISHYPYENLEAFLDKMQKYSTLFAMQNCGKKQSSLKKALLHSSWYFFRNFFLQKGFMQGKIGFIISAYNAQTAFWKYLKLDALNKSEKL

SEQ ID NO: 303 - protein, 245 aa, Unknown
  Description of Unknown: Ichthyenterobacterium magnum sequence
MPKLTVIIPTYNEEHYLEDALYSVKFADEIIVVDSFSLDNTLQIAKQFNCIITQRKFDDFSSQKNHALTFATNEWVLFLDADERITNTLQIEILNTINNPKHSGYKLNFPHFYMNRFLYHHDNDVTRLVKRELCHFEGDVHEKLIVKGTIGKLKNPVLHFTYKGLSNYIGKKDSYAWFQANQLFKKNKKATCFHLAFKPFYRFFSSYIIKGGFLDGIPGLAVASVNAYGVFSRYAKLILQQKGLK

SEQ ID NO: 304 - protein, 257 aa, Acidithiobacillus sp.
MSKQLVSVVYITLNAEKYLEKSLDSVKSIAQEVLIVDCGSTDQTLSIAHKFEAKVIYRAWEGFAAQRQFAVDSACCDWVLMLDADEILTEPGVQMIDEALSDPADVAAYFLRRLSVFHDKKILHGDWGRDRVLRLFDRRQGKYTDNLVHEAWETCAPIKALPGISMLHYSYKNYAELLDKMRRYAILNAQQLHLKGRIVRAHMPMTHAIAALLRSYFLRLGMLDGVEGAAIAWTIALGAFMKYAIALEMQAQDKDAS

SEQ ID NO: 305 - protein, 256 aa, Bacteroides salyersiae
MKISVIINTYNASKHLKQVLEAVKGFDEIVICDMESTDNTIEIAKTFNCKIVTFKKGNHNIVEPARNFAIQQASHPWVLVVDADEVVPEQLKEYLYKQIASPDCPAGIYIPRKNYFMGRFMHCHYPDHILRFFKKEGTVWPPIIHVSPIVEGTLFSIPARRKELAFVHLANDSVSDIIRKTNEYTRNEVERKKNKRYGTLAFFYRPFFRFFKTYILKGGIRDGKEGFIKACLEGYYQFVMLAKLTEHHKGNHTDNK

SEQ ID NO: 306 - protein, 243 aa, Unknown
  Description of Unknown: Candidatus Shapirobacteria bacterium CG10_big_fil_rev_8_21_14_0 _10_48_15 sequence
MLSAIVLTKNEAGNITACLKSLRWCDEIIVIDDCSQDETVVLAQKLGAKVYRRALQNDFAGQRNFGLAKASGAWVLFVDADERVTPPLRDEIIQAINLPVAGYFLKRVDYLWGRPLQHGETAHVRLLRLARKTAGQWQRQVHEIWQIKGATEELKNPLFHYPHQDLSEFIDHLNFHSSLHAQALAKEHKKSSIVKVVFYPPAKFLQNYFWRQGFLDGMPGLISALMMSWHSFFSHAKQYVKNH

SEQ ID NO: 307 - protein, 459 aa, Pedobacter sp.
MSNPHFSIIILTFNEEQHLPRLLQSIETLKAKTYVLDSGSTDQTLNICQKYRLQVRQHPFHNHPKQWDTALRCFNIQTPWVIGLDADHIVGDELCTMLKNFKDEEYTNVNGIYFNRKNYFKGKWIRFGGYYPKYLLKMFRYQVGYSDLQENMDHRFQVPSRTIIWKKGYLIEENLKENEISFWLDKHNRYSDLVAEEEIQRLTKTRTQVIKPNFWGSPNERNALLKKIWWQLPRYLRPFLYFTYRMIFQLGILDGRTGIIFHFLQGFWFRLIVDIKIDEKIGKTRRKPLNFIFSFLSLFLLFYCFNLMYIGITSPGQYYSSFLDKHFNYISSWRNFYISSAAYVLKILGYHVSTNENHLINHGFSGFKLVYSCLGYGVMSCFAAFVIAFPKSKRSKILFLAIGLTGIQLLNTLRLILISIYYKPQTAASNIDHHDIFNFMLYLILGTAVYFWIDISSKT

SEQ ID NO: 308 - protein, 286 aa, Rhodobacter maris
MTTHESNRAPALPVTVAVPVKNEEGNLAKCLDRLGRFSEIVVIDSGSTDRTCDIARKFGARVVNFKWNGQYPKKRNWFLMNEELNTPWVLFVDADEYLDDAFCDELEQAVRREDVDGYYLGYDNYFLGKALHHGLEQRKLALFRVGRALFEKIDEDHWSTLDMEIHEHPIVEGKIGQISTRIDHRDYKGFAHFIDKHLAYAKWEAYRYNRLRQTPEAWEHFTGRQKFKYTNLERWWYPWFYFLFTYVVKRGFLDGGAGFQYSAYKAWYFQTIRLLIQELKSADTKP

SEQ ID NO: 309 - protein, 254 aa, Unknown
  Description of Unknown: Microgenomates group bacterium GW2011_GWC1_38_12 sequence
MEDKLSVTIITLNEEKNITRCLDSIKEIADEIIVVDSGSKDKTVEIAKKYRAKVFYRKFGNYASQKNFAARLAQSEWILSLDADEEISPELASEIRSRIADNRSPFVAYSIPRKNVIFGKFIKYTRWQPELDRHVWLWRKDEGKWKGDVHEEVIVDGKIGRLKYAKIHHQYETVSEFMDMMNRYSELDAQEHVQKGGRFSFPKLFLQPIYNFLVRYFYRLGFLDGWRGFVLSYLMTVYHFELWIKVWEKERGIR

SEQ ID NO: 310 - protein, 254 aa, Thalassospira xiamenensis
MSTNIPKLSVVITAHNEEARLPSCLSHVAFADEIIVLCDKCTDRTEEIAASAGAKTLVGSWQMEGERRNFALAEATGDWVLEVDADEHVSEELAKEIREVISLSNFGFHGLPVDNYIGNRLVRNGWGSSFGKSSYRGLFRRGIKHWGPQRVHPAVKFDGDEGPSLKYPVRHYVDRNISDMIKRLDSYSTARAADLRDSGEIGGFANNLRRLVSRFIRCYVGRKGYKEGGLGFLIALFAGLFPVISYLKARYEDN

SEQ ID NO: 311 - protein, 255 aa, Acidiferrobacter thiooxydans
MSLSVIVITHNEEDMIERCLASVAWADEIIVLDSGSTDRTVAFCRQRGARVVETDWPGFGPQKNRALDHATGAWVLSLDADEYLTQEAQAEIQAVLASGPQADAFRMPRLSSYCGRFMRHGGWYPDYVTRLFRRGRARFSDDLVHERLLVSGPVATLREPLRHETYRDLEEVLRKVDHYSAAGAAMAAQGGQRGGVMLALAHGLWSFVRTYFVRRGLLDGPEGLMLAISNAETTYYKYMKLWLLRKQRGRADESS

SEQ ID NO: 312 - protein, 281 aa, Unknown
  Description of Unknown: Bacteroidetes bacterium sequence
MSEKLSVVIITLNEEQNISLCLDSVWQVADEVVVVDSFSTDNTKQICLDRGVIFIEHKFEGYIEQKNYAVTKCTNDLLLSIDADEVLSNELISSILKVKQNPTYCSYSINRMSHYVNRFIKHGHWFPDRKIRLFKKGVGKWTGRNPHDNFSLLNGGETVNLKGVLYHYTFSSVYEHVAQVNKFSEIGSQELDEQPLLYLVAKAIFSPTWGFLYGYIGRLGFLDKWQGLTIAIVSSTETFLKYAKALSRRYELRNDIEQEKVTPGISLIISTYNWPEALEQC

SEQ ID NO: 313 - protein, 249 aa, Unknown
  Description of Unknown: Ignavibacterium album JCM 16511 sequence
MNKISVIIITKNEAENISECLNSVKWADEIIVVDSGSNDETISIAKQFTDKVIFNEWKGFAAQKTFALNLAQNDWVLSLDADERVTEELKDEILNSNLEKFDGYRIKRDNYFLGKLIRGCGWGNDYQLRLFKKSETKLTDRLVHEGFEVEGNVGQLKNSMLHFSYRNFSDAFTKINHYSTLEAIEKQNKKRVNAFTIVLTPLAAFLQHFIFRKGFIDGIYGLFVSVMHAITKLQVQLKIWELKKKKQIS

SEQ ID NO: 314 - protein, 313 aa, Anabaenopsis circularis
MLSKIPVSVLIPAKNEEANLPACLTSLQRADEIFIVDSQSTDKSIEIANNYGANVVQFHFNGRWPKKKNWSLDNLPFRNEWVLIVDCDERITPELWDEIAQAIQNAEFNGYYLNRRVFFLGKWIRHGGKYPDWNLRLFKHKIGRYENLNTEDIPNTGDNEVHEHVILQGKVGYLQNDMLHEDFRDLFHWLERHNRYSNWEARVYYNLLSGQDEQGTIGADLFGDAVQRKRFLKRVWVHLPFKPILRFILFYIIQRGFLDGKAGYIYGRLLSQYEYQIGVKLYELRNCGGKLNTANTAKPVPPSLPQKIEQTAV

SEQ ID NO: 315 - protein, 271 aa, Leptospirillum ferrodiazotrophum
MAKDLPSDSRRPPLSVYVLGYNQEHKIKPALESVLWADDVVLVDSYSTDRTVQIAEELGVRVCQVPFEGFGHLRNAAVNFCRHEWIFSLDSDERMTPEAQTEIEGILADRDSADAYLVPRKNYFLGRWVRHSDWYPDFRQPQLFRKGAMVYSADVVHESYRLNPGKTLGKMSSAIIQIPFSDQEEMIRKMNRYSSLGSDKVLARGQRASVLIALGHAVWSFFRHFILKKGFLDGSAGFVIAFYNFESAFYKYAKAYEKQRERLPPHSREGP

SEQ ID NO: 316 - protein, 250 aa, Unknown
  Description of Unknown: Candidatus Beckwithbacteria bacterium CG_4_10_14_0_2_um_filter _47_25 sequence
MKLSAVVLTHNSGAVISDCLQSLRFCDEIIVVDSGSIDNTLKLAASARIYKRKLVSFSGQRNFGLKQATYPWVLMIDSDERVPIELAKEIKAAIITDSYSAYRVKRLNYFFGRAMKHGGYWPDWQTRLFRVKDFLKYSGSVHESPHFTGLLGSFANYLTHYSHNNLSECLAKSIIWTKKEAVEFVKAGHPPVSWWRLMKVMVWEFCHRYFKKLGFLDGYVGLVEALIQAMNRFYVYQQVWELQRHEDRPL

SEQ ID NO: 317 - protein, 691 aa, Dehalobacter sp.
MKLSIGMMVKNEEKNLKRCLESLKPLLNAVSSELIIVDTGSMDQTVEIAKKYTNKVYFHPWENDYSKMRNITVQYTRGDWFMFVDADEELRGYEAIVQFITSKVSKNINAAAIQIDNIFQTNNTSKVGTGVVTRLFRKTAKFGFQGVIHEEPIFEPPLAVLDAQLLHYGYPADDPELRERKLKLYEPILLQAIEKDPDNVGLLFYLSNTIATFKNHKDALDPAVRAYETAKRKNMDPVEYFYVYSTLAMLYNDNGEYKKTVELAQEGLKYREWAIDLWFCLAKAQGMLKQYQEAIASYQKYLYYVENYDQFRGKDPRIISNSFSHKDDVYYDLAVMYKEIDQKEDALEALEKLETIEMIEKAVPHQISLYLSLEKYQEIKCFYNKISKFAKKDLEKSFCLALETLLFSEDEIKREEVARLFHNEDSEYGLLNTIRLWGQKNVTNQLLSGIKSLSLSELGFYYGDIFYFVTKMKLPLNSVNLEIQEQELELLFKYLTEKYPDFDEVCDVYLQSRDQDAPLEEQRVHKILRRIMLQAENLDEEKYDQVLDRYIHEGIGYIRRIYRPELFENDKPYLLANKEEIFFYCLDKAHFVENSDQAQYVRYLKKALLEYPDMKKGIEVLLDRLTKKIDVQTQPAVSTEMQEYARIVKANLKQFIQNGMFKEAREIIQAYEEIIPNDPEIAEFKADMEDN

SEQ ID NO: 318 - protein, 248 aa, Unknown
  Description of Unknown: Ichthyenterobacterium magnum sequence
MISALAITYNEEENIESFIKSLSFADEIIIVDSGSTDKTLELARQYEVKIVNRSFDNFSAQKNFALQQAKHDWIVFFDLDEVISKELAEEIKQKTLFASNTKAYKVKRNFHFMGKRIKYSGFQNDSVVRLFKKEACSYNTNLVHETLDVNGTTETLKCRSDHFTYKSFDLYNQKLTQYSKLQAKMLYQKNLRPSLYHFLVRPWFRFFHQYVIKLGILDGKEGFILAYLSAFSVFKRYLYLWTMYRKIE

SEQ ID NO: 319 - protein, 304 aa, Parabacteroides sp.
MLDVSVIILTYNEEIHIRRCLDNIKDLARDIYIIDSFSTDRTLDIVKEYKEYNVMILQNKWENNYAKQFNWALEHAPIRTAWVLRLDADEYLLPALQDELIKKIPFLLDSVSGIVFKRRHYFLGKWMKRGIYPVYLLRMFRYGKAVCEQRLMDEHIQLLDGTSVNCEGDFVDHNLNNLSWFCNKHVNYAVREAADLLDIEFDLYGVSQSDDQKKLTAQAIEKRRIKHRYVRMPLFWRSFFYFCYRYFFKGGFLEGKEGFLWNFLQGWWYRTLVDAKVFEIKRACGTDKEKIKRYLSEVYNCRQV

SEQ ID NO: 320 - protein, 348 aa, Unknown
  Description of Unknown: Candidatus Altiarchaeales archaeon HGW-Altiarchaeales-1 sequence
MALALCMIVKNEEKMLPKAIESVKSIVDEIVVVDTGSTDNTKDIAKSYGAKVIPLEWNDNFGEARNVSIRNAKSDWILVIDADETIAKEDLSTIKELMKDKRYMAYAFIQRNYTNIENVSGFIHSDNDTYAESKNYPGWVESTVTRLFKNLPEIFYEDYVHEDVASAIMKKKGTGKICLADMPIHHFGRVVRSYEERLKWSDMYIRIGLKKLNDKIKANGSKRELAIACFEIGNSYGFKREMDKATDYYKKAEEYDSSFRPCISNLGMIYMDGGDYGKAEIYLKKATSIRDWDTPMVVRDYIALAKLYVFTKRITDAKHTLKACLKIDPRNAEVIKMMDILEFLRFSL

SEQ ID NO: 321 - protein, 259 aa, Psychromonas ossibalaenae
MSENKISAIIITKNEQNNLPACLDSLTWVDEIIIVDSGSIDQTENIAAKYGAKFYSHTNWQGFGKQKQLAQNYATSKWILAIDADEVVSPELQQSIQQQISAADADTVFKIQRKTWVFGRFLEHSGWVDKIIRVYPKEIARYNDALVHEKIITDENAKIAQLDGDLFHYSYGDMENYLVKSASYGKAWADGRQARGKKSSLTQGFTHALGCFLKMYLLKRGFLDGKQGLLIAVLSAHSTFIKYADLWIRNNDSRADRNN

SEQ ID NO: 322 - protein, 283 aa, Lysinimicrobium rhizosphaerae
MNKVPVTVLVQTKNEERAIAACLSGLADFDEVIVVDSFSDDATRQIALECGVKVIDFKWNGRYPKKKQWQLENVETRHDWVLFIDADESPNARLVTALRELMNSANLGEVAAGTLALDYHFAGRSLRFGHRVYKTVLLHRERARFEPVDDIGIPGMGELEGHYQPVCDGRVVSLAGRLAHDDPDPVRTWFDRHNRYSCWEAGLESRRRESGGRDVNRSLQGRVFGRLPFKPVVFFGYSYVLRFGFLDGRAGFDYAVALSMYYWQIGLKSRELEREKRGQFAEA

SEQ ID NO: 323 - protein, 257 aa, Unknown
  Description of Unknown: Candidatus Woesebacteria bacterium GW2011_GWB1_43_14 sequence
MAKLSAIVITKNEELMIEDCLKSLAWADEIVLVDDHSEDKTVKIAKKFGARVVLPLKNNSMDYSLPRNLGLAKANNDWVLYVDADERVTSDLSKEIQKVISDPGYNYYAVPRKNIVLGRELKHGGMYPDYVKRLFKKKHLKGWKGKLHEEPNIIGEIGHLGSALVHIKHETLSEMVEKTNKWSVIEARLMYDAKHPQMNIPRFVTAMAREFWKRMVRHVAFLDGTIGIIYAMYQVFSRFVSYSKLWEMQVKNESGNL

SEQ ID NO: 324 - protein, 292 aa, Unknown
  Description of Unknown: Acidobacteria bacterium sequence
MEAGEARTHERPRISAVVTTFNEEHNVGECIASLEWCDEIVVVDSFSTDRTPDIARSCEKVRFFQRPYRGSASQKNWAMDQTRFEWILIFDADERCTPALQAEITSLLAASPPALAYVIKRRAYFMDRVIRYSGWQHDRVVRLVKRGAGRYPNKRVHADMQTMGPAPVLKSPMLHYMVESFDQYLPRIVKYGFWGAAQGWKTDRGSGFKEVFGRPLWRFARMYILQFGFLDGMAGLVFCMLQAFGTYLKWAILWEWRANAARGRTPKLPEFDDDESVWAWEERRDGGATDKA

SEQ ID NO: 325 - protein, 663 aa, Marinobacter vulgaris
MNIRHRITHGLAVAGLGGALASSSILAGVALLLAVLGGYAIWKKEMPRRNWDTPKELRLLHFAFWFFVLVSLLSWAFEGFEYEGGKTLGTHARLILFWPIAIALIAARVRATTVFSAFVVGGLVVIGLFALHVIDLSGNLNVLWRLRFGAGINPIQFGNLAMLTSLLCLIGGFYFKAARRGKLAIFAVIVGLATLAIALMSQTRSNLIALPAALALLLFLIPRKLIIPGIIVLAMVGTLSVMNSERFTNSLDALVEGNLDKSLELRLQAWKVAGSAFVANPLLGAGLSGYHEIAEAQESKAFRDCCTDHAHNDTMQQAATKGLPGILSWIFLMFIPLVTALRLVRSGNLEIACLAGGGAMIPASYLIFGLTEATLDRSLFLTFYLLSVSATFAALFNALSASYTRQRAVKVSATVITKDEEDHIVDCLKSARLIADEIIVLDSGSSDRTVELARQYADVVEQTDWPGFGIQKQRALERATGDWVLSIDADERITPELAREINHTLADARADAYKLPWAVTIYGKRLDFGRSGRAPLRLFRKEGVRFSDALVHEKILLPRGRVVKTMRGRLTHYTHRNFGHALEKSAKYAWLGSQQKYRRGKRTRSLIYPTIRGIMTFVQVYFIRFGFLDGAVGYLVAVTYAQGSFNKYAGLWTLTRTERRMRG

SEQ ID NO: 326 - protein, 254 aa, Nonlabens sp.
MTKYNITAIIPAFNEEHNIVDVLKSVDFCDEVILVDSNSTDNTVELAKPYFTKLLTRNYEHSASQKNWAIPQAKHEWILLVDADERVTPALKEEILNLYPTLDTADYVGYWIGRRNFFMGKQVRYSGWKNDKVIRLFKKSKCKYKDKHVHSEIIADGPVGKLENRFLHYKYVSMDHHVKKLQRYADLQAKDFDKKVGKITAYHIVIKPMWGFFKHFFVQKGFLDGFVGFTIAYLRSYMIFMRYVKLWLLRRGIK

SEQ ID NO: 327 - protein, 253 aa, Tenacibaculum jejuense
MHKHKISAALITFNEEENIARTLEKLVWCDEIVVIDSYSSDATLEICESFGAKVFQKKFNGYGEQKRYLVSKCTYDWVLSIDADEVLTNDLIDEIKLEFNQDTVPHKAYFLNRKHVYLGKVFEYGYLKNTPVLRLFNKNHAEFSNKKVHETVEYNGSKGRFKNFFYHYTATSVEQINLKKNRYASLVSEEYFKKNKRVNLLFLVFKYPFTFFKEYVIRGNMFNGYEGYVWSTYIAEYSVLKYLKLMERKKMKK

SEQ ID NO: 328 - protein, 263 aa, Unknown
  Description of Unknown: Microgenomates bacterium UTCPR1 sequence
MKISGIVITKNEEKNIVRCLKSLSFCDEVIIVDDFSYDDTIRNAELFLQENSVSKFNVKIFKHRVSGNFAKQRNYALGKSGNDWNIFIDADEELSQDLINEIKDLDKGGNLNRIGSYRLKRRDFFWKKEIRYGEVLLSRVYGISRLVKKGSGEWVGNVHEVFRSYEGYHEKKLKGYINHYPHQTLREFISDINQYSSLRAKQLAAQGKKSGIFQIVLYPLVKFFISYFFLLGILDGAAGFVYSFLMSFHSFLVRAKLWQHYSI

SEQ ID NO: 329 - protein, 258 aa, Vibrio superstes
MATIGILLITKNAEKTLDKCLSSVQEWAHEIVILDSGSTDNTLNIARMYTQKVYSKTNWEGFGAQRQVAQSYLTTDWILALDSDEVVTSELKTSILQSVNSANLQTCFSLNRLTKAFGKFIQHSGWYPDRIVRLYPRNYTSYNNAKVHESVIIPENTTVKRLNGDLLHFTMDSLSQYTSKTNLYIKSWADQREGKKKSSLGKAISHAFFRFFKMYIIKLGFLDGKHGLLLAILSANTVFTRYADLWVRDMTKNEDTNL

SEQ ID NO: 330 - protein, 250 aa, Serratia marcescens
MAKIAVCILTFNSSRLLHEVLSPLMGIADEWIVVDSGSTDKTLSICQSFGISPIYHRFETHGRQMNFAISQAHHDWVLCLDSDEILDAETIASILTFKAQENPPPQQAFRIKRNWFVLGQPVRTIYPISSPDYPVRLFNRTQVRFNDAPVDDAAEGYIQTSVIPGNVKHDTFYSLHEIFNKLNSYTTRVVKYRNIRPSIFRGVVSAIGAFFKWYVLSGAWKEGKVGAVTGFYAVAYSFLKYFKSWYGKDR

SEQ ID NO: 331 - protein, 260 aa, Unknown
  Description of Unknown: Nitrospirae bacterium sequence
MSKLSVYVIAYNDEPNMKACLESVAGWGDELIVVDSHSTDRTAVISREYTDKVYQVNFTGFGDLRNQAVALTAHEWVFSLDSDERMTPELREEIHGLLALGADADAYFVPRKNYFLGRWIKHCGWYPDYRQPQLFRKSRFRYREELVHESFDCDGPVGFLKNPALQYPFRDIDHYVAKQGRYSDLMARRMVEQGRKFSFHQMITHPFGALFKMYVLRGGFLDGMPGLILSGLYAYYTFMKYAKFWESSLAAKVSGGAVRS

SEQ ID NO: 332 - protein, 271 aa, Leeuwenhoekiella nanhaiensis
MSNIPVSVLVPIKNEERNLQLSLPLLSDFDELILLDSQSTDASLKLAEQYGARVAQFYWNGQFPKKRNWALRNIELRNEWVLFLDADEYVTPEFLNELREAINRPGYVGYWIPFRNYFMGQQLKHGDVFKKLPLFKKSAGEYERIAEDSWSHLDMEVHEHPILEGQVGTFKTHIDHNDYKGLEHYIAKHNSYSSWEARRFIKLQETGFAALNSRQRLKYQLISWGIMPMAYFIGNYFLKLGFLDGSKGYYFSKYKAQYFFQIQTKIKELQS

SEQ ID NO: 333 - protein, 250 aa, Unknown
  Description of Unknown: Crocinitomicaceae bacterium TMED135 sequence
MKISAIIPTFNEEEHISEAIKSVSWADEIIVVDSFSEDKTIEIAKKFGVKIIQREYKYSASQKNWAIPQSEHNWIFLLDADERVSNSLKEEILNWKKTKPKKQSYWIYRTNHFMGKKIKFSGWQGDKVIRLFHRDCRYEDKKVHAEIQNSSKAGKLKSPILHFTFKSMSHYLLKWDQYSSWSAKDHLKKVKNPNFFHFFVKPSFRFLRDFIFRGGFLDGKTGYIVCKLSSMGVFMRYIKLKELRDKSSTN

SEQ ID NO: 334 - protein, 261 aa, Shewanella fodinae
MRQHKISCFLIVCNEADRIAQCLAPLQGWVDELIILDSGSTDGTVEIAKKYTSKVHCTDWPGYGPQRNRALAMCQYDWVLTIDADEVVTDALKAEIDAVLSVAKPDANMIKIPWKTYFFGKFLNHGRYTAPQGKLFYKVGAKFKERQVHETLLQPNQRIKVLKSALLHYSWRNYQHVQEKHLKYACLMAQEKANKGKTSTIGFAVLRFFTDFFQQYVLSLGFLDGWRGLLMAIILGEYAFHKYAALAELSLSKDATTVERR

SEQ ID NO: 335 - protein, 259 aa, Sulfurirhabdus autotrophica
MMQNTNKNTRQPLSVTIVALNAAHQITACLESVAFADEIVVVDSGSTDATLEIARKHGARVIHQDWLGFGPQKQFAVTQASYDWVLCLDCDERISEGLRQSIEAALVNPEYQAYQMPRCNRFMGRWLRHGEGYPDWSLRLFNRHVAGWSEDAVHEKVITATTVCRLKGDLLHESAESLDTYLEKQNRYTTLQAQKMADLGKLASLVQLIFSPVLRFIKFYFVRLGFLDGLPGLVHISIGCFNSFIKYAKLKALSRKDEG

SEQ ID NO: 336 - protein, 245 aa, Unknown
  Description of Unknown: unclassified Mesoflavibacter sequence
MKQLSVIIPTFNEEAYIEKAIRSVSFADEIIVVDSYSSDKTVQIAKQFNCTVVQRKFDNFSNQKNYALQFVSGEWILFVDADERITYALKQEILDTISNPKHAGYKLKFPHFYMNRFLYHHYDSVLRLVKRANCKFEGLVHEKLIIDGSIGQLKNPVLHFTYKGLEHYISKKDSYAWFQAEQMLKKGKKVTYFHLAFKPFYRFFSSYILRRGFMDGIPGLAVASINAYGVFSRYAKLMLLKKGIK

SEQ ID NO: 337 - protein, 250 aa, Unknown
  Description of Unknown: Chromobacterium piscinae sequence
MRYAISVVLITKNAGQQLEQCLQSVGFADEIVLVDSGSTDNTLAIAAAYRAKVIHQEWLGFGPQKQFAVEQASHDWVLCLDADEYLSPELALSINQILDNPQAAAYRFARCNRFMGRFLKHGEGYPDWSLRLFDRRRARWSDDVVHEYVICEGPVEKLDGDLMHESGEDIARYLSKQNRYTTLQAEQLFARGKKAGAAKLVLSPLLRFFKFYLVRRGFLDGLAGLVHICIGCFNSYIKYAKLIELHRLNK

SEQ ID NO: 338 - protein, 252 aa, Unknown
  Description of Unknown: Chryseobacterium soli sequence
MKLSVAIITFNEERILEKTLSSIEDLADEIIIVDSYSTDRTETICKRFSKLKFIQQKFPGFGRQKNYAISLCTSEWILFLDADEIPDETAKDSIRKIISDEHQKCFVYDIRFNNIFLGKALKYGGWGNTRRERFFKKGYGKYSEDIVHEEFITTEKKCRLDGRINHYTYKDIHHHIEKSNKYTSMMAEKMYRNGKKATVAKILFKPLYQFIKSYFLRLGFLDGLVGYYAAFTAAFYTFLKYKKLHEITNLNK

SEQ ID NO: 339 - protein, 633 aa, Unknown
  Description of Unknown: endosymbiont of Riftia pachyptila (vent Ph05) sequence
MRQMSARPQWQQQSDELARGMAVAAAFAIPLPTAWVGITMGLFLLFWIASGDFANKWQRVRQNPVALMALGLFALLGLGVSYSSVGLSEALEGWGAYHKLIYIALLVSVLNEPKWQQRALMAFVLAMLLVLLLSYAQLLGFWPEGKPEQEFAPFKGRIAHNFFMAFAAYLVFDLFMRQPARRLLWAGILLLMLYNILVMVPGRTGQLVLFVMVVLATWHHWRWRGLLVGALLTLALGAAAMQFSDGFRPRMQALLDNASSYFEGGAAESSTGLRLSYYENSIELILKHPLIGTGTGSFIHEYQQHANAKGVPLTDNPHNEYLNLGVQLGLLGMGALLLFFLLQWRFAGLMRPEQRRLAQALVLAMALGCLFNSFLMDHGEGKFYVILAGILFARTREATAQALREGTPASLSVIVITRNEAARIRACLESVSWADEILVLDSGSSDETLAICREYTDKVFVNRDWQGFGVQKNRVLDKARGDWVLSIDADEQVPEALQAEIHQLLVLADEAPAVYKIPRLSSYCGRQMRHGGWWPDHVARLFRRGKARFSDDLVHERLLFVPPAGRLENPLTHQSFDNLEQVLEKVNRYSSASAERMLQQGKRGGVGKALLRGLWSFLRGYILRAGFLDGARG

SEQ ID NO: 340 - protein, 267 aa, Aureicoccus marinus
MKDSYQTTPSISALVITYNEIGYIEKCLESIAFADEIIVIDSYSTDGTYEYLLQQENVRVIQHPFKNFTAQKSYALEQARNDWILFVDADEVVTEQLRDEIQETLAGPQTHDAYWFYRQFMFENNRLRFSGWQTDKNHRLFKKSKVKFTDRKLVHETLEVNGTSGKMRSKLMHYCYKDFEDYKGKMLHYGRLKAREAFYKEKHFNYLSLYVKPFWKFFNNYILRLGIMDGKKGITICYLNALSVYERFRELKRLEKKNELAYYLVMP

SEQ ID NO: 341 - protein, 280 aa, Runella sp.
MSQFSVIILTFNEEDNIESCLNKILKVSNDVFVVDSFSTDNTIKILEKYPIKSVQNKFVNYSQQRNWAQENCPFNHEWVLHIDAGEFLTPELIHWLQHVFPTQMEKFDGFIFSRRVYFLNKWIKRGGMYPNSHLRLFKKEKGFCENKSYDQHFVVEGKINKVPLGADVIDNNGSNVNDFILKHLRWANKEAEDIISNQNTQGNVKESILGNDIERKRFLKNNLYYKFPVLWRAFFLFLYRYVFMLGFLDGKVGFIYHFLQCFWFRVTIDSIFIQFNENNK

SEQ ID NO: 342 - protein, 266 aa, Prevotella copri
MDKTSVEQEQGNGISVVINTYNASCHLQQVLDTVKGFDEVVVCDMESTDDTLDIAKRNGCKIVVFPRGSYQICEPARQTAIDAASCKWVLVVDADELVTPALKQYLYSLIGKEDAPLGLYVPRKSRFMGRFMHCFYPDYQLRFFIRKDTVWPAVIHADPIIKGRIEKIPATHADMALVHLADDSIASRMGKINQYTANEIEKKKDRNYGMAALFYRPLVRFFRAYIQKGGFRDGKEGFVCACYEGIYQFVAVSKIIEDRLKHKKGK

SEQ ID NO: 343 - protein, 249 aa, Polaribacter sp.
MTKITAIIPTLNEEIHIADAIKSVSFADEIIVIDSFSTDKTLEIAEKLNVKIIKRKFDDFSSQKNFAINQAENDWIYLLDADERVTPKVEKEIIEALKDPKDFVGFYVRRTFYFCGKRVDYSGFQRDKVIRLFLKEYCKYSGLVHEKIVTKGKLGFFKNKIDHFSYRNYDHYISKMNHYAAIKASELHEKGKKVNIYHVMVKPTARFFIHYIIRLGFLDGFTGFLVAKTQAYGVLTRYIKLWLLNRGIR

SEQ ID NO: 344 - protein, 255 aa, Unknown
  Description of Unknown: Chryseobacterium sp. CF314 sequence
MPELTEKVSGLIITYNEEQNIREVLGCFDFCDEIIVIDSFSTDHTVEIANTYPNVKVIQHKFEDFTKQRNLALDAANNDWVLFLDGDERITPLLRKEIIDELNKPVSQQKDAYYFYRKFFFANKPINYSGTQSDKNFRLFRKSKARYISGKKVHETLEVNGSIGILKNKLFHYSVSSYESYKQKMIHYGVLKGQELALKGKKFSRITQYSKTAFKFFKAYILRLGIADGKEGYQLSYLQSLSVYETYESLKKEQI

SEQ ID NO: 345 - protein, 235 aa, Campylobacter pinnipediorum
MKISIVMLTFNSEKYLKKALKSIEFADEVVIIDNGSTDNTKQICSEFKNTKFIFQKWLGFGKQKSFGVNQSKNDWIFVLDSDEIFTKELEAEIKDILQNPKFFAYKVARLNYFFGKPIKQMGLYPDNSVRFFNKNHANFNDKEVHESVVLFDDANKFGVLKNHFLHYAYESIEQFINKQNRYSTLGAKKNRLKAIINPTWTFFKLFVLKGGFMAGWRGYVVAKLYSQYTFWKYIK

SEQ ID NO: 346 - protein, 261 aa, Unknown
  Description of Unknown: Chryseobacterium taichungense sequence
MALSLAVITYNEEDNIVRLLDSISEIVDEIIIVDSLSTDKTKEICTEKYAKVKFFEKKFNGYGEQKNYAMELCSGEWILFLDADEVPDEDLKKEIQRITSEQNPKFSVYKAKYNNHLGIHLIKFGGWGNICRERLFRKDSARYSDDKVHEFLITNEKAGLLDGKIDHYTYKSIHHHISKINKYSDMMAEKMFERGKRYQNFKIIVSPAFEFIKVFIFKLGFLDGFAGFYVAKTMSYYTFLKYIKLREKIRIREFRKKCGDL

SEQ ID NO: 347 - protein, 282 aa, Rubrobacter xylanophilus
MSQKISVLVNTLNEEANIRNCLECVKWADEIVVVDMYSEDRTLDIAREYTDKVFLHERVDYVEPARRYALEQATNEWVLVVDADELVTRELRDRILQIAEEDRYDVVYVPRINYFFGRAMRGTGWAPLQDMHVRFFKKWCVRYSDEIHSPVGVDPSARVYELLDESCAFVHFNYIDAEHFIDKLNRYTTIEAKNSAAAGRSFSGLGVLYAVLKEVGWRFFLKNGFKDGFQGLALSLLMGFYRLSAGLKLYLMERYSTENVRDTVLKQYARIAEREIRRYEQS

SEQ ID NO: 348 - protein, 253 aa, Siansivirga zeaxanthinifaciens
MNNPSKISVLLITYNEINHIAEVIKNVDFADEIIVVDSFSTDGTLEKLAKFKHVKTICRAFTNFTEQRNFAIKQANFNWILFIDADERIPLELKNEIFEVINSNKNVAAYMFKRLYFFKKKRIRFSGFQTDTTYRLFKNGKVKYIENKLVHEMPEINGESAILKNTMLHYCFDSTAHYKSKMEHYAKLKALELHKKGKKTSVFQLLFRPFYKFVVNYFFRLGILDGKEGFQICYLSAYGVYFRYKELERLNNI

SEQ ID NO: 349 - protein, 252 aa, Alistipes sp.
MKISVVINTFNSDRFLDQCLRSVEKFDEIVLCDMHSTDGTIAIAEKYGCRIVYHERTGIVEPARNYAIAQAENEWVLVLDSDEVVPDALREYLYRFAETAEQRGYAALKMARKNYFLGRFMHGDYPDYIIRLIRKSKTYWPETIHARPVIDGGIFAIPSRRRELAVEHLANESVSSRIAKIDLYSDKELLRRADQRFSVWKAFSKCSWRFLRFYVVKGGFRDGKAGFTYAVLNACYKFATIAKIWERQSSED

SEQ ID NO: 350 - protein, 254 aa, Unknown
  Description of Unknown: Fastidiosibacteraceae bacterium SYSU SYW-6 sequence
MTEKKNTLGVVIITKNEEKNIARCLASVKWADEIIVVDSGSTDKTLEIAKTYRAKIIERHWPGDGPQKHFGISQLTTDWGLVLDADEEVTPELSNSMKTTLKNPQCSFYKMHRRSFFLSKIIYHGDWGKDWIVRLFDCSKHQWTQDIVHAKLNVSKKQAGMLKGKLIHHSQDSIASSLKKMNDYSDGTSTILWQKGKRTSLLKANFHKHWTFLRGFIMRLGFLDGKRGYLIAKLSAYGSYFKYIKLWEKQQNEQ

SEQ ID NO: 351 - protein, 259 aa, Unknown
  Description of Unknown: Candidatus Roizmanbacteria bacterium GW2011_GWC1_37_12 sequence
MKLSAVVLIRNEEKNIERCLESLTFCNEVIIVDDFSTDGTLEKIRNSKFEIRNKSKIKIFKRKLNGDFAGQRNFGMSKASNEWVLFVDADEEVSGELRKEIVKLLNGQIVNEVGFYIRRLDWFWGKELRYGELKKARDIGIIRMVKKNSGQWLGNVHEMFYTAKNIERLKGFLNHYPHQTLKEFINDINYYSSLRAEELYRQGKKTNVLEIIFVPSLKFISNYLLNLGFLDGVPGFTYSFLMSFHSFLVRAKLWQYYFI

SEQ ID NO: 352 - protein, 256 aa, Campylobacter sp.
MDTQKISVCILVKNAQDTILECLNSLSEFGEIILLDNESSDDTLKIAENFNQTYQKLHIYSNKFIGFGKLKNLALSYAKNEWILSIDSDEVLEKEALEELKALELTSNSIIALPRKNLYRGEWIKACGWYPDFVWRVFNKNFTRFNDNFVHESVLMPVNSQKIKFKNGFKHYAFKDMQGIIHKMNTYTSYSAQEKFKNGKKTSFFAAFCRFHLVFFKDYFLRSGFKYGYKGFIVALLNALGAFFRYAKLYELQKDK

SEQ ID NO: 353 - protein, 307 aa, Unknown
  Description of Unknown: Candidatus Pacebacteria bacterium GW2011_GWF1_36_5 sequence
MSISVVVIAKNAENIITRSLKSVQFADEVILVDIKSTDETRQIAEKYCTKIYDYKEDSRFVEPVRNFAFSKATKDWILVLDADEEIKEALALKLQEIDQKDLGDVYHLSRKNIVSNYWMQNTGWWPDYQLRFFKNGLVSWGTKIHAKPEIKAGSRVVILEAKEDLAILHHNYKDTKDYLARFDRYTDIEAEQKAEELKDNFSISQSGMLKAFSDDWFRRFFDKQGYKDGVRGFYLSLMQAAYQMTTQMKTFDLLGNKNSLEKDSRQLLIKDLRHFQKELNYWINDMEIKEKNGLTKLVIVLKRKLGL

SEQ ID NO: 354 - protein, 252 aa, Unknown
  Description of Unknown: Chryseobacterium soli sequence
MEDIKLSALMIVFNEEKNIEGALKSLEFADEIIVLDSFSTDKTIEIIRKKFPQVKIFQNKFEDFTKQRNLCLTYANHDWILFLDADERIPRALRDEIKKEIKNPDAKDAYFFKRKFFFMKKPVNFSGTRNDKNIRLFKKEVGHYDDTKRVHEGLSNIQSSGTLHNYLLHFSFDTYEAYYRKILHYANLKAKDLHEKHVQYGFFKQIGKSAFNFFKMYILKLGILDGKKGFILSYFSALTSFKTFEYLKEQYS

SEQ ID NO: 355 - protein, 260 aa, Unknown
  Description of Unknown: Candidatus Kryptobacter tengchongensis sequence
MKGGREKLSVVVITGNEEKNIAECLESVAWADEIIVVDSESKDKTVEIAKKYTDKIFIKKWEGYANQKQFAIEQATGDWVLSLDADERVSTELKSEIENILKGETEYDGFYVPRKNFFLDKWIKSCGWYPNYQLRLFRNGKGRITPRKVHEKFVVDGKVGYLKGHLIHLTHIDLFDTFEKINHYSSLSAEEKSGRKVRWYHILFVPVFAFLSHFILKRGFSDGIYGLMVSLNHAMTKLQTYMKIWEIQNVKSKGKEKIRW

SEQ ID NO: 356 - protein, 251 aa, Unknown
  Description of Unknown: Flavobacterium ummariense sequence
MSTKISALIITLNEAKNIKQLIHNLDFADEIVVVDSFSTDDTLAILKEFSNIKVYQHTFQDFSSQRNIALKYAAHNWILFIDADERISENLRNEILKTVSLNETKQGYYFKRKFYFLDRPMGFSGLRTDKNLRLFKKEGAQYRGLVHEKLNIANTGTLQNYLTHYSYSSYGHFKDKVVYYNKLKALEKIKKGVKPSVFMSIFHPVYTFLNRYFFRLGILDGKKGYIISKIYAQAINERYKEMFRLMKEQAK

SEQ ID NO: 357 - protein, 654 aa, Methylomusa anaerophila
MAKISACVIVKNEADNISRCLQSVKDIAAEMIVVDTGSTDDTVKIARQMGAKVFQYQWNNDFAAARNYALTQAKGDWIIFLDADEYILPGKIQNVRPFIDKIHGNRMIESVVCRMENTEGVDGPLKSTNPTVRIFRNSRVIRYQGKVHEQIYKHGKPTRSIGDAKQFIVICHTGYTKEAIPEKIKRNTIMLEEDLNNGNVRNLTYYYLSDAYWRLGQYEKAIEFAQKAIDHGGVFHTLYAYKPYVTLIASMVRLNTYSNEAMEAIRDQAIQKFPHHPEVLLHQALYYRKTGRYRQALESFFQSIAANERYGDINLNNDFYGLVSVVYLNIAKLYDMMNENVPAFDYYVKTLQQDRYNQEAFNGLMLLIRTQNAADVVCLMNRLYNMDDEADVDFLVVELSRLKMKKVLDYYCKIRFERFGRREPAGILLLTNGRFEQAFQGFAAFFRETGDQGAELLAVVSLLLGGSPSWVDLLGPQLRPAFQRIITAFFAPEEGCVLAAEDFSSYLELTNDFIHLIHLGNENQLIAFLHVGKRFLLAEAPVQIGDILARKKLFHHALDMYLYKIDAVFSEAGPSESIYCKAGFCCYKLKDFAAAANFFSHALECGYVMYDIFEYLEWSYQQCNDGVIKGKFKALKDFYGNETEAMAEIKQHAG

SEQ ID NO: 358 - protein, 260 aa, Rhodococcus sp.
MALSAVLITLNADKQIAEALESLQFCADLVVVDSNSTDDTIEIAQKCGARVVQQDWLGFGPQKQFAVTQATHDWVLCLDADERVTPELERSIRAVIQQAEQGLLPVDVAGFDMPRCNFFLGRYLRHGEGYPDYSRRLFNRKMANWSNDAVHEKVECTIPDTRFEKLEGDLLHESAESLESYLTKQNRYTSIQAQHLAAHGRWPGLGKLMLSPVVRFIKFYLVRKGFLDGWPGLVHIAIGCFNSFMKYAKTRELMQQKRER

SEQ ID NO: 359 - protein, 254 aa, Rhodoferax sp.
MGLSVVIITKNEALNLAPCLESVAFADELVVVDSGSTDGTLQIAQSFGAKILQTPDWPGFGRQKNRAVDMATQDWILSIDADERIGPVLRDEIMATMASPTHKVYALNRRSSYCGQTMNHSGWYPDPVVRLFQRGAARFSDDLVHESLRTSLPIGALQGPMAHLSFRNLESVLDKVNRYSTAGAQALANKGKSASLGKALLHGFWAFFRTYVVRRGFLDGRMGLVLAISNAEGTYYRYLKLWLLQRPVDEKEPA

SEQ ID NO: 360 - protein, 253 aa, Dialister invisus
MAKISALILAKNEERNIKACIETLSFADEILVIDDFSTDKTKEIAESLGARVIQHGMNGDWGKQQTFAIKNARYEWVLFVDADERISKPLAKEVCSVAEKGDKKAYWIRRENKFYHHHATHGVLRPDYVNRLFPAEGSYVEGYVHPRIVTPYPNEKLHEIMYHYTYDSWSHQLNKLNNYTTLAAAKYKKNHKKCNFFFDIMLRPFWAFFKVYVLNLGFLDGKMGWILSTNHYFYTMNKYIKLYFLYQDKDGRL

SEQ ID NO: 361 - protein, 444 aa, Desulfotomaculum guttoideum
MKIVTRLSQCMIVKNEEKNIRRALSWGKGIVFEQIVVDTGSSDNTVEIAKEMGAKVFHFDWNDDFSAAKNFALEQAKGNWIAFLDADEYFSDEETKKLLPLLRRLDKTLSPTLRAVALNCTMANLDDSGGVINLFSQCRIFRNIPELRFKNRVHERLSLSADIKLTSLDASEELTIYHTGYAESVYEETGKIDRNITLLKRELEENISNGDTWSYLADSFYAANRLDEAEEACLKAIEREESSFDKNRKREDITKLIKIKYRKNSGQEEDIVSIYQVAKDYAGSTPDLEYWTGLWFYQRGERQKARHYLEQALNLLDQQKGDGKVAMVGNLAEIYQILFGICKAYGTPSDVIRYGVLALRMNPYLFPVLLDMLLLLKQEPGEEETAGATFGFLSKLYDLSSFKNKTFLIKVAEKVPFPALEKQIYPLMSKEEQEVFAGVGEIFG

SEQ ID NO: 362 - protein, 269 aa, Unknown
  Description of Unknown: Candidatus Protochlamydia sp. R18 sequence
MTSSFPISVTILTKNSQKYLREVLQALKGFDEVVICDTGSQDETVSLAKQFTNVAIYHEPFKGFGPTHNTASNLAKNDWILSIDSDEVVTRELAIEISQLQLKSKHVYSFPRRNEYRGKWIKGCGWSPDRQIRLYNKQETHFTNVQVHEAIIATELTHVHLQSPLKHYSYDQISDFLSKMQSYSTLFAEQYKGRKSSSFVKALSHGLFSFFKSYIIKRGFLDGQEGFEISFYNGSTAFYKYLKLAEINRYLKKEGSEKCDGDLKKKLSA

SEQ ID NO: 363 - protein, 270 aa, Desulfotalea psychrophila
MKTISAFVTTFNNEKTLANCLKSVQWADEIVVLDSYSTDSTVSIAESYGAKIFQHEFLGYGPQKQSALEKISCEWALLLDADEEVTPALAKEIQGMLTTESGHDGYKLPRQEQLFWVMSSPYSGFNYQLRLFRRLAGALSDDAVHADPEVHGTVGQMRHPFYHYGEVNIHAKEARINAYSSGMVEEKVAKGKKHPLLMCLFYPAWTFLQSYVFKRGFLNGSAGFIGSVIMAHYAFLKYAKLHEYYQVEKYGTSLLPADAPDNLAPPKVPK

SEQ ID NO: 364 - protein, 318 aa, Nostoc punctiforme
MSSKIPVSVLIPAKNEQANLPACLASVSRADEIFVVDSQSTDNSIEIAKSHGVNVVQFNFNGRWPKKKNWSLDNLPFRNEWVLIVDCDERITPELWEEIDQAIQNEEYTGYYLNRRVFFLGKWIRYGGKYPDWNLRLFQHKKGRYENLHTEDIPNTGDNEVHEHVILQGKVGYLKNDMLHEDFRDLYHWLERHNRYSNWEASVYFNTLTGKDDSGTIGANLFGDAVQRKRFLKKVWVHLPFKPFLRFVLFYIIQRGFLDGKAGYIYARLLSQYEYQIGVKLYELRSCGGHLNTATTPKEEAGEQGNRGTDVKLLTIDS

SEQ ID NO: 365 - protein, 253 aa, Unknown
  Description of Unknown: Bradyrhizobiaceae bacterium PARB1 sequence
MTATPRLSLIVITKNEEAAIARCLGSVSLADEIIVIDSGSTDATVEIAKSFGAEVIVTTDWPGFGPQKARALERARGGWVLSLDADEWLDAEAIEPLKAAIAAGDAPAAYRMSRRSRFCGSVIRHSGWSPDYVTRLFRRGQARFSDDLVHERLIVDGDVRTASFRIEHDSITSRADAEDKIVRYSTAAAQQMFTRGRRAGALQAPLHGWAAFLKTFILRAGFLDGAAGWDVADYNRRYAYEKWRRLAELSRNA

SEQ ID NO: 366 - protein, 410 aa, Conexibacter sp.
MSRRRLSACLITQDEEERLPAALASLAFCDEIVVVDSGSTDRTVELARAAGATVVHNPWPGFARQRNVALRHATGDWVVEIDADERVTPELAAELRAFLDHPTLPDRFPLLSLPRRNRFLGGWLRDSMKYPSYCRRMFALGVYEHDETRTVHEEVVPTTPAWAARGDITHELAGTWREALRDTWAYAKLDAAQFRPQLSVTALVRGVVLRPLVKAAYRLTLDGGWRDGWRGAARIALDTGTDAAVWLLAARAARRTGPDGAADATAGHYSERFPAVSAVRVVGVATSAGGAQRVTAWLAQAAAAGADATLLVPPSVAPVDLDAAAPPWVRDAVRVQALAGRGPVAIGRALDREEQVRPVELVVAADDARRATRLALRLVARGPAAGDLDAPAAPQVMSARPAADIQTTWR

SEQ ID NO: 367 - protein, 358 aa, Kineothrix alysoides
MLPISVCLISKNEEKYIGECLSRLIKYDWEIIVVDTGSTDRTIEIALSYTPNIFHFDWIDDFSAARNYSIAQAHNDYVLIVDCDEYLENSSLTEETVRNLPNLISPKQVGMICLRNISSHTTGNLAESSSDIIHEHIARFFHRGYTYYQGSIHEQLVSREGNVLSFTSLPLCFYHVGYSTDEIRAAKADRNITMLKQSLSNQGGNPYLYFQLGQSYFGISDYENALPYFEKALSMDVDEREEYVQTLVESYGYCLLYLKKYKAALQLDGLYPIFSKRSDFAFLMGLIYMNNAMFEQAIAAFDHAVSIQRYAIEGVNSYKAFYNIGVIHECMGHISEAMKYYQKCGSYPPALHRLDILK

SEQ ID NO: 368 - protein, 252 aa, Unknown
  Description of Unknown: Chryseobacterium sp. Leaf394 sequence
MKLSVAIITFNEDRIIEKTLSSVYDIADEIVVIDSFSTDRTVEICQKFSKVKLIQQKFPGFGKQKNFAISQCSGEWILFLDADEIPDETAKKSIQKIANQNHSDFSVFNIAFNNIFLGKSLKYGGWGNLKRERLFRKNAGKYSEDIVHEMFLTEEKIGLLEGKLNHYTYKDIHHHIEKSNKYTTMMAEKMYSRGKKSSVLKIIFSPIYQFIKSYFIRLGFLDGLVGYYAAKTAGFYTFLKYQKLYELHKVKK

SEQ ID NO: 369 - protein, 253 aa, Unknown
  Description of Unknown: Chryseobacterium hominis sequence
MTHLKEKISGLIITYNEEKNIREVLECFDFCHEIIVVDSYSTDKTTDIARSFSNVTVVQNKFEDYTKQRNLALNLANNDWVFFLDGDERISEKGKQEIIETVNNPNACDAYYIYRIFFLGQQKIRFSGTQNDKNFRLFRKSKAHYDDLKKVHETLLVNGKIGFLKHKLLHYSFENYHRFKDKMIYYGQLKGLELSQKGKKYSSFMKWSKTTFKFIKTYILKLGVLDGINGLKISYLQSLYVYETYESLRKATS

SEQ ID NO: 370 - protein, 252 aa, Unknown
  Description of Unknown: Candidatus Abyssubacteria bacterium SURF_5 sequence
MTKLPISAYVITLNEEKNIRRCLESLRDFEEIVVVDSFSKDATVDICREYTDKVYQHEWPGHTNQYVYAVSLTSHEWVFWIDADEVVSPELAEDIRRVFANSAPQDYDGYYVSRMTFYLGRWIRHGAWYPDYKLRLFRKSSGKYVNDDPHMSVIVEGRTARLNGKLLHYSMASFSDHLRRLDSYTDIYAHNQIKSEASFPLFSMLTRPPLRFLKSYVLKAGFLDGMPGLIVAAMSGFTVFARYVKFWERKHS

SEQ ID NO: 371 - protein, 255 aa, Unknown
  Description of Unknown: Candidatus Gottesmanbacteria bacterium GW2011_GWA2_47_9 sequence
MISSVVLTHNDEATIAKTLGSLTWCEEILIIDDGSTDNTLSITRKFTSKIFKHPLDNDFAAQRNFGLSKAKNEWVLFIDSDEIVSPALAKEIREIAAPRQLAGTRNDNTVGYFIKRRDIMWGRELRHGEQGRMKLLRLAKRDTGKWIRPVHEVWDIKGATLELQHPVLHFPHSSVAQYLGEINRYSTLNARYLYAQKIHVTWWQIVAYPLAKFFLNYFLRLGFLDGTAGAQVAIMMSMHSFLTRAKLWQLWDKRV

SEQ ID NO: 372 - protein, 252 aa, Unknown
  Description of Unknown: Candidatus Shapirobacteria bacterium CG10_big_fil_rev_8_21_14 _0_10_40_9 sequence
MISVVVLTKNEEKNIEACLKTLKWCDEIVVIDDNSSDKTVEIAKKLGAKVFIRDLNNDFSAQRNFALRQAQGDWILFIDADEQVSPQLRAEIKSATSNKQQAISGYYLRREDRIWGRVLKHGETTNVRLLRLAKKTAGTWKRRVDEYWGIAGQTDILKNPLIHYPHQTISEFLESINFFSSLNAQAFYDEGKRTTLLDWFKPPVKFIQNWIFRLGFLDGMPGFTVALMMSFHSFLVRAKLYLLWKREGGWRR

SEQ ID NO: 373 - protein, 258 aa, Hydrogenivirga sp.
MGKLPLSVAIITYNEEDRIGRTLEAVKDIASEIVVVDSHSTDRTREIAESYGAKVYVEDWKSYAGQKNYALEKCTQEWVLFLDADEVVSEELKRSIVKAVNSGRADAFYLNRKTYYLGKFLEHIWQPDWVLRLAKRSSDPKWVGGSVHERLEVKGRAEKLEGYLYHYTYRDLSDHFQKSLRYARLSAGDMFRGGKRFKLHKLVLNPVWAFLKQYFIKGGFRDGIRGLSVSMSYFFSTFLKYMFLWELEQEERRKGGRG

SEQ ID NO: 374 - protein, 594 aa, Desulfosporosinus acidiphilus
MKPKISLTMIVRDEAAFLAECLEHVRHEVDEIIIVDTGSTDQTLTIAQRFTDQIYTFSWTGDFSAARNFALQQAAGDWILSLDADEIIQGEPGSLRMLIRDAGDKEAFLLPLHNPISNSTGEFNTFYVIRIFKNNDLYRYVGKIHEQVSIPDPEKVGLAQSPLIEHKPLPLRVQHKKRNRNLRLLLQASKENPLNPFLQYYLGVEWLMLGKGSYALPLLQKAYRSLGDENLLFRAPALKYLILCLRELGKPDEAFCLCLEASLSYPIYTDIFYFGGILLEEMGEYLAALKWFNHALLCGSPPALFSHLTGSESFLAHYHLGFCYEKLDKKAEAFNAYVTALDTNPKYPYPLYPLILILLSEKGPANCYQILAQKGYLANPILCLTAANLFYLSGHVEEAFLCLDSNRECFLEDKRFLLDLGKYCIYSGRLNMGLNLLRQIPKNSSYFSSAQTLSIIALIFLGNYPEAKLSAIHLWRNPLNRGEAFILLSIIRNIVQDNKGTIQPDLPNIRERETIPMATELYQDYLRYLNHPSSRKSPNHFVQRWGEALETLLKSSENGLSFLLRGYDQRLENLKQNFIKIFGSEWRVNEYVNC

SEQ ID NO: 375 - protein, 259 aa, Thioploca ingrica
MSRLSVIIITHNEEHQIGECLASVSWCDEIIVVDSGSTDNTVTQCRQFTHNIFIQDDWQGFGVQKNRALAKATGEWVLSIDADERISTALQQEIKQAITHPTTSAFRIPRQSYYCGRWIKHSGWSSDYVIRLFRRQCAHFTNDLIHEKVQVLSGKVNTLTTPLLHYSFTSVEEVLEKINRYSSLNAQLHYEQGKRATLTQAIGHGLWAFVRTYLLQAGFLDGAEGFMLAVSNAEGTYYRYLKLMYLQKYVKNQRYSDNL

SEQ ID NO: 376 - protein, 279 aa, Unknown
  Description of Unknown: Acidobacteria bacterium sequence
MSVSVLIPTLNEERNISECLASVAWSDDVVVVDSNSVDRTGGIARAAGARVVEFKWDGNLPKKKNWALANVDWRHPWVLVLDADERVTPELAEELLARVANTDCRGFLLNRRLIFLGRWIKHCGYYPSWNVRLFLHRRGRFESLVDGDTGSGDNEVHEHVIVDGLVGRLRGELVHHAYPDIATWVEKHNRYSNWEAAVEVWGVQSGRLPSGTAAAARRHARILTRKLPCRPTLRFLYSYVLHGGFLDGYPGYVLSRLMATYELLSLLKAREARQRRTTP

SEQ ID NO: 377 - protein, 269 aa, Unknown
  Description of Unknown: candidate division Zixibacteria bacterium SM23_73_3 sequence
MSKISCIIITYNESRNIRRCLKSISWTDEIVVVDAHSTDDTKKIVSEFTDKIYDLKWEGFGPAKEFARSQASGEWILSVDADEVVSKELREEIQRMIESCNSLDGYYIPRRSNFLGRWIRYGGWYPDFVMRLFRKDRGNFSHRLVHEEVRVDGKSGCLKNDLLHYTDPNFDHYLEKLNRYTSLDALQLYTRGRKAKLLDILFRPPITFVKMYIFKKGFLDGTPGLILSISSAFHVFSKYVKLWHLKQSGNKSGSKKNSGVPKDPMFPDG

SEQ ID NO: 378 - protein, 259 aa, Geobacter sp.
MSTKTKISAVVRTFNEELNIRDCLESLKWADEVLVVDALSTDRTVEIAREYADQVILQEWLGHVGQSQFVTDRASHLWVFSLDADERVSPELRDEILALDLENSPHDAYDMPRRHFFLQRWINHSGWYPDRNIRLFRKDRCRWGGYEPHDKIQVPGSLASLKGDLHHYIYRDMNHFAETKNRYATRTARDHFKTGRKSTVMHFTLRPLFTFFDRYLIRRGILDGLAGYVISVMEAYGVFLKYIKLYEMQRKLMRFPDER

SEQ ID NO: 379 - protein, 357 aa, Clostridium sp.
MKTIGLVMIVKNESRSLEKCLSHAQKLVDGIYITDTGSTDNTVEIAEKFHAHISRFEWNNDFSAARNYALEQSPCDWNLILDADEYLISGSKKDLLTFIEKGDHIGAVQLNNSYKEANGEISQSCLCITRVIPKGTRFEGRMHEQVVSDLPIALLPLVFEHDGYMLEGKGERNLQVLLEELKDKPKDPYILYQAARTLWIMKDYTRADQYFERFYQTVPFSGTGYRANGVISYIYNLIELKKYETGFKIIENEQKRLAPYADYHFACGTFYTQAIFSDVQRYINYLPEIERSYRRCLEIGEVPEHEGVIGSGSFKAAYNLGVWFEVNGKNKEARFYYKMALDWGYQPAGERMKALRG

SEQ ID NO: 380 - protein, 251 aa, Unknown
  Description of Unknown: Ignavibacteriae bacterium sequence
MQKLSVIIITYNEEHNITDCIESVKWADEIIVVDSNSNDNTIALAKKYTDKIFFVTNSSYSQSKNAGLDNAVNDWILSIDADERVTEELKNEICTAINNADNIKAYFLNRKSFFISKFIKHCGWYPDYILRLFRISAGIRFNDSKVHEKAEYSGKTGKLNANLLHYTDLSFEHYWNKMNRYTSISAEELFAKKRKASFFDIIFRPAFAFFKMYFLKLGILDGFTGLVLCTLSSVHVFVKYSKLYYLNNSGD

SEQ ID NO: 381 - protein, 259 aa, Unknown
  Description of Unknown: Aquimarina sequence
MEKKASHREKVTAIVPCYNEEHNIRKVLESVSFADEIMVVDSFSTDKTIEIAKEYTDFIIQREYEYSASQKNWAIPQANHEWIILVDADECVTPELKDEILKTLENPGVDNITGYWIKRMNHFMGERINYSGWRNDKVIRLFHRDRCSYQDKQVHAEIKTDGKIAFLKNKFYHNTYTTLDAYYTKMNRYAAWQANDYDKKTGKLTPYHFVIKPFWGFFKHYIIQSGFRDGLPGLVIGYIQGYTVFMRYVKLWLLRRDRK

SEQ ID NO: 382 - protein, 251 aa, Polaribacter glomeratus
MTKITAIIPTLNEEIHIEEAIKSVSFADEIIVIDSFSTDKTIVLAEKYNVKIIKRKFDDFSSQKNFAIDQAKHPWIYILDADERVTIEVRGEILEAVKDPEDCVGFYVRRTYYFSKKRVNYSGFQRDKVIRLFLKEYCCYSGLVHEKITTKGKLGFFKNKIDHFSYRNYDHYISKLNHYAAIRAKELHKRGDKVNIYHVMIKPPARFFIHYIIRLGFLDGFTGFLVAKTQAYGVLTRYIKLWILNKGIKEN

SEQ ID NO: 383 - protein, 256 aa, Conchiformibius steedae
MTSSVLPISATVLTKNSERHLVRVLNALRGFDEVVVLDNGSQDNTLAIAGEYANVSIHHHVFEGFGKLKNRAAAQARNGWIMNIDSDEIVSDELMQSLQRIDFSEINKIYTVSRLNHYRGRPIRGCGWYPDMVPRLYHRSHTAFSDVPVHERIEIQNDSQLTALSGELLHYSYNGAGELLAKMQFYSDLYAERYRGKKSATTAQAVAHGAFAFLKSYVFKKGFLYGGDGWVISASVAANSYYKYVKLKEANEQPKP

SEQ ID NO: 384 - protein, 300 aa, Stanieria sp.
MFSIYILTYNEEIDIAACIESAAVTDDVIVVDSFSKDRTVEIASSYPVRVVQHKFESHGKQRTWMLKNIPTKYEWVYILEADERMTPELFKECLAAIKSQQAIGYYVAERVMFMGKWIRHSTQYPRYQMRLFEKTKVWFDDYGHTEREVCLGNTGFLIETYPHYTSGKGLSRWLDKHNRYSTDEAAETIQQLNQGKVNWQQLFFGKSEIERRRALKDLSLRLPFRPLIRWIYMYFILGGIWDGKAGFAWCTLQAFYEYLIVLKVEEMQASFSPQVEANHQQNVDIKNETIVDSLLPSSVS

SEQ ID NO: 385 - protein, 291 aa, Unknown
  Description of Unknown: Verrucomicrobia bacterium TMED60 sequence
  MOD_RES (185)..(185): Any amino acid
MTQGFKVPLSLFVPCKNEETNLARCLQSVSWIDEIFVVDSQSTDRTTNIADEYGAKVMQFEYKGGWPKKKNWGLENLPFSNEWVLILDADECLPPEAEDEIKKILSDPNKKHAGYWINRRYFFLGQPLKHAYFPNWNLRLFKHKLGRYEKITDLTTESGDHEIHEHVVVKGTTGKLNSIMDHHAXPTIDSFVEKHNRYSNWEAVVESSAQDDDSALQHEGVKGKRKLRKVFRKLPFRPTLRFLYVYLWQGGIFDGWPGYVFARLHAQYEFLSLAKAKAVLRERKEAGKTTR

SEQ ID NO: 386 - protein, 261 aa, Unknown
  Description of Unknown: Pectobacterium carotovorum subsp. carotovorum ICMP 5702 sequence
MRKTLSVLIITKNEEELIQECLESISWADEIIIVDSGSSDNTIEIAQKYGAKIYHYDNWLGYGKQRQRAQTHASGDYIFFIDADERMTKELRSSVETILKKPDIITDTVYACARRNLFLGRFMKHSGWYPDKVLRFYANHHYHYNDNQVHESLIYGNAAVKSLMGDLLHLTCRDFSEFQKKQLRYASDWAKERHAKGKHCSYVSIFSHTMFSFIKTLILKAGFLDGKQGLLLAIVNAQYTFNKYAELWSYKEVNDDVKTPK

SEQ ID NO: 387 - protein, 317 aa, Emticicia sp.
MVAVGHPDLFYACIKGSSEHGISVFFKLFVVNMCVGFYHYESFFCKITMLALQTILLLELKTQPMPLSVVILTFNNTRTIRQVLEAVAGWANEIVIVDSGSTDETLSIAQEFGCKIYHHTFAGFGKQKHFAVEQATNNWVFVVDSDEVVTEALKQEIDAKVVEGTEYRGFMVPRILIFLGKKLKYGRESKLPTLRIFNRKFGNYNDKDVHEDVVLDGKTLILENEMLHYSFSDMAEFFQKMNDYSSRSAIELYKKGKRTSVLKVVTKFPVTFFVEYFIRLNFLNGYPGFVWAFTQAVYASLKYIKLRELQRKAMLQS

SEQ ID NO: 388 - protein, 251 aa, Magnetofaba australis
MVITLNAESVITECLHSLQFCNEVVVVDSGSTDETLAIAGQFTNVRIVHQQWLGYGPQKQFAVKQATHDWVLCLDADERVSHPLKQEIEQLLATPERANHAYEFPRCNRFMGRWLRHGEGYPDPNLRLYDRRHGRWSSDPVHEHVIADGPVGRLRGDLLHLSEQGLEDYLAKQNRYTTIQAQRLAAQGKNIRAHKLWLSPGLRFLKFFFLRAGFLDGVPGLVHIAIGCFNTLIKYAKARAIQRRQTPDKTS

SEQ ID NO: 389 - protein, 277 aa, Gramella gaetbulicola
MVSVVILTKNEERDLARCLESLKWSNDVHVLDSGSVDQTIKIALDYNAKVSKHKFESFGQQRNFALEHIDFKNEWILFLDADEVVTKEFKEDLISSILEADDETVGFYCCWKMMLEDRWLKYCDNFPKWQFRVLKKGKAEFTDFGHGQKEGRVDGKLEYIKEPYLHYSFSKGWTQWIERHNKYSSQEAEARLDNCPPFRNIFNKHSSTRNPALKSWLIKVPGWPLLRFLHAYFFNLGFLEGSPGFIYCTNMAYHEFLISIKMRELKRKKRQVELKTI

SEQ ID NO: 390 - protein, 261 aa, Legionella worsleiensis
MLTVIIITKNEETNIRRCLESVRFADEVIVVDSGSTDKTVAIAQEYTDKVFQTDWQGYGVQKQRALAKANGDWVLNLDADESVSVELQKEIINVIASDSADAFRVPIQMFFYNQLLKYSASPKRHIRLFKRENANYSTDIVHEKILVAPNSRISRLKNAIQHHSFRDLSHALYKLNKYSSYSAKIRIASNKKPGFLGVLLNTGWMFSRCFILQRGFLDGKLGFLFAVYSAQGTFYRGLKQIYKDNDLHQLPQIINETKDGL

SEQ ID NO: 391 - protein, 248 aa, Unknown
  Description of Unknown: Candidatus Rokubacteria bacterium sequence
MSVSAVVITFNEEERLRACLESVAWADELVVVDAESSDKTVQIAREFTDRVWVRPWPGFPDQKNFALEQATGDWVLSVDADEEVSSELREQIEAVLGSGSASADGYLVPRQNIFWGRWVRHGGLYPDWQLRLFRRGRGRFVDHAVHESVAVTGTVGRLGTPLVHRSYRGVTDFLARADRYSTLAAEAWIRSGRPARLSDLVWRPAGRFLGMYVVRAGFLDGWRGFLLASLYAYYVFIRSAKAWERARG

SEQ ID NO: 392 - protein, 250 aa, Unknown
  Description of Unknown: Flavobacteriaceae bacterium JJC sequence
MMLKEKISGLIITFNEEKNIQEVLDCFRFCDEIIIVDSFSTDQTLAIASKNPKVKIIQNKFEDFTKQRNLALDAAQNDWVLFLDGDERITPELEEEIVRTVNRSDAKDAYYIYRIFFVGKKKINFSGTQNDKNFRLFRKSKANYLEHKKVHETLEVNGTTGILKHPLLHYSFENFEAFKKKMLNYGYLKGAELAENGKKYWVFVHWSKVAFKFIQTYFLKLGFLDGEDGWKISCLQSLYVNETYRTLKKA

SEQ ID NO: 393 - protein, 288 aa, Gillisia limnaea
MVSVIILTKNEEQDLPKCLSSLQWTDDVLVLDSGSTDDTVKIARDFGARVSYNKFTSFGMQRNYALENLELKYDWILFLDADEVVTPPFENAILYAIENADQRVAGFYCCWKMMLDDTWLKNCDNFPKWQLRVLKKGRATFTDFGHGQKEGEVKGKIEYIKEPYLHYSFSKGWTQWIARQNRYSSLEARDRIEKRPPFKHIFHRNSSQRNPALKSRLSDVPGWPLLRFLHAYIFNGGFLEGTPGFIYCVNMGYHEFLIKIKMRELRLKRKKNTVAISNATKESEITIS

SEQ ID NO: 394 - protein, 262 aa, Unknown
  Description of Unknown: Candidatus Vecturithrix granuli sequence
MKKKQALSVTIITYNEEQYIREALESVSWADEIVVVDSQSTDRTVEICREYTEHIYQIPWHGYVEQKNIATDKASHLWILNIDADERVSPELAREIQNALSQESQYVGFLMPRKTYYLDGWIAHCGWYPDYKLRLYRKDCGVWVGQALHEQVQVNGPVNYFQHDLYHYTYQDIADHLEKMNSFTSLAASQKQGAVSGAGILGRTVLTFFKKYLLQQGFRDGTRGMIVSLLAAFTVTLKYSKLWERQQAISQKKPSFFKKLGF

SEQ ID NO: 395 - protein, 244 aa, Pedobacter sp.
MYISAVIITKNSEKTIKRCLDSIAGIADEVLIVDSGSTDRTLKIAESFGCVIIKTPWLGYGATKNLGHQAARFPYILSLDSDEALSYALVKEMEPEKLKLQGLYEFRRLNNYCGKWIKHGAWYPDKKIRLFPKEILWNHAASHEKLVLTEDPFLYTFKSPILHYAYSSEEELKSKVELYARLGAEDRKHLSKIAAVGKMIFSPALSFVKSYLIKRGFLDGIAGLKISYYIALGTFLKYKYLLQG

SEQ ID NO: 396 - protein, 259 aa, Psychroflexus sp.
MTQPKPKITGLIITLNEEKNISEVIENIDFVDEIIVLDSFSTDKTVDIAQSYKHVKVYQNKFENFTDQRNLALDYANHNWILFLDADERLTSELRKEILETVKNEDTAEAYYFFRKFMFKDKPLHFSGWQTDKNIRLFKKDAARYSKERLVHEILRVKGRTRTMKHKLIHYSYIDYDSYKQKMINYANLKAKELYMKDVKPNFFHYYIKPAYKFLYTFLIRLGILDGKRGFIICYLNALSVYYRYPFLKKLYQSKKEPI

SEQ ID NO: 397 - protein, 250 aa, Unknown
  Description of Unknown: uncultured bacterium sequence
MLSTVLITKNEEHNIKNCVDHLIDWVDEIVVFDSGSTDRTVAILQEYRSPKIKIQQIEWQGFARTKNLAIEAAVGDWILSVDADEVITPELKNEILDKMRSAGANGFLVPRLLYFCGRPVRYGGSYPDYQLRLFKKVSGRFVETPVHEYVRLDGEPGRLKNHMLHYSYRTMFDYWARLNRYTELDAEKKFQQGKKFRFYRVLVLPLEIFKRLYLKMGILDGFPGIFYHIFSAVSSLVKYAKLWEYCENKQ

SEQ ID NO: 398 - protein, 277 aa, Unknown
  Description of Unknown: Thermodesulfobacterium commune DSM 2178 sequence
MSKISCVIHTYNSEKYLRECLSSVEWCDEIVIIDMYSTDRTIEIAQEFGAKIYMHEYLGYADPARNYGLSKCSYDWILALDSDELIPKKLKIRLKEIADKDIFDVVLISRRNFFFGKELLGGAWGYDQDVIARFFKKGFLTYGSEVHNFIKINPKARVGKIIDKESSIIHFNYNSVRHFIEKLNTYTDFETFSTKYNYKGKPAIKILYHICREFFGRFIYKKGYKDGWIGLYLSLAMAFYRATAIAKSNLPNEEEVIKLYKELSKNIRDTKNDNKDK

SEQ ID NO: 399 - protein, 254 aa, Unknown
  Description of Unknown: Omnitrophica WOR_2 bacterium SM23_29 sequence
MIQDKLPVSVVVIAKNEEKKIADCLESVKWADEIVVLDDMSEDKTVEAAKRYTDKVFQRKMDIEGRHRNYAYSLAKHNWVLSLDADERATPELKDEIKEVIKSKADHYGFAIPIRNYIGNYWIKYGGWYPSPQIRLFKKDHFKYEEAEVHPRIIMPDPRGVLKSDIIHYNYKDFEDALRKLNKQTTLEAAKWVRDKRKMTLFKALWRSLDRFIRRYFGKAGHKDGIIGLVLAVFSGAYQFLSYAKYWQRRQDRR

SEQ ID NO: 400 - protein, 310 aa, Isosphaera pallida
MRASDHRITSKAPVSKAPVSVLVPVKNEAANLERCLPALAWADEVFVVDSQSQDATVEVAQRHGARVVQFYFNGVYPKKKNWALDSLPFRNEWVLIVDADEVVPPQLANEIAQRIATDEADGFLLNMKYFFLGRRIRHCGYAECWNLRLFKHRMGRYERMPVAPGSGTGDNEAHEHVILDGRIKKLTHELDHYAYPDISTWVEKHNRYAAWEAEQYERFLKEPIPKGIGAGKRFKRMLKKIYLRLPARPVIRFLYAYVARLGFLDGKPGLAFCGLLAFYDFLAWAKRYEKSLQSLDASHNEGKGGVYSES

SEQ ID NO: 401 - protein, 246 aa, Unknown
  Description of Unknown: Nitrospira bacterium SG8_35_4 sequence
MFPVSVAIITKNEENNIEDALRSVADADEIVVVDANSSDRTVEICGKYTDKIFQHEWQGFAIQKQMAVDHTRGPWVLILDADERVPPELKKEVTDVLADTDCSGFYVPRKNHFLGKWIRHSGWWPDHTLRLFRKERGHLEPREVHESVTVQGPVGYLRHPLTHYTYWSLTDFIKRMENYSTLAAKEIRKSAGHAGIFSLTVKPCATFLKMYVLRLGILDGKRGLILAILYSYYTFLKYAKTWEKEI

SEQ ID NO: 402 - protein, 353 aa, Bacillus kyonggiensis
MKISLAMIVKNAETTINKCLESVQGIVDEMVIVDTGSTDQTISVIKKYSNVLLYDFNWCDDFSKARNYAIEQTTGDYILVLDSDEYITSGTRVELESVMSQNKIGRILICSDFKKENQIYQAKEYVSRFFPRETRFIGAIHEQLDSNKPRVKLDLMVNHSGYFETNKSKRNIPILLNEVMQNPTDPYYLFQLGKVLRIEKQYERAFQLLRKSYDLVPKNAPYYEELVVEVINCGKECGKEEVLEVIMQNDEILINVSDFHFAKGLYYLDYCLVFSDKAVNYIQKIEDSFLTCLRLNNQTHIEYLQGSSTFLPAYNLGVYYEVTSNVEKALYYYQLSSKYGYCLAEKRLEKLFI

SEQ ID NO: 403 - protein, 275 aa, Segetibacter koreensis
MISVIILTKNEERDLPNCLNSLIWCDDIHVLDSNSTDQTIQIAVTYGAKVVTNPFISFGKQRNFALDNINTKHSWILFLDADEVVSNKFKDAMIYAIENAAEDTAGFYCCWKMMLEGKWLKHSDNFPKWQFRLMRKGRARFTDFGHGQKEKNIIGKMEYIKEPYLHFGFSKGWMNWIDRHNLYSTNEALARINNCPPFKNIFHRHESVRNPALKCWLSKLPMWPFFRFFYTYFIRAGFLEGLPGFIYCVNMGYYEFLIQIKMREIKNGYNFKTNI

SEQ ID NO: 404 - protein, 259 aa, Moritella sp.
  MOD_RES (86)..(86): Any amino acid
  MOD_RES (90)..(90): Any amino acid
  MOD_RES (99)..(100): Any amino acid
  MOD_RES (204)..(204): Any amino acid
  MOD_RES (257)..(257): Any amino acid
MSNKISVCIICKNEEQKIEACLQSVMWADEIVVVDSGSTDETLAIVKKYTDKVFVREDWPGFGEQKRRAEALASNDWIFSIDADEXVPEXLALEIQAAXXNANDEQVFSVNRLTHFCGEFVYHSGWYPDKLPRIYNRSRYRYNQKMVHESLECKDAPIIDLQHNLLHYTFSDLSIYLQKRTGYAEAWAQEKYDKGKKGSMLKGXLSAVFAFIRHYFLRRGFLDGRIGFLIAAIQFQYTFNKYTLLKFKHISDNKKNXTK

SEQ ID NO: 405 - protein, 245 aa, Unknown
  Description of Unknown: Flavobacterium sp. AR-3-4 sequence
MNKLSVIILTYNEEFYIADAIKSVAFADEIIVLDSLSTDATRQIAIDLGCNVITREFTNYSSQRNYAIDYVTGDWILFLDADERVTDDLRIEILKSIQTDKFAAYKIWFPHFFMGRFLFHYTDKVIRLVKNNNFIFENEVHEKMIVNGKIGVLKNYMIHLTYKGLFHFIDKKDRYAWFQSKMAYDKGKKATLFLLLFKPFYRFFHTYFVKRVFLDGVPGLAAASIDAYGVFSRYAKLLLLEKKLK

SEQ ID NO: 406 - protein, 253 aa, Bordetella sp.
MKLSVIIITKNEAAHIVACLDSVSFADEFIVVDSGSTDNTVELARDMGATVEQTADWPGFGPQKNRALALAQGEWVLSIDADERVTPELAAEIQRVIQTDAKDAYEIPRLSEFCGRFIRHSGWWPDPVLRLFRRGTGRFTDAAVHEKVVPVQTWRAGRLDAHFIHYSYPDLDALIAKSNRYSSDAAAMMYARGKRASIFSALGHGLWTFIRIYLIRRGFLDGRQGVVLAVTAAAGSFARYAKLMFLGDQDKRP

SEQ ID NO: 407 - protein, 303 aa, Unknown
  Description of Unknown: Candidatus Woesebacteria bacterium GW2011_GWF1_31_35 sequence
MAKISVVVNTYNEEKRLSRALSSLKGFANEIVVVDMMSTDQTREIAKKFKARVFKHKKIGYVEPARNFAIEKAKYEWVFILDADEEIPETLKIYLKNEIKEPQANFYRIPRRNIIFGKWMKHTGWWPDLNIRFFKKGTVSWNEIIHSVPVTSGKGMDIDCSEELAIKHKTYSSLEEYITRMNRYTTIQARELNKKGVEFSWKDLIIKPTAEFLRRYFAEEGFKDGLHGLNLSLLQAFSEIVLYSKLWQKQDFKKKKLDITEVHEIFEKSYKDFSWWIINSKILESTNFFKKLWLKITKSLKYR

SEQ ID NO: 408 - protein, 252 aa, Helicobacter sp.
MIQISAVILTKNSEHYLQKVLESLQELDEVVVLDNGSEDSTLSIATQFQNVNIHQHPFIGFGKMKQLGASLAKNDWILSIDSDEIASNALIAELRHTHLEPHIAYSYEVKNFYQGQWVRCCGWDKDRCVGIYHRKYARFDDSEVHEKIISLQGKLQTKPLQGFIEHYPFENATEFLVKIKRYGELFAKQHIHHKYSSPIKAVTRSVWCFFKNYFLQRGFLHGYVGFVISSYNAQSVFWKYIILYELQQKTKS

SEQ ID NO: 409 - protein, 249 aa, Arcobacter sp.
MNISVVVLAKNNEKTIDKTLKSLVGFDDVVVYDNGSTDKTMQIAKSFSNVNLVQGEFKGFGWTKNQASSFAKNDWILVIDSDEVVDSELLGELKNKVLDEKIVYKLNFKAFYKDIQVKYCGWNNQKIKRLYNKTITSYNSNDVHEDIIIDGLKIEELKGNVEHYSYHTISEFIIKADRYSTLFAQNNMGKKSSSPTKAFFNGMYSFIRTYIFKQGFRDGYVGLIISYSHMVTNFYKYIKLYELNKENKR

SEQ ID NO: 410 - protein, 260 aa, Psychroflexus halocasei
MSQIKPKITGLIITLNEERNIKSVIENLHFVDEIIVLDSFSTDKTIEIIKTFPNVKLYQNKFKNFTDQRNLALSYAENEWILFLDADERITQKLKDEILNEIQKPQTADAYFFKRKFKFKNKNLNFSGWQTDKNVRLFKKSKAIYTKERLVHEILSVNGSTKTLKNKLIHYSYLDYQSYKAKMISYAHLKAQELHQKGVKPNFYHFIIKPAYRFFHSYFIRLGILDGKKGIIICYLNALSVYHRYPELKRLNALPEKSTA

SEQ ID NO: 411 - protein, 254 aa, Unknown
  Description of Unknown: bacterium (Candidatus Ratteibacteria) CG_4_9_14_3_um_filter_41 _21 sequence
MEKLSVAIITKNEEKSIGRCLESLKWVDEIVVLDGYSTDRTVKICKNYTNKIYQKQFESFPVERDFVLKKTSHRWVLSVDADMYFLPEICEEIKTVLKSDIKYDAFLMRGLTVFLGKEIRHCGWFDLRYLRLFNKEKGNYDLNLKCIDPFIIKGEIGYLKNHFIHYGGDSFSEYFGKIKRYSYLTALEYKTKGLRIQPYNCLFYLFLKPLLVFIYKYIVKRGFLDGIVGFLVCVNSAITYFASYSTFWDIQRKE

SEQ ID NO: 412 - protein, 311 aa, Halomicronema hongdechloris
MFSIFILTYNEEIDIAACIESALLSDDVIVVDSCSCDRTLAIAGQYPVRIVQHPFESHGQQRTWMLEQIACKYPWAYILEADERMTPALFQECLTAIQHPERVGYYVAERVMFMGTWIRRSTQFPRYQLRLLKRGHVWFDDYGHTEREVCRGATGFLQETYPHYTCSKGLSRWIEKHNRYSTDEARETLKQLGQGQIHWQQLVWGRSEVERRRALKDLSLRLPGRPLLRWLYMMFILGGWRDGRAGLAWCTLQAFYEYLIVLKVWELRHPDQMIGMPQSTATTSGPEAASAAAKPVHDATQLSSPSLSGRS

SEQ ID NO: 413 - protein, 247 aa, Sebaldella termitidis
MKLSVGLITFNEEKNIARTLDSVLEIANEIVIVDSGSTDKTLEIARKYNAAIFSEEWKGYGRQKNSVIAKCNGEWILLIDADEEISKELKNKIKIVINDEKSGSVYKPNFTAVCFGKKIRYGGWSNHYRVRLFKKGIGKYNDREVHEKFITNEKPEILQEEIFHHTYEDLEDYFVKFNRYTTESAIQYKKQNKKKNFILFYLDSIFKFFKMYILKAGFLDGYEGYLLAKLASFYVFAKYAKLKEKNK

SEQ ID NO: 414 - protein, 246 aa, Unknown
  Description of Unknown: Ignavibacteriales bacterium CG_4_9_14_3_um_filter_34_10 sequence
MSEKLSVAIITKNEEANIEKLLNSILWVDEIVICDTGSTDRTIEICKKYNCKIFSINWEGFGKAKQSAVDKTSYNWVLSLDADEYVTEELKDEIIAVLSNPKFNCYYIKRSSFYLGKEIKHCGWNNDFPKRLFDKRKAKYNDDILHESLIVDEERGRINSRLLHYPYQSISQHIKKMNYYSDLAAQKLSDKGKKYSVLSSVFLGFAKFLNMYFIKFGFMDGKEGLLLCLNSAIGVYLKYIKTCKAN

SEQ ID NO: 415 - protein, 259 aa, Acetohalobium arabaticum
MASLGALVLTYNEEENITDCLDSIDWVEEIVVVDSYSEDDTVELAQQYTSKVYQREFDDFASQRNFGLEKLESEWVLVVDADERVTEELKEEVLDKLSNPQVEGYRVPRRNYFLGKWIKHCGWYPDYTLRLFKTAENSYSGLVHEGIELDGKVVELENDLIHYTYRNLDHYLDKMNHYTTLDAEKKYQAGVKKSLAYMLLRPVLEFIKKFFLKKGFLLGRQGLILSIFSFYYQFQKYVKLWEKYEVEPGSDSNEEDTIS

SEQ ID NO: 416 - protein, 259 aa, Beggiatoa alba
MLSVIVITKNAALHIDRCLTSVSWVDEIIIVDSGSTDDTLTRCARYTDKIFIHTDWQGFGVQKNRALQYAQSDWVLSLDADEVVTPDLQKAIKTVMQDSRYEAWQIPRLSRYCGRWMRHGGWYPDYVTRLFRRGSAHFSADLVHEKLLVTQGHIGQLTTPLLHYSFENLEEVLQKVNAYSSASAQMQFARGKQGGLSKAILHGLWAFIRTYIIRLGFLDGREGFMLAVSNAEGTYYRYLKLFYCQHHASNTAQPHRHDL

SEQ ID NO: 417 - protein, 257 aa, Thalassobacillus devorans
MGVDLTVIVLTKNEENNLNDLLDNIKSLAAKKVIVDSGSTDNTLSIAQRYNCKVLHRDLKSFADQRNYALDNSKTDWVLFLDADERLTDELLTNIPELIELGIKENISSFSFRRKTIAFGKELKRAWSDYQPRLINRNNCRYDTKILVHEDLLVTGKRKNVNSGYIRHFTYQNFEQYLTKMNLYVKMEARNIGQNDISLTKLIVEPLLVFFDRLIIKAWIMDGVSGFHASFTSFIVRFLSLSLARSLKLNGNIYSKE

SEQ ID NO: 418 - protein, 245 aa, Unknown
  Description of Unknown: Flavobacterium cyanobacteriorum sequence
MAKLSVIIPTHNEESYIEDAIRSVAFADEIIVIDSYSNDSTRQRALNMGCRVLERKFDNFSAQKNFALAEAKGDWILFIDADERVTQLLKQEITDVLKKPSYNGYTLAFPHFYMNRFLYHKVDRVVRLVKNKNIAFTGDVHEKLNFEGKAGTLENFMIHYTYKGLFHLLSKKDSYAWFQASMSVKKGKKVTYLHLIFKPLYRFFHTYIIKKGFLDGVPGLALASMNAYGVLSRYVKMMLIQKGLK

SEQ ID NO: 419 - protein, 254 aa, Desulfovibrio aminophilus
MKPTVTGLILTFNGQRLLRECLKSLDFCDEILVVDSLSTDQTRELAKQAGARVLTRKWEGPGPQFQFALGQIATDWVVSLDQDEYLTDELRDNIRRALAEAPADLAGWYVPRRSFYFDRFLKHSGWYPDHLLRVFRAGRMKVTVTGAHYHFNPQGPTAKLSGDIVHYPYANFREHMAKMNSYAQQAADEMRAKGRKGGVARAVAHAAIRFLKLYVLKLGFLDGRAGFINACAGAYYAFQKYIRVEEKGDWGPKP

SEQ ID NO: 420 - protein, 250 aa, Unknown
  Description of Unknown: Candidatus Desantisbacteria bacterium CG_4_8_14_3_um_filter_40 _12 sequence
MNISVIIITHNEEKNILACLSSVKWADEIVVVDAFSTDNTKKLAEEFGAKVFQVKWQGYGKQKNYALSLANGDWILSLDADERVTPELAEEIQTVMPHSQMDGYQISRKAYFLGKWIRHSGWYPDYCLRLFRKDKARFVEKPVHEFVELDGKMDQLKGVLLHYTDTCLEHYLHKLCCYTTLAADELAAKNKKASLGDIIIRPSFIFVKMYVLKKGWMDGMHGFILAVLSSFYVFVKYAKLWEKDNSSYFS

SEQ ID NO: 421 - protein, 369 aa, Unknown
  Description of Unknown: Candidatus Shapirobacteria bacterium sequence
MYQRMFVCLNKPSVSFSRTYSRRGDVGYENSRNLSFQHGNTKQSCIINRISNWRYCASNCHKYNHVRKSTSHIRINNGRLLAMTSIFFVFYFLIIYNQPSMTHSLSVAIATYNEQKNIKAFLNHLKWVKEIIIVDGSSTDKTRQIARKYKNVKVIKTTNKPIFHINKQKAIDRCQGDWILQLDADERIPLKLKKEIQFILKRPIDKVPYDAFWIKRKNYFLGTFLTKGGQYPDPVIRLFKKGQAWLPCKSVHEQIEVKGAISSLKHNMLHYADTSFSRYLERNNRYTTLIAQQMLDDNIKLNFYLALKYLIFKPCHWFLLTSFRHKGLVDGFPGFVFSLFSTLRFPIAFIKFWELKKTNRSIDLKKDWN

SEQ ID NO: 422 - protein, 255 aa, Neisseria sp.
MPAISVLILAKNEENNIQDCIESCNFAQEVVVIDDFSTDKTVEIAEKCGAKVIQRAMNGDWGGQQTFAIEQAESEWIFFIDADERCTQELGQEIIQTVARGEEFGFWVKRINHFQRKIVKHGPLSPDWVCRLMPRQGSRVEGFVHPKIIHQFADRKLNAPMLHFTYETWEQYLRKMNQYSTLSAEKYKKEGREYHFLIDIVLRPLFAFVKMYILKRGFLDGVLGYILAKNYANYTMNKYVKLKYLNTSAPKNRNF

SEQ ID NO: 423 - protein, 249 aa, Unknown
  Description of Unknown: Candidatus Gottesmanbacteria bacterium GW2011_GWA1_43_11 sequence
MKLSAIILTKNETATIGDCLASLKDLQCDEILVIDDESTDQTVQIARAKKAQVYTHKKDNFAEARNFAATKAKGDWLLYIDADERLSAVLVTEIKKTLEKKTNYVAYSLLRVNYYLGKRWPKTEQLVRLLQKDKLIKWQGSVHETAEVNGEISALHEPLIHLTHRSLSEMVTNTIEWSQIEAELRFKAHHPPVTWWRIPRVMLPVFFDYYITQGGWQVGTVGLIESIYQAFSIFISYARLWEMQQKQTK

SEQ ID NO: 424 - protein, 295 aa, Achromobacter xylosoxidans
MQKIPVSVVVMTKNEERNIAKCLKALVEFDEVFVVDSNSTDATCSIATAMGARVSNFQWDGKYPKKKQWCLEQLPFTHPVVLYVDADEEMTPGLAAEIREVLPRFAAGAGGAFVPFDYVFCGKKLEHGHRVYKLALLARDRSRFLDYDDLDVANMWEVEGHYQPQVQGETFALRQRMVHNDHDSLYHYFDKHNRYSDWEANLRTKGLMNDPREANVGGRALLKRIFQAMPFKAPISFLHSYVFKLGFLDGKAGYDYAVARAMYYWQIRIKTEEILKARQASEAASRRDAVAGAAK

SEQ ID NO: 425 - protein, 250 aa, Unknown
  Description of Unknown: Chryseobacterium sp. sequence
MQEAKEKVSGLIITFNEEKNIREVLGCFDFCDEIIVVDSFSTDKTVEIAGEFPNAKIIQNRFEDFTKQRNLALSYAKNDWVLFLDGDERTTPELEKEIIDTVGDSEAKDAYFFYRTFFVGKKKINFSGTQNDKNFRLFRKSKASYSENKKVHETLVVNGSIGILRNRLLHYSFENYEHFEKKMISYGKLKGEELRLQGKKYSAIVQWSKVIFKFFKTYFLKLGILDGINGLRISYLQSLYVYETYRTLKN

SEQ ID NO: 426 - protein, 289 aa, Unknown
  Description of Unknown: Thiotrichaceae bacterium sequence
MREVMSNENRPTLAAVAISQNEEVDVKGFLDNLLPWVDEIVIVDDASTDATIDIIKAAGDKVKLVKRKMDKDSGFSGQRNAGIDAAESDWLLHMDIDERVTPELAKELLIAICDNSINGLRYKRLNFFLHHPMRGGGWQYWNNPQIGRKGFHRFQNKIHEQCVVDGRDAKTGQLNAFMWHLNDEDYVERVGKNVRYMQMSGQEILDKGIVVKWYHLLFYPLYRALRSYFYDGGFREGTRGLLFCLYTFSSSFNWWAYAWEKQNHIKREGLEKELMKIWQQSDAANKSDK

SEQ ID NO: 427 - protein, 255 aa, Unknown
  Description of Unknown: Chryseobacterium hispalense sequence
MAEQVMMNVSGLIITYNEEKNIQEVLECFDFCDEIILVDSFSTDKTVEIAKKFSKVKVIQNTFEDFTKQRNIALDAAKNDWVLFLDGDERITAALREEIIEELKKTVQKDAYYFYRKFFFAGKPIYYSGTQTDKNFRLFRKSKARYISGKKVHETLHVNGTIGELKNKLLHFSVNDYESYKTKMLHYGVLKGQELAAKGKKYNLAAQYSKTAFKFFKAYILRLGILDGKEGYQLSYLQSLSVFETYESLKRSKTD

SEQ ID NO: 428 - protein, 270 aa, Larkinella arboricola
MSVSPVSSSPPVSAVMITFNSARILPAVLGALTWCDEIVVVDSGSTDQTLAIAQHFGCRVLHRDFNGFGQQKGFAVDQARNHWVLVVDADEVVTDALRSEIQLRLAEAEAGTLSFRGFEVPISLVFLGRLMRYGGEYKMPHLRLFDKRFGNYNSARVHEDVVLQGSVGKLTHHMLHDSYGSLHEYFEKFNRYTTAGAHDLQSRGRHGSIAQIVFRLPITFLKEYLLKQNFLNGYPGFIWSLFSAMYPVVKYAKLRELENSGQAHPVSRVS

SEQ ID NO: 429 - protein, 261 aa, Unknown
  Description of Unknown: Flavobacterium sp. sequence
MILTEKKLLSALLITYNEESNIREVLHNLAFADEIIVVDSFSTDQTTEIAKEFKNVKITQRVFDNFASQRNFALNLATYPWILFIDADERLTPELQKEINKVINQEKSASAYFMHREFMFENKRLKYSGWQTDKIIRLFKKEKATYNPEKIVHEKLIVQGKTKKLKNKLIHHSYSSYDDYKQKMIFYGQLKAMEELSKQTNPGFFHFYIRPLYQFLNQYLIRFGFLDGKKGIIICYLNALSVAVRFKELKKIRNKLKISKI

SEQ ID NO: 430 - protein, 251 aa, Pelosinus propionicus
MDKKIAVLILTFNEENNIRECIESVAFADEVIIIDSGSTDKTCEIAETLGAKFLYHAMDEGFAGQRNFALKQTLAEWVLFLDADERITPELAMEIEEIVQRNEQFAYDILRSNVVFGERVSYGGHSPDYSLRLYPRNAIQWQGVVHEQAQVSLPILKTKNGMLHYTYTSWDRYFFKFNQYTTLMAQQMEAKGKKAHFIDIILHPLAGFFRFYITKSGWRDGKIGFILAGFHGFYTMAKYVKLYYLQKERKE

SEQ ID NO: 431 - protein, 263 aa, Enterobacter aerogenes
MFKLSVCLLTCNSARLLREVLPPLLRVADEFIVVDSGSTDETLQICQQFGLTVHHHPYAAHGMQMNYATSLATHDWVLCMDSDEILDDEVVAAILALKAGEEPDPSCAWRLPRYWFVLGEQVRTIYPISSPDYPVRLFNRQRASFNQRPVDDQVVGHLTSTRLPGFVRHDTFYSLHEVFNKLNSYTTRLVKMQKVRPSLSRGIISAIGAFFKWYLFSGAWRSGKVGAVTGLYATLYSFMKYFKAWYAYNGKQQGTVTEKRTDP

SEQ ID NO: 432 - protein, 290 aa, Unknown
  Description of Unknown: Candidatus Omnitrophica bacterium sequence
MFDGYSAGNSGRSVSGTAGNREIGGLTPSNRRGAEVDKPPVSVVVITKNEEENIAECLKSAGWADEIIVVDDESADATREIAAGYTDKVFIRKMANEGRHRNWAYAQASNDWVLSLDADERITKGLADEITDLLKGAPENKVYTIPRRNYIGDHWLRYGGEYPAPQTKFFLKNEFRYEEVEVHPRAFSDGSCGHLKGDIVHYSHKDIADYLHSLNSQTTLEARKWYRTGRRMSLGHAVWRALDRCFYRRLLRKKAYKDGIYGLAVAVFSGLYQIVSYLKYREMFRQDKGS

SEQ ID NO: 433 - protein, 245 aa, Unknown
  Description of Unknown: uncultured bacterium sequence
MISVIIITKNEEEVIEECILSVKAVADEIIVVDDSTDKTPGIAKNLGAKVIKNPFKNFSDQRNRALENVKNEWIFYIDSDERATPEFLKELKEKIKNDNGASAFFVRRKIFYFGKNWGLTDKVERVFKRDKLVNWEGVVHETPKFIGEIGIIEEPILHYTHRNLSQMLGKTNDWSVYEAKLRFNANHPRMNGWRFVRVIATGFFKSYLKEKGYKNGTAGLVEGMYQAFSMFITYSKLWEMQKKSS

SEQ ID NO: 434 - protein, 299 aa, Unknown
  Description of Unknown: Bacteroidetes bacterium 38_7 sequence
MKDISVIILTYNEEMHIERCIENVQSFAREIFVVDSFSSDDTINIAQKLNARVYQNKWENNYAKQFNWALENLPIQTTWVLRLDADEYLYPELIKEINTKLDTLPKDVSGVVFKRRHIFMGKWMKRGTYPVKLLRLFRYKKAICEQRWMDEHILLLEGRAVEFEHDFADHNINNLSWWTQKHNGYAIREAIDLIDIELGLQITQQEAGKLSEQASTKRNRKRNYAKQPLFWRSFAYFIYRYIFKGGFLEGKEGFLWHFLQGWWYRTLVDAKILEIKKACGTDKKKIKAYLKKEHNIELE

SEQ ID NO: 435 - protein, 251 aa, Bacteroides salyersiae
MKISVVINTYNASKHLKQVLEAVKNFDEIVVCDMESTDDTIDIAKIFNCKIVTFKKGNCNIVEPARDFAIQQASHPWILVVDADEIVPDQLREYLYKQISNPNCPAGIYIPRKNYFMGRFMHCHYPDHVLRFFKKEGTVWPPIIHITPTVQGKLYSIPSKQKNLAFIHLANDSVADIVKKTNEYTENEIEKKKNKKYGIGAFFYRPFFRFFKTYILKGGILDGKEGFIKACLEGYYQFIMLSKIVEYRKSK

SEQ ID NO: 436 - protein, 251 aa, Serratia sp.
MDFCNRISVCLLTFNSSRLLRDVLQPVAAFADEIIVVDSGSTDGTLAICDDFNIKPLYHPFETHGRQMNYAISRARHDWVLCLDSDEIMDDEAVDAMRLFKRTPGPDKNNAYRIRRDWFVLGQAVRTLYPVSSPDFPIRFFHRQVVKFNDAPVDDAAEGGASTLILAGHVKHDTFFSIEEVFAKLNSYTARVVKYKAIRPSILRGVISAIGAFFKWYIFSGAWKAGRVGAVTGVYAVSYSFLKYFKAWYHR

SEQ ID NO: 437 - protein, 250 aa, Sulfuricurvum sp.
MNVSAVMIVKNGARTIRRSLESLREFDDVVVYDNGSSDGTQNIANEFPNVRLIEGEFDGFGTTKNRAASYAEHEWILIIDSDEVVDAELLHALKTKLLDPRTIYIVNFLAYYKEIQIRHCGWNNQKIRRLYNKSVTRFNDNAVHENIIDEGMNKAPIEGNMKHYSYMSVSDFIVKVDRYSTLFAADNAGKKFPTPSKAFFNGLYSFFRTYVLKRGFLDGYAGLIIAFSHMATNFYKYIKLYEVNREQRRG

SEQ ID NO: 438 - protein, 255 aa, Unknown
  Description of Unknown: Chryseobacterium koreense CCUG 49689 sequence
MLGLKEKVSGAIITFNEEKNIQEVLGCFDFCDEIIVVDSFSTDKTVELALQNPKVKVIQNKFEDFTKQRNLAIDAANNDWILFLDGDERITPELRDEIISELGQSDKKDAYYFYRKFFFAGKPIHYSGTQTDKNFRLFRKSKCRYVGDKKVHETLEVHGNVGVLKHKLLHYSVSSYDSYRKKMLHYGELKGKELYDKGKKFSRLTQILKTAFKFLKTYILRLGILDGKEGFQLAFLQTLSVFETYNSLKKAEKKQ

SEQ ID NO: 439 - protein, 258 aa, Unknown
  Description of Unknown: Nitrospirae bacterium sequence
MSKVSAYVIAYNNETTIRACLESVRWADELIVVDSHSTDATEKISREFTDKVYQHEFHGFGRLRNEAVAHASHEWVFSLDTDEVATPEIRDEIRRLLDRGPEADAYFVPRKNYFLGRWIRHCGWYPDYRQPQLFRKDRMKYCDQLVHETFELHGTVGHLKEHVLQYPFQDIDQYLAKMDRYSDLMARRMVEQGRRFRTHQLVSHPVFTFLKMYLGRLGFLDGRPGLILSGLYAYYTFIKYAKLWELQRGPAAVGEGLR

SEQ ID NO: 440 - protein, 319 aa, Alkalinema sp.
MTHAKTPSNSSKIPVSVLIPARNEEANLPACLQSVARADEVFVVDSQSSDRSVEIAESYGAQVVQFQFNGRYPKKKNWSLENLPFRNHWVLIVDCDERITPELWEEIAEAIQNPAFQGYYLNRKVFFLGKWIRYGGKYPDWNLRLFQHAQGRYENLGTEGMRNTGDNEVHEHVVLQGEVGYLKNDMLHIDFRDIYHWLERHNRYSNWEAQVYYNLRNGKDHAGTIGANLFGGAVQRKRFLKKIWVRLPFRPLLRFILFYILRLGFLDGKAGYTYARLLSQYEYQISVKLFELEQLGGVLNQTDTLTDQMTLSPVPQPEA

SEQ ID NO: 441 - protein, 270 aa, Unknown
  Description of Unknown: Flavobacterium rivuli WB 3.3-2 = DSM 21788 sequence
MISVIILTKNEEQDLPMCLDALHWTDDIHILDSGSEDTTLDIAAKYNAKISYNAFKSFGDQRNFALDNIDAKYDWILFLDADEVATPPFVAAISKAIETAPQEVAGFYCCWKMMLEDTWLKRSDSFPKWQFRMLRKGRARFTDFGHGQKEGEIDGVLEYIKEPYLHYSFSKGWTQWIARHNKYSSDEAVARFNDAPPFKNIFSSNTSVRNPALKSWLTKTPGWPLLRFTYAYFIKLGFLEGTPGFIISANMAYYEFLIQIKIRELKRKKI

SEQ ID NO: 442 - protein, 253 aa, Nicoletella semolina
MPTLSVAMIVKNEAQDLAACLDTVADWVDEIIILDSGSTDETKQIALSYGVKFFENTDWQGFGKQRQFAQQYVTSDYVLWLDADERVTPELKDAIQQAVRRDEKNAVYQLPRLSEVFGRQIRHSGWYPDYVTRLYRTDFAQYGDELVHEKVHYPKHANVVKLKGDLLHYTYKDLHHYLVKSASYAKAWAIQRANKGKKGSLLQGITHAIACFVKMYFLKAGFLDGKQGLLLAILSSHSTFIKYADLWNRTRNE

SEQ ID NO: 443 - protein, 248 aa, Unknown
  Description of Unknown: Chryseobacterium sp. Leaf201 sequence
MNISGLIITYNEEKNIQQVLECFGLCDEIIVIDSFSTDKTVEIAKTFPNVKVVQNKFEDFTKQRNLALDEAKNDWVLFLDADERITPPLKQEIIDEFKKPEQKDAYYFYRKFYFAQKPIHYSGTQTDKNFRLFRKSKARYTPDKKVHETLNVKGSVGELTNKLLHYSVSDYESYKQKMIHYGVLKGQELSLKGKKFNIFVQYSKTAFKFFKAYILRLGILDGKEGCQLSYLQSLSVFETYESLKKEQN

SEQ ID NO: 444 - protein, 246 aa, Tenacibaculum sp.
MIKLTVIIPTLNEESNVQRALDSAFFADEIIVIDSFSSDTTVDIVSQSDAILFQRKFDDFSSQKNYALRKASNEWIFLLDADEEITEELRDSIIFNLKSNALHSGFLLKRDTFMNERKLHFGGFRNNIVRLFKKEGSFYEGLVHEQIQIDGSIGKLKGNLNHYTFTNFKQFKRKIDHYAQLRASELYSKQKKVTLYHEWIKPFARFVIHYIIKLGCLDGKRGFQFSYLISYGVWKRFQLLKKLNNT

SEQ ID NO: 445 - protein, 254 aa, Unknown
  Description of Unknown: candidate division Zixibacteria bacterium sequence
MKISAVIITKNEEKNIIRCLESLKWVDEIVVVDSESTDKTVEIAKRYNAKIVSPIWEGYGKAKNSGVDAACGEWILSVDADEELSEKLKVEIKEIIDNSDACGGYYLKRKTKFMGQWILHCGWYPDYILRLFKKSKGRFDDKVIHERVLVQGATGKTNGELLHYSYDNLEQYFEKFNRYTTISAKEEFSKGTKVGIVKLFVKPVAAFVKHYIIKLGFLDGTAGFVLSVLSAKAVFVKYSKLMELIEKEKYGNKN

SEQ ID NO: 446 - protein, 286 aa, Pedobacter oryzae
MPDFSFIILTFNEELHIPRLLESIKSLGAPTFVLDSGSTDSTLQICRNYGVSVETNPFENHPRQWDKALKTFPVQTPWIIGLDADHIVSPELLQQLSQFRDADFTDVSGIYFNRKNFFKGKWIRHGGYYPRYLLKMFRFGTGYSDLNENMDHRFIVSGKSIIWKQGHLIEENLKENRISFWISKHNHYSDLLANEEIERMNKLRFQTIKPNFWGSPDERIASLKNLWWKLPLFLRPFLYFTYRMIFQLGILDGRTGILFHFLQGFWFRIIVDVKISEILKEKKNEQ

SEQ ID NO: 447 - protein, 250 aa, Unknown
  Description of Unknown: Uliginosibacterium sp. TH139 sequence
MSARLPLSAVLITRDCVGPLRATLESLAFCAEIIAVDSGSTDGTIELLESFGARVIREEWRGFGPQKQFAIEQAAHDWVLCIDSDEIVSEALRVSIERALVQPAYQCYEFPRCNRFLGRYLKHGEGYPDLSLRLFDRRHARWSDDIVHERVITLGGVGLLRGDLLHHSEDTIESYLAKQNRYTTLAAKALVEEGRQVSAGKLLLSPLFRFIKFYVMRAGFLDGLPGLIHILIGCFNSFAKYAKMIEFSRR

SEQ ID NO: 448 - protein, 218 aa, Unknown
  Description of Unknown: Flavobacterium sp. sequence
MSIAFSFIVLTFNEEQHLPRLLHSIAGLGAPLFVLDSGSTDQTLKIASDFGAVVKHNTFENHPKQWDFALKNFEVETPWIIGLDADQIVTPELFDQLSKFKDEDYQGINGIYFNRKNFFRGKWIKYGGYYPKYLLKMFRKEIGFSDINENMDHRFVVTGNTAIWKKGHLLEENLKENEISFWIAKHNRYSDLVAEEEVERMYELRMQTVKPDFFGDPY

SEQ ID NO: 449 - protein, 285 aa, Unknown
  Description of Unknown: Acidobacteria bacterium sequence
MNQVTNLSIIVLTLNEEENIAQCLGSVADISDDIFVVDSGSTDRTLELARRWTSNIVIHDFHGYSAQRNWALRNLPFRYEWVLFLDADEFVSPELKNELHSTLGGRTTVAGFYLPRKLIFQEKWIRFGGYYPTWILRLVKHRQATCEDRKVNEHLIVTGATGKLRGDLIHNDKKGITAWISRHNAYATLEALELIESMERSPSNRNAVQPSFWSTQVERRRWLRERVWNRFPPLVRPCLYFIYRYFVLGGLLDGRAGFTYHFMQALWFPLLIDVKFLEMRRSGRR

SEQ ID NO: 450 - protein, 256 aa, Prevotella bivia
MAQDNKISVVINTYNAEKHLQEVLDSVKDFDEIVICDMESKDNTLAIAREYGCKIVTFEKKNYTIVEPARNFAVQSATHSWVLVTDADELVTPELRQYLYQYIATPNCPEGLFIPRRNRDMNVLDMGRLRDFQLRFFRRDKVYWPPLIHSIPEIEGKTTKLVDNDKAVFNHLDENYLHDRMEKLNRYSDEELDKRANKQYGLGALIWRPTWRFFKAYVMDQQYKKGLPGLISSYLSGFYQFLIVAKTIEKQKYKTK

SEQ ID NO: 451 - protein, 251 aa, Aliiglaciecola lipolytica
MIVCNEADRIDASLAPLAGWVDQLIVLDSGSTDGTVELAKKYTDSVHQTDWPGFGAQRNRALTYCEHEWVLNIDADEVITEELKNEIDAVLSEPDLEATFIKFPWHTFLFGKTLKHGRYASPQGKLFIKTGANFKHRSVHETLEMPVQNIRILKSPLLHYSWRDYYHVQEKHLKYAVLGAGDKAKKNKKSSLSFAVLRFFVDFLQQYILRLGFLDGKRGFLMAIILGQYAFHKYAALWALQQESSQTEPKR

SEQ ID NO: 452 - protein, 256 aa, Raineya orbicola
MKLSVVIITFNEEQNIQRCLESVQAVADEIVVVDSFSTDKTAEICQKYQVQFIQQAFLGYVEQKNFANAQASYDWILSLDADEALSERLKNEILQLKKQENPNADAFSMPRLTNYLGKWIRHTDWYPDRRIRLFNKTKAHWTGINPHDCIQMQNANSLVSKLKGDILHYSYYSIHQHIAQLNHFTSIMAETLVKSGKKAPLYKLFINPIWKFLYSYVLRLGFLDGYYGFVVCAVSAFATFTKYLKIRELSKKSKKN

SEQ ID NO: 453 - protein, 252 aa, Unknown
  Description of Unknown: Crocinitomicaceae bacterium TMED16 sequence
MPNLSVVIITFNEEKNIARCLASIETIADDIVVVDSFSTDRTEQICLQFKVRFIQHRFEGHIQQKNWALQQAKYPHVLSLDADEALDEKLKSQVNSIKENWTADGYTMNRLTNYCGQWIKHCGWYPDKKLRLWDTRLGDWGGTNPHDKVIMQKGTRITHLNHDILHYSFYTIDQHLKQIDFFTDISAKAAFDAGERSSSFKIIYKSAFKFFRDYILKLGFLDGYYGFIVCKNSAFAKRMKYRKLQELNKSGA

SEQ ID NO: 454 - protein, 248 aa, Sulfurospirillum sp.
MVNKISVVILTKNSQKYIYECLKSLVKFDEVVILDNGSTDNTLEIANEFSNVKIHLHEFIGFGPLKNLAISYTKYDWILSIDSDEIFSESLVDEILSKPLIPTCVYAIQRDNYYKNKLIKCCGWQNDYVYRLFNKNITSFNNKPVHESVILENMKTEKLKNRFKHYSFGNPSELLQKMDKYSSLYAQEYSLVKKSSPLKAFIRAFVAFLKNYFFQRGFLCGYEGLLISISNANGVFYKYIKLYEENKK

SEQ ID NO: 455 - protein, 303 aa, Unknown
  Description of Unknown: Candidatus Gottesmanbacteria bacterium GW2011_GWC2_39_8 sequence
MKISAVINTYNEEKNLERALRSLVWAEEIIVVDMESTDKTLEIAAKFNAKVYSHPYVGYVEPARNLGLEKANGDWIFILDADEEATLLLGKKLRQLSENIEGKTYFRLPRKNILFDKWIQHTGWWPDYQIRFFRKGSVTWGDEIHSIPETRGKGEDIPASEENALIHHNYQTVEQFVTRMNRYTTIEARLLYNQKQPFEWKKLIERSIGEFLGRYFAGEGYKDGVHGLGLSLLQSFYQVLVQLKLWQAYKFEEKQVGLADSEKVITSSLGELKYWIDNKKIEEEKGQLKKNILKLKSRLPLNL

SEQ ID NO: 456 - protein, 256 aa, Unknown
  Description of Unknown: Candidatus Microgenomates bacterium sequence
MEINNKLTAIIITKNEEKMIEDALKSLKFADEILVVDTGSFDKTIYIAKKYKAKIVKYTSGESFSDWRNKGLAEAKGNWVLYVDADERIPNALAGEISNILKTKSEGAFAIPRKNIVLGRELLHGGWYPDYVKRLFSVNVLTQWTGDLHEEPVFSGKLLHLENSMLHIKHETFSEMLIKTNKWSQIEAKLMFDANHPPMNTVRFVSAMWREFWSRMVLRNAYLDGKVGVIFSIYQVFSRFVSYAKLWEMQNESSNI

SEQ ID NO: 457 - protein, 250 aa, Unknown
  Description of Unknown: uncultured bacterium sequence
MKPSLSVILITKNNEKTIEKCLESVKWADEIVVLDSGSTDRTLSLCTKYTTKIIQTDWPGFGPQKNRAIDKATGDWIFSIDSDEWLSDASRDEIIATINNPTATVFQMPRLNQYCGQWIRHGDVGKDKVIRLFKRGAARFNDNLVHEKLQTDIHIGILKNSLLHNSYDSLDALLQRINYYTTLSAQSRFKQNKKTNFAKAIFSAWWAFTKSYFFRAGFLDGKMGFIVSLSSAESSFYRHVKLMELQKHAR

SEQ ID NO: 458 - protein, 257 aa, Unknown
  Description of Unknown: Gammaproteobacteria bacterium sequence
MSQQTKISATIITLNEERCIRECIESLEFADEVIVIDSGSKDKTIDICLELGAKVIQQEWLGFGAQKQLAVDQTQNDWVFCIDADERVSRQLNAEITELKQQAEISPKAFNMSRCNRFLGRWLRHGEGYPDHNLRLFHKQYARWSEHTVHEHVITDEKVGLFKSDLMHESEDGIFDYLQKQNRYTTLQAEALLAKGKKGSIARMLISPVTRFIKFYFIRRGFQDGVPGLIHVLIGCVNSMTKYAKLIELNIKAEKDS

SEQ ID NO: 459 - protein, 261 aa, Legionella fallonii
MLTVIIISKNEEANIGQCLKSVSFADEIIVLDSGSTDNTVAIAKQYTDNVFSTDWPGYGIQKQRALSRAKGDWVLNLDADESVSPELQEEIKEAIASGDADGYRIPIQMIFYNQPLKYSASPKRHIRLFKRANASYSKDIVHEKILLLPNAKVEKLKNGIMHHSYRDVTHVLYKLNKYSSYSAKIRIESGKETGFIRIFIGTGWMFFRCFILQRGFLDGKLGFLFALFSAQGTFYRGIKQLYRDKNIDKLPKLAKESEDIL

SEQ ID NO: 460 - protein, 249 aa, Marinobacter aromaticivorans
MKLSAVLITKNAGPDFAECLKSLAFADEIVVLDSGSTDDTLATAQQFGARIFQSEDWPGFGRQRQRAQSYARGEWLFWVDTDEVVTEELATSVQQVIEGASKNRVFQVVRLSWFFGRFIRHSGWYPDKVVRLYRREEYGYDDALVHEKVHCPGADVGTLKGDLLHYTATDFADYMAKSVRYADDWAEERVRRGKAASLVSACTHSLGAFLKKYFLKFGILDGKHGFLLAVMTAYYVFNKYAALWIKTRR

SEQ ID NO: 461 - protein, 252 aa, Polynucleobacter cosmopolitanus
MSLSVILITKNEEANLKDCLESVSFADEIIVVDSQSSDKTQEIARSFGAKLEITSDWPGFGPQKNRALNLATQDWVLSIDADERVTPELKQEILTAIASPNAADCYAIPRSSWYCGRFMKHSGWYPDYVDRLFKRGSAKFSDHLVHERLLPTGSSGKLNNHFLHYSYRDFSQVLKKVDVYSSAAAQQAFKQGKKGGLGEALIHGFWAFFRTYVLRRGFLDGKHGLALAISNAATSYYKYLKLWQLQNKKDIY

SEQ ID NO: 462 - protein, 236 aa, Chlorobium ferrooxidans
MLAECLGALEMFAEVVIVDNGSTDDTIAVASRFRNVRLFEHPFTGFGPMKNIAIDKAANDWILSVDSDEIVTPELSAEILSLKLDSSRIYAVGRDNHYRRRLICGCGWQNDQVQRLFNRKRTRYDDKLVHEGLRMDETLQTELLEGRLNHYPYDNAAQLIHKMQHYSTLWAEEHRGRKKASPFKALFYGVLTFFKSYLFKKGWLYGYEGLLISISNANGVFYKYIKLYEADRSHSL

SEQ ID NO: 463 - protein, 255 aa, Pedosphaera parvula
MTPVSVVVNTLNEEANLPGCLESLRWADEVVVVDMHSIDRTAEIATAFGCRVFQHERTGYVEPARNFAIAQAKNSWVLVVDADERVSPGLATWIKDHLGSISAVAFRIPRRNFYSDRWITCCGWFPDEQLRLFQRDYVRYSDRIHRAPTVEGSVITLPLHGEAFFAHYGFNTLEARVEKDNKYSSITAQSMFQEGRRIGAFGLLTRTVWAFVTAYLFQGGIRFGTLGVSLAWERAFATFLKYAKLWELQQKHKSS

SEQ ID NO: 464 - protein, 256 aa, Geminocystis sp.
MDLNTITPLILTYNEEPNIDRTLHKLTWAKEVIVIDSFSTDKTIEILKSYSNVKVFFRKFESFAKQCNYGLSLIKNTWVLSLDGDYILSDDLINKLTILNVNSEINGYLIPLSYCIFGKPLKKTILPPRICLYKKNTAHYRDDGHAHKVIIEGKVSYLKSYIYHDDRKSLSRWLWAQDRYMVLEVEKILNTPFYELSLSDRIRKQIILAPFIVFIYCLFLKGGIFDGWGGWYYAFQRMFAEILLSLRLIENKYFNS

SEQ ID NO: 465 - protein, 253 aa, Unknown
  Description of Unknown: Bacteroidetes bacterium sequence
MSKIKLSITIITFNEERNIARCLDSVKDIADEIVVVDSFSSDRTEEICKRYNVRFIRNAFVGHIEQKNFALDQVSFKHVLSLDADEALSPELLRSIEVLKENWNDEAYSISRLTNYCGKWVRHGSWYPDRKVRLFIKGKGKWAGENPHDAYIPDENSIIRKLKGDLLHYSYYSTEGHIAQVNKFTSVGAQSAFKAGQKANSFMLLYKPFYKFIRDYFFKLGFMDGYAGFVIARISAHATFLKYVKLIELQKKK

SEQ ID NO: 466 - protein, 245 aa, Unknown
  Description of Unknown: Flavobacterium kingsejongi sequence
MTKLSVIIPTYNEDSYIEDALKSVAFADQIIVVDSFSTDTTKAKALAAGCTVLERKFDNFSSQKNYAIAAATGDWVLFIDADERVTEKLKFEIQQTINAPKHAGYKIKFPHFYMNRFLYHKVDKVVRLVKNDGIVFQGDVHEKLLVKGSIGQLQNFMIHYTYKGLFHFLQKKDSYAWFQANTAFQKRKKVTFFHLAFKPFYRFFSSYILKRGFLDGVPGLAVAAVNAYGVFSRYAKLLLLQKGLK

SEQ ID NO: 467 - protein, 262 aa, Vibrio sp.
MTQLSQPNRATIAAVIITKNEEDSLKDCLESLTWVDEIVIVDSGSTDKTEAIAVQYTDKFLINADWPGFGKQKQLAQSYTECDWILAVDADERIDETLKSNILDMLENAPDNTVFNLNELTWVFGRFLKHSGWYYRHVRLYPNKLTTYNDNLVHESVVIPDGCKVAELDGDILHYSYKNLNHYLVKSAGYGKAWADQRQAKGKKASLSQGVVHALACFMKMYVLKRGFLDGKQGFLIALLSAHSTFIKYADLWARDNDPHYK

SEQ ID NO: 468 - protein, 297 aa, Bordetella genomosp.
MTRVPVSVIVMTKNEERNIEKCLRALADFDEVFVVDSHSTDRTVELATGLGAHVVQFQWNKRYPKKKQWCLDNLPFTHDVVLYVDADEVMSPELAREINACLPRFAQGAGGAFVGFNYVFCGKQLNYGHRVYKLILLSRTRSRFLDYNDLDVANMWEVEGHYQPQVTGPVFLLKGRMAHHDHDGLYHYFDKHNKYSDWEANLRVKGLLNDPREANVGMRSLMKRIFAAMPFKAVAAFVHCYILRLGFLDGKAGLDYAVARSMYYWQIGIKSRELRAAMATASPAATAEADALRGGTH

SEQ ID NO: 469 - protein, 301 aa, Unknown
  Description of Unknown: cyanobacterium PCC 7702 sequence
MSLSKIPVSVLVPAKNEEANLPDCLASLHSADEIFVVDSQSTDKSVEIALTYGAKVVQFYFNGHWPKKKNWSLENLPFQNEWVLIVDCDERISPQLWEEIAQAIQNPEYNGYYLNRRVFFLGKWIRHGGKYPDWNLRLFKHKKGRYENLKTEDIPNTGDNEVHEHVVLEGKVGYLKNDIIHQDFRDLYHWLERHNRYSNWEARVYLNLLTNQDDGGTIGANLFGDAVQRKRFFKKIWVRLPFKPFLRFVLFYIIQGGFLDGRAGYIYARLLSQYEYQIGVKLYELRQCGGKLNPKSTLSVS

SEQ ID NO: 470 - protein, 247 aa, Arcobacter thereius
MNISVVIIAKNSEKTIEKTLKSLVDFNDVVVYDNGSTDNTIKHSKEFENVNLVEGEFKGFGWTKNKAISYAKNDWILILDSDEVVDSKLLNTLQNKKLEDDTVYLLNFNAYYKEKQVKYCGWSGQKIKRMFNKKVTKINDNMVHEDIIIEGLKLEVLEGNVEHYSYSSISDFLQKTDKYSSIFANDYKNKKKSTPLKAFFRATYFFIKNYIFRRGFLDGYIGLLVCVSGANGVFYKYLKLYEENHDL

SEQ ID NO: 471 - protein, 251 aa, Anaeromusa acidaminophila
MQPRLAILILTYNEEKNIGSCMDSAAFADEIVVVDSGSADQTTAIAAEKGGNVVVHPMTEGFAGQRNFALTQTQAEWVLFLDADERLAPEVAAEVRRIMERGDAFAYEILRKNIVFGQPVFHGGHAPDWSLRFYPRAAIRWEGIVHEAAKVTLPVKRLQACMFHHTYQEWERYFFKFNQYTTLLAKKMRDEGKKVSFFDLLLRPLAGFFKFYILKAGWRDGRMGLVLALLHFFYTMTKYLKVYYNAPEERK

SEQ ID NO: 472 - protein, 245 aa, Unknown
  Description of Unknown: Flavobacterium aciduliphilum sequence
MQTITVIIPTYNEENYIEDCLHAVSFAHQIIIIDSFSADNTLTLAKKFDCQIIQRAFDNFSNQKNEAIKQATGDWILFVDADERVTEKLKHEIFETLKNPKYDAYKLRFPHFYMNRFLYHTENKVVRLVKNDSVYFEGDVHEKLIHKGEAGILKNFMIHYTYKGLFHYIKKKDSYAWFQAKMSKEKNKSARYFHLVFKPFYRFFHTYIIRKGFLDGVPGLAVATIDAYGVFSRYVKMILLDKNLK

SEQ ID NO: 473 - protein, 268 aa, Unknown
  Description of Unknown: Enterobacterales sequence
MFKLSVCLLTCNSARLLRDVLPPLLKIADDFVVLDSGSTDETLDICREYDLHVHYHPYAMHGAQMNHATSLAAHDWVLCMDSDEILDEQTVNFILQLKAGEEPGADQAWRLPRYWYVLGEQTRTIYPVSSPDFPVRLYNRRTARFNNRAVDDQVEGYSASTKIPGHVRHDTFYSLHEVFSKLNSYTTRLVKYQKVRPSIGRGIISAIGAFFKWYLFSGAWRNGKVGAVTGLYATLYSFLKYFKAWYAHNGHNDEKNAVAEEKKNTRTV

SEQ ID NO: 474 - protein, 246 aa, Unknown
  Description of Unknown: candidate division KSB1 bacterium sequence
MRKPSLSVIIITHNEEKNIAACLKSVCWVDEIILVDSNSKDQTVAIAQQFGAKVFQKNFASYGHQKQYALEQATGEWILSLDADERITPELQAEILEKIAQSDEVVGYEIPFKNFVFGKWVKYAGLFPDYHLRLFRRDAGCFTPSTIHEGIEVNGKVQKCQNPILHFSYPTIASYVEKMNRYTEILARQGYSFRFSHLVFSPLSKFFRLYLARQGFRDGLPGLIYCILAAFYNFAKDAKAWEQTRV

SEQ ID NO: 475 - protein, 253 aa, Phorcysia thermohydrogeniphila
MKLSVGILTFNSEKRIGEVLNSIKDVADEIVILDSGSEDRTLEIAERFGARVFYRKFDNFVNQKNHLLSLCRGDWVLFLDDDEIVSEELAAQISKIKKENPPVDGYYVSRLTNYLGRWIKHAWYPDWQLRLAKREKCRWVGDWVHERLLVNGKTGYLKGDLLHYSYPSVSFHLKKIDLYTSLYAEGAFKKGKKFSLLKLLLSPAGAFLRRYLLKRGFLDGFEGFVLSVMASHYTFLKYLKLWELEKNEKARRS

SEQ ID NO: 476 - protein, 253 aa, Formosa sp.
MIKISGVIITFNEERNVEDCILSLNNVVDEIVVVDSFSTDTTKAICEKYDVKFIEQQFLGYIEQKNFALQQASYDYIVSLDGDEALSPELQKSILNLKSTWAFDGYYCNRYNNFCGQWIKHSDWYPNKKLRVFDRRQGQWTGLNPHDHVELHNKSSKTGHLKGDILHKTYQTYSEFNQKTEYFSTIAAQAYYDLGKTAPIWRIIFNPLWAFFKAYVLRLGFLDGFNGLIICYQTGNITFLKYAKLRELYNSKD

SEQ ID NO: 477 - protein, 257 aa, Unknown
  Description of Unknown: Candidatus Levybacteria bacterium GW2011_GWB1_37_8 sequence
MIKISGIVITKNAENLIAGCLDSLSFCSEIVVVDNVSSDRTRDIAEKMGAKVIEYSSDDFADMRNMGMKKAMGEWLLYVDADERVTSALREEIIKSTNNPTNKNVGFRIKRKNFYFGSAKQNEWPYVERLERLFKKDSLKEWYGQLHESPNVKGEIGELDGYLFHYTHRDLSSMVKKTIEWSKIEAELRYKNGHPKMTWWRFPRVMVTAFLDSYIRQGGWKVGTVGLIESMYQSFSIFVTYARLWEMQEKLKMKNEK

SEQ ID NO: 478 - protein, 265 aa, Klebsiella michiganensis
MLKLSVCLLTCNSSRLLREVLPPLLRVADEFIVVDSGSTDATLQICQQFGLSVHHHPYTAHGTQMNYATSLARHDWVLCVDSDEILDDEVVAAILALKAGDEPDPACAWRLPRYWFVLGEEVRTIYPVSSPDFPVRLFNRSVARFNDRPVDDQVVGFTHSARLPGFVRHDTFYSLHEVFSKLNSYTTRLVKHQKIRPSLARGAISAIGAFFKWYLFSGAWRKGKVGVVTGLYATFYSFLKYFKAWYAHQDKPESAADKHTDSRMI

SEQ ID NO: 479 - protein, 256 aa, Unknown
  Description of Unknown: Flavobacterium soli sequence
MELSPNKNISVLIITLNEEAHMYELLSDLDFADEVIVVDSYSTDKTKEICLSFPNVKFLEHKFENYTSQRNFAIDQAKHNWVLFIDADERLTPDLKKEIIQTINSDTDVSAFLFYRKFFFKRKVLHFSGWQTDRIFRLFKKDKSRYTYKRLVHEKLDVEGKIGFLKHKLIHYSYSDYQSYKNKMVTYGRLKAREKFLSGFKPTLVYEYGHPIYNFLYQYLIRLGILDGKKGIIICYLNALSVKVRYQELNKLYNKK

SEQ ID NO: 480 - protein, 250 aa, Unknown
  Description of Unknown: Zetaproteobacteria bacterium sequence
MPVSAVVITLNEQAHIAECLRSLCWADERLVVDSGSTDETCAIARSLGARVIHHPWEGFGAQKQFATEQARFDWVLNVDADERVSPALARSIGEAMQSPTQPAAYRCNFRHRMLGCWLRHGEAWPDPHVRFYDRRRAHWVPRAIHEYVLVDGPIGRLDGCIEHCTAESIAELFAKINRYTDVQARLLVEQRRRIGLLQILGNPAWRFLRNYLLRLGVLDGVPGLVHATQAALTSFLKYAKAYEMARRERS

SEQ ID NO: 481 - protein, 254 aa, Nonlabens sp.
MLKYKISAIVPCFNEAHNIVEVLKTVEFCDEVILVDSNSTDNTVELAQPYIDKLLVREYIHSASQKNWAIPQAKNEWILLVDSDERVTPALKEEIITLFENIDNQPHVGYWIGRLNFFMGKQVRYSGWRNDKVIRFFKKSKCRYADKHVHSEIVADGTVGFLKNKLTHYKYVGMDAHIKKLQRYASHQAKDYDEKTGKITGFHIIIKPLWSFTKHYFIQLGFLDGFVGLTIAYLRGYMVFMRYVKLWLLRRGID

SEQ ID NO: 482 - protein, 314 aa, Scytonema hofmannii
MSSKIPVSVLIPAKNEQANLPACLTSVQRADEVFVVDSQSSDKSVEISQDYGANVVQFHFNGRWPKKKNWSLENIPFRNEWVLIVDCDERIPDELWGEIAQAIQNPEFNGYYLNRKVYFLGTWIRHGGKYPDWNLRLFKHKNGRYENLNTEDIPNTGDNEVHEHVILDGKIGYLKHDMIHEDFRDLFHWIERHNRYSNWEARVYHNLLTGKDDNGTIGASLFGDAVQRKRFLKKVWVRLPFKPLLRFVLFYIIQRGFLDGRAGYIYGRLLSQYEYQIGVKLYELRQHNGRLNTSSQPIVQSPSLPKEIGQTVTQ

SEQ ID NO: 483 - protein, 252 aa, Unknown
  Description of Unknown: Elusimicrobia bacterium sequence
MSKLSVIIITYNEEENIKHCLESVKWSDEIVIVDSFSNDKTVEIAREYTSQVFQNKWTNFSQQKNLALEKASSEWVLNIDADERVTPELKKEILAVLNSQFQSFDGYYIPRRNHYLGRWIRHCGWYPDYKLRLFRRRKGRFNERMVHESVVVEGRKGHLKSCLNHYSYKNLSDHLSKIDKFTSLAAEEMFTNGKRARVFDLLLRPLVKFVKMYLIKRGYLDGIYGFIVSIIGSFYVFTKYLKLWELSKREIH

SEQ ID NO: 484 - protein, 351 aa, Paenibacillus sp.
MKLSICMIVKNEEKHIAECLNSIPDNCEVIVIDTGSTDNTVEIAKSFPKVKLFQVPWEQNFASVRNISLSHATGTHILVLDADERLSTNAYERIKQYVKKYPGIPAAVLIENIDEGDSTIHRMVRLFPKQNKFSFRGVVHEQLFEHDVPAKFLLSDIIIHHYGYQKENYENQKYEFYLELYKQVIKKQPRNGYIWYQIGKLHAVVDNYEPACEAFLNACEYMEAPSLSHASMILHFAKLLHAAHLNEDAIVLLENHKGMYADYPDIYFQLGILNMEIGNLAEIRSCFESALELGETTKYTTTSGVGSYLAAYNLGVYYEVTGDMVLAKKYYLLAAPNSNLAAKRLELMVKR

SEQ ID NO: 485 - protein, 264 aa, Unknown
  Description of Unknown: Flavobacterium gillisiae sequence
MTINRSRDEISSNKTFLSALIITYNEEHNIKNVLNDLDFADEIIVVDSFSTDKTVAIAADHKNVKVVQHPFENYPSQRNYAISLATHSWILFLDADERLTAELKEEIIETIHDKNSFSAYYCCRTFMFKNIKLHFSGWQTDKIIRLFKKEKAQYDLGKIVHEKLTVTGKIGKLKNELIHYSFRSYNEYRQKMSVYGKLKAIEELNKGTKPTFFHFYVRPVYQFLYQYVIRMGILDGKKGIVICYLNAYSVYVRFQELKRLRLND

SEQ ID NO: 486 - protein, 254 aa, Bdellovibrio sp.
MIKISVAIITFNEEDNILRCLNSVAPIADEIVVVDSFSTDRTPQICQEFGVKFVQNHFKGHIEQKNFALDQCQYDHVLSLDADEALSSELTQSIDSVKKNWRGPGYSFNRLTNYVGHWVRHCGWYPDTKLRLVEKKRASWVGVNPHDILKLQQGSEQFIAGDLLHYSYKSITAHINQTNRFTTIAAKEAHARGVRSSQFKIASRPVLKFLRDYIWKRGFLDGRYGLIICTINALSAFLKYSKIKELEAQKSIEA

SEQ ID NO: 487 - protein, 250 aa, Unknown
  Description of Unknown: Chryseobacterium camelliae sequence
MMKISGLIITYNEEKNIKEVLECFDFCNEIIVVDSFSTDKTVEIAGRFPNVKIIQHQFEDFTKQRNIAVDAAQNDWVLFLDGDERITPKLKKEIIREMNASKPKDAYYFYRKFFFEGKPIHYSGTQSDKNFRLFRKSRARYISGKKVHETLEVSGSVGTLKHKLLHYSVTDYESYRQKMIHYGMLKGKELALKGKRFNMVIQYAKTIFRFFKAYILRLGILDGKAGYQLCYLQSLSVFETYESLRKEQNN

SEQ ID NO: 488 - protein, 326 aa, Unknown
  Description of Unknown: uncultured bacterium sequence
MKLKLSVVISAYNEEEKIDKCLSSVKWADEIVVMDNSSTDRTREVARKYTDKVYSQPNDPFKIDLQKNTGFEKATGDFILSLDADELVSDELKIEITDLLEKVSLKDGYFIPRKNIIFGRIFEYAGWYPDHQLRLFRKGKGRFKTENVHEGIKVDGETEYLKEHLVHHNYENISQFIHKNMIIYAKNQANALIRENYALKPGDLIKTPSKEFLSRFFARKGYQDGIHGLFLSLLMAASHLVMLAYVWEEQGFKEASSKRTLEEAESELKALNKELKFWFLSIKMDDIKNPLGKLSLKLKNKSSTFFELSIKLNNLRGFRKVLDKLK

SEQ ID NO: 489 - protein, 256 aa, Unknown
  Description of Unknown: Pectobacterium aquaticum sequence
MNKNLSILIITKNESELIEECLQSVSWADEVIVVDSGSTDSTVEIAHRYGAKVYQHNDWPGYGKQRQRAQSYASGDYIFFIDADERITPELRQSIESTLLKSNLDDKVVYSCPRRNLFLGRFMKHSGWYPDRVLRLYANKHYQYNGNSVHESLDCGDASVQYLSGDLKHLTCRDFSVFQEKQLRYAITWARERHEKGISCRYSEIFTHSIFSFLKTWLFRAGFLDGKQGLLLALVNAQYTFNKYTELWSLSNKNNK

SEQ ID NO: 490 - protein, 320 aa, Pseudomonas psychrophila
MTDLSRHKEKIGLSTIILTFNEELHLERALRSVADFSKEVFVIDSFSTDRTLDIARAHGATVLQNKFVNQAKQFQWALDNAQISGNWILRLDADEIIESDLAIEIAEKIPDLPSDVVGINLKRKHIFMGRWVKHGGRYPLVMLRIWRKGYGRMENRWMDEHIVIFGGKSVTFEGGFADHNLNNLTFFTDKHNKYATREAIEILNQRMNFFPRDHSVTKESTSLQTAAKFFIKEHIYNHIPFTVSAPLYFLWRYIFQLGFLDGRSGLVYHFLQGYWYRFLVGSKVLELERALSHLNDKDMISEELSLLTGYTLKPTPDQPK

SEQ ID NO: 491 - protein, 256 aa, Unknown
  Description of Unknown: Flavobacterium denitrificans sequence
MILPQKQFLTALVITYNEEQNIKPVLDDLAFADEIIVVDSFSSDKTFEIASSFKNVKIVQRIFDNFASQRNYALSLASHSWILFLDADERLTPELQKEISFIIHQSNSASAYFVRRNFMFEDKKLRFSGWQTDKIIRLFKKENAFYNHEKIVHEKLIVTGKTSKLKNRLIHYSYSNFEDYKQKMIFYGQLKAKEEFLKNTKPNFFHFYIRPAYQFLNQYLIRFGFLDGKKGVIICYLNALSVAARFQELKKIHSGN

SEQ ID NO: 492 - protein, 260 aa, Vibrio crassostreae
MITGVVITLNESRNVVECIQSLQKVCSEVIVVDSNSTDRTVELAEAEGARVISQDYLGDGIQKNVGLDYANNDWILSLDADERLTDEMVSAIKGLDLSTTKNDAFAFRRRNYIGSRWIKQCGWYPDFCIRLYDKSKTRFAAVKQHAAVQAKNPERINADIIHYSFENLGQLFAKPGRNFSGRAAKIMYQKGKRANSFSPFTHGLNAFIRKYIFQKGFLGGVDGMTVALSSAVNSYLKYAKLLEFQRDPKVLEKEDFDKVW

SEQ ID NO: 493 - protein, 255 aa, Unknown
  Description of Unknown: Candidatus Aenigmarchaeota archaeon sequence
MTISICIISFNEEQNIRRCLESATWADEIIVVDSMSQDKTVEIVREYTDNVYQKAWPGYVEQKNFALSKAKGEWILSVDADEEITESLRNEILDEIKKDGAKDGYRIPRRSFYQGRWINHSGYYPDRQLRLFRRKRGHWTGGRVHERVDVQGSIGELKGDLLHYPYKGIISGQLQTVNSFSSLMAEDMYERGKRYHTSLLLLRPTFKFFEVYLLKLGFLDGVAGFIIAVTSAYAMFVRYVKLRELWNGLGNKSAL

SEQ ID NO: 494 - protein, 247 aa, Campylobacter sputorum
MIKASVYVICQDEEKHIERMLKSVADFDEIIVVDSGSKDKTLEIAAKFTDKIYHHDWQGEGLQKNYAFSLCKNEWVLNLDADEEITAELKTEIENFMKQSEYDGLDIKFHEYSLGRICSPFVRKNTHIRFFKKSCGEYRNLGVHAQISINGKVTKSKHSIHHFSDKFIKELVMKNNNYSSLRAQRDFEKGKKPNFLKLIFIFPLVFFKSYILRRSFFDGKKGFITSMINAFYAFLKEAKLYELNLKK

SEQ ID NO: 495 - protein, 286 aa, Pedobacter sp.
MNKNFSFIILTYNEEIHLSRLLNSIKGLQAPTYILDSGSTDTTVKIAENFKAEVKVNKFENHPKQWDYALKNFHIQTPWTIGLDADQIVTPELFELLAKFEAENHQDINGIYFNRKNFFQGSWIRYGGYYPIYLLKMFRTGIGFSDLNENMDHRFIVPGKTVIWKNGHLLEENLKENDLNFWFDKHERYSDLIAQEEIERMKKLRVQSLKPNLLGSPDERKAWLKHLWWKLPLGIRPYLYYYFRMLFQLGILDNKTGRRFHYLQALWFRKLVDRKIMKLKRELSRV

SEQ ID NO: 496 - protein, 250 aa, Unknown
  Description of Unknown: Candidatus Levybacteria bacterium GW2011_GWB1_36_18 sequence
MISAVVLTKNEENNIVDCLESISFCDEIIIVDDNSNDRTLELLSNFKVKLYKRSLNDNFSIQRNFGLEKATGDWVLFIDADERVTPLLKKEILYKTEANGEVSGFYFRRKDYFIGKPLNHGETASIKLLRLVKKRKGIWQGRVHEVINVLGKTESMENPIIHYPHKTLSEFLSEISSYSTLRAKELFESGKKTNFLSIILYPKAKFLLNFFIKKGFMDGIYGFVFAILMSFHSFLVRAKLWLLWQKKYIS

SEQ ID NO: 497 - protein, 253 aa, Polaribacter tangerinus
MTKISAIIPTLNEEIHIADAIKSVGFADEIIVIDSFSTDKTLEIAKKYNVKIIKRKFDDFSSQKNFAISQANYPWIYLLDADERVTTEVEKEILEAVKSPNDFVGFYVRRTFYFCGKKVNYSGFQRDKVVRLFLKEHCKYVGVVHETIKTSGYLGFFKSKIEHYSYRNYDHYISKLNHYASIRAKELHGKGKKVNAYHVLIKPPARFVIHYFIRLGFLDGFTGFLVAKTQAYGVLTRYIKLWLLNKKYSKNAE

SEQ ID NO: 498 - protein, 239 aa, Halarsenatibacter silvermanii
MSLGALVLTYNEEDMIESCLESIKWVDEIVIVDSFSDDSTISICRKYTDKIFQKEMNNFSSQRNFGINKITAEWILIVDADERIPKELKQEISTVISSDPEKKVFKFPRKNFFMGKWMKHCGWYPDYTVRLFYNISEHRYSGQVHETLSFKGEAGKLKTPLIHKTYKDINDFVDKINYYTDLAKENSSCPNLFVLFIRPILEFIKRYLFQLGFLSGKEGLILSMLLSYYSFLKYAKRCE

SEQ ID NO: 499 - protein, 269 aa, Unknown
  Description of Unknown: Deltaproteobacteria bacterium 13_1_40CM_4_54_4 sequence
MSVPGSTVGPRPTVSAIVVCFNEEQNIGDCLESLSWCDEIVVVDSFSTDRTVEICRQYTDRIIRRPWAGYRDQKAFAHSQATKDWVLLVDSDERVTPKLRDEIRQTLGHETSECAGFAVPRLVFYLGRWWWRGGWYPDYDVRLFKRDRATWGGSDPHEKILVDGKVRHLQHPLHHFSYRNIEDHVQRIDRFTSISSRELRKEGKHWHLADALFRPAFRFFHSYVLKRGFMEGFAGFYVAVTAAIYVFLKYAKLWELELEEKDDIDRKRS

SEQ ID NO: 500 - protein, 252 aa, Capnocytophaga stomatis
MKISVVINTYNAEKHLQTVLETVKDFDEIVICDMYSTDRTIEIAGKYNCKIIYHERFTYVEPARNFAIHQAENEWVLVIDADETVPPKLKEYLYDIIKTPNLGGVYIPFKNFFINKWMRSAYPDFKLRFFRKEGAYWPNEIHSTVKVKGDVIKIPRGRTDLASDHLANDSVSTILRKTDTYSDAEIERKKNKKITTFGLIFSPFFWFIKYYFIKKGFLDGKKGFIFACLKAQSKLVILAKVYEYQEQNKVTK

SEQ ID NO: 501 - protein, 254 aa, Unknown
  Description of Unknown: Candidatus Omnitrophica bacterium sequence
MIDLSVVVITRNEEKNIEDCLASVAGWAGEILIVDDLSTDKTLDLASKFTERIISRKMDLEGRHRNYAYSQAKNLWVLSLDADERATPELKNEIEEVLKNGTEFNGFTIPRKNYIGNYWVKHGGWYPSPQLKLFRKDKFRYEETGVHPRAFMDDPCGHLKSDIVHFSYKNFEDFFHKLNNQTSREAQKWFKQDKPMRLGRFIWRAIDRFMRTYLGKRGYKDGFIGFVVAFNAGLYQFLSYLKYCELTRERGKAK

SEQ ID NO: 502 - protein, 258 aa, Arenibacter algicola
MPDLREKISALIITYNEIGYIKQCIDSTSFADEIIVVDSYSTDGTFEYLKNHPKVKVIQNPFENFTTQKSFALKQANHDWILFLDADEVVPISLKEEIKTKTNSNSEVVAYWFYRKFMFQDKPLHFSGWQTDKNYRLFRKSKAKFSDQKIVHETLVVEGESGILSERLIHYCYKNYDHYKAKMTKYGKLKALEEFQKGKKWHIMPQVLRPAWKFFYHYIIRLGFLDGKKGVTICYLNALGVWTRYIELRKLNNQEKSS

SEQ ID NO: 503 - protein, 251 aa, Unknown
  Description of Unknown: Marinilabiliales bacterium sequence
MAELSVVIITRDEEKNIARCIKSVASLASEVVVVDSHSQDNTQQICLSLGARVITHDFEGFGKQKQFADAQAKYEWILSLDADEELSTELRDSIGNIISNPQADAYSMNRLTNFCGKWIKHGGWYPDKKVRLYKKSIAKWNDYPVHELLNVNKNAAVMHLRGNLLHYSINTINHHIKQINRYSEIAAGNLVEKGRRTTCFHLALKPVFRFVKIYFLKAGFLDGYFGFVIARNSAFSVYLRYAKAKALKKKR

SEQ ID NO: 504 - protein, 299 aa, Synechococcus sp.
MNIVAIVLTFNSEASIAQVIESCQELVARILVVDSYSSDRSLDIVRSYRCELVQHEFKNYSKQRNWAQDYANLAPEDWVLHLDSDEVISPELAASIRQLKASDSEPDVDGYLIRRLSYFLGKPIRYGNINPSWHLRLFRAKCGQCEERLYDQHYIVPGATRKLAGTMLDLQLTSLETWTASHNRWSTAEAAEVNRRISQAKEEAQTLPATLRGDIRMKKRWLKNNIWYKSPPLLRPFLFFFYSYFLRLGFLDGRAGLIFHVLQSFWFRFLVDAKLVELHMQQDRQDPLESTSQPQQESA

SEQ ID NO: 505 - protein, 308 aa, Unknown
  Description of Unknown: Cyanobacteria bacterium J069 sequence
MTQPLAKIPVSVLIPAKDEELNLPACLKSLAPADEIFVVDSQSGDRTAAIAQEYGAKVVQFHFTGHWPKKKNWALDHLPFRNEWVLIVDCDERIPPALWDEIAQAIQNPAINGYYLNRRVYFLGKWIRHGGKYPDWNLRLFRHAKGRYENLHTDTAPNTGDNEVHEHVVLEGAVGYLATDMLHIDYRDLYHWLERHNRYSNWEARVYYNLLKGMQPDGTIGDRTSGWWSNAVQRKRFLKLLWVRLPFRPTLRFILFYILRLGFLDGRAGYTYARLLSQYEYQIGVKLYELQQLDGRLNPQLDLDDGTR

SEQ ID NO: 506 - protein, 257 aa, Unknown
  Description of Unknown: Candidatus Erwinia haradaeae sequence
MQQTQKLSVVIITHNSEEVLDKCLASVNWADEIILLDFKSSDKTLDIAVKYGAIVYHSNIWYGYGKQRQIAQNYANYEMILMIDSDERVTPELQKSINRILQKPPENIVYSIARRNLFLGKAMRYGGWYPDRVIRLYPSFCIYNDNLVHESLDVPKIPIRSLYGDLLHVTSRDFCDFQFKQCTYAKAWARQHYQQGKHYGIIKIIYHSFWSFIRTLLIRRSFLDGTQGWLLAIVIFQYTFNKYTALWALNYISRDKN

SEQ ID NO: 507 - protein, 237 aa, Arcobacter nitrofigilis
MNTSINKLSIVIITKNEEKFIGDAIKSSLFADEVLILDSGSNDTTCKIASELGAKVFEEEWRGFGAQKNRAVELASYDWVFVLDSDERITEELKKEIIKTLENPSANGYFVARLNNFFGKDIKTCGLYPDYSIRLFNKKFGKFNEVPVHESVQLETKARYLKNHMIHLAYENIDEFISKQNRYSTLNHKKKSILKAIINPYWTFFKLYILKQGFKDGWHGFVISKLYAQYTFWKYIK

SEQ ID NO: 508 - protein, 319 aa, Leptolyngbya sp.
MATTPKVPISVLIPAKNEEQNLPACLASLERAAEIFVVDSHSSDRSVDIATAAGAKVVQFEFNGHWPKKKNWALDNLPFSHEWVLIVDCDERIPPDLWDEIAVAIQQTDFDGYYLNRRVFFLGTWIRHGGKYPDWNLRLFRHRAGRYENLQTADIPNTGDNEVHEHVMVEGAVGYLKHDMLHEDFRDLYHWLARHNRYSNWEAQVYYNLLTGMGDGGTIGANLFGDAVQRKRFLKKIWVRLPFKPLLRFVLFYVLRLGFLDGRAGYIYGRLLSQYEYQIGVKLFELRQFGGQLNVTPQGSPAQPQPAVQPAVVPVESAP

SEQ ID NO: 509 - protein, 222 aa, Unknown
  Description of Unknown: Candidatus Rokubacteria bacterium sequence
MTARLTVAVITWNEEARLRRCLESVAWADEIVVVDAASTDKTATIAREFTDHVFVHPWEGFARQKNRAVERATGDWVLSLDADEEVGDELRESIRRVLASDAGPNGYTVARRNIFWGRFIRHGRLYPDWQLRLFRRGAGRFVDRDVHESVEVTGTVTRLDGALVHESYRDVADFLERTNRYTSLAADEWVRSGRPIRARELCLRPLARFCSMYVLHAGFLDG

SEQ ID NO: 510 - protein, 255 aa, Unknown
  Description of Unknown: Betaproteobacteria bacterium sequence
MPATLSVIVITHNERDNILGCLQSVAFADEWVVVDSSSTDGTREIAQGFGARVVNTTDWPGFGPQKNRALAEATGRWVLSIDADERVDDELAAQIRAAIARDADGPMGYEVSRLSRFCGQWMRHGDWYPDRVLRLFRRERGRFSNDLVHERLIVDGATARLSGHLLHDSMPTLDDALDKLNRYSAGRARDRVRAGRRGGLAPALGHGLWAFVRCYLIKRGFLDGRLGLVLALYQAEGTYYRYLKMWLQEPAAVSE

SEQ ID NO: 511 - protein, 249 aa, Unknown
  Description of Unknown: Nitrospirae bacterium HCH-1 sequence
MKGVSVVIVTKNEEDRIEAALQSAAAASEIVVVDAMSEDRTVEICKAYTDKVYIRQWQGFAAQKQTASDLAAGPWIFILDSDERFTPELAEEISSTLKDTALDGFYVPRKNFFLGRWIKYGGWRPDYTLRLFKKECGRLEPREVHEKVVVNGRTGYLKNPVEHYTYRSVAEFLAKLDNYSTLSAKDKGARRIGIASLTVRPIATFIKMYFLRLGFLDGVHGFILAVLYGYYTFVKYTKLWEVNQGGKGL

SEQ ID NO: 512 - protein, 253 aa, Unknown
  Description of Unknown: Microgenomates group bacterium GW2011_GWA2_37_6 sequence
MNISAVLIVKDEEKNIVDCLDSLSFVDEIVVVDDNSTDRTIELAERLAKEKAIKIFKRELDNDFSAQRSFGVEKTTNDWVLFVDADERVTKELATEINESLTPNTEYGGFLIPRIDFMWGKQLKHGETGNIKLLRLFDKQKGSLKGKVHEIWETKNKVGVLSSPIKHYPHPTVGDFLQEINFYSDLRSRELFEKGEKSNLFSIIIYTKAKFLQNYFLKRGFLDGTPGFIHAILMSLHSFLVRGKLWLLWQKYQ

SEQ ID NO: 513 - protein, 257 aa, Beggiatoa sp.
MQLSIIIITKNAATHIEACLTSVAWCDEIIVVDCGSTDNTVALCRPFTNKVYITDDWPGFGPQKNRALAKATGKWVLSIDADERITPALQQEIKQAITQTSVTAFRIPRQSRYCGRWIKHSGWTPDYVIRLFRRDCGRFSDDLVHEKVQVLQRGGDIGTLKSPLLHYSFNSLEEVLEKVNSYSTANAQMAYAKGKKSSLKKAIFHGLWAFVRTYVLRAGFLDGRVGFMLAVSNAEGTYYRYLKLMYLQENMRIKNEK

SEQ ID NO: 514 - protein, 269 aa, Unknown
  Description of Unknown: Candidatus Omnitrophica bacterium sequence
MRKAISVVILTKNEEERIADCIKSVLSWADEVIVVDDESADRTPEIAKNLGAKVLFRKMDIEGKHRNWAYTQAKNEWVFSLDADERLTPELKKEIIEVLSSSPSHSAYTVPRKNFIGNYWIRWGGLYPAPQIKLFRKDKFKWEEVEVHPKAFLEGSCGHLKNPLIHYTYRNWGDFLNKVNKQTTLEAIKWYKLSLVNPKKAHYKMNLIHVLWRMLDRFIRTFLVKKGYRDGFVGFMVAYFSSLYQIVSYAKYKELIKHHKTPPNETKQV

SEQ ID NO: 515 - protein, 271 aa, Unknown
  Description of Unknown: Desulfobacteraceae bacterium sequence
MIQGTTLSASIITYNEENNIEDCLNSVTDFVDEIIVLDSFSTDKTESICRNNPKVKFSQHPFDGHIQQKNRALEMCSSEWILSIDADERVSPELRQSIIRFLSGNPKPKIAGVKFPRLTYHMHRYIRHGGWYPNRRYRLVRKGMAYWGGENPHDRIILKGKGKTIKGDLIHYTAKDLSDQVTTINNFSSIAALVRYNKGKKYRLWRLLLKPVSKFIETYLYRRGFLDGTQGFIIAVSSSYASFIKEAKQYEMDVLGSDKPSNLSRLYRKER

SEQ ID NO: 516 - protein, 261 aa, Vibrio sp.
MNVSKPTLAVALIVKNEAQHLQACLETVHQWVDEIVVLDSGSSDNTEEIARRYTDKFFVNSQWPGFGPQRRLAQSYVESDYVLWLDADERVTKELKDSIQQAVAANKPNTLYQFARLSWVFGRYIRHCGWYPDRVLRLYPTQLTQYNEALVHEKVEVADGMKVENLAGDAIHYTYNDIHHYLVKSAGYAKAWAEQREKRGKKSSISQGILHAFGCFLKMYVLKAGFLDGKQGFLLSLLSAHSTFVKYSDLWVRTSTKPPKG

SEQ ID NO: 517 - protein, 250 aa, Aureispira sp.
MPLTVIIPTYNEEEHIADLLKQVTWADEVIVVDSFSTDATVELVQQTTAKLVQRTYIGPADQKNWAIDQASHNWVLILDADERLTTPLMNELKEIVTQPVLEHAGYWIYRQNYFMGKKIKYCGLQRDKVIRLIQRDLCAYNNKQVHEEIESSGSIGFLNHKLEHHTYKNLAHFLAKNERYALWSAQDHLPNVKRVTSWHLFVKPVGRFFSQYILKRGFWDGQAGFIFCVIMAWGVFLRYAKIKELLEERR

SEQ ID NO: 518 - protein, 313 aa, Fischerella muscicola
MSSSKIPVSVLIPAKNEEANLPACLASVQSADEVFIVDSQSSDQSAEIAKSYGASVVQFHFNGRWPKKKNWSLENLNFRNEWVLIVDCDERITPELWEEIAQAIQNPEYNGYYLNRRVFFLGKWIRHGGKYPDWNLRLFKHKKGRYENLNTEDIPNTGDNEVHEHVILDGKVGYLKNDMIHEDFRDLFHWLERHNRYSNWEARVYYNLLTGNHDNGTIGAKLFGDAVQRKRFLKTIWVRLPFKPFLRFVLFYLIQRGFLDGRAGYIYGKLLSQYEYQIGVKLYELRHCGGKLNTKSTSVTTTAFPQKVRQTVV

SEQ ID NO: 519 - protein, 407 aa, Conexibacter sp.
MTAPPRPTITACLIVRDEERLLPRALRSVAFCDEVVVVDSGSTDRTVEIARAAGAVVVQRGWPGFAAQRNVAIDHAHGDWILEVDADEQITPALAREIRAFLDAHDPRHDIVALPMRHEYLGGWLEPAIKYPCYRYRLFRRGAYRHDERRTVHEGLWATTPAWAMRHDMEHELAPTLRAALADLRAYTRLEASQFTPSRTPRAVLVGVLARPLAKTAYRLLVDRAWRDGWRGVLKVALDAVADAGVWVLALRREAGHPDGSGAHFSLEPPPRGPLRLVGVATDAASTRAICAWLHEAADRGADTALLTPCPETVVVGHAPGDGPAVTAAGVRVRPLSSAGALALTRGLDAERQVRQVDALVVPARLTPLARRAVARVGHHAPVPVTTPVADALHTVRAHRTRGGAGA

SEQ ID NO: 520 - protein, 305 aa, Unknown
  Description of Unknown: Candidatus Aerophobetes bacterium sequence
MHSEVKVPISVIIPTRNEEMNMRQCLESVKWADEIFVVDSKSTDHTIEIANEYTDNVVMFHWNGKWPKKKNWALEKLSLSHEWVLFLDADEQVTPGLAGEIRQLVSNGTEFSGFLVKYDFYFLGKLLKHGVLLLKCVFFKHKLGRFEKIDIPEVTDCDVEIDEHPVIKGKVGKLKNKMIHHDFKDLHHFFHRHNIFSDWETGLRSCKTKRDKEKELKASLFGSQVERRRFLKELFFKLPGRPVIYFLYSYVIRGGFLDGKAGYIYNVLKAFYYFSVDIKLYEERLRLEKVGRQLHEKTRNAGDWI

SEQ ID NO: 521 - protein, 1063 aa, Unknown
  Description of Unknown: Candidatus Melainabacteria bacterium HGW-Melainabacteria-1 sequence
MFAFNLVERTENHIVALTIPANGKNCLPVPHASRQVFTASEAVSLSACLIVRNEAHCLARCLDSLVGVADEIILVDTGSTDQTVEIARQYTDKIFYHAWNDHFSEARNVALAQATGDWVLIIDADEVVPAETARLIPTYLNRPDFQNRPLVLNWRVCSDHHPDLYSRGLFPNHHGIRFAGRVHEIPVLPGQQLPTYHCQDLVLRHDSPGTQDVAKQMYYQSLMLRGLAEACDAAEINHLQKHLGLSHLAMKQWQVAWDMLSACYHGMQDLGIAPQDGFYGEVLRGLVLAGSKLGLPKTHGYALEMQRHYPLEPIAWPVRSGARHPWRKGAIALTMSVLAACQPASTLPHSTSPKPAEHQSMGANPNNLLLPRQTNGADFRIQAAYFCPSQSNKVFNCYASGGDPVIGESSLDANGKSCYIFDHCDIPCELTNTCSCEHTGACETPPPPNEEECIEEPGGEPCVILPPGGGGDDGETDDCEDAPLLLPEDIAPLMQDIQQIQPVQPQVLNRHEKLLEQMKALEAQLAAEGVQVSPPEPLILPAPLPPQGFQTQSTTQSGTLSKKAQKWLAKYEELQTEHAQHRAAIEQTMQGINAPLESLLQRITDTFEIDYTQPETEPNFSLEDYKSSLDIAIGNIQAWLAEENTYSQAAAAANYGNLVLLYHQLYRDILAGKQLAASQPLPESEPFAYFYEEVAQIQDQRALANFMARKLESLQARIQTKQQKLSAATEALIAEAESISQQLDAFELELTQLEADLAEGEGGFSTQAAADGPFVRDGASGTNGALAGYNFPAQGVGSRSTRTPSSRAQGVKQTSNSNVSRSVQQLQRAETAWRASISQRQMAQKNRNQAVKQVDVYRGKPNYNPDVLANLQARADAALADLNAALANEGAANAVRQQAKANAKNASSNVSKVESSCRDENCFKRKDYRGHQLKYDIKEGLDQDWRDRDFLNEDQALSTALDAAFKEIHDRTGLVRSQFKPTAWVRDQRTGKTHPTIFEGPGGANVNIDRPHVDKSWSPGKEWQSGPDAPHVGWQTSGKKTQIKGHIILRDLPYFRPLRGERD

SEQ ID NO: 522 - protein, 256 aa, Unknown
  Description of Unknown: Chryseobacterium hispanicum sequence
MKETTKLSLKISGLIITYNEEKNIGEVLKSFDFCDEIIIIDSFSTDKTLEIAKTFPNVKIIQNQFEDFTKQRNFALDAANNDWVLFLDGDERITPELREEIIVELNKADKKDAYYFYRKFYFAGKPINYSGTQTDKNFRLFKKSKARYIAEKKVHETLNVDGNIGELRNKLLHYSVTDYESYRKKMIHYGILKGQELAQKGKKYNVLTQYAKTGFRFFKSYVLRLGFLDGKDGFILNKLQALSVWETYESLKRENK

SEQ ID NO: 523 - protein, 255 aa, Bacteroides sp.
MAKQGISVVINTYNAEKFLPEVLESVKGFDEIVICNMESTDKTVEISESYGCKVVTFPKANHHSAEPARTFAIQSASCDWVLVIDADELVTKELKDYLYQRIQRPDCPAGIWIPRKNYFMGKFMHCHYPDYLLRFFRREGTVWPPYVHTFPIVEGKQERIDKRRMELAFIHLANDGVKDIIRKTNEYTENELEKKKDKHYGAMAFLYRPLFRFVKAYLLKGGIRDGKAGFIKACLEGYYQFIMLSKIAERKNSRK

SEQ ID NO: 524 - protein, 254 aa, Shewanella sp.
MKLPISVFIITKNEEKHIEKTLQSVASLDEVILVDSGSTDSTLDIAKRYGAKVYSHPWLGYAKQKQYAMSLCSHEWVLNLDGDEAINSSLIDALKAIMEHDKADSVRFWRNDIFIDKPLSSWTKKPNNHRFYKRSKSFFDDSRLVHESATVNGKEIFINETFDHFGYSTIAAITNKHNTYSSLKADEKFAKGKKFSNLKLITIIPLVFIKEYFFRRKIFSGKRGFILAVMKAYYAFSKEAKLYENYQTKQKTNL

SEQ ID NO: 525 - protein, 248 aa, Unknown
  Description of Unknown: Candidatus Parcubacteria bacterium sequence
MSLSIIILTKNEENTIVDSLESASFADEIIIVDDNSTDRIDEIIKKINNPKIKLTKHSLDHDFSAQRNFALKITKSDWILFLDADERISKELQKEIIEKIKDNNIDGYFIKRSDFLWGKKLRYGETGNIKLLRLGKRGSGIWKGKVHETWNIKGKTSELENDLTHLPHQTIKEFLSEINYYSDLRAKELFDKGVESNLLSIIIYTKGKFMVNYFLKLGFLDGIPGFVFAILMSFYSFMVRGKLYLLRH

SEQ ID NO: 526 - protein, 298 aa, Unknown
  Description of Unknown: Candidatus Woesebacteria bacterium GW2011_GWA1_37_8 sequence
MKLSVVLAVKNEEENIGACLDSVKQIADEMIVVDDGSSDKTVEIAKKHGAKVFSFVHKNNFHETKQFAIERAKGDWVLQLDADERVTKELADEIKEVVNFSDKENQSRVLSSSSTVHNTLSSKHLKLFLRHQKLIEQREGHLGKKTGEVVAFFITRRNFFLGRPLIHAGVYPDGVIRLIKNGKARLPAKSVHELMEIDGEVGWLFNDLEHHDSPTLKRYLDRMNRYTDLQAKEFETKKIPATNWNLFKYSFIVPSVNFLKLYFRHKGILDGRQGFLWSVFSSLHFPITYFKYYQSKLK

SEQ ID NO: 527 - protein, 252 aa, Unknown
  Description of Unknown: endosymbiont of Galathealinum brachiosum sequence
MKVKLSVVIICKNEESRIRQCLESITWVDEIIVIDSGSTDKTLDIVAEYTDKIFVNTNWSGFGLQKRLAVDKASNDWVLSLDCDEVVSEQLRDEILDCMSGLDEKTVYRINRLTHFCNKFIYYSGWQPDRVVRLFNKKYYTYNDKTVHESVDCKDAEKVDLEGKLFHYTFESLEEYIDKRNGYAKAWAESHYAKGRKVGLFEIIHHTLFAFIRHYIVRRGFLDGYQGFLISVIQMQYTFNKYNFLKFKNISK

SEQ ID NO: 528 - protein, 246 aa, Unknown
  Description of Unknown: Candidatus Woesebacteria bacterium GW2011_GWB1_38_5b sequence
MKNFLSVIVITKNEEENLSRCLSSVGGLADEVVVVDSGSTDKTLEIATRFGAKIYKRHFDNYSNQRNFAISKTTGEWVLSMDADEEISDGLALEIKQVVKSQGADGYLIPRINIIFGAEIKHSRWSPDKHIWLFRKSRGKFRNLIHEEVDVNGRVEELKGAKIHHSHKSVFEFVAMTNKYTDIEAREILKNGYNFSFMKLLYLPLRSFFGRFILKQGFRDGWRGFVLSYLRAVYQFIVWVKVWEKS

SEQ ID NO: 529 - protein, 259 aa, Geobacter sp.
MTLIERPRLSAFVITKNEGAKILECLGSLQWVDEVVVVDDYSTDDTVPKCSNFANVRVVHHPFASFRDQKSHAMSLTSNEWVLEIDADERVSNEMKSAVLALSQADFSEFDAFAFRRLTNFWGKWIRHGSFYPDYKVRLYNKRNGAWSDSTIHERFVPRGKIKRIAADIIHDQDLDLTAYFQRTTRYSELSALDYHSRGKRSKWHHYTLRPVYTFFYRYLFRLGCLDGVQGFVVSAMGAIGTFQKYMRLFELQKGRRRV

SEQ ID NO: 530 - protein, 249 aa, Unknown
  Description of Unknown: Flavobacterium frigidimaris sequence
MLIRSRKLSVIILTFNEESYIGDAIQSVAFADEIIVLDSHSTDLTAKIVLDLGAKIIFRKFDNYCNQRNHAIGSATGDWVLFLDADERVSDKLKNEILETINLNKSDAYRIWFPHFFMDRFLFHYTDKVTRLIKNDNIRFENEVHEKLVLKSKPPVLKNYMIHYTYKDLSHFISKKDKYAWFQAKISVKKGKNATLFLLFFKPLYRFFHTYFIKRVCLDGVPGLAAASIDAYGVFSRYAKMILLEKNLE

SEQ ID NO: 531 - protein, 268 aa, Mesorhizobium sp.
MQRTEKPPVSAFIICKNEVSMIGPCIESLDVCREIVIVDSGSTDGTIELIETYRDKGYPIRLFQRDWPGYAKQKQFALDQCTETWCLNLDCDERLDDALKLNLPELISTDQTVAAWELDFRLFLLGYGYTPDRVRLGHLVRLVRKGRVHYRLNQLVHEGVDVEGEIGTNNKGKILHARPISIEEHISKLNQYSGLKSTQLFNSGKNPRLFRLIFNPFIYFIRIFIFRRFYLCGWAGFIHAGTGAIYSFLTEAKLYQMHAKARGDKSQS

SEQ ID NO: 532 - protein, 248 aa, Unknown
  Description of Unknown: Chryseobacterium taeanense sequence
MKISGLIITYNEEKNIREVLECFDFCDEIIIVDSFSTDKTVEIAEQFPKVKIIQNTFEDFTKQRNLALDAATNDWVLFLDGDERITAALRKEIIEELQKPTQKDAYYFYRKFYFADKPINYSGTQTDKNFRLFRKSKARYIAGRKVHETLEVNGTIGELKNKLLHFSVSDYESYKKKMIHYGALKGQELAAKGKKYSLIIQYSKTAFKFFKAYILRLGILDGKEGYQLSYLQSLSVFETYESLKKEQK

SEQ ID NO: 533 - protein, 319 aa, Unknown
  Description of Unknown: filamentous cyanobacterium ESFC-1 sequence
MTVSPDRVPVSVLIPAKNEELNLAACLNSVAPAAEIFVVDSYSSDRTVEIAKENGAIVYQFDFQGEKERHEAALTAGKSSKLRKKKNWSLDELPFSNDWVLIVDCDERITPALWEEMAALIEQDECDGYYLNRRVYFLGKWIRHGGKYPDWNLRFFKHKQGRYENLNLDYIPNSGDNEVHEHVILQGPVGYLKNDMDHIDFRDIYQWLARHNRYSNWEAGFYNQLLDGKLNDGIEPNPFKAGPERTRFLRMVWARLWFKPLLRFTIFYILRLGFLDGQPGYVYARLLSQYEYQIWVKFYELRNFSGHLNTDPVLKSKNS

SEQ ID NO: 534 - protein, 315 aa, Oscillatoria acuminata
MASTASKIPISVLIPAKNEEANLPACLASLEPADEVFLVDSQSSDRSIEIAENWGAKVVQFHFKGGWPKKKNWSLENLPFRNEWVLIVDCDERIPLELWEEMAQAIQNPNCDGYYLNRKVFFLGKWIRFGGKYPDWNLRLFRHQKGRYENLNTEDVPNTGDNEVHEHVILDRPAAYLKADMIHEDFRDIYQWLERHNRYSNWEARVYYNLLSGKDDSGTIGANFFGDAVQRKRFLKTVWVRLPFKPLLRFIWFYIIKLGFLDGKAGYIYGRLLSQYEYQIGVKLFELRQFGGQLNQLSAKPTAESPTLPEIKESA

SEQ ID NO: 535 - protein, 321 aa, Leptolyngbya ohadii
MLPLTVLIPAKNEEANLPACLESVSRADEIFVVDSQSDDRTIEIAESYGAKVVQFHFNGRSPKKKNWSLDNLPFRHEWVLIVDCDERITPELWDEIEQAIQNPEYDGYYLNRRVFFLGKWIRHGGKYPDWNLRLFRHAKGRYETLNTEGIANTGDNEVHEHVILSGKVGYLKEDMLHIDFRDVYHWLARHNRYSNWEARVYYNLLNGMDDRGTIGANLLGDAVQRKRFLKKIWVRLPFKPLLRFVLFYILRLGFLDGRAGYIYARLLSQYEYQIGVKLYELQQFDGQLNRKASEAASHPAKDSSASITSSSGLSPNGGSYE

SEQ ID NO: 536 - protein, 262 aa, Unknown
  Description of Unknown: Candidatus Omnitrophica bacterium sequence
MDKLPVSVVILTKNEEENIANCINSVLGWADEIIVVDDESTDRTRDIAKDLGAKVFVRRMDIEGRQRNWAYQQAKNDWVLSLDADERVSKELKREIEKIVVKKNCEFTNFTVNLRNYIGNYWIRGGGWYPAPKVRLFLKDKCRYEEAEVHPRIISKGKCGRINADLLHYSYKGWEDFLNSLNKQTSLEALKWYKLSLKDPKKARYKMNVIHALWRMLDRFIRIFFVKKGYRDGFIGFIVAYFASLYQILSYAKYRNLTKSFE

SEQ ID NO: 537 - protein, 266 aa, Curvibacter sp.
MSKISVYIIAYNEAEKVAATIESARWADEVIVVDSWSTDGTPEIAAKLGAKVVQVEFKGFGDLRNQAIAACSHEWIFSIDADERCTPEVAQEVRAIADHPASLDVYRVPRRNYFMGRWIRHSGWYPNFRQPQLFRKGCMSYDLKPVHEGYILHSARAIGTLQNAIWQFPFKNMGEVLHKANRYSTLGAEKIRHKKISMGTALTHGLWSFVKHYIFKLGFLDGWAGFVIALGNFEGTFYRYVKALEIQKGSAWKAPVTPTAATPRQP

SEQ ID NO: 538 - protein, 290 aa, Pedobacter sp.
MQKDFSFIILTYNEEIHLPRLLNSIKGLNAPIFILDSGSTDRTLKIAKEFNAVVKSNSFENHPKQWDFALKNFEINTPWIIGLDADQIVSKELFQLLEKFKDEDHKGINGIYFNRKNYFQGKWIKYGGYYPFYLLKMFRAEVGYSDLNENMDHRFIVPGKTIIWKNGFLEEDNLKENDLQFWKSKHQKYSDLIAQEELDRQNKIRTQTLKPNLSGSPDERRAWFKQIWWTLPLGIRPYLYFSYRMLFKLGILDGTKGIYFHYLQGLWFRLLVDRKIKELKLKNNNTPTSI

SEQ ID NO: 539 - protein, 252 aa, Winogradskyella epiphytica
MLKLSGVIITFNEERNIENCLQSLVNVVDEIVVVDSFSTDNTKQICKKFNVKFIEQKFLGYIEQKNFALSQASYDHVVSLDGDEALSETLQKSIIELKSHWKFDGYYANRFNNFCGQWIKHSDWYPNKKLRIFDRRKAEWQGTNPHDHVQLHDSTLKTGHLKGDILHKTYQTYSEFNLKTEHFSTIAAKAYYDKGKKAPLFNIIFNPTWAFFKSYFLRLGFLDGFNGFVICVQTANITFLKYSKLRELYQEK

SEQ ID NO: 540 - protein, 285 aa, Pedobacter yonginense
MNKNFSFIILTYNEEIHLPRLLESIKNLKAPTFILDSGSTDQTLSIAAQYGAKTATNAFTNHPKQWDFALNHFDIRTPWIVGLDADQTVTPQLFQLLNDFNTDDYAEVSGIYFNRKNFFQGKWIRFGGYFPFYQLKMFRNGVGFSDLNENMDHRFVAPGKTIIWKNGYLLEENLKENDINFWIAKHQRYSDLVAEEELDRIKNIKAQSLKPSLLGNPDEQRAWLKRLWWKLPLGLRPYLYFSYRIIFKLGILDGKTGMKFHYLQGFWFRRLVDRKIKRLKTALKI

SEQ ID NO: 541 - protein, 228 aa, Unknown
  Description of Unknown: Candidatus Rokubacteria bacterium sequence
EIIVIDAESTDKTAQLAREFTDKVWVRPWPGFPVQKNFALEQATGDWILSLDADERVSPELRERVRRILMVDGPADGYSVPRKNLFWGAWVRHGGLYPDYQLRLFRHGAGRFVESAVHESVAVQGHVEALAEPLLHHSYRGLEDFVARSNRYSTLAAVELTREGHRPRWTDLTLRPFARFFSMYVTKMGFLDGWRGFVLAVLYANYVFLRMAKAWESRGAGREDAGAP

SEQ ID NO: 542 - protein, 313 aa, Unknown
  Description of Unknown: Blastopirellula sequence
MTEGVETTIRAASGARERELSPGNVTDERVLPISVVIATKNEACNIEECLESVLWADQVCLVDSQSTDGTVEIAESYNAEVHQFHYEGGWPKKRNWALEHVSIRNPWILILDADERVTEELRSEIETAIKNTEIDGYYIRWKFMFFNRWMKHSWSHGWMLRLFRHGKGGYEDLGMRGEGGWDAEVHENVVVEGQCKRLKSPLLHETRQDLEYWIRKQNEFSTWNAKRRLQQLSDHMLPLSYLWDGDPIHRRRWLKTLYIRLPFKPLLMFIYLYFVKCGFLDGVAGFYFCVLRAIHEFNIDAKVYEARRNTNGS

SEQ ID NO: 543 - protein, 256 aa, Unknown
  Description of Unknown: Flavobacterium sp. ASW18X sequence
MDRTEKITALLITLNEEKHIKEVLENLSFCDEIIVVDSFSTDNTTKIIANYPHVKLIQRAFKNYTDQKQFALDQATNNWVLFMDADERVTPKLKNEIEVTINLKSPAAAYYFLRTFMYKNKVLRFSGWQTDKNYRLFQKDKVKFVKDRIVHETLEVNGVSKTLKNKLIHYSFNSYSTYKDKMIKYGEMKAKEAFFNGKKARWYHSIFRPFWKFINHYILRFGFLDGKRGIVICYLNALGVHSRYKELKRLQKSNLK

SEQ ID NO: 544 - protein, 253 aa, Prevotella sp.
MNEKNKISVVINTYNAEQHLDRVLTAVKDFDEILICDMESTDHTLEIARKHHCRIVTFERKQYNIVEPAREYAIHEASNEWVLVVDADEVVTPALKNYLYTLVQQEHCPDGLFIPRKNYFMGRFMRCHYPDHILRFFRKDKTHWPAIIHCVPEVAGRVEKIPAKRKELAFEHLANDTIENIVYKTNQYTRNELERKQHKHYGTMAFFWRPFFRFFKTYILKGAILDGRPGFIKAVLEGYYQFIFLAKKYEQSI

SEQ ID NO: 545 - protein, 454 aa, Clostridium sp.
MIDQEGILVKIKINLSQCMIVKNEEKNIRKALNWGKNIVCEQIVVDTGSTDRTVEIAEEMGAKVFHFEWIDDFSAAKNFAIEQATGNWIAFLDADEYFSEEDTKKILPLLAQLEEERRKLKIPLMVRSSLANLDDEGRTSSIATQARLFSNVKSLRYDGRIHETLMIGGTKAPKAFEARDILTVYHTGYTDKVYKETKKMERNISILKKEVEKNKDNYEAWAYLGDSFLANKQMKEAEEAYNYVVENMSFEMFQERRDFVFCNLLKINYYRNKKDESVILDIYHKSVEFACLAPDAEYWVALWMLDWGKLQQGIEYMELALRRLEVYDRDGNLDMAGSLPNVYGRLFEACKSLNRAQEAVRYGTLYLRMEPYGESVLIEMIRLFKGGANGEEIATAILSFLSKLYDLSRSKDKLFLIRISRKLMFDELEKGVLNLLTQDEKEFLHENQSTILGM

SEQ ID NO: 546 - protein, 248 aa, Unknown
  Description of Unknown: Verrucomicrobia bacterium sequence
MSERSNTRVPLSVLVPVKNEAANLCDCLASVAFADEIVVVDSASTDGTQEIATAAGARVVQFVWNGKFPRKKNWALENIPWRHEWVLIIDADERITPELEREISLAIRHSDADGFYLNRRFWFLGGWINHCGYFPSWNLRLFRHRLGRYERIEIDDNVRSGDNEVHEHVLLNGRAEYLSVAMEHYAFPDVASFIEKHNRYSTWEAEAREQLYQGAGQNTLRATPFGTALERKRWLKKLSVGCSRGTSS

SEQ ID NO: 547 - protein, 380 aa, Unknown
  Description of Unknown: Acidobacteria bacterium sequence
MSRSRASSKFRQSRTTTSRSSTSRRCRKCRSAVAAARSRPQGRAPFRRVGRRSSDSSWAGRAGRAGGAGRAGRVRRRNHPAHLPIPPIPPILPIQPSGYTPRVPKLSVTVITKNEAAGIDDALASVAFADEIVVVDAFSTDETVRIAKRHTDRVIVRDWPGYIDQKNYAASIARYDWILSLDADERVTQELAGEIRSLMSGAPREMAYRIPRVTFHLGRWIRTTDWYPDYQLRLYDRRAAQWTGRYVHEAVTVRGEIGRLRGELQHYAYRDISDHLETIDRYTTYAARQMHEVGRKTSVLQIAGHPPLAFLRNYLAHGGIRDGVPGLIISVLNSYYVFLKFAKLWELQRTAPHSRATRSQQPVTSNQQPATSPRDVLPSR

SEQ ID NO: 548 - protein, 295 aa, Achromobacter sp.
MQKIPVSVVVMTKNEERNIAKCLKALAEFDEVFVIDSRSTDATCALAASLGAKVVDFQWNGKYPKKKQWCLEQLPFSHPVVLYVDADEEMTPALAREIRASLPRFEAGAGGAFVPFDYVFCGRKLRHGHRVYKLALLARDRSRFLDYDDLDVAHMWEVEGHYQPQVQGQTFALREPMVHNDHDSLFHYFDKHNRYSDWEASLRVKGLMNDPREANLGGRALLKRLFHALPFKAPISFLHSYVFRLGFLDGKAGFDYAVARAMYYWQIRIKTEEIRKARQACAEDGDDKVVAGAAK

SEQ ID NO: 549 - protein, 260 aa, Unknown
  Description of Unknown: Candidatus Enterovibrio escacola sequence
MKHSQQRASISAIVITKNEELILPECLASLDWVDEIIVVDSGSTDKTVMIAKNSGAKVYVTVEWFGFGKQKQLAQSYATKDWILAIDADEVVSLKLKNRLLSMLKNPPKNTLVEVNELTWVFGRFLRHSGWYYSHVRVYPRDFTQYDDALVHEKVIVPHNAKTIVIDAELLHYSYRDLTHYLVKSASYAKAWADTRQDKREKISIGQGIIHAIGCFLRMYVLKLGFLDGKQGFLIALLSAHSTFIKYAHLWVLNNDSRVH

SEQ ID NO: 550 - protein, 250 aa, Unknown
  Description of Unknown: Deltaproteobacteria bacterium CG_4_10_14_3_um_filter_60_8 sequence
MSLPISVILLTLNSSATLRPCLDSLRAFAEVVALDNGSTDDTLAILAAYDNVKVYQHPFIGFGALRNLAIGHATYDWILGVDSDEMVSSELCQEIASLALDPQVVYAVPRLNHYQNQPLRGWGWRPDRVIRLFCRRTTGYQDEQVHESVAIPRGVTIGQLKAYLLHYPFNNPGDIIDKMQRYSSLFAAQHRHTGKSATPAKAFSRLFTTFLTDYLLHGYIRDGYGGLLLSVGNAAGAFFKYCKLYEMNRP

SEQ ID NO: 551 - protein, 263 aa, Unknown
  Description of Unknown: Flavobacterium sp. LB-D12 sequence
MTNNHNTNISVLIITLNEENQMKSLLADLEFADEIVVVDSFSSDKTESICKSFQKVTFIQNKFENYSSQRNFAISQAKNDWILFLDADERLTPALKNEIITTVNTNKTYSAFMFYRTFMFEDKVLHFSGNQNDKIFRLFNKNNADYTKERLVHEKLKVNGKIGVLKNKLIHYSYSNFQAYKAKTIRYGKFKAQEKFIKKQKSSFLLRFLHPTYNFLFNYIVRLGFLDGKKGLIICYLNANSIHVRYQELEQLWKTEKKLSPKQ

SEQ ID NO: 552 - protein, 264 aa, Maribacter sp.
MMNNREKISALIITFNEIGYIEKCLESVSFADEIIVVDSFSTDGTYEYLLNHPKAKVIQNPFENFTAQKSFALKQATNDWVLFLDADEVVPAPLKREILETVSKESEIVAYWFYRQFMFQNEKLRFSGWQTDKNYRLFRKSKAKFSDRRIVHETLDVEGTSGILTEKLIHYCYKNYEDYKSKMLNYGRLKAIECFYRERKFNYAAMYLKTGWKFFNHYILRLGFLDGKKGYAICYLNALGVLERFRELKRLEQKNELAYYLVMP

SEQ ID NO: 553 - protein, 315 aa, Scytonema tolypothrichoides
MSFKLPVSVLIPAKNEQANLPACLASVQTADEVFVIDSQSTDKSVEIVQSYGANIVQFYYNGKWPKKKNWSLENLPFRNEWVLIVDCDERITPELWDEIAQAIQNPEYNGYYLNRRVFFLGTWIRHGGKYPDWNLRLFKHKKGRYENLETGDVANTGDNEVHEHVILDGKAGYLKNDMIHEDFRDLFHWIERHNRYSNWEAHVYRNLLTGKDDSNTIGANFFGNAVQRKRFLKKLWVRLPFKPFLRFVLFYIIQRGFLDGRAGYIYARLLSQYEYQIGIKLYELCQYDGRLNTTCTTTSKEPHLLVGVGESRPRR

SEQ ID NO: 554 - protein, 298 aa, Unknown
  Description of Unknown: Nostocaceae sequence
MFSIYILTYNEELDIASCIESAMLSDDVIVVDSCSSDRTVEIANRYPIRVVRHAFESHGRQRTWMLESLPPKHKWVYILEADERMTPELFAECEQAITTSEYIGYYVAERVMFMNQWIRHSTQYPRYQMRLFQHGKVWFTDYGHTEREVCEGATSFLKETYPHYTCSKGLSRWIEKHNRYSTDEAKETLYQLENGKVDWRDLLFGKSEVARRRALKDLSLRLPARPLLRFLYMYFLLGGCLDGRAGMAWCTLQAFYEYLILLKAWEMKYLPIPSLEPEIVPSSDSNQEAAKEELGSRD

SEQ ID NO: 555 - protein, 253 aa, Actinobacillus minor
MPTLSVAMIIKNEAQDLAACLDTVKGWVDEIVILDSGSTDETAQIAEQYDAKFYINADWQGFGKQRQLAQQYVTSDYVLWLDADERVTPELKHSILQAVKNDEQNTVYKIGRLSEVFGRQIRHSGWYPDYVVRLYPTTIARYNDSLVHEKVVFDSATKVEKLQGNLLHFTYKNITHYLTKSAHYGSEWATQRVKQGKKVSLFSAFSHALSSFVKMYLLKKGFLDGKQGLLLAVLSAQSVFNKYADLWVRGQGK

SEQ ID NO: 556 - protein, 272 aa, Unknown
  Description of Unknown: Candidatus Omnitrophica bacterium CG_4_10_14_0_8_um_filter_44_ 12 sequence
MAKIPLSVIILTKNEEGNINECLDSVKGWADEIIVIDDFSNDNTVAIAQGLADKVLIKKMEVEGTHRNWAHSQAKNSWILSLDADEKVTPELREEITSALPATGHACFSVPLRNFIGGYWVRYGGWYPAGKVRLFKKEKFRYEDVGVHPRAEVLGSCGHLKGDIIHKGYPDFEHFLASLNRQTTLEAQKWIITNRKMNGGWAAWRAIDRFFRRFIGKKGWKDGFIGFMVAFFDTLYQIMSYAKYRQMLLEKAENRKQRTENRERKTENEKQQ

SEQ ID NO: 557 - protein, 316 aa, Hydrocoleum sp.
MTSSKIPVSVLIPAKNEQQNLPACLESVARADEIFVVDSQSSDRSAEIVESYGANLVQFYFNGTWPKKKNWSLDNLQFRNDWVLIVDCDERIIPELWDEIAIAIQDPNYNGYYLNRRVFFLGKWIRHGGKYPDWNLRLFKHKEGRYENLKTEGVRNTGDNEVHEHVVLTGNVGYLKNDMLHEDFRDLFHWIERHNRYSNWEARVHYNLLTGQGDSGTIGASLFGDAVQRKRFLKKIWVRLPFKPFLRFILFYFIQLGFLDGKAGYIYGRLLSQYEYQIGVKLYELKDCGGQLNVTEKKAQTTNPQPVAQVDSASSS

SEQ ID NO: 558 - protein, 274 aa, Citrobacter freundii
MLDLTIAIPVKNEERNIKGCLECIGEQFVKKIVLIDSGSTDATLEIARSYGAEIIDFKWNGKYPKKRNWYLENHQPDTKWVLFLDADEYLTPAFKNSLRHAISSDDKEGFWLNYTIYFQNKILKGGYPLKKLALFRVGNIRYEKIDEESWSGLDMEIHEHPIVSGKTGQIKARIDHQDFRGIDHYIKKHDEYGTWEARRFLRLRNNNAIWNDLTWKQKMKYRLMNTPYLGPMFFIGSFFFMGGFRDGRRGFTFSLMKMSYFTQIYCKIREYKKN

SEQ ID NO: 559 - protein, 626 aa, Paenibacillus sp.
MTYTISLCMIVKNEEKVLEKCLNSVQSKVDEIIIVDTGSTDRTLEIAEKYQAKIYSFEWINDFAAARNYSLDQATSDYLLVLDADEYLEEQSDLKKDIAEFKDYYIMRIKNLLSNNRVLTHSSIRVFKNEKRLRYKNRLHEHLDIDQLENELSRGESDAIVQHTGYTDEVMEEKDKRNRNMPLMQIEVKENPTSYNLYNMAKLYMNIEEYDKAFEYFKKAFVGSENRMYQPELLTKMASCLDQLGFIEDGLKVLEDAVELYPEDTGIWNERGNLFKKAGYYRDAELAWLHCLAIGDNGITVNEGVGSYIAYFNLAVLYDMQGKLLQSYEMIVQSIQFNIAFVPSLNKYFEIVLKANIPLDDIYNNFNLLYNVASVEELQRLLDLLYTLRHPLLHQYIENKNIVAEKHVSAISYQYIKQYDLAQKYWGEVEEVAEENAIDLITLAFIKKDIELLIRAKSIINVSEKEYKIIKLLFDNQNTESQKLSANIKNILIDIFDKLIYLQEFDVLQTMANLLSETNSEFQYRFGKLLSEKGYSEAAIDVLIKAYNQNEGNIDINILLGDLCISSGYLEDAQLFYNKLIKLKPEYSSYERCYNIAEKMNDVPKMVEMQSIIKEKYPLSKWITTV

SEQ ID NO: 560 - protein, 276 aa, Unknown
  Description of Unknown: Flavobacterium saccharophilum sequence
MNKIPISVIVSVKNEALNLPSCLDKLKRFDQIIVVDSCSTDDTPIIAKAMGAEVLQFQWNGKFPKKRNWALQNADLHHEWILFLDADEFVSDEFVTEVGIKTQDPNYNGFTIRFENYFMGRKLKYGYGFQKSALFKKSKGAYEKIDEDLWSHLDMEVHEHPIIQGKVGVIKSKVIHKDFKNLEHYISKHNAYSTWEAQRYLQLKQTKNTLLSFNQKIKYSLINTGLLPAVYFFGAYFLKFGFLDGKEGFYLARFKSHYFFQIQTKIDSFKNNIELK

SEQ ID NO: 561 - protein, 406 aa, Unknown
  Description of Unknown: Candidatus Brocadia sp. BROELEC01 sequence
MFYNYMKQLSACLIVKNEALLLPYCLESITPVVDEIIVVDTGSTDETIKIAKKYCAQVYQFSWTEDFSAARNISLMHASGEWILYIDADEAIDSVNALKIREAIKRKDIMGITVRQCIPQQTNNIATAYYIEYCRVFRRHKDIRFVGKVHEQILPSIERLEGKVLRTDIVFNHWAYAITNEKKKARAERNLRYLLDELKNVQNDPFLYFNLGTTYCELGKKDAAILSLQQSLVLDNGNIKRELIGQVHLSLAKLYLELDNFAKAEYHARMVSSYDPVNPLSAYVLATVAVLNKQYKTAIFHLEKAIQITRGESGSCPSIELNLAQLYLELGSCRSASGDLLDAEKDLVRSLEYDSSRALPYVLLGNCRFLHGDINQAQKLYEHALAINPSLESASNGLALCRTHNK

SEQ ID NO: 562 - protein, 248 aa, Legionella sp.
MLSVIIITKNEEANLRRCLESICWADEIIIMDSGSTDKTLEIAKEFTDLVYSADWEGYGIQKQRALDKATGSWVLNIDADEVINDALKDSIRQAIATDNADAYRIPIRLHFYDKTLKFSWSPKNHIRLYKREGAAYTDKIVHEEILLPQSARIGKIKAAIEHHCIQDVSHALYKMNLYTTYSAKINIEKNKNPSLIKSILSSWWMFFRCYFIQGGFLEGKDGFLLAVLSAHGSFYRGVKVIYLDKELQ

SEQ ID NO: 563 - protein, 257 aa, Ilyobacter polytropus
MKLSVGIITFNEAKILPLTLKAASKVADEIVIVDSNSSDGTVEIARNLGAKVYDEEWKGFGPQKNSVIEKCNGEWILLIDADEELSEDLIKKINKIKNGIYDYQVYQINRCSICFGKELKYGGWSNQYATRLWKKGSVKVSDNLVHEDYITDCEIGKIKEKINHYSYITMKDYFDRFNRYTTLGAEEYYKRGKKSGILKIILNPMYKFFRMYFLRLGFLDGIEGFVIACTSSMYSMVKYFKLREIYRNGAYVENKNS

SEQ ID NO: 564 - protein, 247 aa, Unknown
  Description of Unknown: Candidatus Azambacteria bacterium GW2011_GWA1_44_9 sequence
MSLSIIMITRNCSEVLNETLESIEGLWKELLVSDQNSTDGTRDILEHYKASIIETESDNLGKRKQELVKKAKGDWILVLDSDERVSAELREEIKTKIHGSRLGGRDDKPEAYRIPYQNYVFGRAVYWGGERYSKVRLFRNGYGNVGKIPLHEEITVDGKIGEMKGVIHHHSYRTISQLFRKFTSYALIPARFKKKRVTFAKLFLYGPHMFWARFIEEKGYKDGLHGLVLAIAFGYMETLTYWMLLLY

SEQ ID NO: 565 - protein, 245 aa, Unknown
  Description of Unknown: Bacteroidetes bacterium sequence
MASLTVIIPTFNEEAYLEAALRSVQFADEIIVVDSFSTDDTPNIARIYATHFLQRKFDNFSDQKNYALEHATSDWVLFLDADERITYSLQIELKHAIETGKHGGYKLDFPHFYMNRFLYHHNNKVLRVVKRIGTHYTGLVHEKLHCEGSIGQLKNPVLHFTYRGLEHYIAKKESYAWIQAEQLHKKGKKTTLLLLFIKPTYRFFSSYFLKGGFRDGVPGMVVSAVNAYGVFTRYVKLILLDRATK

SEQ ID NO: 566 - protein, 283 aa, Unknown
  Description of Unknown: Acidobacteria bacterium sequence
MILDVVNPAKAPVSVLVLTRDEAANIGECLESLRWADEVFVVDSLSTDRTAEIARALQAKVHLHPFVGYADQRNWALQNLPFAHDWVLMLDADERIPKALADEISVAVSRQDTYSGFYLARRIFFMGTWLKHGGLYPTWLLRLFKRQRARVEERPVNEHVIVNGSVGYLAHPFDHADRRPLGDWVTKQNRYADLQTEEYLREKSRLGFTSSIRANLRGSQAERKRWIKLRIWNRLPLLFRPFLFFTCNYFLRGGFLDGRAGFIYHILWSFWIKFLIDVKVMER

SEQ ID NO: 567 - protein, 289 aa, Unknown
  Description of Unknown: Candidatus Protochlamydia naegleriophila sequence
MIRLPISVTILTKNSQKYLKEVLEALASFDEVLICDTGSEDNTLLIAQEFPNAVIYKRSFIGFGPTHNIASSLARNDWILSVDSDEVVTGELAKEIADLKLAAGHVYSFPRHNEYRGKWIKWCGWHPDRQIRLFNRAETRFTDAQVHESIIIEHLKHVHLQAPLRHYSYDKVADFLTKMQSYSTLFATQYQGRKHSSFGKALSHGSFSFFKSYILKRGFLGGQEGFEISFYNAATAFYKYLKLAEANRQLELEGLEKCGDGQTKKLAASKPLHQATPNQAPPSGEHKQK

SEQ ID NO: 568 - protein, 255 aa, Arcobacter lanthieri
MLIDNISVVVLTKNNENTIENTLNSLQDFSDVVIYDNGSIDNTIKIAKSFLNVNLVEGEFKGFGWTKNKAASYTKNDWVMIIDSDEVVNNNLLNCLRTQKLENNTVYRLNSNGYYKNTRVKYCGWTLTVKRVYNKKVTSFNDEDEVHEHILSDGLNENILSGNINHYSYSSISEFIIKADRYSTLFAQNNVGKKSSSPTKAFFNGLYSFIKTYIFKQGFRDGYIGLIISFSHMVTNFYKYIKLYELNLEEKKSKK

SEQ ID NO: 569 - protein, 254 aa, Unknown
  Description of Unknown: Flavobacterium sp. sequence
MEFTRTNKLSVLIITLNEEAHMHELLSDLDFADEVIVVDSYSKDRTKEISTSFGNVKFLEHTFENYTAQRNFAIDQAKNNWVLFIDADERLTPELKQEIIETVNSDTDVSAFLFYRKFFFKKKTLHFSGWQTDRIFRLFKKDKARYTYRRLVHEKLDVEGKVALFKNKLIHYSYSDYESYKGKMIAYGKLKAKEKLFIGFNPNFIHYYGHPLYTFLYQYLIRLGILDGKKGIIICYLNALSVKARYIELKKLKL

SEQ ID NO: 570 - protein, 258 aa, Simkania negevensis
MISATILTKNSEETLSTCLKALEGFNEVIVLDTGSTDLTLDIAQTFSNVKVFEAPFEGFGPLHNLAAEHATSDWILSLDSDEVLSDELSKEILALNLKPDCVYSFPFHNYFNGKHIRGCGWFPDRHIRLYNKTATQFSDDYVHEKILTKGLKEVKLTHAVKHYSYRSISDFLKKMENYSSLYAQQNRQKKSSSLLKALLKSSYTFFKSYFLQKGFLDGREGFIISNYNAQTTFYKYLKLEELNLSDATLSTLSPRRKR

SEQ ID NO: 571 - protein, 254 aa, Unknown
  Description of Unknown: Photobacterium leiognathi sequence
MILISVFIITKNEEKHIRKTLNSVKDMDEVIIVDSGSTDNTLSIAESFENVKIFHHKWQGYAKQKQYAMSLCKNEWVLNLDGDEELTPGIIEAFKKIINDNSADSVRFWRNDFFIGEGLSPLSKKPNNHRLYKKSKSFFDNSRFAHESATVDGKEIFINETFNHYGYPSISIRTDKNNTYSSLKAEEKHHKRKKHSTLKLVTIFPLTFIKEYFFQRKFFSGKRGFILSIIESYYAFLKEAKLYELYEKENKNEF

SEQ ID NO: 572 - protein, 249 aa, Unknown
  Description of Unknown: Candidatus Curtissbacteria bacterium GW2011_GWA1_40_47 sequence
MKISALILTKDEEEMIDDCLKQLSFADQIIVLDQNSRDKTVGIARKYTKDIFETKEEGFDKNRNTLAKMAKGDWLLYVDADERLNETLVKEIKTAIYEDKYAAYYFPRKNIILGKWLRHTGFWPDYVPRLFRGTNLVKWYGKVHESPQITGNFGYFKMPLSHFTAQSMSKMLNKSIKWAKIEAELSLKDKHPQVTILKVVKGMLFEFINRYFVKKGFLDGTVGLIESIYQAYHKAMVLTYLWELQTHDE

SEQ ID NO: 573 - protein, 247 aa, Arcicella aurantiaca
MQLSVVLITLNSEKTLTKVLEAVSWADEIVLVDSGSTDKTLEIAQQFKAKIVHRAFDGYGSQKNFATEQASHDWILSLDDDEILTPELQKEIQSLDLQNTNFQGFKIPRSLIFLGKLLKFSGEYKRNTLRLFNRKCGNWNAEYVHESVEVKGEIGTLKNQILHDSYRDLTDFFNKFNKYTSLGAKTLAERGKTTSTFKIISRFPTTFLKIYFLKGSFLDGYAGFMWALFTAITPVVKYAKLKEMVSK

SEQ ID NO: 574 - protein, 251 aa, Sulfurovum riftiae
MIDKISVTILTKNSEKYLKQCLDALKAFDEVLILDNGSNDKTLEIAAGYANVTRIKHPFIGFGPMKNLAAEKARNDWIFSVDSDEIASEALIAAIRELDPVQVNRVYTIDRLNHYNGKPIRCCGWYPDTVIRLFNRTYTCFNDAMVHESLVLKPDTQKTVLAGELKHYPFDDIGSLISKMQSYSTLYAQQSEKTSSPLKAFGRATFAFFRNYFLQKGFLCGYEGLVISVSNANGVFYKYMKLYEKQCGDQL

SEQ ID NO: 575 - protein, 528 aa, Selenomonas sp.
MKISVCYITKNEEKNLPSSLEGIKAIADEIIIVDTGSTDKTLAIARAYGAKAYSYAWQDDFSGPRNYAIEQAAGDWIIFLDADEILKHSNRQRLMDWLRDNGKQLVLMMWMKHIDMDTGQILMENMAPRIMRNHKELRYVGKIHEQLFFQGKTVSKVGYCPISAGWLLHTGYTQSRMKKKAERNLRMLLPELELDKPSQDVYMYLAEAYDGLEDWEHAVYYARKDIEQGRRSIIYASRSWMLLLRLYAKYPEYIQERLQVVLSAVKNFPELPVFHAELAECYVSYANFAGAYRSFERALHLCENYRHGLEPQLLTLEQMKQIEQRMRAVKKQIHYPEQWDLARQQEILELHKQNRIAISKVLPELIELIIRLQQERPTAKRDETLIRLISYLPVDYEAFWQYQLGLLDVMPINMTDTYLTMLVYVLRYGDAEQWHYYTEQSLRMTADCFYKTINLLLEQERWQIAWSLLEQIPADSDWIQAEYWYAAGVCLFYRHENLLALECFSRAKNAGMQNNEMDSYIKWAGDET

SEQ ID NO: 576 - protein, 254 aa, Anaerovibrio sp.
MSKLTILILAKNEEKNIEDCVKSALFADEVLVIDDFSTDNTVKIAEELGAKVIQHSLDGNWGQQKTFGINEAQGDWIFFLDADERITEVLQSEIIKAVSSGEKIAYYIARLNHFCGNVVKYSGWFPDYGIRLIPKEGSYVTGYVHEQVHYNCPEKYFPKSAYMLHYTYVSWEQYLRKLNNYTTLGAKKQYDAGKRAGILDIVFHTLFGVIKIFFIQRAFMDGMTGLFLTVGHGISVFMKYTKLYYLSKGIGEKS

SEQ ID NO: 577 - protein, 254 aa, Unknown
  Description of Unknown: Chryseobacterium sp. FH1 sequence
MSELLEKISGLIITFNEEKNIREVLECFDFCDEIIIVDSFSTDKTLEIANEFPNVKILQNKFEDFTKQRNLALDMAKNDWVLFLDGDERITPQLREEIIAELYKTDKKDAYYFYRKFFFEGNPINYSGTQTDKNFRLFRKSKASYIAEKKVHETLEVNGEIGELKNKLLHYSVANKDSYRKKMIHYGTLKGMELAQKGKKYSIMAQYSKTGFRFFKGYILRLGFLDGKFGYILNKLQAISVWETYESLKRENSR

SEQ ID NO: 578 - protein, 275 aa, Olivibacter sitiensis
MVSIIILTKNEEQDIDLCLKSIAWCDDIHVLDSGSVDKTIEIAEKYGAKIAFHPFESFGKQRNYALEHLNVKYDWVLFLDADERSTPAFRNALEVAISNAGGDTVGYYCCWKMILEGRWLKRCDNFPKWQFRLLKLGEANFIDFGHGQKEGSINGKLAYIKEPYLHYGFSKGWTFWIERHNRYSSQEAKARLYEKRPFKDIFNSNTSIRNPALKSWLSNLPGWPLLRFFQAYVLKLGFLEGRQGFVYCVNMAYYEFLIKIKMKEYKSNLQNHEIT

SEQ ID NO: 579 - protein, 252 aa, Unknown
  Description of Unknown: beta proteobacterium L13 sequence
MSEALSVVLITKNAETQLEKCLQSCAFADEIVVVDSGSTDRTLAIASAYKAKVIHQDWLGFGPQKQFAVAQASHDWVLCLDADEWLSDKLRNEIMQLLENPGAYAWRFARSNKFMGRFLKFGEGYPDYSLRLFHRQHARWSDDAVHEYVQTNGKVGTLAGDLMHESGEDIALYLSKQNRYTSLQAEALYQRGKQCGLAKLVFSPLTRFIKFYLVRQGFRDGLPGLVHISIGCFNSYIKYAKLIELHRLGKTR

SEQ ID NO: 580 - protein, 251 aa, Unknown
  Description of Unknown: Nitrospirae bacterium sequence
MSKLSVYVITYNDEPNMRACLESVAWADELIVVDSHSTDATEKISREFTDKVFQHEFKGFGQLRNEAVAHTTHDWVFSLDTDERATPEIRDEIRWTLERGPEADAYFVPRRNYFLGRWIRHCGWYPDYRQPQLFRKSRMRYREELVHEGFELEGRAGYLKAHILQYPFRDIDHYLTKMDRYSDLMARQMVEQGRRFRTHQLVTHPLFTFLKMYLGRAGFLDGMPGLILSGLYAYYTFVKYAKLWERCRASA

SEQ ID NO: 581 - protein, 245 aa, Unknown
  Description of Unknown: Candidatus Sulfopaludibacter sp. SbA3 sequence
MKITATIITLNEERNIARAIESLRCCDEILIVDSGSIDRTVELAEKLDVRVIEANWRGYAGQKNWAAEQATHEWILSLDADETLSEPLEAEILAMKKSGPRFDAYTMPRLARYLGRWILHSGWYPDRKVRLYDRRKARWVGDFVHESVIPDGRVGHLEGAILHFTCESLSEHVKTMDRYTTLAAQELAARKLTVPLSKMIIDPAWTFLKTYFIQRGFLDGVEGLIIAYMASYYTFLKYSKARIMS

SEQ ID NO: 582 - protein, 263 aa, Unknown
  Description of Unknown: candidate division Zixibacteria bacterium sequence
MNRISVVIITKNEEENLSRCLDSVRWADEIIVVDSKSTDRTLEIAEQYGAKIFRPEWRGFGPAKQEGVRRAGGDWILSIDADEVVAPELAQEIKAVTLTDDGIIGYYMPRRTQFLGRWINHCGWYPGWVLRLFRKDSGDFDDALVHEKVIVKGNTARLKHDLLHYSFPTIDVYLEKQWEYAELGAQQAFRGGRRSGALAVVVRPLASFVKHYVLKRGFLDGIEGFLISALAAYYVMVKYAKLRNLAQQSKPMALEETNTDADN

SEQ ID NO: 583 - protein, 261 aa, Cupriavidus plantarum
MKISAVLITKNEAHNIAECLASVSWCDRAIIVDSGSTDGTVEIARSLGADVYQTDTWPGFGPQKNLALSKVQTEWALSIDADERVTPELRDEILAAIESGNADAYEMPRLSRFCGRFIRHAGWYPDYLTRVFRVGRARFTDDLVHENVVADSPVARLRTPLLHYTYDDFSQVLRKIDQYSTLGAQQAFRRGKTATVAGALGHGFWAFLRTWIFRRGFLDGAQGLGVALMNGQASYYKYVKLWLLCQQARQQDDRSATPPRG

SEQ ID NO: 584 - protein, 250 aa, Thermodesulfovibrio yellowstonii
MKIPISIAIITKNEEKNIEDALESVKDFEEIVVVDAFSEDRTVEICKNYTDKIYKLEWKGFATQKQFAVEKTTLPWVFILDADERVTEALKMEITEKISNDDFDGYFIPRKNFFLGKWIKHSGWWPDYTLRLFRKDKGKMQIREVHEKVIVNGKVGYVKEPILHYTYQTFEDFIKKMQIYSSYGALELIKKNPSKCKIVLKIFFAPVFTFFKMFFIKLGFLDGLRGFILAFFYSFYSFLKYAKVWEKQWK

SEQ ID NO: 585 - protein, 250 aa, Unknown
  Description of Unknown: Flavobacterium beibuense sequence
MSTKITALAITYNEEENINRYVKSLSFADEIIIVDSYSTDATEKLANELNVKFIKNEFTDFSSQRNFAIEQASNDWILFFDLDEIVTPALETEIKQAVENKDGIVAYFVKRKFHFMGKHIRYGGWRTDKAVRVFNKKHCKYTGLVHEVISAKGRVCTLREKVDHYSYRSFDNYNNKLNLYSKLQAENLYGRKVRPNAYHFLFRPFYRFCWQYFYRLGILDGKEGFILAYIHSFSVFKRYIQLWMKYRKIN

SEQ ID NO: 586 - protein, 252 aa, Chitinivorax sp.
MPNKLSAILITKNAAHQLPACLSSLQFTDEIIVVDSGSTDNTVEIAIQHGAKVIHQTWLGFGKQKQLAVNHSSHDWVLCIDSDERITPTLRDSIQAILRSPLHMAYRMPRSNCFMGRFLKHGEGYPDWNIRLFNRQFAQWSDDVVHERVMHTGRVGTLAGDLLHESSEDITHYFDKQNRYTTLQAQTLFEHGKKSGVTQLLLSPIFRFVRFYLFKRGFLDGVPGLVHILIGCFNSFSKYAKLIELHRLHKRP

SEQ ID NO: 587 - protein, 249 aa, Desulfovibrio oxyclinae
MRVTGLVLTLNGERLLERCLRSLAFCDQVLVVDSESTDRTVEIAESCGARVLVNPWPGPVEQFRFAFANIETDWVVSLDQDEVITDELRGSIEAALADPGEHAGFYTSRSTWYFDRFMKHSGWYPDRLLRVFNKDRMALSASGAHYHFRPEGPTRNLDGDILHYSYRNFFDHLDKINYYAQKGAEDLRAKGRRGGVTPAITHGLGRFFKLYALKKGFLDGRAGFINACAGAFYAFQKYVRIEEKGDWDG

SEQ ID NO: 588 - protein, 851 aa, Thermotoga caldifontis
MIVKDEEHNIRRALDSIKDVVDEIVVVDTGSTDRTPQIVREYTDKLYFHPWKNDFSEARNNSLKYPTCEWVLILDADEEASEDFRKNIRSFLESLPPDVNTIYLPTLSYLDWDFKRSEIASTPRIFRNGTVYYQNIVHNQAIYKPKVVNANFLIYHYGYIWTRKLKKQKYERTGSLIRKHLQQCKNDQERLYYLVQLYKTEKTGGKPHEAASVGWEALQLIRKLTSIPAIGLEFLYLFSIDLLNAGLNELAEQLAKSALQAVPEYPDPYLSLIHASFKRKDWQALLKHYEDFRKAVEHASANVEKFGWTIMSFKDIPLADVLAMIAAIEIEDYERFNRIALERFEKDEDVREDMLQYLLNRSSGKDVEKALPGLKKFLEFARKKNLHLNAQPLYEKIVERRLPVKVEEIVLKQITPFSYYLLRRLETGEDMLLDFLCARQLEKLVRENGVGGFLFVYTVLPESEKKAFVERFLEDEDTLIRGIAKALHADHLLKESKFLEAIRSYRDSIQLVAELSRFVKPIVEDLKTRLDPTIESVYEELYRFYATQKEFMIDFKKYAGNEVSKLYLISDSDVALYVSAVHTDDAKKAVELLSKIKDPSKFPMYNYRLAKFYNEFDKEKAFVHHVKAVEENERLADIVFGRFFYSGLYPNLTMNFFDKNDPILWVGNVSEKFSTLGVIHPVRAWKKAKNGLIYAVPYPADESIKAYKDLEKEFGIKPSFRVTDSHLRKVLLETNWSNVEKTQELEDFARVFEDLGIELSQNAKRRIVLDGVETQLELKRLVSDAEEALIFHRFPNLSDENDPVWFYPAFRLLRSFAQIKKELSSLGYEIVDEFLFENGLRCVWVRRRTSR

SEQ ID NO: 589 - protein, 252 aa, Crenotalea thermophila
MQSISAIVITYNAAAHLRACLQSLLPVASDVLVVDSFSTDRTAEIAQTFPVRFVQHAWEGYGQQKNWAMEQVQHDYVLFIDADEVLSAELQQSILDARQQGLSGCYMLQRLNRYFNRWIYHGLEYPDHKIRLFDRRQATWSTDPVHETVVFHAEVQTHLLNGYLLHYTYQDMHTLWLKIDQYAQLGAKKLHQQGKKSSPWQWISHPFATFWKAYLLKSGWKEGTAGLLLAFLAAISVFLKYVRLWLKQHQLN

SEQ ID NO: 590 - protein, 253 aa, Unknown
  Description of Unknown: Deltaproteobacteria bacterium sequence
MEKLSVVVITHNEEDNIGRCLESVKWADEIIVVDSFSTDRTVQIAEKYTKKVFQKAWEGYGRHKNYALSKATNTWVLALDADERITRELADEIIGVLRAGDTQVIAYELPYKVFFGGKWVRHGGWYPEYHIRLFRKDKAAFKERAVHERVETSGPVGRLHHFVEHYTYRSVSDFCQRMDRYSTLSAEAYYKEGRRVGWFEALFRAWFTFGQMYILKRGFLDGGLGLQLAMLYSCYTFVKYAKLKELCQADKEK

SEQ ID NO: 591 - protein, 255 aa, Unknown
  Description of Unknown: Chryseobacterium sp. JAH sequence
MKLSVAIITFNEDRIIGKTLNAIHDLADEIIIVDSFSKDCTEEICAQFPNVKFITQRFLGFGKQKNFAIEQCQSEWILFLDSDEVLDDEAKKSIRKIISEDQPEFNVYDIEFNNIFLGETLKYGGWGNIKRERLFRKGFGKYSEDIVHEEFISSEKKGKLAGKINHYTYKDIYHHIEKSNKYTSMMAEKMYKNGKKSSVLKIIFKPLYQFIKSYFLRLGFLDGLVGYYAATTAAFYTFLKYKKLHEIHKFGHKEC

SEQ ID NO: 592 - protein, 271 aa, Leeuwenhoekiella sp.
MNKIPVTVLVPIKNEEINLRKSLPLLTDFDQILILDSQSTDESLSIAESYGAEIHQFHWNGKFPKKRNWALRNLEIKNDWVLFLDADEYVTPEFIEELKVAITKPDVQGYWIVFRNYFMGHQLKHGDQFKKLPLFRKGSGEYERIIEDSWSHLDMEVHEHPILEGVVGDLKAPILHNDYKGLEHYIARHNAYSSWEARRFIKLKESGFEGLNSRQRLKYKLIALGIMPFAYFWGNYILKAGFLDGMAGYYFSKYKANYFFQIQTKIKELTS

SEQ ID NO: 593 - protein, 283 aa, Leptospira sp.
MHIPLSVCIITFNEEDNLENCLSQLEFADEIILVDSGSTDKTLTIAKQYNAKISYRKFDNYIKQKNHAISLAKNDWILALDADEVISPALKEELHSLKVEDFESNSAFAIPRLTYYLKKWIRHSGWYPNYQVRLFHKKKGNFAGILVHETVEIKGNSKKLKNPLFHYSYKSISDHLAFIDRYSTLFAIEKFKSGKRSTIGKAILKSYYKFFWMYFIRCGFLDGSVGIAIAILGSYYNFLKYLKLYELGKDEKSISPLFVVVDSIHEVESNKATQENSDQVYIR

SEQ ID NO: 594 - protein, 261 aa, Unknown
  Description of Unknown: Chryseobacterium sp. HMWF028 sequence
MPLSLAVITYNEEENIVRLLSSLADTADEIIIVDSFSTDKTKEICAQYPQIKFFEKKFNGYGEQKNHALNLCTHEWVLFLDADEVPDEEMKRSIKKIISSGNMEFSVYKAKFNNHLGTHLIRHGGWGDVCRERFFRKKCARYSNDKVHEFLITDQKSGLLEGKLDHYTYKSIYHHVSKINKYSDMMAEKMLERGQKINRFKIIVSPIFEFIKVFIFKLGFLDGFPGFYIAKTMSYYTFLKYIKLREKIRLVKIEMEKDRVK

SEQ ID NO: 595 - protein, 257 aa, Capnocytophaga sp.
MSPISEKVSGLIITYNEEKNIAEALSCFDFCDEIIVVDSYSKDATVRIAESFPKVKVIQHKFEDFAKQRNLALAEATNDWVLFLDGDERITTELKAEIIQTLSCTDKKDAYYFRRLFFFAGKPIYYSGTQGDKNFRLFRKSKCHYVSERKVHETLAVEGSIGVLKNKLLHYSVSNYDSYRQKAVLYGKLRGEEMYAKGKHYSALKMYTKMCFAFFKTYILKLGVLDGKEGFLLSKVSALSVYENFKALKREEEKNGK

SEQ ID NO: 596 - protein, 246 aa, Unknown
  Description of Unknown: Epsilonproteobacteria bacterium SCGC AD-308-I21 sequence
MKITANIITLNEEKNIEEVIKSVRKVCDEVLVVDSRSSDRTCEIAESLGAKVVKQEYLGDGPQKAFGAPLAKYDWVLSIDADERLDANAIEAIKKLDLDSTIYDAFSFARKTFVGKSFIKLWYPDRVTRLYNKTTCGYTTAGGHARVDTKNVKDLDADMLHYSYDNYAQMVKTSHKFITRGAKIAHEQGKKASAFDPFLHGVGALFKALVLKGGVFHGVNGWNVAVISAFSSYMKYALMLEMQENE

SEQ ID NO: 597 - protein, 259 aa, Unknown
  Description of Unknown: Candidatus Woesebacteria bacterium GW2011_GWC1_38_13 sequence
MISVSIITLNEEKYLEKCLQSVKGIADEIVVVDSGSTDKTLDIAKKFSAKVYFRKFDNYANQKNYAVEKCTGDWILSMDGDEEIEDDLLKEVKSEILNPKSEINGYSIPRKNIIFGKFIRYTRWQPELDRHIWLWKKDLGKWMGDVHEEVVVEGRVGKLKHAKIHHQYETVRDFFEMMNRYSEIDASERVKNGRKYSHFRFLFDPIYNFLVRYFYRLGFLDGWRGFVLSYLMAVYHLIVWVKVGENKIRNSNIEIRNNN

SEQ ID NO: 598 - protein, 263 aa, Unknown
  Description of Unknown: Flavobacterium aquicola sequence
MTNSNAEKLSVLIITLNEEKHLKTLLSDLDFADEIVIIDSFSNDRTEIIAKSFPKVKFIQNKFENFSVQRNFAISQAKNDWILFLDADEVLTPELKQEIIETLQNNKTYSAYFFERIFMFESSVLKYSGNQTDKIFRLFDKKSARYDEKRLVHEKLIVDGKIGSLKNKLIHHSYSSYHDYKEKIIFYGKFKAQEKFIKKVKPSFILKLLHPSYNFLYNYFIRLGFLDGKKGIFICYLNAYCIVIRYRELKKLWKQDQDLISKT

SEQ ID NO: 599 - protein, 670 aa, Marinobacter sp.
MLSPRLSFHALLMIGLGGALLSSSILAGATLLLAIAGIALSVRKSLDKTGWDKPKELRLLHFAFWFFVLVSFLSWALEGFDYEGGKTFGTHARFILFWPLIVAMSYARIGARTTFVAIGLIAVSIIGVFLVTVAARQGTFEQVLNSRFGGGINPISFGNLALLGGMLTIVAALFFTRDNRRGVATLLFLAGTAAIVISMLSETRSNLVALPFLLAALVPLFGKRLRIAGLVAIPLLVTGAIVISDRMSHSLEGLLHDGGLDTGMEIRLEVWAQAWNMFRESPWTGAGLGGFTHRIESEVEAGNLPKHFIDCCTGHAHNDLLNVAATSGIPGILSWALLIFIPLAIFARHLFSRHIPTAHLATAGTMVCAGYFFFGLTEATFNRSLFVTFYLLAVASLASAMFTELSGSYVRNRARKVSATVITKNEEDHIADCLTSARLVADEIIVLDSGSTDRTVEIARGLADVVEVTDWPGFGVQKQRALEKATGEWVLSLDADERITPELAREINHHLSDPDADAYKLPWAVTIYGSRLDFGRSGRAPLRLFRRQGVSFSDALVHERILIPAGRKIKTLRGRLTHYTHRDFGHSLEKSAKYAWLGAMEKHRRGKKTRTMIYPTLRGLMTFVQVYFIRFGFLDGAVGYLTAVTYAQVTFNKYAGLWTLDRSQSDTFHE

SEQ ID NO: 600 - protein, 253 aa, Unknown
  Description of Unknown: Bacteroidetes bacterium sequence
MKISVVINTYNAECYLAEALDSVVDFDEVVICDMESTDSTREIAARYGCRVVTFPKGNHTIPEPARNFAIQSASHPYVLVIDADEVVPAALREYLYSLAGGDACPDGLWLARQNFFMRRFMHCYYPDYILRFFRREVADWPPTIHSMPQIDGRVEYMPRKRRDLALLHVVDETVAEQWVKMCRYTDNDAYRRREKRYGTGALFYRPLFRFFKIYFLKGAIRDGRAGLIKALMEASYQFMIVSKIIDGRERGEW

SEQ ID NO: 601 - protein, 266 aa, Enterobacter cancerogenus
MFKLTVCLLTYNSARLLHQVLPPLIRIADEIVVVDSGSHDETLFILEEYKISSIYHPYAMHGEQMNIAISQSRNDWVLCMDSDEILDEDTLEYIISLKSGEEPPADWGWSLSRYWYVLGERTRTIYPVSSPDYPLRLFNRRYVKFNNRPVDDKAVGAGQVTRIPGHVRHDTFYSLHEVFNKLNTYTSRVVKYQALKPSIARGIVSAIGAFFKWYLFSGAWRQGKIGVVTGLYATFYSFLKYFKAWHQYQDKRESASREHTDSHLIE

SEQ ID NO: 602 - protein, 266 aa, Enterobacter hormaechei
MFKITVCLLTFNSERTLHDVIPPLLKIADEFVVVDSGSTDATIYICQSYGLSPIFKKYSWHGEQMNHAVSHAHNDWVLCMDSDEILDQETVGAILKLKMGDEPEPDMAWRICRHWFVLGENVRTIYPVSSPDYPVRLFNRTQSRFNNRPVDDQVEGFLRSERIPGYVRHDTFYSLHELFNKLNGYTTRLVQYQTIRPSLGRGAISAIGAFFKWYLFSGAWRKGKVGVVTGFYATAYSFLKYFKAWYQDREKKESVAKEQSDSYLAE

SEQ ID NO: 603 - protein, 295 aa, Desulfobacca acetoxidans
MAKAPVSVIILTYNEEVNIRACLQSAKDLTDEIFIVDSFSTDQTLNIARAYTEKIYQNAWVHWADQRNWALDNLPLKTDWVLFLDADERLTPELCQEISETLAGKANPSVQGYYIKRNFYFLGRWLKHGGYKADYILRLIKKQQARILKRGAWEYATVQGELGYLNYPMRHEDARGLTYWIAKHNNYAIMESHELVRLDNKAGLTNEAAATNQRKIEHKFKIWLREKIWVRMPLFIRPLFYFFYRYIVQLGFLDGKEGLIYCFLHGLWYPFLVDAKYLELKKRNSHSGTSPCNNG

SEQ ID NO: 604 - protein, 292 aa, Unknown
  Description of Unknown: bacterium B17 sequence
MSTENTSVNHGKKAPLSVLIITYNEEVNIRESLESVVDWAGEVFVVDSFSSDQTVAICKEYEDKGVKVFQHEFENYSAQRNWALQELPWSNEWLFWIDADEIVTLELGRELMDLAVTDSFKKDFYYVKRRLIFLGKWIKHSSSYPLWLIRLFRIKDARFTRPINEQVVVPGDGGRLEHDLLHDDKKGIAGWLEKHNRYSSMEAEEYLKVLENSEGDQDFLNEKERPDVKRQKKLRFFIHLPFRPFFMFAYLYFWKLGFLDGKAGLIYCMLKAGNQRSISAKMQELKVARSKN

SEQ ID NO: 605 - protein, 253 aa, Unknown
  Description of Unknown: Chryseobacterium frigidisoli sequence
MNFTKVSGLMITFNEEKNINDVLKCFSFCDEIIIVDSFSKDKTVEIARQFPKVKIIENKFEDFTKQRNLALKNAKNDWILFLDGDERISPELENEIILELQKEDKKDAYYFYRKFFFAGKPVNFSGTQNDKNFRLFRKSKCHYVEDKKVHETLEVNGETGFLKHKLLHYSVEDYRSYKDKMIHYGKLKGEEIFIKGKRFSLLTQYLKTGFKFFKTYFLKLGFLDGKEGYQLSYLQSLSVFETYKSLKKVENKS

SEQ ID NO: 606 - protein, 249 aa, Arcobacter sp.
MNISAVVLAKNNENTIRRTLKSLKGFSDVVVYDNGSTDTTMNIAQEFSNVNLIQGEFKGFGWTKNHAASFAKNDWILIIDSDEVVDKELFETLQNKILDEKCVYKLNFKAFYKEIQVKYCGWNNQKIKRLYNKKCTQYNSNDVHEDIITDGFKIEELKGNVEHYSYHSISQFVIKADHYSTLFAQNNAGKKKSSPAKAYFNGFYSFIRTYIFKRGFLDGYVGLIIAFSHMVTNFYKYIKLYEANKELKK

SEQ ID NO: 607 - protein, 245 aa, Unknown
  Description of Unknown: unclassified Flavobacterium sequence
MKKLSVIILTYNEEFYIADAIKSVSFADEIIVLDSNSTDATQKIATDLGVKLFSRKFDNYCNQRNHAISFATGDWILFLDADERVTDKLQAEILKSIEWDEFDTYKIWFPHFFMNRFLFHYTDKVVRLMKNEKLVFENEVHEKLIIKSKPGVLKNYMVHYTYKGLFHFIGKKDKYAWFQAKMCANKGKKVTLFLLFFKPFYRFFHTYIVKRVYLDGVPGLAAAAIDAYGVFSRYAKMMLIEKDLE

SEQ ID NO: 608 - protein, 320 aa, Spirulina subsalsa
MTSKVDKIPVSVLIPAKNEERNLPACLESLTRADEVFMVDSQSGDRSVEIAESYGAQVFQFHFNGRWPKKKNWGLENLPFRNDWVLIVDCDERITPELWDEIAERIQDPDYDGYFLNRKVFFLGKWIRHGGKYPDWNMRLFRHKKGRYENLKTENIRNTGDNEVHEHVIIDGKTGYLKEDMLHIDFRDIYEWLARHNRYSNWEAQVYYNILTGKMDGDNIGANLFGDAVQRKRYLKKIWVRLPFKPFVRFILFYILRLGFLDGTPGYIYGRLLSQYEYQIGVKLYELRKFGGSLNVDVQHPPSNTPSNPPSVPQTVTEQQ

SEQ ID NO: 609 - protein, 253 aa, Emticicia sp.
MHLSVVILTFNSTRTIRQVLAAVAGWADEIVVVDSGSTDETLAIAQEFGCKIYHRKLDGFGKQKNFAVNQAKNDWVFVVDSDEVVTEALKKEIDAQLAQNTEYRGFLVPRILIFLDKKLKYGRESKLPTLRIFNRKFGNYNDKDVHEEVVLDGKTLTLKREMLHYSFSDIAEFFQKMNDYSSRSAAELYVKGKRTSILKVITKFPITFFVEYFIRLNFLNGYPGFVWAFTQAIYASLKYIKLRELQTASTLQS

SEQ ID NO: 610 - protein, 264 aa, Unknown
  Description of Unknown: Flavobacteriaceae bacterium MAR_2009_75 sequence
MPKERQKVSALIITYNEIGYIEKCIKSVEFADEIIVVDSYSTDGTFEFLKAHPKVKVIQHPFSNFTLQKSFTLKQATNDWVLFLDADEVVSEKLKAEIIKTVNSDTDISAFWFYRKFMFANKPLNFSGWQTDKNYRLFRKSKANFSDKKIVHETLDVIGKSGILKEKLTHYCYKSFEDYKSKMLKYGRLKAKEDFYRENRYNLLSLVFKPLWKFFNHYIIRLGILDGQKGVVICYLNALGDLERYRELKKLEKKNELAYYLVMP

SEQ ID NO: 611 - protein, 248 aa, Methylobacter tundripaludum
MLSVIIITKNEASHIGRCLESVAWADEIVVLDSGSEDDTVSICRQYTDKVYETDWPGFGIQKQHALDKANGDWILSVDADEVVTSELRAEIEKAIQQGNCKGYEIPRLSSYCGRQMRHGGWWPDYILRLFRRDCGRFTDSVVHENIIVQGQIGRLRSPLLHDAFVNLDEVLHKVDSYSSLGAEMLYQRGVRSSLGKAVLKGLWTFIRTYWIKAAFLDGRQGLMLSISNAEGAYYKYLKLLELQNRQPR

SEQ ID NO: 612 - protein, 266 aa, Lelliottia amnigena
MFKLTVCLLTCNSARLLREVLPPLLIVGDEIIVVDSGSTDNTLDICHEYGLTPHLHPYAMHGMQMNHAIGLASNDWVLCMDSDEILDAETIDFILALKAGEEPAVDNAWRITRYWHVLGQEVRTLYPVSSPDFPVRLFNRTQARFNHRPVDDKVEGRLHTVKMPGRVRHDTFYTLHEVFNKLNSYTSRLVKYQNVRPSIGRGIVSAIGAFFKWYLFSGAWRQGKVGVVTGLYATSYSFLKYFKAWYQHEDKKEPVAKEHTDSHLVE

SEQ ID NO: 613 - protein, 245 aa, Lacinutrix jangbogonensis
MSSITVIIPTYNEEAYIKQAIQSVGFASQIIVVDSNSVDNTAQIAEEMGCEVYLRPFDNFSNQKNHALQYATSEWILFVDADERIPYALQQELLAAIDSGKHAGYKLNFPHYYMNRFLYHHSDNVTRLVIRKKCHFEGSVHEKLIVDGTIGKLKNPVLHFTYKGLQHYISKKDSYAWFQAEQMLNKGKKATYFHLAFKPFYRFFSSYILRGGFRDGIPGLTVASVNAYGVFSRYVKLMLLKRGMR

SEQ ID NO: 614 - protein, 272 aa, Nissabacter sp.
MMELSICVLTYNSERLIREVLTPLLTLSDDIVIVDSGSSDNTLAICRELGCEPHHAPYETHGRQMNLAIQRARHPWVLCMDSDEIMDAQALCWLLQFKLVPNPDPHTAWRLCRHWFVLGQPVRTIYPVSSPDFPVRLFHRNVVRFNDQPVDDAAEGFSRTEIIPGSVRHDTFYSLHEVFTKANSYTTRLVKYKPITPSLWRGIASAIGALFKWYFFSGAWREGKVGVVTGSYAVLYSFLKYLKAWYASTETMTLADKLKQQWEKIRRIYPAP

SEQ ID NO: 615 - protein, 250 aa, Methylosarcina lacus
MLSVIVITKNEAAHIGRCLESVAWADEIIVLDSGSSDETVAICRRFTDKVFETDWPGFGIQKQRALDKAQGDWVLSIDADEVVGPELRQEIEQAIASAQLSGFEIPRLSDYCGRAIRHGGWWPDYVLRLFRRESGRFTDAVVHERVIVEGEIGRFKSPILHEAFVDLGEVLHKVNAYSTLGAEMLQRKGVRSSLSKAVLKALWTFIRTYCIKASILDGRQGFMLAVSNAEGAYYKYLKLWELQNRNLGPK

SEQ ID NO: 616 - protein, 255 aa, Unknown
  Description of Unknown: Flavobacterium beibuense sequence
MPQNNLSQKITALAITFNEEDNINRYVKSLSFADEIIVVDSFSTDATKELAEHLNVKFIQNEFKDFSSQRNFAIEQASNDWILFFDLDEIVTPSLENEIKQVVTSNDGSVAYFVKRKFHFMGKHIRFGGWRTDKAIRVFNKQHCKYTGLVHEVITAKGKVSTLKEKVDHYSYKSFDNYNGKLNLYSKLQAENLYSKKVRPNAYHFLFRPFYRFCWQYFYRLGILDGKEGFILAYIHSFSVFKRYLQLWMKYRKVD

SEQ ID NO: 617 - protein, 222 aa, Unknown
  Description of Unknown: Candidatus Collierbacteria bacterium GW2011_GWB1_44_197 sequence
MKLSVIILTYNVEDEIIPAIKSSQFADEIIAVDTGSTDGTLDICRKNGVKIVHTTTDSFSKWRNDGAKVAKGEWLLYLDSDERIPVKLAKEILATIQSPQHSAYTISRYEVFLGKHLNHWGDPRVLRFMKRSALKRWEGKLHEQPKIDGTIGDLRQQMVHLSHKNIDEKLPNTLLWSKTEAKMLYVLKAGSRLSIRCSASLSLTSGFGRCRENLLSKRPTIT

SEQ ID NO: 618 - protein, 254 aa, Sutterella sp.
MNNLAVLILTKNEEKNIAETIQSARQCTDEVILIDSGSTDRTVEIAEKAGARVVYRAWTNDFSAQRNFGLSATDATWVLYLDADEHLTPELASAIRRATEPGAQPAAYRMLRLCCAFGKTFRHGVIGPNWVTRLFPRTDVTWVNQVHEHPECSLQEKTLPGYMEHYTYADWSSWERKMSLYSTLWAENAYRQGRRTSLGGIFGHSAGSFFKMLILKLGFLDGALGTYLCFLNFSYTMMKYLKLHELQRTAADKK

SEQ ID NO: 619 - protein, 260 aa, Vibrio hepatarius
MSKATIGVLMIVKNESKHLAECLETVKDWVDEIVIVDSGSTDNTETIARQYTDKFYTHTDWQGFGKQRQVAQSYMTSDWVLPLDADERVTPELKSSIKKVLADNPKQTCYTLDRLTHALGKFIRHSGWYPDTITRLYRREETQYNDSLVHESVEIPKGMTKAHLSGDLLHYTFDSLSQYTGKTQLYMKSWADQREGKKRSGLTGAILHGFFRFFKMYIIKRGFLDGRHGLLLAILSANTTFTRYADLWIRDYVKQQDNKK

SEQ ID NO: 620 - protein, 286 aa, Pedobacter chitinilyticus
MKPAFSFIILTFNEEQHLPRLLNSIARLNAPIFILDSGSTDDTLKIAESFGAMVKFHPFENHPKQWDYALKNFEVQTPWVIGLDADQIVTPELLELLINFNDETYGNVEGIYFNRKNIFKGKWIKHGGYYPKYQLKMFRYGMGYSDLNENMDHRFIVTGNTTIWKKGHLLEENLKENEIRFWIDKHNRYSDLVANEEIERMENLRKQTIKPKLFGDPYQRTAYIKSIWWKLPRFLRPFIYFTYRMTFQLGFLDGRTGILFHFLQGFWFRLIVDVKIAEKLNQSKQK

SEQ ID NO: 621 - protein, 264 aa, Unknown
  Description of Unknown: Candidatus Curtissbacteria bacterium GW2011_GWA2_41_24 sequence
MSALSMLSVVVITKNEEKQIAKCLETCRFADEIIVVDDFSTDKTCQIARKCNAKVYLRRLDSIAKQADFGYSKAKGEWILAIAADERISFKLSQEILRAIKSKEYDGYNFYFQSFLFGKALGSTQTDGQVRLFKKNKGYITKERIHEKIRVKRGKIGQLKNPILHYSYPSVFGVVEKFNRYTNPESYLAYKRGERTNLFKISVAVPRVFFWRYLVAGEWRDGKRGFILSFLFGIYHLLWQLKLWEIQNKKGKHKFHSVHYIPKA

SEQ ID NO: 622 - protein, 249 aa, Orenia marismortui
MADLAALVLTYNEEGNIKECLESINWIEEIVVIDSYSSDNTIAIAKDYTDRVYQRKFDDFASQRNFALDKIEATWVLVVDADERVTLELKDEILNLLTSPQADAYKIPRKNYFLGSWIKYCGWYPDYTLRLFKAQENRYSGLVHEGVKIKGKVDKVNNAFIHYTYRNLNHYLSKINHYTSLDAEKKYKAGKKKGLAYIILRPIVEFIKKFILKKGFLLGMPGLIVSVLSSYYQFLKYIKLWEKNVSSDK

SEQ ID NO: 623 - protein, 279 aa, Unknown
  Description of Unknown: Desulfobacteraceae bacterium sequence
MKQKPALSVSIITYNEEDNIQDCLDSVQDLADEIVILDSFSTDQTESICLKNAKVKFSKHIFDGHIQQKNRALEKCSGEWILCIDADERVSQELQSSIEGFLLKNPQDIAGVKFPRLAFHMHRYIRHGGWYPNARYRLVRKGMAFWGGENPHDKLILKGKGLKIQGDLIHLTERDLSDQVKTINNFSSIAALMRFNKGKRYRIWRLLFKPVSKFVETYILKFGFLDRTQGFIIAVSSAYASFLKEAKMFEMDVLGSDKPSNLNNSYQKTRSSGRSRQGS

SEQ ID NO: 624 - protein, 380 aa, Alicyclobacillus acidiphilus
MSTSGSNWFCALQVGTIERPSCRRLPMKSNEDIQTMILKRQFDGVRYACIERISHNRLDGQAWAFLGTALVGLQRAQTARLCFERAWLFDPLSADLEKACHQAAELPPGRDDERVKKLLQVPKSTVSANILTKNSESTIYNCLSALQNAVDEIVVVDTGSTDNTIEIVQSFGIQVHHFDWVEDFSKARNFALSLSSCDWVLAVDSDEFLVTPDVPAVREVAGLYADCPWNPIVLCIQLNYVSGRVTPNGPARMFRNDGRTVWTRRIHEIPTSVEDSASPDVRRPLVRIRFNHFGYDPATIDTKAKCERNLELLFRDLNDHPNDARTLFYIGREHAGLGQRDEALHYLTLAKANMSPDEEVYFRSEMQEILAYLKAAETTS

SEQ ID NO: 625 - protein, 285 aa, Unknown
  Description of Unknown: Candidatus Woesebacteria bacterium GW2011_GWA1_39_12 sequence
MTKLSVVLAVRNEEKNIGECLSSIKGTADEIVVVDEESKDNTIEIVRSFGARIIKVEHSPIFHISKQKALEEANGEWILQLDADERVTPKLAEEIRRVIEMPDNKIDEYQKTLKNQRLFARHKRLIEKRDGAFIKEGEFAGFFIPRLNYFLGKYLRYGGVYPDGVIRLVKKEKAHFPQKSVHELIKVDGKVGWLQNDLIHMADPTFSRYLQRNSYYIDLIADDMKNENLGKSVWQFLNYVLVKPIWWFFLTLFRHKGILDGFQGIIFSFFSALRFPRAYLRYLRK

SEQ ID NO: 626 - protein, 265 aa, Franconibacter helveticus
MLKLSVCLLTCNSARLLREVLPPLIIVADEIVVLDSGSTDETLKICQEYDITPYTHPYAMHGQQMNHAIALAKNDWVLCMDSDEILDKETVDFILALKAGETPAPDKAWRLSRYWHVLGQPVRTIYPVSSPDFPVRLFNRRQARFNDRPVDDKVEGNIHAVKIPGYVRHDTFFSLHEVFNKLNGYTSRLVKYKYVKPSLLRGVISAIGAFFKWYLFSGAWREGKVGLVTGLYAAFYSFLKYFKAWYAYDKKRTDVKTASDSHLIR

SEQ ID NO: 627 - protein, 264 aa, Sediminicola sp.
MSSTKEKITALIITYNEIGYIEKCVQSIDFADEIIVVDSFSTDGTYEYLCNHPKIKVIQNPFENFTAQKAFTLKQATNDWVLFLDADEVVTKKLQKEIVETINGQSEHVAYWFYRKFMFQNKPLHFSGWQTDKNYRLFRKSKTKFSDKKIVHETLDVEGTSGILKEQLVHYCYKNYEDYKSKMLNYGKLKAKEAFYKEKKFNYFLLFLKPTWKFFNHYILRLGILDGKKGVIICYLNALGDFERFKELKQLEKKNELAYFLIMP

SEQ ID NO: 628 - protein, 312 aa, Calothrix rhizosoleniae
MMSTKIPVSVLIPAKNEEANLPACLVSLERADEVFVVDSQSSDRTMEIAQEYGANVVQFYFNGSWPKKKNWSLENINFRNEWVLIVDCDERITPELWLEIEQAIQSPSYNGYYLNRRVFFLGKWIRHGGKYPDWNLRLFRHKIGRYENLNTENIANTGDNEVHEHVVLTGQIGYLKKDMLHEDFRDLYHWLERHNRYSNWEAKVYYNILKQQDNSHTIGANLWGDPVQRKRFLKHIWVRLPFKPILRFILFYFINLGFLDGKAGYIYARLLSQYEYQIGVKLYELCHCHGQLNTVTKRQGSREENTYINIGT

SEQ ID NO: 629 - protein, 255 aa, Unknown
  Description of Unknown: Candidatus Roizmanbacteria bacterium GW2011_GWA2_33_33 sequence
MKISAIVLTKNEEKNIERCLKSLDFCDEIIIVDDYSTDKTIEIINNVGNKNLCSVHKRQLNNDFAQQRNFGLSKANNEWILFVDADEEVSKELKKEIVSLFHGSIVKENAFYLRRIDYFWNHELKFGEIKKVRIRLLKKNSGTWMGNVHEEFRIKNSKLKIAKLNNYINHYPHPTLKEFISDVNNYSSIRAEELFNRGTKTNVFEIIFLPFGKFIYNYFFNLGFLDGAVGFTYSFMMSFHSFLVRSKLYQLTNKQ

SEQ ID NO: 630 - protein, 205 aa, Unknown
  Description of Unknown: Candidatus Shapirobacteria bacterium CG10_big_fil_rev_8_21_14_0 _10_38_14 sequence
MKKPKISVVIIAKDEEKMIEDCLQSVKWADEVVLVDSGSTDQTPQIAKEYGAKVIQVPFEKLEFAKWRNVGLEKARGDWILYVDADERVIPELKKEILKVVTGHSRSVTAYEIPRRNFYLGKEVHYGGAWPDYVKRLFLKKKLKGWRKRLHEDPIFKGQMGRLKSPFVHLTHRDLSSMVEKTREWSKIEAKLLFESGHPAVTWWR

SEQ ID NO: 631 - protein, 257 aa, Cellvibrio sp.
MSYEQTPISAYLITLNEEAHLEEVLASLAEADEIVVVDSGSTDRTLAIAEKYGARIVYQPWLGFAKQKAFAMAQCTHDWVINLDGDEVLPAEGVRTIRQAIIEHPGRCFAFHRDDYFMGASMRFAKMKYFRKAYPKSAAKWRETDFVHEHIDISLPTKILPTIIKHYGHDSTEIIAAKKNRYSTLKAQQREAKGRQFSVLRMLLIYPVMFLKLYLLHRFCLCGWRGFIKANIEAGYFFLTEAKLFEKQFKTKHNIKS

SEQ ID NO: 632 - protein, 259 aa, Unknown
  Description of Unknown: Chryseobacterium tenax sequence
MQELKEKVSGLIITFNEEKNIREVLECFDFCDEIIVVDSFSTDQTLEIANTFPNVKILQNTFEDFTKQRNLALNTAKNDWVLFLDGDERITSQLREEIIETVKNPNAKDAYYFYRTFFVGTKKINFSGTQNDKNFRLFRKSKAHYLENKKVHETLKVNGTTGVLKHKLLHYSFENYECFKNKMLSYGKLKGQELQLKGEKYSVIVQWSKVIFKFSKTYFLKLGFLDGMNGLKISYLQSLYVYETHKTLNLKATDIFKNN

SEQ ID NO: 633 - protein, 284 aa, Coleofasciculus chthonoplastes
MFSIYILTYNEERDIEACINSARLSDDIIVVDSCSSDRTVEFAQRYPVRVVSHPFESHGRQRTWMLENLPTKYEWAYILEADERMTPALFAECLEAIKDNQYVGYYVAERVMFMNRWIRHCTQYPRYQLRLLRKGQVWFTDYGHTEREVCHGSTGFLQETYPHYTCSKGFSRWIEKHNRYSTDEARETLRQLEQGTVNWGALLLGRSEVERRHALKDLSLRLPFRPLLRFLYMYIFLGGFLDGRAGFTWCTLQAFYEYLITLKVWELKDEQLPTIEGTDSQLSF

SEQ ID NO: 634 - protein, 348 aa, Paenibacillus odorifer
MIVKNESEKLGRCLESVRSIVDEIVVVDTGSVDDTKKIASAYGARVFDFQWVNDFSAARNFALEQCEGDWILVLDADDRIIKASRKEIDDFITNNNSLGRIRITNSFDYDGELRESEANVTRLFPKGLFYTGKIHEQIVSDLPRKNVPIYVYHDGYYKSDKYKRNIKMLELELDEYPDDNYLLYQLGKEYRIIKDFINAEAYLSRCYSGITDIDGYKPQLIIECLYTMLGVGNFEEGLVLIEREARLLSDFPDFYFVSGLFYMELVFSDINKYMRYFPLIEKSYLKCLSIGDTDKYESVKGTGTFLATYNLAVFYETTGDLNKARKYYELSAQYNYKLARKRFEILSG

SEQ ID NO: 635 - protein, 314 aa, Fortiea contorta
MLTKIPVSVLIPAKNEQANLPACLTSLQRADEVFVVDSQSSDNSGEIAKSYGANVVQFHFNGSWPKKKNWSLDHLPFRNEWVLIVDCDERITPELWEEIALVITNNEYDGYYLNRRVFFLKTWIRHGGKYPDWNLRLFKHQNGRYENLHTEDIPNTGDNEVHEHVILQGKVGYLKNDMLHEDFRDLYHWLERHNRYSNWEARVYFNLLTNLDDSGTIGANLFGDAVQRKRFLKKVWVRLPFKPFLRFVLFYIIQRGFLDGRAGYVYARLLSQYEYQIGAKLYELRNCNGQLNTVNTSKSVTPLLTQEMGQTAAN

SEQ ID NO: 636 - protein, 630 aa, Unknown
  Description of Unknown: Bacillus sequence
MMGDKMRTISLCIIVKDEERFLERCLNSVAKHINEVILVDTGSTDRTLEIAENYNAKISHYEWINDFAAARNNSIKQATSDYILVLDADEYLDEDTDLQTVLITEKDHYTIRIKNYLSSGGAIFHPAVRLFKNHRGLQYQGRIHEHLNVEDKSLGLSHEFADVLIHHDGYKDEVVQEKEKHKRNIAILLEEVEKNPSGYNLYNLGTQYRANHQDEEAITYYKRAFELSKDRLYIQSLLYNMIDSIRRLGRHDEASNVVNAAIESFPNHTDFHFLKGRIFEELDFNNDAVQAYEHCIRLGEVELFQTLEGVGSFLAYVRLGAIAVEKGQYVLAFEMALKALESNKYHMPALRLYLEMMKKTNIPLKTMEEHLRNIFSVANVTDLKHLIVVLTVIKSPLLQQYIDLYKLKLDPSVSMIARLYNRQYAEAVEIATKMDDIKESETNDLFLLAYISNSEDLAGAARKPLNFSIKEWKQLKSFLQSKPEDLGNISEPVANIIVFIAEQLLNLQEEDLFNQCISTIQQGPATLTIKFCHMLIENRYSNIAMDLLLAEYDKNKQNIEWLELLGDACTQENQDKDALSVYNRALQLKPEYRIYEKVYEIYIKLNEHKEAGLIKNEIAKLFPFVEWAKA

SEQ ID NO: 637 - protein, 250 aa, Hydrogenimonas sp.
MVERISVTILTKNSERRLARCLDALREFDEVLIVDNGSSDDTLEIASKYPNVRVLEHEFTGFGPLKNFAAKEAKNDWIFSVDSDEVATRQLIESIKELDPEKIENIYSVERLNHYGNRPVKCCGWYPDIVMRIFNRSSTSFSDALVHESLIVPPGIEPKVLRGELLHYPFESVESLIAKMQSYSTLYAKQSDKPSSPAKAFWRATFAFFRNYFLQRGFMYGYEGLLISVSNANGVFYKYMKLYEKREAKR

SEQ ID NO: 638 - protein, 401 aa, Unknown
  Description of Unknown: Candidatus Brocadia fulgida sequence
MIQLSACLIVKNEAFLLPYCLDSIGAFVDEIIVVDTGSTDETIKIANKYKAKVSQFPWTEDFSAARNHSISCARGEWILYIDADEAIDRVNAGKIHDAIKRKDIMGITVRQCIPQRINNIATAYYSEYCRIFRRHKDVRFKGKIHEQILPSIERLGGKVLRTDIVFNHWAYGINEEKKRRRAERNLRYLLDEVENAPYDPFVYFNLGITYCELGKKDAAICSLQRTIDLYTGNIKRELIGQAHLWLAKLYLELDNFTKTEYHARMVSSYDPANPLSAYILATIAVVKEQYKTAIEHLEHAIQISKGETGLLPSVEMDLAQMYLELGSCRSASGDTLDAEKDFVRSLEYNPSGALPYVLLGNCRFLDGDKKEAEKMYERALAIDSSLVNASHGIELCRANKK

SEQ ID NO: 639 - protein, 249 aa, Unknown
  Description of Unknown: Chryseobacterium sp. T16E-39 sequence
MINISGLIITYNEEKNIKEVLECFDFCDEIIIIDSFSNDKTLEIAKANPNVKIIQNKFEDFTKQRNLALDEAKNDWVLFLDGDERITPALRAEIINELDKPDKKDAYYFYRKFFFAGKPIHYSGTQTDKNFRLFRKSKARYILEKKVHETLEVSGTIGELKNKLLHFSVSDYESYKQKMIHYGILKGQELSNKGKKFNITTQYSKTAFKFFKAYILRLGILDGKEGYQLSFLQALSAYETYESLKKEQN

SEQ ID NO: 640 - protein, 253 aa, Unknown
  Description of Unknown: bacterium BMS3Abin03 sequence
MPKNKISVIIITANEEENIRECLESVKWADEVIIVDSESSDRTTDIAGEFTDKIFIREWAGFASQKSFALEKTSNEWVLSIDADERVTPELSNEILSMDLSKSDGYFIKRDNYFLGKLIVGCGWGNDYQLRLMRKSKSGLTDNLVHEGFVVSGKREKLNSSIIHYTYNSIHQALDKINYYTSLEAKEKYTKKNVNILKIIFQPPVAFYHDFIARKGYKDGVRGFLISFNNALTKLQVLTKIWELKKNERTGAN

SEQ ID NO: 641 - protein, 329 aa, Leptolyngbya valderiana
MPLQDDLESHRAVLAELPAVEGYPPDGSVPVSVLVPVKNEQDNIAACVRRLAWAEQVTVIDSQSTDDTIVLSQALEAEVYQFHYDRSAGWPKKKNWALEHVPWRHEWVLIVDADEHITPELAAEIEAVVTGKYEPDGNGCGDGYWINRKFMFLGRWLKGGGWYPSWNLRLFKHRVGRYERIGDLGDTGSGDNEVHEHPVLLTGEAGYLKHDMLHYAYRDLTTWIEKHNRYTTWEAHAWGAKDAGGVKARLFGSTIERHRWLKKYARNLPGRPFLRFGFDYFFRRGILDGYPGLVMATNMAWYEFMSVAKRREMEIARRLGQRYSGAPPA

SEQ ID NO: 642 - protein, 251 aa, Orenia metallireducens
MDNLGALILTYNEEDNIEECLETLNWINDIVVIDSYSNDNTVELAKKYTQQVYQRKFDDFASQRNFGLEQIEAEWVLVVDADERVTPALKDEILNRLNSPQAEGYKIPRKNYFLGKWIKYCGWYPDYTLRLFKAHNRYSGLVHEGVKVEGRVDKLNNALIHYTYRDLKHYLSKINHYTTLDAEKKYKASKKIGIAYIILRPIVEFIKKFILKKGFLLGMQGFILSVLSSYYQFLKYIKLWEKNQLKLGREK

SEQ ID NO: 643 - protein, 288 aa, Hydrocarboniphaga effusa
MLAKLPTRLPLRAGERRTLSALIICCNEADRIEDCLRSLHGWVDEIIVFDSGSTDGTLDIVRRYTDKIWKTDWPGYGPQRNRALQQASGDWVLYIDADERVTPELRQEIDNALIDPHLDTTLFRIPWRTYLFDGELRHGRYATPQNRLFKRQGARFRDHQVHEQIVLPERRAAVMKAKLEHRSWRDYAHLQRKHRRYANLLARQKFEEGARGSIPYACMRFVTDFVQQYVLRLSVLDGWRGLMISAVLAQYAYWKYADLKALEREAARTAAPAANKTLAPVSAALLRR

SEQ ID NO: 644 - protein, 315 aa, Unknown
  Description of Unknown: Candidatus Magasanikbacteria bacterium GW2011_GWA2_45_39 sequence
MKQSLSVVLSVHNEESVIEPALESAKPIADEIIVVDNESTDKTVQIAKKYTKNIHEHKNTPELLNKPKNFGFSKAAGDWILSLDADERVSPELAKEISGILHSSFDIQNSPVGYWIPRQNLVFGKWLQHGIWYPDYQLRLFRKEKGQFPAIHNHEFLAVEGRTEKLKGHLIHKSYSGITEYIDKFNHTYTDNEAENFLKSGKKITWIDAIRWPLSDFITNFFARRSYQDGLHGLVLSLLQAFYALEVFAKVWERQGFWEYNSKDLAKGVKAEFQAKSKEFSWWYAKELIPWFMKPEVPDLSASIPQTITCQKVIR

SEQ ID NO: 645 - protein, 296 aa, Unknown
  Description of Unknown: Cyanobacterium stanieri PCC 7202 sequence
MTLEQKKIPVSVLIPAKNEELNIGACLDSVADADEVFLVDSQSGDRTVAIAEEKGAKVIQFHYNGKSPKKKNWSLENLPFKNDWVLIVDCDERITPELWAEIAQKIEDDNYQGYYLNRKVFFLGKWIKHGGKYPDWNLRLFRHKLGRYENLNTEDIKNTGDNEVHEHVILDGTVGYLENDMLHIDFRDIYEWLARHNRYSNWEARVYYNFLTGQNDDGTIGANLFGDAVQRKRFLKKIWVRLPFKPLLRFILFYIIRLGFLDGKAGYIYGRLLSQYEYQIGVKLYELMKFKGRLNN

SEQ ID NO: 646 - protein, 267 aa, Flagellimonas maritima
MTPLSNSKQKLSALIITYNEMGYIERCIDSISFADEIIVVDSFSTDGTYEYLKKLPNVKVIQNPFENFTAQKSFTLKQATNDWILFVDADEVVNNKLENEIIETINSPKACEAYWFYRKFMFQNKPLNFSGWQTDKNHRLFRKSKARFTDKKIVHETLEVDGTSCILKEKLTHYCYKDYNDYKGKMLRYGQLKAKEAFYKEKKFNYFSMIAKPLWKFFNHYFLRLGFLDGKRGIIISYLNALGVLERSKELKRLEKKNKLAYYLVMP

SEQ ID NO: 647 - protein, 246 aa, Unknown
  Description of Unknown: Candidatus Woesebacteria bacterium GW2011_GWC1_42_9 sequence
MKTSVVILTKNEERNIKKCLKSVYFSEEIILIDDYSTDKTVSIARRNGAKIYKRHLYDDFSKQRNFGLKKAKNKWVLFLDADEVLSPELAKEIQSLGATDTQGYFLKRRDYFLNKKILGGESGGVWLLRLGRKSAGKWDRAVHEHWEINGKTQRLKNYLYHSPHPSFLSLISKINYYSDLHAIENEKEGKNPSLIKIIFFPMAKFIYNFVFRLGLRDGTHGFVLAVAMSFHSFLSWSSLYLDDQKK

SEQ ID NO: 648 - protein, 273 aa, Unknown
  Description of Unknown: Solemya pervernicosa gill symbiont sequence
MEKLSVFITTFNNAHTLPFTLESVKWADEIVVLDSFSTDETMAIAEQYGCKTAQHKFMGYGPQKQLALEMTSHNWVLLLDADEAPCPELQAEIQALMAEGPSKAGYTIARQEQLFWRMRTTKNRMNHFLRLFDKRNGGLDDIPIHAAPKVEGELGRLKHPFYHFGEIDIHTKVSKINSYAQGLVADKVAKGRKGNPWMMVFYPPFFFVRSYLFKRSFLNGWAGFIGSVIATFYVFLKYANLYEHYQFEKHGDSLLPKGAPSTVALREKGRKTV

SEQ ID NO: 649 - protein, 267 aa, Unknown
  Description of Unknown: uncultured bacterium sequence
MKLSAVILTKNEEKNIERCLKSLDFCDEIIIVDDYSTDDTKNQISKINPPAGGKNDKLNIKIIEKNLNNDFAQQRNFGLSKANNRWVLFVDADEEVSEELKQEIVGLDSRLRGNDINICNAYYLKRRDYFWGKELKHGEINQIRQIGLVRLISKDSGKWMGTVHEVFYTAKNIGQLEGFLNHYPHQILKDFIIDINNYSSIRAEELFNRETKTNIFEIISFPFGKFFYNYFLNLGFLDGPAGFTYAFMMSFHSFLVRAKLYQLTNKK

SEQ ID NO: 650 - protein, 301 aa, Lysobacter sp.
MPAISACIITFNEAARIGDCLASLAFCDEIVVVDSQSTDATVQIADAMGARVLERPFTGFRSQKQFAIEQARHDWVLCVDADERVSDALREAILAARDAGFVDAAGYRFARLDNYFGRFLRHGNAYPDRILRLFDRRRGGWRGSREIHEAASVDGPVKTLAGDLIHYPYRSLEQQLAKTQRYARMMAEHDFARGKRASLTKLVLSPAWRFWRGYFLRAGFLDGWHGLVYAYVRANYVRQKTIMLWLLQNGQAVADTVEEGEERTPAFSVASNSAAAADVSATRAVDDHLPAPASHPPRAEG

SEQ ID NO: 651 - protein, 260 aa, Unknown
  Description of Unknown: Candidatus Woesebacteria bacterium GW2011_GWA1_39_8 sequence
MNNINAIVIAKNSEDKLLECLNSIDWVDEIIIVDTGSTDNTISIAEKKGCKVYRFNGGGYSQWRNEGLRRAGGRWVFYVDTDERISQKLAKEVRSVVGLTNNNYTAYAIPRTNIIFGKVLKHGGWWPDYVKRLFIRDKLNRWTGKLHEEPQFDGELGFLENPIIHKKHDNLEEMVVKTNDWSAIEAKLLNDAGHPKMVGWRFFRIMLTELWYRLVYQRGCLDGPQGILYAFYQMWSRFISYAKLWEMQTSKAGDLRISED

SEQ ID NO: 652 - protein, 253 aa, Mesonia sp.
MIKLSGVIITYNEERAIEKCMQSLQNVVDEIVVVDSFSTDKTKEICQKYGAKIIEQQFLGYIEQKNFALEQASHNYIVSLDGDESLSEELQKSIIELKNNWQLDGYYCNRYNNFCGQWIKYSDWYPEKKLRVFDRRKANWKGINPHDQIKLHNKESKIGHLKGDILHWNYQTYSEYNLKMETFSSISAKAYYDLGRRATLFNIVFNPFWAFVKSYILRLGFLDGVNGLVICSIKAHYTFLKYIKLLEIERKNK

SEQ ID NO: 653 - protein, 245 aa, Aequorivita sp.
MVNLSVIIPTFNEEAFVEEALKSISFADEIIVVDSFSTDKTPEISKKYATKFLQRKFDNFSNQKNFALKEATGDWVLFLDADERIPQKLKAEILTTLQHPKHDGYKLNFPHYFMDRFLYHHSDDVLRLVKREGANFTGLVHEKLNCTGSIGKLKAMVEHYTYKGLQNYISKKESYAWFQAEQLFAKGKKVTWGHLLIKPTFRFIKSYIIRGSYKDGVPGLTIAAINAYGVFSRYVKLMLLQKGIR

SEQ ID NO: 654 - protein, 259 aa, Gelidibacter mesophilus
MTKISGVIIAYNEEQYIAKCLESLQGIVDEILVVDSFSTDETLQICEKHGARVIQRAFIGFTDQKNYATEQAKFDYVLSLDADEALSEELKASILELKPTMDGEGYAFNRLNHYCGKWIHHSSWYPGTKIRLYNKHKARWYSPTNIHETITLDNPKSVVKLKGDLLHWAYDSFSKHHLKIDTYTTLSAVNYVKNKSKKVPYTKIIINPFWKFFKNYFINRGFLDGFQGFVVCCMSGYTTFLKYIKIIELQQNEKHHLNR

SEQ ID NO: 655 - protein, 232 aa, Desulfuromonas sp.
LADEIIVLDSGSTDRTVEIAGQYTDQVEVTDWPGYGRQKQRALDKATGDWVLSIDADEALSPELQQEIAAILDSDCEQVAFRLPWAVIVFGKQLNHGRSARAPLRLFRRAGTRFTDAIVHEHAQVPPGKIGRTRGRLLHYTHRDFEHYLQKNRQYAWLGGQRRYAEGKQGGGLAGAAVRAVLVFLQIYILRGGFLDGPVGFLVAVMYSQGAFNKYAALWYLRRQDRLAAHKK

SEQ ID NO: 656 - protein, 261 aa, Unknown
  Description of Unknown: Flavobacterium frigoris PS1 sequence
MDKAETIADSTIHLSVLVITYNEERNIKQLLQDLDFADEILVIDSFSTDKTVEIAQSFSNVKVSQHLFENYAIQRNYALSLAKGTWILFLDADERLTPALKNEIIQTIQNKAKFTAYYFKRTFMFANEKLLFSGWQTDKIIRLFRKENASYSLQKTVHEKLNTAGDIGKLKNNLIHHSYSDYFSYKEKMVRYGQLKAHEELIKGTKPNLIHFYIRPAYQFINQYILRLGILDGKKGIIICYLNAMSVYIRFQELKRMKINN

SEQ ID NO: 657 - protein, 310 aa, Rippkaea orientalis
MIAKVPVSVLIPAKNEELNLPACLESVARADEIFMVDSQSSDRSTEIAQQYGAKVVQFEFNGRWPKKKNWSLDNLPFRNDWVLIVDCDERITPELWDEIAEVIEDPSHNGYYLNRKVFFLGKWIRYGGKYPDWNLRLFRHKFGRYENLHTEDIPNTGDNEVHEHVILQGKVGYLKEDMLHIDFRDIYHWLDRHNRYSNWEARVYYNILMGDDDSNTIGSNLWGSMVQRKRFLKKIWVRLPFKPFLRFILFYVIRLGFLDGRAGYIYGRLLSQYEYQIGVKLYELRQFGGHLNVQTEPELSSSTTQPLISK

SEQ ID NO: 658 - protein, 290 aa, Prevotella denticola
MFHAFFIRLFCGDNEYFIIFAAMNDAQRISVIINTYNAERHLEAVIEAVKDFDEIVVCDMESTDRTLDIARSYGCKVVTFPKGDLRIVEPARQFAIDKAGSPWVLVVDADEIVTPALRKYLYAAIRKADCPDAIAIPRKNYFMGRMMHSSYPDYIVRFLRRSKCSWPPVIHASPKVDGNIWKIPASRTDLAFEHLANDSVADIIRKNNTYSDYEVPRRRQKKYGCMALVYRPVFRFFKSYFLKRGCLDGVPGLIHAVLDAGYQFYIVAKLREERQCDPMSVNTRTPAPDI

SEQ ID NO: 659 - protein, 256 aa, Unknown
  Description of Unknown: Candidatus Omnitrophica bacterium CG11_big_fil_rev_8_21_14_0_20 _42_13 sequence
MDKVPVSVVVLTKNEEVNIIDCLSSVKGWADEIIVVDDESKDKTVELANEYADKVLLNKMKVEGAHRNWAYAQARNEWVLSLDADEQVSPELKNEIDRALADTDCVCFSIPLRNFIGKHWVRYGGWYPAGKVRLFKRSKFKYEEVEVHPRVFTEGRCGFLKSDIIHKGYPDFEHFLASVNRQTTLEARKWVNTNRKMSFGKAMWRTIDRFFRAFIGKKGYKDGLVGFMVALFASWYQILSYAKYRQMKQEASQIEK

SEQ ID NO: 660 - protein, 243 aa, Lebetimonas natsushimae
MKSEKLSIVILTKNSQKYLEKVLKSVEFADEVIIYDSGSSDKTLDIAKNFKNVKIFVDKNWEGFGKQKQKAVDRASNKWVFVLDSDEVFTDNLKKEVLEILKNPIYDAYRVARLNNFFGKWIRHCGLFPDYSIRLFNREKCKFNEREVHESVECKRVGVLNNYFLHYAYENIEEFIDKQNRYSSLGAKPNKLKAIFSPYWTFLKIYFIKLGFLDGWAGFVIAKLYSEYTFWKYVKDKYENIGN

SEQ ID NO: 661 - protein, 398 aa, Selenomonas ruminantium
MRWKVFFIILAKYTGEGGSILQKIELSVCYMVKNEAENLPVSLASIKDAADEVVVVDTGSQDNTKEIAAAIGARVYDFPWQDDFSAPRNYAIEQAQGEWILFLDADEYFPSALNKDKLLCYLAGQKEKDAILLLRYNIENDKERKDWRTDWCLRIFRNVPYLRYKGRIHENIARHNGELQVAYAPTEWYLYHTGYKKELNEAKAQRNLRLLQQSIREEGWQPGYDLYLMDCYYGLQEYEKALQHGMSLLRGDCYVYGGMVHVYHMILECMRFLHRPDEDMLPFAQEACREYPDIPEFYGEQGMILCGMGQLIQARQLLIDALLRYEERQAKGQLDGYFSPVVAAKVAARLGEIAMHYEDEEEAAFWFRQAMTYCDNSEVVLMKYQKYRQWAAEKGLEP

SEQ ID NO: 662 - protein, 254 aa, Unknown
  Description of Unknown: Cryomorphaceae bacterium BACL23 MAG-120924-bin60 sequence
MKWTLLVPTYNEEDVLERCLSSAAALADEILVVDSFSTDGTLKIAQRFGAKILQREYQNSASQKNWAIPQASHPWILLLDADEWLSPSLQQELRRVKDGRDPMECGFWMYRANHFLGKRVRYSGWQGDKVIRLFQRDTCRYQEKHVHSEIETSGRVGKLRGKLNHDTFKGIPAWEKKLRRYAAWQSRDYDQRMGAITLYHWWVKPGFRFFKHFILRGGLLDGRVGFKVSAYAAWAVRLRYEALRDLRAGNPWEA

SEQ ID NO: 663 - protein, 251 aa, Unknown
  Description of Unknown: Bacteroidetes bacterium 4572_77 sequence
MIKLSVVLISYNEERNIGRCLDSVQNIADEILVVDSYSTDKTVEICEAKGARVVPHVFENFIKQRNFADSQAQNPYVLILDADEVISLELAVSIQKIKENWQYDVYEFNRLNNYCGQWIKHSGWYPEWRPRLFDKRQAHWEGQLVHERLAKNAGVTTGRASGNLLHYSYNSIAEHIQKTNRYTDLTAQEAFEKGKKSSLFKIWFNPKWRFIRDYVINGGFKDGFMGYTICKISAWGTFLKYSKLQNMHHKR

SEQ ID NO: 664 - protein, 269 aa, Unknown
  Description of Unknown: Berkelbacteria bacterium GW2011_GWA1_36_9 sequence
MKLSTIVIAKDEEERISACLESAKWANELVVVMDDSVDNTAKIAKKYTNEVLIYKGEHDFAKLRNWAMEQTSGEWVLFLDADERILSPLKEEIVNAISGSEKSAFAIPRKNIIFGTEKKYGPFWPDFVIRLLKRENFTGWAGKIHEQPTFEGSLGYLKNPFLHLTHRDLNQIICKSLDWSNIDAKLRLSSNHPKISSWRLIRILLIELFNQGFLRKGFFAGTIGTMDAILQTFSLVMTYIRLWEMQQSRPLDRVYAEIDKKLIDGNFKF

SEQ ID NO: 665 - protein, 249 aa, Unknown
  Description of Unknown: Chryseobacterium nematophagum sequence
MMNISGLTITYNEEKNIKEVLECFDFCDEIIVVDSFSTDKTVEIAKTFPNVKIIQHRFEDFTKQRNLALDVAKNDWVLFLDGDERITPALRKEIIKELNSPSKKDAYYFYRKFFFANKPINFSGTQSDKNFRLFRRSKARYIAEKKVHETLEVKGTVGILENKLLHYSVSDYESYRKKMIHYGVLKGKELAAKGKKFNILVQYLKTVFKFFKAYIMRLGVLDGKEGYQLSYLQSLSVFETYESLKKEQN

SEQ ID NO: 666 - protein, 245 aa, Lacinutrix sp.
MKSITVIIPTYNEEAYIKEAIRSVAFASQIIIIDSNSKDNTVKIAKEMGCEVYSRTFDNFSNQKNHALQYATGEWILFIDADERITKSLQQEVFEAIASGKHAGYKLNFPHFYMNRFLYHHSDNVTRLVLREKCHFEGSVHEKLIVDGTIGKLENPVLHFTYKGLQHYISKKDSYAWFQAEQMLKKGKKATYFHLAFKPFYRFFSSYILRGGFLDGIPGLTVATVNAYGVFSRYVKLMLLKRGMR

SEQ ID NO: 667 - protein, 253 aa, Unknown
  Description of Unknown: Chryseobacterium soldanellicola sequence
MPELTEKVSGLIITFNEEKNIREVLECFDFCDEIIIIDSFSTDKTLEIAQSFPNVKIIQNKFEDFTKQRNFALDHAKNDWVLFLDGDERITPQLRSEIIEKLNRPYKKDAYYFYRKFFFAGKPINYSGTQTDKNFRLFRRSKARYISEKKVHETLEVHGTIGELRNKLLHFSVSDYESYKQKMIHYGVLKGQELASKGKKFSSLTQYSKTAFKFFKAYILRLGILDGKEGYQLSYLQSLSVFETYESLKKEQN

SEQ ID NO: 668 - protein, 316 aa, Stanieria sp.
MTYSTKKVPVSVLIPAKNEELNLPACLESVAQADEIFIVDSQSDDRSSEIAETYGAKVVQFNFNGRWPKKKNWALENLPFRNDWVLIVDCDERITPELWTEIATVIETSECDGYYLNRKVFFLGKWIRYGGKYPDWNLRLFKHRLGRYENLSTEDIPNTGDNEVHEHVILQGKVGYLKEDMLHIDFRDIYQWLARHNRYSNWEARVYYNLLTGKNESGTIGANLFGDAVQRKRFLKKIWVRLPFKPTLRFILFYIIRLGFLDGLPGYIYARLLSQYEYQIGVKLYELQKFGGKLNRASNSSKLPTLESSPVKTVQL

SEQ ID NO: 669 - protein, 248 aa, Unknown
  Description of Unknown: Nitrospinae bacterium CG11_big_fil_rev_8_21_14_0_20_45_15 sequence
MEKLSVIIITYNEEEHIERCLKSVQWADEIVVLDSFSTDATVDICRRYTDRVFQMEWQGYGGQKNLAAEKASHTWILNLDADEEVSSEVEREIRTLMEVGPMFSAYDFPRKNFFGEHWIRFCGWYPDRIIRLYDKMKARFTEGRVHEKIETAGGVGSLNEPLLHHSFRDMEDYITRQNRYSTLSAQDRFDRKGPVGIGRILLGPPWVFIKVYILRQGFREGRLGFFIAASMAFYSFLKYIKTHECKVS

SEQ ID NO: 670 - protein, 257 aa, Unknown
  Description of Unknown: Candidatus Peregrinibacteria bacterium GW2011_GWC2_33_13 sequence
MTISVVIHTYNSEKYLEECLESVKSVEEIVICDMYSNDRTIEIAQKYGAKIVYHENLGFADPARNFALSNASQDWILVLDSDEIVPKELLSYLREYIKNHDPLYEAVYIPRKNILLGKVLWSWYPNPIIRFFRNGVVTYDEKVHCAPTIHKGGQFFIDPKRTELALIHYNYDSIEAFISRMNKYTSLELEKFSERNIKFSVTLLFTRPIAEFLKRYFLKKGYKDGWHGFIFAVLMGIYKFVAIAKLWQSELNLETKA

SEQ ID NO: 671 - protein, 265 aa, Franconibacter pulveris
MFKLSVCLLTHNSARLLREVLPPLIIVADEIVVLDSGSTDETVEICREYDISPHTHPYAMHGQQMNYAVDLAKNDWVLCMDSDEILDRETVDFILALKAGETPSPDKAWRISRYWHVLGQPVKTIYPVSSPDYPVRLFNRRQARFNDRPVDDKVEGNIETVKIPGYVRHDTFYSIHEVFNKLNGYTSRLVKYKYVKPSLWRGVISAIGAFFKWYLFSGAWREGKVGLVTGLYATFYSFLKYFKAWYAHDKKSARVKTASDSQFIR

SEQ ID NO: 672 - protein, 262 aa, Unknown
  Description of Unknown: Nitrospira bacterium SG8_3 sequence
MQRETVGSAVVSFNEEKNLQPCLESAKWMDEIVVVDSFSTDRTIDIARKYTNKIFQRHWRGFGDQKNYAMDQVSTDWVFILDSDERISAELQAEIETVLSARSTDGPVAYYVPRHNYYFGSLVLHAGCYPDYQLRLFRRGIGHLDDAEPHNKFIFTGDSAYLSCPLIHHTRPTLQNYLEKFSNFTTMAAQDRAKTKGYVRSTDLLFRPVFTFLKYFLVRQGYRDGMSGFLVSALASMYTFVKYAKVWHMKQYESYGSLQEKK

SEQ ID NO: 673 - protein, 258 aa, Unknown
  Description of Unknown: Flavobacteriales bacterium 34_180_T64 sequence
MKEGTVKLTALVITYNEMIHIEELIASLSFADELIVVDSFSTDGTFEKLSALNHVNVVQHKFESFAEQKNYALSLANHDWVLFIDADERISEEFKKEVHEKINALHNPIAAYYSLFQYHFGQTPIKYSGFQTAKSHRLFKVSKCSYDTTKKVHENLIVDGESGLLNNRIKHFSFRNYEHYKEKMKHYAHIKARELHKKGKRSTFFASRIKPLYRFFNHFVMRLGILDGKIGYIISKLNAFEVKERYRELDRLNDSLSK

SEQ ID NO: 674 - protein, 251 aa, Giesbergeria anulus
MNRPTLSVILITKNEALLIDQALASVQWADEIIVVDSGSTDATVEICRRYTDKVTVTDWPGFGAQKNRALALATGEWVLSIDADEQVSPELAQEIRATVQDAAYPVYSLPRLSSFMGRPIRHGDWWPDEIPRLFRRTQARFSDDLVHERLVFEGAAGRLQHLLLHQSIRSIEQLLGKTNSYTTGGAVRVRQAGKSCGIGTAISHAFWAFLRGYVFKRGFLDGKEGFIIALSVAENSFYKYVKASYLPPRQP

SEQ ID NO: 675 - protein, 254 aa, Prevotella sp.
MDKKISVVINTYNAERLLKKVLESVKDFDEIVVCDMESTDATVEIACQHGAKVVTFPKADHKSAEPARTFAIQSAQSPWVLVVDADELVTPELRDYLYSRISQPDCPAGLYIPRKNYFMQRLFDYPDYQLRFFIKEGTTWPPYVHTFPQVNGPLGYLPKERKELAFIHLADDTISMRLKKTDLYTDNEVKKRFGKHYGATALLVSPLWRFIRSYFFKGGIRRGKAGFINSVLYAFYKFITVAKIIEYNRQNDIR

SEQ ID NO: 676 - protein, 252 aa, Halanaerobium saccharolyticum
MMKNLTALVLTYNEEDNIADCLDSINWIERVVVIDSYSDDRTEKICQQYDKVDFYENEFNDFASQRNFGLDKIETEWVFVIDADERVTEELRDEIKDVLNKPEVEGYEISRKNYFLGKWIKYCGWYPDYTLRLFRSKYKYKGLVHESPQINGRIDRLKNDFIHYTYKDLESYVSKMNQYTTLDAEKKYSAGKTVGISYILSRPFLEFVKKYILKRGFLLGSQGLILSILSAYYQFLKSVKLWELNKFGDGNL

SEQ ID NO: 677 - protein, 252 aa, Shewanella woodyi
MKLPISVFIITKNEEKHIEKTLQSVALLDEVILVDSGSTDGTLAIAERYGAKIYSHPWQGYAKQKQYAMSLCSHEWVLNLDGDEAINTSLIEAFKTIMEQDKADSVRFWRNDIFIDKPLSSWSKKPNNHRFYKRSKSFFDDSRLAHESATVDGKEIFINETFDHFGYCSIEAITSKNNSYSGLKADEKFAKGKKFSNLKLITVFPLIFIKEYFIQRKIFSGRRGFILAVMDAYYAFIKEAKLYEHHQLKDNK

SEQ ID NO: 678 - protein, 342 aa, Unknown
  Description of Unknown: unclassified Butyrivibrio sequence
MITISLCMIVKNEEEKLPTCLDCIKDLVDEMIIVDTGSTDKTIEIAKSYGAKVYNFEWTGSFSDARNYSFEQATCDFIYTADADETIDEENRERFRQLKKDIDELDIDVVQMYYCNQLSHNTVYNYDKELRPKLFRRIRKYVWHDPIHEMIKLDSTVCNSDVEVKHNPTEDHGERDLAAFRRAIREGEYISKRLHNMYARELFMVGTDEDFMLSKEFFEESIMDNGRDLDQIKEAACVLAHIAVLDGKTEEILKYCLKDLTTIPSSEMCYELGNYYRNKGDLIEAIIWYYNAAYETSPILEIHRGGDMALHKISECYRELGNLEQAEDYEAAANNWQIPSNE

SEQ ID NO: 679 - protein, 259 aa, Unknown
  Description of Unknown: Proteobacteria bacterium sequence
MAEEIFLSGLMVAHNEEEVIEEALKSLHFCDEIIVVLDRCTDQTASIAKKYATKVVEGGAGDNFHIEGVRRNTGIEACKGTWVLELDADERISPELATEIQKTVKTVGEKGYYLLPVHNYVGDRHVQYGWAGSFGTNSVARLFTKGSKTWGDGLVHPKVELHNRLGRLTKPIVHLVDKDINDMIDRLKRYTDARALDMASQPLPKFRTTVRKGLTRFYKSYLARKGYKEGRMGFLLALMAMPFVILSHIKAEIEVKKNG

SEQ ID NO: 680 - protein, 253 aa, Pontibacter ummariensis
MPGVSAIIICKNEEQHIAGAIASLSWADEVLVVDSYSTDNTLQIAATYPVRLLQHAFENYSRQRNWALSQASQPWVLMLDADERIPGDLQAEITALLQSEPAHAAYRIFRKNFFMGKRVRFSGWRHDGVVRLFDRRRCQYSDKNVHEELIIPGTVGQLKHRMLHYTYKNLPHYLEKWDQYTWLSAKDKAKKTKHVTLFHLALKPWVRFVRQYFFKLGILDGRVGFVIASLSAGSVFMRYLKVWRLQEEELQNK

SEQ ID NO: 681 - protein, 265 aa, Unknown
  Description of Unknown: unclassified Klebsiella sequence
MLKLSVCLLTCNSSRLLREVLPPLLKVADELIVIDSGSTDATLQICQQFGLTAHHHPYVTHGAQMNYAISRATHDWVLCMDSDEILDDEVTAAILALKAGDEPDPACAWRLPRYWFVLGEEVRTIYPVSSPDFPVRLFNRAVARFNDRPVDDQVVGFKHDSKLPGFVRHDTFYSLHEVFSKLNSYTTRLVVHQKIRPSIGRGIISAIGAFFKWYLFSGAWRKGKVGVVTGLYATFYSFLKYFKAWYAHQDKQEPAAKKHTDSRTV

SEQ ID NO: 682 - protein, 251 aa, Unknown
  Description of Unknown: Pelagibacteraceae bacterium TMED13 sequence
MKKISVLLVVHNEEKQISDCLERLSFSDEIVVILDKCTDNTLNIVKKFTNQFYSGSWDIEGDRRNYGIQKCKNDWILEIDADERINLNLSKEILYTIKNSQYDWHQINVDNYINRKLVSHGWGAYFGKSAYAGLFRKKCKSWGSQRVHPKITLLGNRGGNLKNHLIHYYCYSIADLIKKLDGYSSARALDLEKENIKENIFTNIRRVFSRFWKCFIVRKGFKEGRIGLMIGIVAGLYPLLSYLKYKENKND

SEQ ID NO: 683 - protein, 293 aa, Unknown
  Description of Unknown: Microgenomates bacterium UTCPR1 sequence
MKLSLCIATYNEEKNIHYALDSSYDLADEVIVVDGGSTDDTVKIAKSYGKKVRIINSDNPSMFHKNKQKAIEAARGEWILQLDADEELSDELKEEIKKVVDIGSSFYPTILGNQREAGKIASVQSGPANSRYSSENREIVAYRIPRRNWFLTKFLMKGGQYPDYTIRLYRNGVAKFPCKDVHENVEINGEVGYLKSPLNHYADPDFSRYLMRWDRYTTLEVQRPKFKVKNENKNSFLMFLEYFFWKPMMTFFSMFIRHKGFMDRFPGFVFALFSSIRFWVIYIKWVMRRRNSN

SEQ ID NO: 684 - protein, 246 aa, Unknown
  Description of Unknown: Candidatus Roizmanbacteria bacterium CG10_big_fil_rev_8_21_14_0 _10_39_6 sequence
MKHFSILILTKNEEENIGRCLNSVAHMGDETIVVDDQSSDATVEIARTHGAKIYTQSLNGNFAEARNRAIAQVKSRYVLCIDADEVVSNEMRDYIAQIPESTQEYAFAFKRIDYFWNTRMRFGEVRNVYVTRLVAKDHGTFIRPVHEIWQGPKIKKVNRPLYHYPHPTIASFLHSINTYSSLNAEYMLTQNKKVGVFELVTIPMAKFIYTYFAQFGFLDGAAGFVYSFMMSFHSFLTRAKVYTGKK

SEQ ID NO: 685 - protein, 260 aa, Salinivibrio socompensis
MITGVVITLNEEKNIQACIESLRQVCSDIVVVDSQSSDSTIAIAEQLDATVVTQPYLGDGLQKNVGLAHTDNQWILSIDADERLTEEAVKQIQALDLANTEHDAFAFRRRNHIGSRWIKQCGWYPDYCIRLYNKSKTRFAEVKQHAAVKAKNPKQLDCDLIHYSFENIGQLFAKPGRNFSGRAAKIMYQKGKRANGFSPFIHGLNAFIRKYLFQRGFLGGVDGMTVALSSAVNSYLKYAKLLEFQRDPKVLENEDFDKVW

SEQ ID NO: 686 - protein, 377 aa, Aerococcus urinae
MATLPDRHSFPRRSSRPLVAASMIVRNEERHLPDCLSSIAGLVDEIVIVDTGSTDSTIDIARSFGAKVLESPWQGDFAAPRNLSLDNCSSEWILYIDADERLRGIDRAGLEAALSEPGRVCLRPWLRPRIGYTPYREYRLFRNDPRIRFRSKIHESIVPGIEAVAASDGLRVGAIEAVLEHVGYEGDQTAKHRRNLPLLREQVMHSPDRIFLWWHLGHVLEGLGQIEEAEEAWAHGVELARRDVDGTTDALAYLSLIGSRVDRGEDVSALLADAKRRFPTNHYLRFLEARHHMNGKRFAEALPPLLTLAAIDGETFRDEQCAYNKELFGLPTYEALATCYFRLGDFNESATWYGRAEALAPERADLRAKRVVAASRA

SEQ ID NO: 687 - protein, 247 aa, Unknown
  Description of Unknown: Candidatus Microgenomates bacterium sequence
MAKITAIVLTKNEEKNIKDCLYSLTWCDEIILIDDYSTDNTVAIAEKFGARMIKRRLNGSFASQRNYALEMAKNNWILFVDADERVSDSLAYEIKKAILNENNSGYYISRNTVFLGKEMRGGEWSGAKLLRLGKKNSGLWTRAVHETWEIGGTVELLKSPLLHLSPTSLDKMISSMALYSPLHARSRASENKDVKYFQIIIYPVVKFFNNFFVKRGCVDGVHGFVYSTLMSLHSFLSLATQWIEKKS

SEQ ID NO: 688 - protein, 253 aa, Selenomonas ruminantium
MSRLAVIILTKNEETNIVAAMESAAFADEVLIVDSGSTDRTQELAEKRGAKFVSHPMDESGFAGQRNFALTQTDAEWVFYLDADERITQLGRDVIQDIVAQNSNNVYKVERKNIVFGQLMNYGVHRPDYVARLFPRTAVQWQGRVHEGIKTELPVKKLTDILQHYTYTNWYQYFAKFNRYTSLAAEELAQRDKQISNIGIIAHTLGAFFKSYILKKGFLDGFLGFVMSFMSMAYTLTKYMKLQNIYRLKLDRS

SEQ ID NO: 689 - protein, 254 aa, Paraburkholderia rhizosphaerae
MNEPTLGVAIITKNAAARLAECLQSVAFADEIVVIDGGSTDATVQIAQAHGARVVIDTDWPGFGPQKNRALDALSTGWVLSIDADEIVTPELAVSIAAAIATPRADVYAIDRLSAFCGHWIRHSGWYPDWIPRLFRRGSARFSADLVHERLVFDTRVERLSGKLLHYSYEDFETVLRKLDAYSTAGARQRHAAGQRGSFGKALARGAWAFMRTYVMRRGFLDGRAGFMIAVFNAATVYYRFLKLAHLETQQPRK

SEQ ID NO: 690 - protein, 255 aa, Unknown
  Description of Unknown: Microgenomates group bacterium GW2011_GWC1_39_7 sequence
MPLTVIVLTKNEEKNILDCLEGVFGSDQIIVIDDDSSDRTVEVIESLKKKNIEIFKHKLNGDFAKQRDFALSKAKSDWVFFLDADERVPASLFKEINYKIVNSKHRKINGYYIKRRDVMWNRELRYGETGNIKLIRLAKKGAGGWVGKVHEVWDISGEVGDLDNELIHYPHQSTREFLSEINFYSSLRSKQLFDEGKRVKWYEIILFPKIKFFLNYFIRLGFLDGIQGLALALFMSFHSFLVRGKLWLLEDNEKQ

SEQ ID NO: 691 - protein, 222 aa, Unknown
  Description of Unknown: Candidatus Roizmanbacteria bacterium GW2011_GWA2_34_18 sequence
MKLSAVVLTKNEEKNIEKCLKSIDFCDEIIVVDDYSTDKTLEEIQKLEVKSQNYKSKVKIFKKQLNKDFAFQRNYGLSKATNEWILFIDADEEISENLKLEIKNLKVKKNSGTWMGTVHEVFHTANKVGQINGFLNHYPHPTLKEFINDINYYSFIRTEELFSRGTKTNIFEIIFFPFGKFIYNYFLNLGFLDGPAGFTYAFMMSFHSFLVRAKFYQLTNKQ

SEQ ID NO: 692 - protein, 263 aa, Unknown
  Description of Unknown: Chryseobacterium sp. T16E-39 sequence
MPLTLAVITYNEEYNIVRLLDALCDIVDEIIIVDSYSTDSTKEIILRQYPKAKFFEKKFNGYGEQKNHALKFCSNDWVLFLDADEVPNKELKKSIKQITSLQNPEFCVYKAKFNNHLGTRLIKHGGWGTVSRERLFKKDAAKYSDDKVHEYLVTNQKSGTLEGRLDHYTYKSIHCHVSKINKYSDMMAEKMFDNGKRIKRFKIIVSPVFEFVKVFIFKLGFLDGFAGYYVAKTMSYYTFLKYIKLREKIKISELQKKCSQKNI

SEQ ID NO: 693 - protein, 272 aa, Unknown
  Description of Unknown: Candidatus Yonathbacteria bacterium CG23_combo_of_CG06-09_8_20 _14_all_46_18 sequence
MKKIPCSVEILTFNNEKTIRRTLESVKDFDEIVIVDGGSTDGTLAIAREYGCAIISQDMACKNEDGTIKDFAAARNQGLARARNVWFLFVDSDEYMGAGVVREIGDVARGNATPAGYFVPRKYVFDGRMIECALAYPSFQMRLFHKDAAEKFIKEVHERIKLKNGTETRRLAKPMFVPISVDIRALRKKQERYIAIEQKREGNISIGRFLFLFYHQIKTIMLYLFRMARNAIGCHGSRLPFSYEWGMILYHFKLCAAFARCVRIRKQTWIKA

SEQ ID NO: 694 - protein, 254 aa, Unknown
  Description of Unknown: Chryseobacterium gregarium sequence
MTENVVMDVSALIITHNEEKNMQEVLECFDFCEEIIVVDSFSTDKTVEIAEKFPKVKIIQHPFEDFTKQRNLALDAAKNDWVLFLDGDERITPALRKEIIEELNKAKQKDAYYFYRKFYFAKKPVHYSGTQTDKNIRLFRKSKARYAEGKKVHETLEVNGNIGELKNKLLHFSVNDYESYKEKMIHYGVLKGQELAAKGKKFNPLTQYSKTAFKFFKAYILRLGILDGKEGYQLSYLQSLSVFETYESLRKVQN

SEQ ID NO: 695 - protein, 261 aa, Unknown
  Description of Unknown: Microgenomates group bacterium GW2011_GWA2_39_19 sequence
MKISGIIISRNNEDKIERALKSLNGVVDEIVLIDNGSTDNTIKIAKKYKARVFEDGGKSYSQWRNRGLKEAKGEWVLYLDSDEEVTPGLKKEMQSIIDKDTDTDTENYVAYAIPRKNIILGREMIHGGWWPDYVKRLFRKDALIKWEGDLHEEPVFNGQIGHLKNPIIHYKHNNLSEMVEKTNKWSEIEAKLLLESGHPLMSWWRFIRIMLTEAWFRIVVNRAFLDGTEGIIYAIYQVWSKFISYGKLWEMQKTRINTDSG

SEQ ID NO: 696 - protein, 312 aa, Unknown
  Description of Unknown: Cyanobacteria bacterium J055 sequence
MTSTSAKVPISVLIPAKNEEANLPACLESVARADEIFVVDSQSDDRTCEIAESYGAKVVQFHFKGGWPKKKNWSLDRLPFRNEWVLIVDCDERITPELWDEMAAAIQSGDRDGYYLNRRVFFLGTWIRHGGKYPDWNLRLFKHAKGRYENLHTEDVPNTGDNEVHEHVVLETPAGYLQHDMIHEDFRDIYHWLERHNRYSNWEARVYYNILTSNDDRGTIGANLFGDAVQRKRFLKKIWVQLPFRPTLRFILFYFIRLGFLDGKAGYVYGRLLGQYEFQISAKLYELMNYGGQLNVVKESPKVTKSVAQLNS

SEQ ID NO: 697 - protein, 296 aa, Achromobacter insuavis
MSKIPVSVVVMTKNEERNIAKCLKALADFDEVFVVDSNSTDATCAMAAALGAKVSNFQWNGKYPKKKQWCLEQLPFTHPVVLYVDADEEMTPELAAEIRAALPRFAAGAGGAFVPFDYVFCGRKLRHGHRVYKLALLARDRSRFLDYDDLDVAHMWEVEGHYQPQVQGETFALRARMVHNDHDSLYHYFDKHNRYSDWEANLRIKGLMNDPREANVGARALLKRVFQAMPFKAPISFLHSYVLRLGLLDGRAGFDYAIARAMYYWQIRIKTEEIRKARLAVPEERQQGGTVAGAAK

SEQ ID NO: 698 - protein, 269 aa, Larkinella rosea
MSVLPLPGSPPVSAVMITFNSARILPAVLRALSWCDEIVVVDSGSTDQTLPLAQQFGCRVLHRDFDGFGLQKGFAVSQARNPWVLVVDADEVVSDELRSEIQLRLAEVAAGKRHFHGFEVPISLVFLDRLMRYGGEYKMPHLRLFDKRFGNYNTARVHEDVILTGPVGKLTHHMLHDSYGSLHEYFEKFNRYTTAGARDLLSRGKRGSIAQIIFRLPITFVKAYVIKRNFLNGYPGFIWSLFSAMYPVVKYAKLRELRRSRNPNAALSD

SEQ ID NO: 699 - protein, 507 aa, Persephonella sp.
MKISACIIAKNEEKNLPRLLESLKGKFDEIILVDTGSTDKTIEIAKQHGCKVYHRQWQGFADARNYAVSKASGEWIWHFDADFELEEEEWKKALYYLNNIPENILAVTILIKNIGDNIESAGISSNTFIHRNNPKVKWVGKVHETLNVSESYGIPVFVKHYGFQDSTVLRKKALRNIKLLRQELKELDKNSKQYHIKLFYLVQSYAVLTSYDAKYTKQVIKYATQFINNIVEETKFFDIYVYVYLIEALLKEKRFKEALEKIKEAQQIFPDYLDIIFLEGKVYLELEEYNEAVEAFLKFITLTDQHLKNPFVLSKGHAFVSDKLLNLPYYIENIIPEAVIKSDQYTLEKLINLWKEKKGEYLGILIITTAKKLNQDISKFLNKFINLYNNSSKALSFALVYAEHMGHINTKSKIIKRLQKVDPQNSLLCYFSGKEALEKGKYETALKDLTIYFQKTKNLNIIPDIRKCLINLNLKEELKRFDEEINNLTKKLKTTSDNKTQQKQNRR

SEQ ID NO: 700 - protein, 246 aa, Myroides profundi
MNLSVIIPTYNEEKYIADAIKSVDFADQIIVLDSYSNDKTTQIATDMGCLVLQNKFVNFSTQKNFAIPYAKGKWILFIDADERVTDSLRKEILEVIKNPGEYKAFKLRFPHFFINEFLFHKADKVTRLVYNEGVHFTGEVHEKLHTTEGKTGILKNHVVHLTYKGIFHYMSKKESYSWFQASEQFKKKKKVSYYHLAFKPFYRFFHIYFIKRGYLDKTAGLAGATLDAYGVFARYLKLMLLQKGLK

SEQ ID NO: 701 - protein, 263 aa, Unknown
  Description of Unknown: Flavobacteriaceae bacterium CG_4_9_14_0_8_um_filter_34_30 sequence
MKLQERPKITALLITYNEIVHIQQVLENLAFADEIIVVDSYSTDGTVEVIKAYKNIKLVQKKFNNFTEQRNFACSLATNSWILFIDADERIPQILGDEILNTVSSSNASAAYYIKRKIFFNGKQLRFGGRQTDKIHRLFQKDKAHYRKDLLVHEKLEVTGETGILKNYLNHFPYKDFAHYEAKRKHYARLKAKELFLKKKKSNLFHFCIKPPFTFFQHYILKLGIFDGYPGLVLSYLNAKYVYKRYTYLNKFYAANSMETNYN

SEQ ID NO: 702 - protein, 267 aa, Unknown
  Description of Unknown: uncultured bacterium sequence
MKLSIIILSRNVKNEIIPAIKSSQFADEIIAVDTGSTDGTLDICRQMGVKIVHTTTDSFSKWRNDGAKAAKGEWLLYLDSDERIPVKLAREILTTIQNPDYAAYTISRYEVFLGKHLGHWGDPRVLRLMKRSALVRWEGKLHEQPKINGPVGKLKQQMVHLSHKNIDEKLPNTLVWSKYEAQMLLSAHHPPMAGWRFIRIMFSEFWYRCVRQGLWRDGTEGWIEIIYQMFSKFVTYERLWEMQRKPSLKDTYDNIDRQIISEWEKQE

SEQ ID NO: 703 - protein, 720 aa, Unknown
  Description of Unknown: bacterium 1XD42-8 sequence
MKFNFLFGRMAMKARVKNNKNILLSVGIITKNEEKNLPNCLEGLKPLLMAIPSELIIVDTGSTDQTKEIARKYTSKVYDFKWINDFSAARNETLKHASGEWYMYLDADEWIEDCRDLIAFFSNKSELACYNSASITIRSFVDEQMTEQNDFYAPRIARRFPDTIFVGRVHEYIKVRYQPRKYINCVARHFGYVSDNGKVLNKSKRNLPLLLESLDDPTTDLPHTYTQIANEYVIHGDIDKAMEYQRKGIDSLESDDIPERCALYHELVRLLCSQEKWDEALQIAQEYFSGKKTIYSTDVDIHLFLAIAWKNKNDPVKEQAELETYFRLRQLAEQKALDTADLLAANLCYTTVGYTNLAYFLYAILMNDTEPVKALENLEKIQGWNKVEPKVYIEMENSCVIAAKAWDWYPNHYDVISNDEEWGLQRREKMIEIWKNYPESRDSMAQALAKLDIQDDPFLLEVRLQQNMPDALETLEETLPTMSVTPYEINLLYYAMKENLDIDPFISRIDADELQDYIAVIDDWENAYQVITDYYQNYPNPPSLRGLRWKCTALEHILLQADVTDEVVQQNFISYVQSMTVLARALYKEPSEEALSIIPHVHRFAIYMGRAEAARRANKMAECVQYMVDAANEYPIMKHLVQAQIEAIRQDMNEALQQEQNRDAERASLYLQIKEKLRVLIEAGDFDNAAQILEQYQKLNPTDEAISYFWQKINNPVKPS

SEQ ID NO: 704 - protein, 852 aa, Pseudothermotoga hypogea
MIVKDEEHNIRRALDSIKDVADEIVVVDTGSTDKTPQIVREYTDKLYFHPWKNDFSEARNNSLKYPTCEWVLIFDADEEASEDFRKNIRSFLESLPPDVNTVYLPTLSYLDWDFKRSEVASTPRIFRNGTVYYKNIVHNQAIYKPKVVNANFLIYHYGYIWTRKLKKQKYERTGNLIRKHLQSCKNDQERLYYLVQLYKTEKTGGTLYQASEVGWQALQLLKKLTSVPAIGLEFLYLFSVDLLNAGLYDLAEQLSKTAIQAVPEYPDPYLSLIHVSFKKKDWQTLLKHYDDFKKAVEHASINIEKFGWTIMSFKDVPTADLLAMIAAIEVEDYDKFNEIALERFEKDEDVREDLVQYLLNKASAKDAEKALPGLKKLLEFARRKNLQLNAQAFYEKVVEKRLPVKLEEILLKQITPFSYYLIKRLETNADLLLDFLSSGQHEKLVRENGVGGLLFVYTHLRDDEKKPFLEKFLEDEDSLIKGVAKALYADHLLKESKFLEAIRAYRDSIQLVPELSQFIKPIVEDLKTRLDPTIEGVYEELYRFYAKQKEFMIDFKKYAGNDVSKLYLISDSDVALYVSAVHTDKAEKSVELLSKIKDPSKFPMYHYRMAKFYNKFDKEKAFVHHIKAVETNEKLADLVLGRFSYTGLYPNATLNWFDRSDTIVWVGNISEKFPTLGVIHPIRAWKRAKNGLLYAIPFPIDESIKAYKDLEKEFGIESFAKVKESQLRQALVETNWDNVEKTESLESFEHLFEDLGVETSNDSKRRIVLEGIETQLDLSKLVGDSKEALIFYHFPNLSDENDLVWFYPAFRVLRSSAQMRKELSKLGFHLVKEFFFDRGLRCVWVKREGSDP

SEQ ID NO: 705 - protein, 256 aa, Capnocytophaga sp.
MQPLTEKVSGLIITYNEEKNIKEVLQCLDFCNEIIVVDSFSTDHTVAIAESFPKVKVIQNKFEDFAQQRNLALENVSNDWVLFLDGDERITPELKEEIILTLNSPEKKDAYYFYRLFFFAGKPIHFSGTQGDRNFRLFRKSKCHYVPERKVHETLSVEGTIGTLKHKLLHYSVSDYKSYREKAILYGKLRGEEMFLKGKRYNPLKMYVKMAFHFFKTYILKLGILDGKEGFLLSKVSALSVYENFRSLKQQQNKNN

SEQ ID NO: 706 - protein, 262 aa, Unknown
  Description of Unknown: Chryseobacterium daeguense sequence
MPLSLAVITYNEEENIVRLLDSLKDTVDEIVIVDSFSTDKTKEICTQKYPQVKFFEKKFNGYGEQKNHALNLCSKEWILFLDADEIPDETLIHSIKKIISSEQPEHKVYKAKFNNHLGIHLIRHGGWGNVCRERLFRKNCAKYSDDKVHEFLVTGEKAGLLEGKINHYTYKSIHHHIVKINKYSDMMAEKMFERGKKINRFKIIASPIFEFVKVFIFKFGFLDGFPGFYIAKTMSYYTFLKYIKLHEKIRLMELEKKHGKKC

SEQ ID NO: 707 - protein, 284 aa, Parageobacillus thermantarcticus
MNTNISVLINTFNEEKNIRNCLESVKWADEIIIVDMYSDDRTVEIAREYTDKIYMYERMGYADPARQFALEKASNEWVLVVDADEIVPIRLRNKLIEIAESGKYDAVLIPSINYFFGYKMKGTGWGPLQDMHIRFFKKKFMNYGTRIHNFSNLDPSARVYKLKDESLGFIHFNYIDVEHFLEKLNRYTTIEAKNAVDAGEKFSVTKLLIIILKEFINRFIRRKGYADGFQGFALSMLMVTYRLSASLKHYLIEKYSCKEVREEVLRQYDIIANREIEKYKNTKV

SEQ ID NO: 708 - protein, 257 aa, Unknown
  Description of Unknown: Candidatus Berkiella aquae sequence
MTKLSIIVITKNEAHNIGDCLASVAFADEKIVFDSGSTDDTVSVCQQYTSRVTVTPDWPGDGPQKNRALATATGEWVLCLDADERVSEALAQEILAAIQNDRGFAAYEIPYQSTYCGKPLRFGDWRNESHVRLFKRGLASFTENIVHCHLQVHGKTGKLKHAIIHHPFHHLGAMLFKLNDYSTQSAKALFAKGRKATLTTALSRSLWSFFRGYFLKLGLLDGKEGFLLAVSNAQGTYYRYLKLMYLWQAHQNKGTCR

SEQ ID NO: 709 - protein, 261 aa, Unknown
  Description of Unknown: Candidatus Omnitrophus magneticus sequence
MKKTPLTVVVITKNEEENINDCLASAEWADEIIVVDDESRDKTIEIAKKYTDKIYSRKMDNEGRHRNWAYAKASNDWVLSLDADERITEQLAEEVTNLLKGSPVYKAYTIPRRNFIGKYWLKYGGEYPAAQTRLFLKKEFKYEEAEVHPRALLDGDTGHLKGDIIHYSHSDIADYLKSLNSHTTLEAKKWYAQGRKMSLFHALWRAFDRCFYRRIIRKQGYKDGIYGWTVAIFSGFYQIVSYLKYREMIELNKNNKPAKVK

SEQ ID NO: 710 - protein, 251 aa, Unknown
  Description of Unknown: Candidatus Riflebacteria bacterium HGW-Riflebacteria-2 sequence
MLSAVIITKNEEHNIKKCIDHLIDWVDEIVVFDSFSTDRTVAVLEEFRSAKIKVTQIEWQGFARTKNLAVEAASGDWILSVDADELVTPELRAEIQRLVGTAEREGYLIPRLLYFCNRPVRYGGSYPDYQLRLFRKDAGRFEETPVHESVKLSSQPGRLKNHMLHYSYRTMFDYWARLNRYTELDAEKKFRQGKRFRFYRVFVLQLEIVKRLFLRMGILDGFPGIFYHIFSAVSSLVKYAKLWEYQETINS

SEQ ID NO: 711 - protein, 257 aa, Capnocytophaga ochracea
MSTITEKVSGLIITYNEEKNIGEVLPCFDFCDEIIVIDSFSTDNTVAIAQSFPKVKVIQHKFEDFASQRNVALQHAQNDWVLFFDGDERITPELRTEIIQTLNCTDKKDAYYFRRLFFFAGKPIHFSGTQGDKNFRLFRKSKCHYIPERKVHETLAVDGTIGVLKHKLLHYSVADYPSYRQKATLYGKFKGEEMYHKGKRYSALKMYAKMAFHFFKTYVLKLGFLDGKEGLLLSKVDALSVYENFTSLKKYQQNHNL

SEQ ID NO: 712 - protein, 256 aa, Unknown
  Description of Unknown: Flavobacteriaceae bacterium UR159 sequence
MTKISGVIITFNEEKFIENCLKSITGVVDEIVVVDSFSTDRTKEICLQYGVRFIENKFIGFTDQKNFANDQAQYDYILSLDADEALSEELKKSILEAKNNFVHDGYSFNRLNNYCGKWIKHSNWYPDNKIRLFNRHKARWKGENNLHEIIVLDEPKSKENLNGDLLHWAYDSIDEHYQKVRSYTNIAAQNSFKRKPNKKIGFSKIVINPFWKFFKNYFIKKGFLDGYQGFVICCFASFGTFLKYVKIKELQQKNNR

SEQ ID NO: 713 - protein, 256 aa, Unknown
  Description of Unknown: Flavobacterium anhuiense sequence
MNSEKQKLSVLIITLNEEQHIKSLLEDLDFADEIIVVDSYSTDKTIGIIESFTNVKLIQNHFVNYTSQRNFALDQAKNQWVLFIDADERLTPELKSEIIATFNSKKTASAYFIYRIFMFEDSRLNFSGWQTDKIFRLFDKSKCRYNEERTVHEKLIVKGPIASLKNKIIHFSYSSYEDYKAKMRNYGILKANEKFSKGIRPYFSMLFLHPLYTFLYQFIMRFGFLDGRKGIIVCYLNAYSVYIRYKELRRITSSRI

SEQ ID NO: 714 - protein, 276 aa, Parabacteroides gordonii
MEKIPVSVIIPVKNEEKNLPRCLSLLKDFSEVIVVDSYSTDKTPQIAEEYGCRLIEFTWNGRFPKKRNWVLRNVELQNTWVLFLDADESVTNDFIVCVRKTIERTDYCGFWIYYNDHFMGRQLKHGVKMRKLALFRKDKGEYEYIDEHSWSHLDMEIHEHPVIDGKVGVLPVPLIHNDYKGLEHYIAKHNAYSTWEVHRFFQLIKSETPLTFRQKVKYFLLDSWFLAPLYFLYAYFFRLGMLDGRAGLLFSLYKMQYFFQIKSKIIELKRISVINN

SEQ ID NO: 715 - protein, 281 aa, Paenibacillus sp.
MEKIPLSVIIMTKNEEKNIRKCLNSVSAFSQIFVVDSGSTDRTVEIASAMDATVVPFDWNGKYPKKKQWCLDNLPFAHDYVLYVDADEEVVPDFEREVRGLFERGNLKDGYFVGFYILFMDKLLKHGHRSYKLVLFNRHKGRFLDYDDLNASNMWEVEGHYQPEIQGSTAVIGSCLIHHNHDSLYDYFHKHNRYSDWEAMVRSNGAYSNLKESQIWIRALQKKLFHKFPLKWVVSFLHSYVLKMGFLDGSPGFHYALARSLYYWQVEIKIKELYYMKERSV

SEQ ID NO: 716 - protein, 256 aa, Unknown
  Description of Unknown: candidate division GN15 bacterium sequence
MKKLSVIIITHNEEENLPRCLESVKWADEVIVVDSHSTDRTPQIAADFKCQYYDLDWHGFGAAKQAALAHASGEWVLSIDADEAVSEELRASITSGINGKSEYRGYEMARRTQFLGRWIRHCGWYPDYILRLFRRDSGRFNPLVIHESIAVGGPVGRLKGDLLHYSYPNLEKYFAKSNRYTTLGAEEALRLGKRAGIIDLLFKPPISFFKHYIQKGGFLDGTQGLLVSWLSAAAVFNKYAKLWHLSKRADVTNGKK

SEQ ID NO: 717 - protein, 282 aa, Unknown
  Description of Unknown: Nitrospirae bacterium sequence
MRRRFNRRGRAVKQFSIIILTFKEEENIRRCLDSINDFTDDIIIVDSFSTDATLKICEKYGCRVFQHAFTNQALQFNWALDTVPWERPWILRLDADEVLPDKLKQELRELTATCGPEVMGIYLNRRMYFMNRWLKHGGMYPHYILRAFRKGAGRYEEKTEEHFVLTSGRAIYAKNDFLEDNRQNTLKYWLKKHDDLSDGEIRDTLLETRNPGLDLKEDLFGNKVERTRWLKTRVYANSPLFFRAFFYFIHRYFFRLGFLDGVPGLIFHVLQAFWYRFYIDAR

SEQ ID NO: 718 - protein, 872 aa, Selenomonas ruminantium
MKLAACYMVKNEEKNLARSLGSIAGVVDDIVVVDTGSTDKTKAIAAGFGARIYDFPWQEDFSAPRNFAIEQTDADWILFLDADEFFAAKPAIKEFLSSQQKLPDAYMVMRRNQEDGQDKDAGLGTDWCCRLFRRARELRYQGIIHEQLTRADGGICIANLPKEIYLWHTGYQHGLIEEKLRRNLKLLEKDSREKGETPHHWLHMIDCYFGLGDYQRAYQYALKVRQSELEIFNNEAHLYHMLIESMRQLKLPAQDMLPYAEEALQKYPTMPEFHGEKGMILCALGELKEARQELETAIVCYQHPERWPAQTGYFTKKSAAVVRARLEELYQLEQEQESKVEQSRITACYIVRNEADNLARSLASIKGQYDDLIVVDTGSTDTTKAVAQEYQARLYDFTWQDDFAVARNYALDQVKTEWVLFLDADEYLRPDSPSNLHDLVARAGNYEVLLLAMQNIEPTSDEVLMEFWAPRCYRYRQERRYVGAIHEELRDNGAVIESVVRVAPEEIMLIHTGYAAAVSKEKATRNLLLLHKAMEQEAEPQRLYRYLAEAYDGIGDQKSAEAWALRDVAQGRQPVVYASASYRLLLRYYAQSEQQENRYILAANAVREFPEVPEFHAELAECLASMEKWAEAEQQADLAERTYVNRTGAEPVMFTDEMLDTLRQRRKTWQENISIGNDEVLSVLRRAQQEKSGQYPQKLLTALADNVPQLTRALLALEREQTSAVQALLGRGEKLLPAAMAQVWAAYRGLQGVLPSADGYGLMLKEALVYGDESQRQRFLQLSLQMTTAEVYQAAEAAFQEELWEEAFRMYETIPADAPEVTAEFWHHAGICLYHLRESAAAIECLQRAQALGCRNRSIPAYIQWSQELSHD

SEQ ID NO: 719 - protein, 281 aa, Unknown
  Description of Unknown: Candidatus Pelagibacter sp. RS40 sequence
MLANITAIILTYNEEKHIKRCILSIKKFVKNIIIIDSFSTDQTLEIAKKFKVKIYKHKFINQAKQINWALKKIKFQTSWILRIDADEYLTKELKKEVKTHINTLNSNYDGISFNRVIKFLNKEIYYGGTSPHKTLRIWKNKKGKCENVWMDEQIIVKGKVFHLNQNLIDENLNDLKWWKLKHRNYAKREAISFLYNKKNKNKSKFEKKLNNVRKSKHLKEKIYYKFPIFVRPLLFFLYSLIFKLGIVTGWQGLVFYYYQTLWFRLLVDINIFKLSWLFRKK

SEQ ID NO: 720 - protein, 259 aa, Unknown
  Description of Unknown: Deltaproteobacteria bacterium sequence
MNGNNNQRQKLTVLIPCYNEEKNIEACLQSVLWADEILVVDSFSTDRTLDIVRQYTDRILQHEYINSASQKNWAIPQAKHDWVLIVDSDERIPLVLSDEIKEILRKGPDKDGYWIGRKNYLMGKQVKYSGWGRDRVLRLFRRDLGRYQEKRVHAEIKLKNTRLLMTHLEHHSISSMTSWVAKINRYSSWKAKDKFEKGISAPVFHLLFRPPFRFFKDFVLRLGILDGWRGFLISAMSSFAELVMAAKITQITLKSRQNH

SEQ ID NO: 721 - protein, 319 aa, Sphingomonas sp.
MSGGRYRHVAGSAQLVSAAAVPRYRPAAARLRARRVPALDRNFRMSVLPVTVVVPTKNEAKNLQQCLSRLGDFAHVWVVDSGSTDGTQQIARDYGARVIDFDWAGGYPKKRNWVLLNEQFKTPWVLFLDGDEQVSAAFVRELASALTETDKVGFWLNYTTHFMGKVLKHGLPQRKLALFRVGAGLYERIEDPGWSKLDMEVHEHPQLDGAVGEIAARIDHLDFRGIEHFIARHNSYSTWEVHRRAQLMADTGGAWARLTKRQKTKYRALDKWWFAPAYFLGTYIAKRGFLDGAAGLHYALMKFAYFHDIKLKIDERAGQ

SEQ ID NO: 722 - protein, 273 aa, Adhaeribacter sp.
MISVIILTKNEEKDIPLCLTSLHWCDDVHVLDSGSTDKTIEIAKQFEAKVWNNVFESFGKQRNYALDHISSKHNWILFLDADEIVTDKFKLAMYEAINIANIEVAGFYCCWKMMLEGKWLKHCDNFPKWQFRLMRKSRARFTDFGHGQKEDKVDGQIKYIKEPYLHFGFSKGWYQWIERHNKYSTLEAVARLQNPQSIKNIFARHGSVRNQALRSWLSKLPGWPFLRFFHAYFLNFGFLEGIPGLIYCTNMGYYEFLIQIKIRELSRNRVNKK

SEQ ID NO: 723 - protein, 253 aa, Nitrospira moscoviensis
MPLSIVVITKNEERNIDACLGSIRWADEIIVVDACSDDRTVDLARRYTEHVVVREWPGFGPQKNFAMDQATSEWILIVDADERVTDVLRDEILRTIGGTVPDEVAAFEIPRRNFFYGRWLRGGGVYPDYQIRLLRRGAGRYDDTLVHERLNLHGRISRLTQPLDHYSIPTVGHHFRKIARYTTLAASEKLKAEIRISPAQVAWHHLGTFLKVYGVRKGYIDGTPGLIAALFAAMYTFVKYAKAWALVEQRGKG

SEQ ID NO: 724 - protein, 257 aa, Capnocytophaga canimorsus
MKISVVINTYNAEKHLQAVLETVKDFDEIVICDMYSTDKTIDIATKYNCKIVYHQNTGYAEPARNFAISQAKNEWILVIDADETIPPKLKKYLYSIIETPDLGGVYIPFKNYFINKWIRSAYPDYKLRFFRKEGAFWPPEVHSTVKVQGKIIKVPRNQTNLASEHLANDSITTILQKNNTYSTAEIVRKKDKKITWFLLICSPLFWFIKFYFIKKGFLDGKRGFIFAVLKSQYKFLCLAKVYEYQSLNNRKNEDLRD

SEQ ID NO: 725 - protein, 253 aa, Azovibrio restrictus
MAQLTVCLLTHNSLRTLAPCLTPALEIADELVVVDSGSSDGTLEYLAGQGVTPIHRPYKTHAEQMNFAIAQASHDWVLCLDSDEFLDPETLAAIRALKPQLSDPDTAYRIRRYWRVLGREVHGIYPVSSPDFPLRLFNRQKVRFNDVPVDDKATGARKRIVLPGHVVHDTFFSLHEVFAKLNGYTSRLVRFQEVPPSLGRAFFSPPFAFLKWYLRKGGWRDGAVGLVTGAYAALYTFLKYFKSWCRARGIPLQ

SEQ ID NO: 726 - protein, 258 aa, Unknown
  Description of Unknown: Candidatus Omnitrophica bacterium CG23_combo_of_CG06-09_8_20_14 _all_41_10 sequence
MEKINLSAVILTKNSELIIEDSLKSVCDWVGEIVVVDDMSTDKTLDIVRKYTDKIQIRKWDREGAHRNFAYSLAKFDYILSLDSDERVTPELRDEIIGIFKEGPKFVGYNIPHRNFIGNYWIKYGGWYPNAKLKMYVKKGFRYEEEAEYHPRAFLEGKTCTLKSDIIHYAYRDFQNLFSKLNHQTDFEAKKWVRDNRKMSFSLCMVKAISRFIKFYYVKKGKKDGFIGFMMALASAAYQLMTYAKYWEIKKKTCGFCK

SEQ ID NO: 727 - protein, 252 aa, Chlorobium sp.
MADNISVTILTKNSAASLVECLTALEAFSEVVIVDTGSTDETISIASGFRNVILYQHPFIGFGPMKNIAVDRASNDWILSVDSDEVVTTELVDELLSLKLDDNVVYMMARDNYYHRRLIRGCGWENDRVERLFNRQSTRYNDKQVHEGLAMSGNLKTELLTGRLKHYPYDNASQLLHKMQHYSTLWAEDQRGRKKASPLKALFYGVLTFLKSYLLKQGWRYGYEGLLISVSNANGVFYKYIKLYEVDRECHL

SEQ ID NO: 728 - protein, 297 aa, Paenibacillus pini
MVNKIPVSVIIMTKNEEKNIRKCLLSVVDFAEVFVVDSGSTDQTQSISEAMGATVVDFQWNGQYPKKKQWCLDYLPFQNDYVLYVDADEEVTAELAAEIKGLFANGAPLNGYFVGFDLVFMNKVLKFGHRMFKLVLLNRHAGHFLDYNDLNASNMWEVEGHYQPQIDGSTGVLKSSMVHYDHDSLFDYFAKHNRYSDWEAVVRSNGAMSNLNESQIWIRTLQKRIFHQLPLKWAVSFLHSYVMKLGFLDGAAGFHYAFARCVYYWQIGIKIKELRYRTEQALGAELEGDLRKVHEGA

SEQ ID NO: 729 - protein, 255 aa, Unknown
  Description of Unknown: Deltaproteobacteria bacterium sequence
MNREKLTVTIITYNEEENIRDCLQSVKWADEIVVVDAESTDRTVEICKEYTDKVFLNPWPGHKEQKNFAISKASNLWVFSIDADERVPDELKNFILEELKNPVFDGYRFPRQNYFLGKWLRHGGWYPDHVLRLFRKDKGSFGGINPHDKVIVKSGKVATVSVPIIHYTYKSISQYVSKQNLYSSISAKQLPVSNKKVTISLFKVVVKPVWKFIETYFIKAGFMDGIRGLITAIGASYASFLKQIKIWEINNLSRE

SEQ ID NO: 730 - protein, 303 aa, Unknown
  Description of Unknown: Candidatus Gottesmanbacteria bacterium GW2011_GWA1_43_11 sequence
MHKKISAVINTRNEEANIVRCIRSVVPYVDEVVVVDMESTDDTVKLAHQYTSRIFKHKNTDYVEPARNYAISKAQGEWILLVDADEVIPDTLGLKLRKLTEGEYSYFGIPRKNFIFGTWIQHSGWWPDYQIRFFEKNAVSWNDEIHSIPVTTGKGIDLPATEAEAFMHHHYVTIEQYIERLNRYSTQEVRQLLRDGVHFEWKNLIAKPTNEFLSRFFAWEGYKDGVHGLALALLQAFSFLVVQLKLWEQQKFETHTPQNFLDESNEVLKRSYNDITYWYQTTKYQEAEGVSKTLAKIRSKIKL

SEQ ID NO: 731 - protein, 262 aa, Algoriella xinjiangensis
MSTKISALLITYNEEKNIQRYLNNVDFADEIIIVDSYSTDKTEQIALQNPKVKFVKRKFDDFTNQRNYSISLANNEWITFFDADEGIPDELKEEIISTINNNPQFDAYFVYRKFFFKNKHIQYTGMQNDKAIRVFRKSKSQYRLDRMVHEIVECKGEVGFLKHKLDHYTFDNEQEYLAKLNSYSKLRAQELHLKKLVPSFFHYNIKPAYRFLSYYIFRLGFLDGKEGYTISKLHAISVANRYRYLDDIYREEKSKTSIKIEV

SEQ ID NO: 732 - protein, 642 aa, Unknown
  Description of Unknown: Geobacillus sequence
MKPFVSLCMIVKDEEKVLQRCLDSVYGIVDEIIIVDTGSTDSTKQIALKYTNKVYDFEWTNSFAEARNFAQQQATGEWILVLDADEYVERANLQAMIDVLKQTDESVEAYDVVIYNFMGVYGERILQHRHTRIYRNCPHLRYDRAIHEQLQRVNGEYVQAKQGILTVYHTGYMHQAVVEKKKHDRNAPLIEREIQAGESVAFDYFNLGNEYLSKGEIEKALESFVKAYQEKKDIRLSWVSYCLVQIILCLKYLKRFEDALRVITDAETLYSETADFPFLRGEIYYLQHRYDDAAKQLEYLLENKSKYPYTIKTFEYVEYDPHMLLGHIYRHKGNLQKAMYHYSSALSFNRKSYEALYHVLQLLARAHHQEEMIQFIEDKQLANDELAISLILRIASVLHLEKVIQWYALKLSDETARRGFQIKVNILQKNYERALQQILKSSVSNLQTYIRTGSLDSYDLLVTAFKTNQLDVVRLLLHLVSEQKEKEFLLFMMNEYKEASEPMFYLLLLERTIQLKEYELFEQFFALSDKFPASVHIQIGHLLHRYEFMDVALQLYRSVENMSAWDAESFVNVIEALAVKNETIEAVQYGLLAISFGHRDFRLYKYVIELMNICGISEERKKVVQQAKRIYPDSEWLKEKEK

SEQ ID NO: 733 - protein, 260 aa, Bacteroides neonati
MMIDPKISVVINTYNAEKYLAEVLDSAKGFDEILICDMESTDRTCSIAKEYGCKIVTFEKKNHHSAEPARTFAIQSASTEWVLVVDADELIPEDLKNYLYKCIKEPDCPAGIYIPRKNYFMGKFMHCHYPDYLLRFFRREGTVWPPYVHTFPIVKGRLEKIAKDQHHLAFVHLANDGVRDIVRKTNQYTENEIEKKKKKRYGTMALLHRPLFRFFKTYILKGGIRDGKEGFIRACLEGYYQFIMVAKILENRKGKSSIHK

SEQ ID NO: 734 - protein, 253 aa, Burkholderia sp.
MTPLSVYILTYNSERHLDKVLAAAKRIADDLLVVDSGSKDATLAIAAKHGARIAHRTFDNFRAQRLFANSLCLHQAVMFFDSDEIASEALIDEITALKASGFSHDAYVVRRDWIVMGTRVHALMPIGCPDYPIRICHRDKTDFTEHSVHETPIGYESVGRVESPMVHHTFETKSELMRKLDFYTDLAATDLLARRKWIGLLLLKQWTSPVGAFVKWYVRSGNWRDGRVGLALGLYALKYTHRKYRKAILLTNS

SEQ ID NO: 735 - protein, 245 aa, Lacinutrix sp.
MTKLSVIIPTYNEQDYLENALRSVRFADEIIVVDSMSTDRTVVIAEQSGCKVISRKFDNFSNQKNHALAFATGEWVLFIDADERIPYPLRQEILEAITSEKHAGYKLNFPHFYMNRFLYHHSDNVLRLVKRENCRFEGLVHEKLIIDGSIGKLKNPVLHFTYKGLQHYISKKDTYAWFQAEQMLKKGKKVTYFHLAFKPFYRFFNSYILRGGFKDGIPGLTVATINAYGVFSRYVKLLLLQRGIR

SEQ ID NO: 736 - protein, 281 aa, Paenibacillus senegalensis
MQNPIPVSVIIMTKNEQRNIRKCLQSVREFAEVFVVDSSSTDKTVEIAQRMGAAVIPFEWNGGYPKKKQWCLENLPFKYDYVMYVDADEEPSPKLIEELRSLFAGGKLKAGYFVGYDHMFVKKVLKYGHRMYKLVLFHRKKGRFLDYDDLDAANMWEVEGHYQPQISGETGVLKNTILHSDHDSLFDYFAKHNRYSDWEAVVRSNGAYHNLNESQIKLRALQKKMFHRMPCKWVFAFLHSYIFKLGILDGAAGFHYAFARSVYYWQVGIKISERQKEKLPT

SEQ ID NO: 737 - protein, 279 aa, Trichormus variabilis
MSHLCQVSAIILTKNEVCNLERCINSLQWCQEIIVVDSGSTDGTIQLAEALGIKVFTHIQPPPFKISEQRNWALENCQLKSEWVLFLDADEIIPPDLAAEIQRICSANNQEYNAYELPARYLFWGKWLKLTQGYPNWHSRLLKLGEVTFTGGVWEHFSAGTKVSRINIPYDHYANSKGFGDWLERHNRYSSWDAQKVVDFLETGKTSALGTERKLKLRLLAAKLWFMRPIVRFIQMYFLRLGFLEGITALIFCLLYAMYEFMTVVKIIELRRKKSGLPL

SEQ ID NO: 738 - protein, 271 aa, Unknown
  Description of Unknown: Planctomycetes bacterium sequence
MKEKLTVIIPCKNERLNIRPCVLSAKLVADEVLVADSGSTDGSLDIVREIGGCRIVEREYINSGNFKNWAIPQATHPWVLIVDSDERVSDGLAREINALLAEGPTRDGYHIYRENYFLGHHIRHAGWGADKVLRLFRRDLGRYEGESDHAEVHVRDGNVGYLRHRLLHYTYWSYDQYFRKLHRYTVQGAQNKYAAGKRASFWQMLLAPPLRFLHCYIFRLGFLDGLAGLQISALTGMSSFIKQLRLWEMEHRLDQPDPEAEHAADQSRHAA

SEQ ID NO: 739 - protein, 291 aa, Unknown
  Description of Unknown: Candidatus Collierbacteria bacterium GW2011_GWB1_44_6 sequence
MKTKRQTISVTLATYNEEANIAACLESVKDFADEIVVVDGYSTDNTAEIAKKLGVKVILRPNNPVFHVQKDIANRSAKSDWILQMDADERVTKEMVKEILGILEGSYFGYDSWISPLKSSINKIIKIFSEPQLLRSPASAYYLPRKNFFLNRYLENAGQYPDPVIRLFQRGKARLPAKDVHEQMIVKGVTGWLMSDLDHLATPNFSRYLLRENSYSSLHAHQLKDAGVKVNLFNTLNYLFFKPLGTFLSLYFRYRGFLDGFPGFVFSLYSGLHHAFSYMKLWEIYKDEEYK

SEQ ID NO: 740 - protein, 314 aa, Unknown
  Description of Unknown: Saprospiraceae bacterium sequence
MPNQQPPTDKRQFSFIVLTYNEEQHLPRLLASIAPLQAPVFVLDSGSTDGTLGIAQKYGAITAHHDFVNHPRQWDFALHHFPVATPWTIGLDADQTVTPELLALLQNFSDDAVPAHVNGIYFNRKNYFKGRWIKHGGYFPKYLLKMFRTGVGHSDLSQNMDHRFVVPGETVVWEKGYLLEENLKENEIEFWIAKHNRYSTLQAQEEIGRKNGWLKQTTEARMNGDPDQKTAWLKAIWWKAPLFLRPFAYFIWRYFFRLGFLDGKQGLIFHFLQAFWYRLVIDIKMDEIQNKKAAHPSMSSPMTHKSTIDVHTRH

SEQ ID NO: 741 - protein, 252 aa, Nitrospira sp.
MNQTKVSAYVIAYNDEPNMRPCLESLRWVDELIVVDSHSTDATAKISQEYTDKVFQHEFHGFGRLRNEAVAHATHEWIFSLDTDERATPEIRDEIRRVLDEGPKADAYFVPRRNYFLGRQIRHCGWYPDYRQPQLFRKSRLRYREEAVHEGFELNGQAGYLREHVLQYPFRDVDHYLAKMDRYSGLMAERMVKRGRRFSPHQLFTHPTFTFCKMYLGRGGFLDGTPGLILSGLYAYYTFIKYAKLWELTKRN

SEQ ID NO: 742 - protein, 264 aa, Unknown
  Description of Unknown: Flavobacterium sp. 1 sequence
MTANSPVKKLSVLIITLNEEEHINALLPDLDFADEIVIVDSLSTDRTEDISKSFSKVKFLQNKFENFSTQRNFAIEQAKNDWVLFLDADERLTPELKQEIIDTLQNTPHYSAYFFERTFMFENSILKYSGNQTDKIFRLFDKKFARYDKRRLVHEKLIVNGEIGFLKNKLIHYSFSSYNEYKEKIIFYAKFKAEEKFIKKTKTTFLHQLFHPSYNFFYNYIIRLGFLDGKKGIIICYLNAYCITVRYRELKKLWRQNQNLTSKT

SEQ ID NO: 743 - protein, 258 aa, Smithella sp.
MPLSVAIITKNEEENIRACLESVAFAGQIVVVDSGSTDATLAIAAEFGCDIYREGWFGFGRQKQIAIDRCVKPWVLLLDADERIPPETAEFIKEIVMSSDAKTAGFSFPRKNYFQGRWIRHAGWWPDRVLRLFRRDAGRMTDAAVHEAVEVRGAVKNLDAVIEHYTESGLDKILQKIDRYSTLGAQEAFAAGKRSSPASAFFRAALTFLQDYFLRLGILDGRQGLTLAVTDSVNKFFKYAKLSELQRKSRRAGKDSCR

SEQ ID NO: 744 - protein, 251 aa, Unknown
  Description of Unknown: candidate division Zixibacteria bacterium RBG-1 sequence
MEMLSVIIITYNEEKNLARCLGSLTFADEIIIVDSHSTDKTKEIAQKYTDKIWEVNWEGFGKTKELARQKASHAWVLSIDADEEVTPKLQEEILRAVQNNSYTGYFVPRQSLFLGKWMEHSGWHPDYVLRLFRKERGQFDTALVHEQAQVKGEIGYLKNPLLHYTYPNLKHYFKKLQRYTTLAAQQLNERKVKAYPWDLVFRPPATFFKMYLIKLGFLDGWLGFVLAILSSYQVLIKYLKLLGLNFRSQNV

SEQ ID NO: 745 - protein, 272 aa, Unknown
  Description of Unknown: Deltaproteobacteria bacterium sequence
MPSMAAVNNPAEIRPTVSAIVVCYNEEDRIEDCLESLRWCDEIVVVDAFSTDRTPEICRRYTNHVIQRRWAGYRDQKAYAHSQTTKDWVLLVDSDERVTPRLRDEILHALTSDKGQFAGYSIPRLMHYLERWWWRGGWYPDYDVRLFRREKATWGGSDPHEKILVDGKLRRLQNPLHHFSYRNIEDHLSRINRFTSVSSHELKKDGVRWRLSDAVLRPIGRFMRSYILKRGFMEGFAGFYVAISAAVYVFLKYAKLWELELEEKKKIERKRS

SEQ ID NO: 746 - protein, 293 aa, Unknown
  Description of Unknown: Candidatus Amesbacteria bacterium GW2011_GWC1_48_10 sequence
AWNEEKNLPTVVNSVRRLADEIVVVVDKSSTDKTAAVAGKLGCKVFWHPHTGYVEPMRNFSISKATGDWILVLDADEEVPPKLAVQIKDILKQPAADYYRLPRKNLIFGKWITSQHWWPDYVYRLFKKGHVTWEDAIHSVPFTKGSGADLPADENLALIHYHYTGIGQYVDRLNRYTDHQLKHLQQNNHRFLPSDFLIFPFREFIRQFFARRGYRDGLHGLTLALLQAFSELVLYLKFWEQLKFPETPFNPGNLVSELRTTNSELTWWYYQSKIDTSSIFLKPWWKLVRRLKL

SEQ ID NO: 747 - protein, 262 aa, Unknown
  Description of Unknown: Chryseobacterium hispalense sequence
MVLSLAVITYNEEDNIVRLLNSVSDIADEIIVVDSHSTDRTKEICLQDYPKVQFFEKKFNGYGEQKNYALELCSGEWILFLDADEVPDNDLKKAIQQVISQQNPEYSVYRAKYNNHLGIHLIKFGGWGNVCKERLFRKGSAKYSDDKVHEFLITNEKPGFLEGKINHYTYKNIHHHVTKINRYSDMMAEKMFERGKKINRFKIIINPVFVFIKVFIFKMGFLDGFPGFYIAKTMSYYTFLKYIKLYEKIRMIELEQKYGNFL

SEQ ID NO: 748 - protein, 245 aa, Unknown
  Description of Unknown: Bacteroidetes bacterium sequence
MARLTVIIPTFNEEHYIEDCLYSVKFADEIIVIDSFSTDGTVAIANKNNCKVVQRKFDNFSNQKNHALQYATCDWVLFVDADERIPYLLKTQIFDAMESGKHNGYKLKFPHFFLNRFLYHHYNYVTRLVIRTECHFEGSVHEKLIINGSIGKLDSPVLHFTYKGLQHYINKKDSYAWFQAKQMRGKGKKATYFHLAFKPFYRFFSSYVLRGGFRDGIPGLAIAGINAYGVFSRYAKLILLQKGLK

SEQ ID NO: 749 - protein, 250 aa, Nitrospina sp.
MLSIVIIAKNEADKIRECLESVQWADEIVVLDSGSTDSTVKICREYTDKVFETDWPGYGPQKNRALEKATGDWILSIDADERVPPELRSEIEQAVKSERYKGYQIPRSSYYCGQRIRHSGWWPDYTPRLLRQGSGKFSNSLVHERLEIQGPVGYLRNPMIHYSFDDFEDVLNKMNWFSTQNAKMLLESGKSSGLLKAVVRGLFVFIKTYILRAGFLDGRRGFMLAVSNAEGTYYKYLKLLLLREKQSQKK

SEQ ID NO: 750 - protein, 277 aa, Unknown
  Description of Unknown: bacterium (Candidatus Blackallbacteria) CG13_big_fil_rev_8_21 _14_2_50_49_14 sequence
MSLSACLMIKNEAESLPRCLESLQTLASEIIVLDTGSSDQSLQIASAFNAQILQRPWSGHFAQTRNQVLQAAQGDWILNIDADEWLEPESSQALQAFLKQAPPAIYALRWQQAPDQPPSRKAVLFPNHRGVVYLGRVHEIPWDPSGQLPYQTLNHIELAHAPRISPLSAQKVKAYRHLLAQDLEHPNPIERFHALRHWGQSELILQNDRAARAAFLAAWELFRHLPAPCYAWGSTVLEALLFLACETEQAEEYSFWRKVYAQAYPENPRLSSLPLEL

SEQ ID NO: 751 - protein, 313 aa, Dethiosulfatarculus sandiegensis
MAGKISCIVHTRNSEATLEKALSSVDWVDELVVVDMQSEDETLKIAANYADRILKAEPAPRIDGVRNTFLKELNHQWALVLDSDEYLALDAAQNIKSLIKQHGDNFDAFAFPRFNYLAGVPLMGGGRYPDHQIRLFRNGSVKWHDSNHQLPEVITGPDRLMKLTPPNCLHIHHPNYENLQEFMAKQISYALNDTYPQDPAAFEFSEYIARAHEQLALRSEPQTDGDVSHALALVMAWDSLLRGLIHWDRLDPKPPLNYLSALPAGATKVPHSKIALRKMLGRHLAWKHILAALVYRLRRLLHKFKPGRKRDSQ

SEQ ID NO: 752 - protein, 229 aa, Unknown
  Description of Unknown: Candidatus Aminicenantes bacterium sequence
DEIIVVDSMSQDKTVEIAREYTDKVYQKAWHGYVEQKNFAISKARGNWILSVDADEEITATLRKEILTETAKADAKDGYRIPRRSFYQGRWINHSGYYPDRQLRLFRCVRGNWTGGRVHEKVDIQGSIGDLKNDLLHYPYKGVISGQLQTVNSFSSLMAEDMYEKWKRYHISLLFLRPTFKFFEIYILKLGFLDGLAGFIIAVTSAYAMFVRYVKLRELWNRLGNQTTL

SEQ ID NO: 753 - protein, 258 aa, Unknown
  Description of Unknown: Flavobacteriales bacterium sequence
MQIQLSVVIITFNEEKNIARCLDSVVKVADDIVVVDSYSTDKTKKICLSFDRLRMTKLNFVEHKFEGHIEQKNWAITQAKHQYVLSLDADEALTEELQQEIINIKNNWQADGYRFNRLTNFCGTWIKHCGWYPDKKLRLWDTTKGKWGGDNPHDKVIMEKGATTKHINADVLHYSFYTVEQHLKQIDYFTDISSKAAFEKGKTSSGLKIFYKSTFKFIRDYFLKLGFLDGYYGYVVCKNSAYAKRLKYAKLRELNRNS

SEQ ID NO: 754 - protein, 318 aa, Coleofasciculus chthonoplastes
MTSLDSKVPVSVLIPAKNEEANLPACLASVARADEVFIVDSQSSDRSIEIAEKTGAKIVQFYFNGHWPKKKNWSLENLPFRNEWVLIVDCDERIPPALWDEIATAIKNPNYEGYYINRRVYFLGKWIRHGGKYPDWNLRLFKHQKGRYENLGTEGIPNTGDNEVHEHVILQGLVGYLKADMDHIDFRDIYHWLARHNRYSNWEARVYLNMLTGHDESGTIGANLFGDAVQRKRFLRKVWVWLPFKPTLRFIIFYFIRFGFLDGKAGYIYGRLLSQYEYQIGVKLYELRKFGGHLNPEAETSTVSSAKSPATSVVSPNS

SEQ ID NO: 755 - protein, 260 aa, Desulfonatronovibrio hydrogenovorans
MAHVPISVVIPCFNEEDNIGACLESVAWADEILVVDSFSTDRTLEIAGRYTNRVFQREYQSHADQLNWTIPQASHEWVLVVDSDERVPDTLAKEIRDLDLANNKIDGYWIRRSNHLFGKKIRFSGWGRDRVLRLFRRDLGRKENKRVHAEFKVPKAGRLKEAILHYPIPSMEAWVVKINRYTTWKAMDKVEKGNPAALIHFFLRPPIRFFKDSVLRLGLLDGWRGILIAAMSAFAEMIMSAKMMQLKRQDNRGGRSVADL

SEQ ID NO: 756 - protein, 265 aa, Trabulsiella odontotermitis
MFKLTVCLLTYNSERLLHKVIPPLITIADEFVVIDSGSTDKTINICEGYGLTPIYNPYSMHGEQMNVAIKHSSNDWVLCVDSDEIFDEPTLEFIQTLKAGETPSPEYGWRISRFWYVLGEQTRTIYPISSPDFPVRLFNRNHARFNLRPVDDKVEGTGETFTIPGHVRHDTFYSLHEVFSKLNSYTTRLVKYQKVRPSIARGIISAIGAFFKWYLFSGAWRQGKVGAVTGLYATLYSFLKYFKAWYQYQDNKKSVADKHTDSHTV

SEQ ID NO: 757 - protein, 248 aa, Sulfurovum lithotrophicum
MDKKISVVMLTKNSSVYLEQVLNALKLFDEVIILDNGSSDNTVEIAQTYKNVRVHEHEFIGFGPMKQLAVSFARNDWILSIDSDEVLEEELIDEITSLPLNENNVYAIKRDNYYAGRLIRCCGWENDYVRRLFNREKVQFDSKQVHESLILNGIEVQKLRYPMKHYSFNNAEELISKMQHYSTLYAQENQKKKKSSTFKAFSRALFSFIKNYIFQKGFLYGYEGLLISVSNANGVFYKYIKLLEKNRK

SEQ ID NO: 758 - protein, 271 aa, Dysgonomonas sp.
MQYICYYLHFLKMKISVVIHTYNAEEFLDRVLESVKGFDEIVICDMYSTDRTLEIANKHHCKVVFHENVGFADPARTYSISQASHEWVFMVDADELVPTVLREYLYYTIQRRPDIGGLRIPRKNYQMGRFMHSAYPDYILRFFKKENTIWPATVHSQPIIEGGKIFDIPSKRKDLAFIHLSNETIRQTINKMNTYTDFETERRRHKNYGVLSLIFEPLLRFLRFYVFKGGFRDGIPGLIWASEYAYYKFITIAKVIESKVTKEDWDKDLKE

SEQ ID NO: 759 - protein, 254 aa, Unknown
  Description of Unknown: Ignavibacteriae bacterium sequence
MNNKLSVIIITKNEQENIKDCLESVKWANEIIIVDAYSIDGTVEIAKNYTDKIYVREWQGFANAKNYALQFVTNKWVFSIDADERITKELKDEINQLISLENNEYCGYMVARRSYFLGKWIKHCGWYPNYVTRLFQKEYGRYNNLNVHEQLIVDGKVGMLKNDLIHFTDKNLFHYFNKFNTYTSLAVEDLLNSKQKFSYKNLLINPIFTFFKMYFLKLGFLDGIHGLILCTLSSFYVFTKYAKLWEKSINNKEN

SEQ ID NO: 760 - protein, 260 aa, Vibrio sp.
MITGVVITLNEEDNIKECIESLMQVCSEVVIVDSLSTDNTLNIAKSLGAKTVSQPYIGDGLQKNVGLPHTDNNWILSIDADERLTPEAVEAIKQLDLNNTQHDAFALRRRNYIGSRWIKHCGWYPDYCIRLYNKQLTRFAEVKQHAVVQAKNPQRLDADLQHYSFENIGQLFAKPGRNFSGRAAKIMYQKGKRANAFSPFTHGLNAFIRKYIFQRGFLSGVDGMTVALSSGVNSYLKYAKLLEYQRDPKVLEKEDFDKVW

SEQ ID NO: 761 - protein, 279 aa, Algibacter lectus
MTSAIILTYNEENILDQCLSALNFVDQIIVFDSFSTDNTLEIAKKHDAKIIQRVFDNYAAQRNAALESITTDYNWVLMVDADEIITEPLKNEIIKATSTENTTTMYRVRRKDMFQDKWIKQSSGYPTWFPRLFKNGCVTVEREINEEYNTTGAEGVLHEHLIHYPFNKGLTWWFDKHNRYSEMEAQKMLHEINDKLVLSDLFSNDPVLKRKAQKRLSYKLPFRPFFIFTAFYILKLGFLNGKAGYTFCKLRYMYETMIDIKFKELKRQQRKALKQATKA

SEQ ID NO: 762 - protein, 254 aa, Unknown
  Description of Unknown: Fusobacterium necrogenes sequence
MKLSVAMITMNEERILAKTLESVKGIADEIVIVDSGSTDKTEEIAKRYGAKFYREVWKGYGSQRNSAIDKASGEWILNIDADEEISLELQKKILEIKKATREDSVFTINFTSVCFGKKIKYGGWSNSYHIRLFKKDAGRFNENTVHETFETTEKVQILKEEIYHHSYSTLTDYFTKFNRYTTEGAIEYYKRGKKCNIFQLVFNPLFKFLRMYLLRLGFLDGKEGFLLACTSSLYTMVKYYKLYEITKNGSYIEK

SEQ ID NO: 763 - protein, 265 aa, Eudoraea adriatica
MNSSEEKISAVIITYNEIGYIEKCIQSIDFADEIIVVDSFSTDGTYEYLLNLENVKVIQHPFDNFTLQKSFALKQAANDWVLFLDADEVVPENLKNEIIETLNSTPEHAAYWFYRKFMFQNKSLRFSGWQTDKNYRLFRKSKVKFSEEKLVHETLDVDGSSGILSEKLIHYCYKNFREYKDKIISYGRLKAKESFFKEKKFNYAYMILKPSWKFLHRYIFRLGILDGKKGIIICYLDSLGVLERYRELKRLETKNQLAYYLAITE

SEQ ID NO: 764 - protein, 249 aa, Selenomonas sp.
MPRLAVIILTKNEEANIEGAMESAAFADEIVIIDSGSTDRTKELAERHGAKFVSHPMDDEGFAGQRNFALTQTNAEWVLYLDADERLNDKLALEIKKHIAECPQYAAEIKRVNVVMGQTMYHGVYRPDYCQRLFKRENVRWESVVHEHAVTDMPTVCLKTPMKHLCLTNWHQYISKLDRYTTLMAEEMKLRGKKVGWLQMHSHAMFAFLKMYLLKGGFLDGKLGFILCQLHYFYTLMKYVKLHDLYKQE

SEQ ID NO: 765 - protein, 260 aa, Hymenobacter aquaticus
MPPVSLSVVIITFNEEANIGRCLEALQDVADDVVVVDSFSTDQTVDICRRHGVRVVQHAFAGYVEQKNYATAQARHDYVLQLDADEVLTDALRTSIRATKANWQHAGYTLARLTNYCGTWVRHGGWYPDRKLRLYDRRLGQWEGLLLHERFEVAPGQTVGALAGDALHYSYHSVEQHVSQLNRFTSISAAELALRGKTQVTLFHLLLKPVWKFVHGYFFRLGFLDGFAGLCIATISAWGVFLKFAKLRTQSATPAAPLSA

SEQ ID NO: 766 - protein, 257 aa, Unknown
  Description of Unknown: Candidatus Roizmanbacteria bacterium GW2011_GWB1_40_7 sequence
MNLSVIIITKNEEELISDCIKSISFADEVIVIDSESTDKTVDIARKLGAQIVTKKFTNYADQRATALKHAKGKWLLYIDADERASEKLHEEIVEVVNRKPQTANGTDSIVAFRIPRQNYYLGKNKWPHIEYLERLFLKEKLVGWEGAVHEHAIYTGEVGTLQNPIIHYTHRNLELMTAKTNQWSEVEADMLLASHHPLMNELRFIRIMLTKFFDSYIKQGGWKIGTPGLIESLYQAYSYFIIYAKLWEKQNKLRVKK

SEQ ID NO: 767 - protein, 470 aa, Paenibacillus sp.
MRQAILEPIVQALKLKRYKDAEIMAAGVVRNDPLLAQAWVYLGEALMHQGCGKAARRVFDRAWMLDPQSGWVPAVYEAVKNVPDGPERASIHELLRVKKVSVAAAVLVYNSERSIERCLSHLSGAVDEIVVIDSGSTDRTPELVRRFAGAKLVDVEWRDDFADKRNRGLSHVESDWVLWVDADEYLASEDKHTVREVAGLFDGLDLPPVLLIWQMNQINGAVSDEFTQARMFPTRRGLCFKGRVHEQIAIAGDGVLESDTYRQSVRIRLHHDGYEPSIVQKERKLERNLRLLEQMVAEEPDNPGWLLYYGRESWAYGNTDHALELFLAAEEKAAAFPRFGRTLDIQMFLAKLYLSRKELDLAEQACRRALAAAPNFPDAMYYLAQIQMRQAVRLLQSSEQSLRGAKEQFQTYRGPTPADSQIAQWKSDAALADLALITGKKEDARALLQRLLERNPGLEQVRLKLRQLER

SEQ ID NO: 768 - protein, 260 aa, Unknown
  Description of Unknown: Nitrospirae bacterium sequence
MSKLSVYVIAYNDEPNIRACLESVTWADELIVVDSHSADATEKISREFTDKVFQHEFKGFGQLRNEAVAHATHDWVFSLDTDERATPEIRDEIRQTLERGPEADAYFVPRRNYFLGRWIRHCGWYPDYRQPQLFRKSRMRYREELVHEGFDLDGRAGYLKTHVLQYPFRDVNHYLIKMDRYSDLMARRMVQQGVQFRNHQLVTHPLYTFAKMYVGRLGILEGMPGLILAGLYAYYTFLKYARLWEMSRGRASFRSERGVL

SEQ ID NO: 769 - protein, 252 aa, Psychroflexus sp.
MPKISALIITLNEAKNIADVIDNLDFADEIIVVDSYSQDSTVEIAEAYQNVIVHKHKFENFTKQRNFALSKANHEWILFLDADERIPGVLKHEILETIQSKKTADAYYFYRKFMFKSRPLHFSGWQTDKNIRLFKKSKSTYTEGRLVHEVLEVNGKVTNLQHHLIHYSYENYISYKKKMLSYASLKAKELFLKGVEPNPYHFIIKPVYKFLYSYIIRLGVLDGRKGIIICYLNALSIYKRYPYLKELIKTSE

SEQ ID NO: 770 - protein, 264 aa, Zeaxanthinibacter enoshimensis
MSKTKEKISALIITYNEMGYIQKCIDSVSFADEIIVVDSFSTDGTYEYLSAHPKVKVIQHPFTNFTLQKSYTLKQASHDWVLFVDADEVVSDALKDEILATINNNTDCVAYWFYRKFMFQNEPLNFSGWQTDKNYRLFRKSKVSFSDKKIVHETLNVNGKSGILKEKLTHYCYKNYEDYKAKMLSYGRLKAKEDFYRESPYNVLYMIFKPAWKFFNHYILRLGILDEKKGLTICYLNALGDLERYRELKKLEKKNELTYYLVMP

SEQ ID NO: 771 - protein, 292 aa, Syntrophobacter fumaroxidans
MPETPLTAIILTFNEEINIVRCLNCLDWADDVVIVDSGSADRTLELAAQARPDIRVFTHPFKDFGDQRNWALDNVQPKHEWVLFVDADEFCVPELAREIGEYIRSPGDTVGAFIAGKNHFMGKWLRHSGLYPSYQLRLLKMGAVRYRKEGHGQREVTDGKAAFLKEGWIHEGFSKGLTNWLDKHNRYSTEEVDLMVRLRSEPPGLRQLFSKNPLRRRECMKRMGAKLLPLMPLLRFGYRYGLRGGFLDGKPGFLFSLLYASVSIQVVAKVYEAERNRTPMGDDRARRPSNRI

SEQ ID NO: 772 - protein, 316 aa, Aphanothece hegewaldii
MYSQLEKIPVSVLIPAKDEEYNLPACLESVALADEVFVIDSQSSDRSVEICESYGAKVVQFYFKGGWPKKKNWSLDNLPFRNDWVLIVDCDERITPELWDEIAFRIKDPSFAGYYLNRRVFFLGKWIRHGGKYPDWNLRLFKHRLGRYENLKTEDIPNTGDNEVHEHVILNGQVGYLKNDMLHIDFRDIYHWLARHNRYSNWEARVYYNLLTDNSDNGTIGANLFGDSVQRKRFLKKIWVRLPFKPFLRFILFYFIRLGFLDGKPGYTYGRLLSQYEYQIGVKLYELRQFGGRLNQPVPSEKSLSESVAKEPAKLS

SEQ ID NO: 773 - protein, 256 aa, Cellulophaga sp.
MRNKLSVFIITFNEERIIEKCLKSLWWADEIVVVDSGSTDATLAICEKYGAQIFHKDFDGLGTQKQFALEQTKNNWVLSIDADEILTEALIEEIQELLKATPNADGYYIKRKQVFLDKVFNYGPESKQCFLRLFKKELGSFDGKKVNASIVLNGNKGKLKNNFLHFKTRSLDTYIEKLNSYATIYAEGEYLKNKKHPLLFIFIRVKYEFFKKYILELNFLNGKEGFYWAFLSTYYLGLKYIKTNEQYKTVKKQLLF

SEQ ID NO: 774 - protein, 256 aa, Lysobacter sp.
MPLSAVIITFNEADRIADCIASLAFCDDVVVVDSHSTDATAQIAHDLGARVLLRPFDGFRSQKQFAVEQARHDWVLCLDADERISQELAAAIATARDAGFDAAGYRFARLSQYFGKFLRRGNAYPDRVLRLFDRRRGGWRGTREVHEAASVDGPVRTLHGDLIHYPYRSLEQQLAKTQRYARMMAEHDHARGKRATVAKLVLSPAWRFWRGYVLRLGFLDGWHGLVYAYVRANYVRQKTIMLWMLQNGQPVTTPER

SEQ ID NO: 775 - protein, 280 aa, Syntrophorhabdus sp.
MDQPVASNQQKQTLNSEQLTPSDGLPLSVYMITYNNGVTIERALQSVADWADEVIVVDSYSTDGAQDIIPRYTEKLYQFETKDLREKYQYAHDQCINPWTLFIDADEWLMDDIKKEISTIIRGTPSCDGYIASRRNMYLGREIKHGGWYPDREIRLYRREKGRWEGGLHAKVTVDGTVGTLKHFYMHTPYADIAHQIRTIDRYSEAFAEDLRSSGRRFHLVNLITRPVYRFFRDYILKRGFLDGTPGFIIVVSTMYYVFMKYAKLWEIEMKEKKQFRNRF

SEQ ID NO: 776 - protein, 249 aa, Pelodictyon luteolum
MAEKITVTILTKDSEATLRECLEALRGFDEVVVLDSGSGDRTLEIARRFPNVVVHEHPFLGFGPMKNLAVDKASNDWILSVDSDEVVSSFLAEEIQSMQLDEHCVYAVGRNNHYHGRLINGCGWDNDLVERLFNRKRVRFNDRMIHEGLEINEGTRIVRLRGRLKHYAYDNASQLIAKLQHYSTLWADERKGKKSASALQAFLFAAFSFFKYYILKRGWLYGYEGLLISVSNANGVFYKYIKLYEANRR

SEQ ID NO: 777 - protein, 255 aa, Roseivirga seohaensis
MDSIKISGVIITYNEESNIARCLNSLMDVCDEIIVVDSFSTDKTKEICIKYDVTFIEHAFAGHIEQKNFAVSQAKNNVVLSLDADEELSETLKQSILEVKQNWATDAYYFNRLTNFCGAWIKHSGWYPDAKTRLWDKRYGSWGGENPHDTVIITSNKPRVKLKGDLFHYSFHRLEDHALRAAKYAEIAAKAMHQRGKKSSIGKAIGSALILFIKSFFFKLGFLDGFYGIIICVTSAHTSFLKYVYLHELNKKAKH

SEQ ID NO: 778 - protein, 281 aa, Bdellovibrio bacteriovorus
MDKSLSIQKMVSSRESFDKTLIQRESDSVTKLPISLVIITLNEEAHIERCIRSAAFVDDVVVVDSFSTDRTVEIAQKCGARVFQEKWKGFGPQKAFAAAQAKNDWVLSLDADEALSPELASELYESFHSLDPEAGYLFPRKSYHLGRWIKYGGWYPDYQLRLFNKSRSQWNSADVHEKVEVKRMLKMKRDLLHWVFDGLSDQVITNDRYSTLGAKQLAASGKKFSYLKLIFKPWGKFIETYFVKRGFMDGMPGFVIAVGAAYSLFLKFAKQWEMERVHKKP

SEQ ID NO: 779 - protein, 289 aa, Thermoanaerobaculum aquaticum
MPELQRPKISAVITTYNEERNIGDCIESLLWCDEIVVVDSFSTDRTPEIAKSYEKVRFFQRPYYGSASQKNWAMDQTQYEWILIFDADERCTPELQAEIEALLASGPKYEAYTIKRRVYFMDRVIRFSGWQHDRVVRLVKRGAGRYPNRRVHADMQTRGPAPVLKNPMLHFMIESFEQYLPRIIKYGFWGAAQGWKTGRRSGFLEVFGRSTWRFIRMYVFQLGFLDGMAGLVFCMLQAFGTYLKWAILWEWRVNAARGRMPNLPPFDEDEKVWEWKAGEENAEEQKANG

SEQ ID NO: 780 - protein, 246 aa, Unknown
  Description of Unknown: Nitrospiraceae bacterium sequence
MFPVSVVIVTKNEEVNIEDALKSVADAKEIIVVDSFSTDRTVDICRKYTDKVHQHEWQGFARQKQTAVDYAEGPWILILDADERVTPELKAEILKNISGTETNGFYMPRENYFIGKRIRYGGWWPDHTLRLFKKDKGRLGPREVHERVVVEGSTVYLKNPLRHYTYRSVSEFVERMERYSTLAAKEIRKNSGRAGLISLVIKPPFTFIKMYFFRLGLLDGTRGFMLAVLYSFYTFLKYAKTWEKQA

SEQ ID NO: 781 - protein, 263 aa, Unknown
  Description of Unknown: Flavobacteriaceae bacterium sequence
MPNQKISALVITYNEMGYIQKCIDSIEFVDEIIVVDSYSTDGTYEYLLNHPKVRVIQNPFKNFTAQKSFALKQASNDWVLFLDADEVVPEQLEKEITQVVNCNPKHVAYWFYRTFMFQKERLRFSGWQTDKNYRLFRKSKVNFSDKRIVHETLDIDGTSGILKSKLIHYCYKDYENYKGKMLYYGQLKAKEAFNNHKQFNYALLILKPLWKFLYSYIVRLGFLDGAKGITICQLNALGDLERYRELQKLKQEETWSSIFKTYP

SEQ ID NO: 782 - protein, 257 aa, Serratia plymuthica
MSDRKSLSVVIIAKNEAGLLPDCLNSVAWADEVVILDSGSQDDSIAIAENLGAKVFVHTDWQGFGKQRQLAQSYASHDYILMIDADERVTPELRQSIEQTLAAPDDNQVYSCARRNLFLGRFMRHSGWYPDRVNRLYANRRYRYNDDLVHESLNIGAAKVVPLSGDLLHLTCRDFFAFQRKQLRYAEEWANQRHQAGKRCGYSSILTHTFGAFCKTWLLRAGFLDGKQGLLLAVVNAQYTFNKYAALWALGRNSSEK

SEQ ID NO: 783 - protein, 263 aa, Syntrophorhabdus sp.
MERERETRPPLSVYMITFNNSTTIARALDSVAGWADEVIVVDSHSPDGTAEIASKYTEQVLQFDTTSQPEKYQYAQDHCRNSWVLFIDADEWLTDSFKKEVEDILTSGSPSDGYIADRRNIYLGREIKHGGWYPDREIRLYRKDRGGWEGGIHAKVHVEGKVGHMKNHYLHTPYADSAYQLRTIDRYSEAYARDLFAAGRSFHLANMLLRPIWRFFRDYIFKMGFLDGIPGIIIMASTMYYVFMKHARLWEMERDEGGRKGVR

SEQ ID NO: 784 - protein, 277 aa, Planctomicrobium piriforme
MPRVSAFVTTFNDEETIGACLDSLKWADEIVLLDSFSTDRTIEIARQYTDCIYQHKFLGYGRQKQSALDKCTCDWVLFLDSDEMLPLPLQAEIQLVMRSEPSVDGYEIPRREQLFWRMASPNTRHNHFLRLFRRSKVKFNTIPVHAGPELDGRSAKLREQFFHFGERSIHEKVEKVNGYSTGLVNFRAGQGRTASPWAMLYYPPFTFLRQYIQKRHYLNGWAGFIASVCMAFYSFMKCAKAYESVCRERYGSTLLPDECPRLEAPQTAEPAQVTSAA

SEQ ID NO: 785 - protein, 652 aa, Bacillus sp.
MLEVASPTISANIIVRNAERTIERCLNSIQKVVDEIVIVDTGSTDQTLELLKKYHVKLIQTNWNDSFSEARNVAKSHSSSEWILTIDADEYLANQEPPLREMLVSTCEAGWITVKNFLSDDFLHSNQQRALRLFKNNELYSFSGRIHEQILPSILQQHHKVEVLEIPLEIHHTGYLQSEVLTHQKSLRNLSLLKKELSEQQYPFHHYNIAVEYVRMNEHEQALEHLITCFQLEKEAASYLSSATYLKAVILLVLKRYKEAQDWLLTSLDRYKDYADLYYLLGEAYMKQHYYEQAANAYLTATKQNVNNQYMTNEGTNSFGAYYKIGRCFQQTKRFKDALLHFLPVISLRPNDREAYLRTAECLHALDIPVHQIKGYFEDVMTHHHGQPLLIVHALFHIGVYQLTKPFIEMINEKQLTASLQNEVYMNERLLSDAITIQKSLLRDLPEAEQLPIIRDHCLAFLIEGVRLPQFLKRHLHTTFPQLYEVIYEKKLNEEACQLIDRALSLHYPELINYFASIHSSTDALLFYGKQLFKHGYLNRAADYFISLLEQQSLSTEVATYLGEILYHKNHLEEAISLLESVDESALTDSLRLLLSACYLKEAKQWLVRLLEERPNERLQLHLHDTEKSLHRIELSLSSAAWTVKQRRNGEK

SEQ ID NO: 786 - protein, 290 aa, Syntrophobacter sp.
MLAAGKRAGPAHAVSHGFWMFFRNYFLSLGFSGGYMQREKVSVYVLTYNEEAKIRDCLESVTWADEIVILDSFSNDRTLPICQNYTDKIFQQEFVGFGKLRNIAIEHCTNNWVLSVDADERVTPELREEILKKLTDGPDADAYFIPRKSHFLKYWVRHCGWYPDYRQPQFFHKRKMKYREQMVHEGFDVTGKVAHLRGHVIQYPFLSLDQFLKKMDRYSSLRAEDMVKQGASFHISQVLTHPAATFWRMYFLKLGFLDGKVGLILSLLYAYYTMLKYAKLWEKLKSQESI

SEQ ID NO: 787 - protein, 252 aa, Halanaerobium saccharolyticum
MKGLSALVLTYNEEDNIADCLDSISWIDKIVVVDSYSDDRTKEICQQYENVNFYENEFKDFASQRNFGLDKIETDWVFVIDADERVTEELKNEIRNLKNDDEVDAFNIIRKNYFLGKWIKYCGWHPDYNLRLFKNKYRYSGIVHEGFSVNGKIERLENGFLHYTYKNLSSYITRMNQYTTLDAEKKYRSGKKIGITYILSRSFLEFIKMYIIKRGFFDGFHGIVLSLLSSYYQFIKNIKLWELNNLRSDLDE

SEQ ID NO: 788 - protein, 258 aa, Bordetella genomosp.
MKLSVIVITKNEAANIVGCLDSVAFADEFIVVDSGSTDNTIELARAMGATVEQTHDWPGFGPQKNRALNLAQGEWVLSIDADERVTPELAKAIQDAIAAPACDAYEIARLSDFCGRFIRHSGWWPDYVVRLFRRDRARFSDAAVHEKVVPAPGSRVGRLAGHFLHYPYPNLDALVNKVNRYSSDAAAMMHARGKRTGIWGALGHGFWTFVRIYLIRRGFLDGRHGLVLAVTAAAGSFFRYAKLMFLTENARRDGAPRP

SEQ ID NO: 789 - protein, 257 aa, Pontibacter korlensis
MPVKLSVVIITYNEERNIARCLESVKRVADEIVVVDSFSKDRTKEICLGYGARFIEHPFGGHIEQKNYALTQATYNHVLSLDADETLTPELEQAVLTAKNNWEADAYSMNRLTNYCGKWIHHSGWYPDTKVRLFDRTKAVWGGENPHDKIILDKGASLQHLRGDLLHYSYYSVSQHLGQINKFTDASSNAMIRGGKTVFLPMVIIKPLFRFFRAYVLKRGFLDGPEGFIISVSSAVSVYYKYVKLYMHNRQQKRDQK

SEQ ID NO: 790 - protein, 302 aa, Unknown
  Description of Unknown: Candidatus Microgenomates bacterium sequence
MKLSVVVNTRNEEAAIERCLSSVSPYVDEIVVVDMESTDETRQRARKYTNKIFKTKPQGYVEPARNFAISKASGEWILLIDADEVLPESLGLKLRKLVTSEFSYYRLARKNLIFGKWMKHTGWWPDYQIRLFDKQCVFWQNEIHSIPITQGRGTDLEAEESLAIIHYNYQTVEQFIERLNRYTSEEAKEAVRQNQTFHWTNLIRKPTNEFFARFFSEEGYKDGVHGLALSLLQAFSMLVVELKIWQYEKKFAEIRPKEFITELNEQYENVRNDYHYWFHTTQGKQSEGLTKNVHKARAKLRL

SEQ ID NO: 791 - protein, 285 aa, Unknown
  Description of Unknown: Verrucomicrobia bacterium sequence
MNSRVPVSVIIPIKNEAVNLPRCLDCVKWADEIFVVDSQSTDGSIAIAQHFGAKVVQFEFNGTWPKKKNWALENLPFRNEWVFILDADEVLPPPAEAEFAEAITDAGDIGGYWINRRFMFMGRWLRHAYYPNWNLRLFRHALGRYEKLTDAPTNSGDNEVHEHVLVNGRTAKLQVEIDHYAFPSIDVFVEKHNRYSNWEARVAAETLLDSSSGKIGSQAVNRRRKLKTLSQRLPFRPLLRFLYIYVWQKGFLDGAEGYYFARLHGFYEFLSVAKMRELLKARERH

SEQ ID NO: 792 - protein, 366 aa, Phreatobacter sp.
MRLSATLIVKNESRFIEDCLSSLAGIVDEIVVVDTGSTDDTVERARRYPVKLGFFPWCDDFSAARNAALEQATGDWILYIDADERFRPLTADWRQQIDRPDIAAARLRLHPRVGWTAYSELRLFRRDPRIRFEGVVHERVHGTVDAVCRADGLHVGMCDVALDHVGYEDDQAAKVPRNLPLLRRYLAEDPNRVYCWWHLGDQLKTAGDNEGAVEAWRNGIAAIARLPASAIRDSESTPYLSLIQHLHGSGEAVDALLAEARARFPRHLALQWIEAKIALERGDIAQALPVFERLAAIDAETFHDEDLAYDKAIFTHLAQESLALAAFRSGRFADAAVHYRQAALTAPNRQEMLVKASLASARAGSL

SEQ ID NO: 793 - protein, 252 aa, Fangia hongkongensis
MDKLTVIIITKNEEKNIARCLDSVKWADEIIIVDSGSTDRTIDIASQYPNVKVYKQQWLGYGPQKNIALSYATNSWILALDADEVLSSELTDNIQKKIQQEHSASVYKFKRLSQFCGKWIHHGDWGNDIIPRLFKKDSARYSNDMIHEKLIYNEKDALLSGILKHYSQESISISLSKLNNYSDATANRLLLKGKKTTLFKASIHKNWTFIRGFFIKAGFLDGSHGYLIAKLSAYGSYFKYVKLWEKQQNDKK

SEQ ID NO: 794 - protein, 249 aa, Unknown
  Description of Unknown: Flavobacterium sp. 81 sequence
MSIEGKKLSVIILTYNEESYIGDAIRSVEFADEIIVLDSHSTDSTTKIVTDLGAKLIFRKFDNYCNQRNHAIESTTGEWVLFLDADERVSEELQKEILETINSNKSDAYRIWFPHFFMDRFLFHYTDKITRLVKNDSIRFENEVHEKLVVKSKAPVLKNYMIHYTYKGLFHFISKKDQYAWFQAKMSIKKGKKATLFLLIFKPFYRFFHTYFIKRVYLDGVPGLAAASIDAYGVFSRYAKMVLLEKNLE

SEQ ID NO: 795 - protein, 247 aa, Unknown
  Description of Unknown: Chlamydiales bacterium SCGC AG-110-M15 sequence
MSISVTILTKNSEQYLAEVLESVSSFDEVILLDNGSTDSTFEVAEGFSNVVVHRTTFDGFGPMHNRAIDLAKNDWILSIDSDEVLSKELQEEIKEISKDDGAVYSFPVHNYFNGKWIRWCGWYPDRHVRLFNRKKTRFTDVQVHEGVITDGMKTCLLNNPVRHYSYSCTADFLRKMQVYSDLFAEQNVGKKKSSLLKAITHGLGGFLKSYIIKKGFMGGYEGFVISAYNGHTAYYKYLKLLEKNRQL

SEQ ID NO: 796 - protein, 278 aa, Acinetobacter soli
MKISALINTLNEEKNIEKCLQSLSWVDEIILVDMYSDDKTVEIAKKYTNKIFYFERVGYSEPARAFALSQVSNEWVVVLDADEVIPKSLSDELIAIAKEDKADAIWIPRKNFMFGHEIKHTGWNMHDDIQMRFFKKSMMTYGSTIHNFVNISDQARIITLKNNETCIWHFNYIDIEHFLEKLNKYTTVEAKQLFDKRKQSSFLIVIYACIREFIYRFILKSGYKDGFYGLVLSLLMCVYRFTTLAKLKIMIEQNNATPRDSIVTTYDDLSSKVVDSYK

SEQ ID NO: 797 - protein, 249 aa, Pusillimonas harenae
MKLSVIIITKNEAAHIGDCIDSVAFADEVIVVDSGSTDETREIAAGKGAKVSLTADWPGFGLQKNRALDLATGDWVLSIDADERVTPELATEIKKELEHPRADAYKIPRLSNYAGRWIRHSGWWPDHVLRLFKRGTARFSDAAVHESVQTASPVAVLSAHFLHYPYADLESHIAKLNHYSSAAAAMLHARGKKTSTLGAVGHAFWTFVRHYLIRRGFLDGKEGFMLAVMASAGSFFRYSKLLLLNKQNK

SEQ ID NO: 798 - protein, 256 aa, Unknown
  Description of Unknown: Burkholderiaceae bacterium sequence
MNTTPPPLSAVIITRNAAAELADCLRSLAFAQEVVVVDSGSTDGTVALAQQLGARVIEKEWLGFGPQKQFAVEQARNDWVLCVDADERISPALQASIVHTLAAPAQRVYRMRRCNRFLGRYLRHGEGYPDWNTRLFDRRAARWADVPVHEHVVSDVLVGDLEGDLLHHSQDTLASYIDKQNRYTTLQANELFARGKKVGALKIVASPLVRFLRFYVFRLGFLDGLPGFAHIAMGSFFGMVKYAKCYALQLSGNKNQ

SEQ ID NO: 799 - protein, 245 aa, Unknown
  Description of Unknown: Candidatus Levybacteria bacterium sequence
MISAVILTRNEEKNIIDCMESLYFCNEIVIIDDVSTDRTVEIAKKAGAIVYEHELNNNFSKQRNFGLEKAKNEWILFIDADERISVDLKNEIKYKILKKGINGYSIKRSDFFYGKELFHGETSSISLVRLGKKNHGLWDGAVHEEWKINGKISILDTPLLHYPHPTINEFLLEINFYTDLNAMELFNKGIRATWYDVIIYPVAKFIHNFIIRAGFQDGVAGMIIAIMMSFHSFLVRAKLLKYNEN

SEQ ID NO: 800 - protein, 247 aa, Unknown
  Description of Unknown: Candidatus Roizmanbacteria bacterium CG06_land_8_20_14_3_00_34 _14 sequence
MKITILIYTRNEERNISDCINSAKLLTDKIILVDMESSDKTVEIAKSLNIPVFNFPKSNYVEPAREFGIKQAETDWVLILDADERITKELANEIKDITRYNQIQSDKISKKTDYIRLNPIESDSVRLHPIISDYISQYKIPRRNTFAGIKWLRHGGWWPDYQTRLINKKFFLNWPKRIHSTPHIKGDIGYLKNPLIHYFHGDLNGMVKKTIIFEDIESDLLFKAKRKTGIGIFFRKFLAEIYRRLIR

SEQ ID NO: 801 - protein, 264 aa, Unknown
  Description of Unknown: Candidatus Roizmanbacteria bacterium GW2011_GWC2_35_12 sequence
MKHDISVIMITKNAESTIENSLKSVSSWVREIIVVDSYSTDKTVEIAERHKSIVYKHKYEGEGKQRNFALSKAKLNWVLVLDADESVTSKLKNEILRIIKATKLLGFNIPVQSYYKNKQLNYGGENYKKMILFKRVQGKSTLDQIHAVCQVHDKKIGLLKNKLNHFSYTSFCQVIKKFTSYSYRVAMVKAKKGEKASLKKIFLYPIHMFYARFIKDKGYKDGLFRIPLDMVFAYMEGLAYLILFISNVKAQIAKLHLKFKKFKV

SEQ ID NO: 802 - protein, 308 aa, Unknown
  Description of Unknown: Planktothrix sequence
MNSNPSKLPVSVLIPARNEQSNLPACLASVARADEIFVVDSQSSDRSVEIAEDYGAKVVQFYFKGGWPKKKNWSLETLPFRNEWVLIVDGDERITPESWDEIAEVINNPEYTGYYINRRVFFLGTWVRHGGKYPDWNLRLFKHKLGRYENLNTEDVPNTGDNEVHEHVVMSSGQVGYLKNDMLHEDFRDLFHWIERHNRYSNWEARVYYNTLMGTDDSKTIGADLFGDSVQRKRFLKKIWVRLPFKPLLRFIIFYVIRLGFLDGKAGYIYGRLLSQYEYQIGVKLFELRTFGGQLNVTPKPDKPPISH

SEQ ID NO: 803 - protein, 254 aa, Unknown
  Description of Unknown: Pectobacterium punjabense sequence
MNKKLSIIIITKNESELITECLQSANWADEIIIVDSGSTDSTVEIARQYGARVYQHNDWQGYGKQRQRAQSYASGDYIFFIDADERVTPELRQSIESVLLNSNLDDKIVYSCARQNLFLGRFMKHSGWYPDKVIRLYANHHYQYNDNRVHESLDYGDAPIQHLSGDLKHLTCRNFSAFQEKQLRYASAWAKERYEKGKSCSYIAIFTHTIFSFLKTWIFRAGFLDGKQGLLLAFVNAQYTFNKYTELWSLNNNK

SEQ ID NO: 804 - protein, 254 aa, Unknown
  Description of Unknown: Deltaproteobacteria bacterium CG07_land_8_20_14_0_80_60 _11 sequence
MPRLSVIVIALNQEANIGDCLKSVSFADEIVVVDTGSADRTVELARAYTGRVIDAPWEGFGRTKNYALDQARGEWVFSLDTDERAPPALQEEILAVVAADGPRDGYRVARKNYFCGRWIRHLGWYPDYTLRLFRRGRGRFRDREVHEEVVVAGSVGTLTTPLEHYSYRSVSEYVARMDRYARLAAQELAKAGRRPYPGELFFRPFFSFLHLYFIRRGFLEGATGYDLAVLMSMYKFLKYYYLRELSQGRDLDGH

SEQ ID NO: 805 - protein, 278 aa, Unknown
  Description of Unknown: bacterium sequence
MPNNEPNSQSNIKADQTEPVGLAVVICTFNNIRTIEPVLESIAPIADRIVIVDSGSTDETLEIVAKYNTKVIHRPWPGPVDQKQFAIDTSPDARWVLLLDSDEIIEPTLQRALAKAVADDDPSVDGWTINRIVRMFGTDLLHTYQPERRLRLIRGGIGQVVGIGPEGKGGHDRIDIAGKVGNLEGNCIHDSWADLDAMMQQHMNFARRAALYNPKGGRAIDILTRPPIAMFKQYVLKQGFRDGKAGFFASATVFCGTLMKHLYIARQKWIHREEEINR

SEQ ID NO: 806 - protein, 255 aa, Unknown
  Description of Unknown: candidate division KSB3 bacterium sequence
MARQKLSVTIITCNEETRIRAALKSAVWADEIVVVDSGSTDQTLEICREYTQHVFQEPWHGYVEQKNIATARCLHDWVLNIDADEIISTGLAAEIQEIFTCGPTHAGYMIPRRTYYLGAWIRHCGWYPDKKLRLFNKQQGRWTGQMLHEKVQVEGTTASLQHDLYHYTYENIEDHLKTINTYTSIAASHKQGSITAAGILGHTLFTFFKKYLIKQGFRDGGRGLIVSLLSAFSVAVKYAKLWELRHVPQEEKRLT

SEQ ID NO: 807 - protein, 253 aa, Unknown
  Description of Unknown: bacterium BMS3Abin03 sequence
MKKKISCVLITFNEEENLKKSLPAVSWCDEIVVVDSGSSDNTLEVCEKFNCKIFHREFDGFGPQKRFAVSKAENDWILSLDADEVISEELKNEILSELNKEKINYAGFLIPRRLYFLGRKFKHGRESKDYQLRLFNRNYGNYTKDKVHEKVIVKGEVKKLKKELLHFSYSSIHQYFEKFNSYTSRAAEELYKQGKKKSIVAIVFSLPVYFVKNYFIYVNFLNGFQGFLWALFSSLYPVVKYFKLMTLNSTQEN

SEQ ID NO: 808 - protein, 264 aa, Granulosicoccus antarcticus
MNHQYSLSVTIITKNEADRIERCLESVKDLANEIIVFDSGSTDATLDIVRRYTDKIWQTDWPGYGLQKQRALEQAQYDWVLAIDADEALDEELQNSLKEFLSRDRQDVVAVKMKWGVTIYEKRLDYGRSARSPLRMTWREGTFFSNDEVHEKMLHASGRTITLKGRLLHFTHRNYGHAQHKSVEYAWLGSQKYFRKGRRCHSLTGAVLRGLWTFILIFFIRGGFLDGSIGFLTAVSYAQNSFNKYAGLWTLTRMEKIETGRAKR

SEQ ID NO: 809 - protein, 610 aa, Unknown
  Description of Unknown: Flavobacteriaceae bacterium CG18_big_fil_WC_8_21_14_2_50_34 _36 sequence
MTYKFLIYISHSYAIPIGKPLETEILKRGYSVWWYSDLAEGAASISHESNAFNSIKEVVAYRPHIVLTITDMVPDFISGLKVQIFHGFPANKRKGLDQFKIRGFFDLYCTQGSSSTEIFNTLKAKYKTFEVIETGWSKVDALYPLKEKSVSEIPTVLIASTFTKQYSLALNDAVLLEIVRLSELNKWKFMVVLHPKLPENIKQKIKKIQNKNITYYNTTDLVPLFKKADFLFADTSSAIIEFLLQEKPVVTFKNNMPGPYLINISSVNEIEPAFEKAKRRPKHLINEIKKFAQFSHAFTDGKSSERVINACIEFLHKDKSYLKKKPRNLVRKFKIRRKNGFFTWKSYRTAIQYPTKVLTTPKVKISAVIITLNEEEHIDALIKNLDFVEEIIFVDSYSTDKTFEKLSSYPNIQKYQKEFLNFPSQKNFALSKASNDWVLFMDADERITQNGKEEILNLLTNTDKVAFWGKFQYYFGNKKINFSGFQTAKSIRLFRKTKCLYDASIPVHENLIVEGKIGTLQNKILHYSFKNYTHYKSKMEHYANLIARHNFEKNKKMSFPLMLLKYAYRFINHYILRLGILDGKIGLKISYLNAYGIYFRYKILKKLNTP

SEQ ID NO: 810 - protein, 313 aa, Nostoc azollae
MTSKIPVSVLIPAKNEQANLPACLTSLQPADEIFLVDSQSTDKSIEIAGIYGANVVQFKFNGSWPKKKNWSLENLPFRNEWVLIVDCDERITPESWAEIAEVIQNEECNGYYINRRVFFLGKWIRHGGKYPDWNLRLFKHQKGRYENLSTEDIPNTGDNEVHEHVILQGKVGYLKHEILHEDFRDLYHWLERHNRYSNWEARVYLNLLIGKDKSGTISANLFGDAVQRKRFLKTVWVRLPFKPLLRFILFYIIQSGFLDGKAGYIYGRLLSQYEYQIGVKLYELQTLGGTLNVAKTPAYTAKPVNQEVEKTAI

SEQ ID NO: 811 - protein, 248 aa, Pusillimonas sp.
MKLSVIIITKNEAAHIGDCIDSVAFADEIIVVDSGSTDQTRAIAESKGAKVSLTADWPGFGPQKNRALDLATGVWVLSIDADERVTPELAAEIQEELDSPRADAYEIPRMSNYAGRWIRHSGWWPDHVLRLFKRGTARFKDVAVHESVQTSSPVVALSKHFLHYPYADLESHIAKLNRYSSEAAAMLYARGKKTSLPGVVGHAFWTFIRHYIIRRGFLDGKEGFILAVMASTGSFFRYSKLLLLNKQK

SEQ ID NO: 812 - protein, 277 aa, Calothrix rhizosoleniae
MNFLISVVILTKNEESNIQRCISSLEWCNEVVVVDSGSKDTTVQLATKLGAKVFVNIPIGLFSAAKQRNWALHNCDLKGDWVLFVDADEVIPASLVNEIRETCSHTTFNAFQLTPRYLFWGKWLKRSLGYPNWHDRLLKRGEVFYEDESGSMECFTKDTKTSRLYEPYDHYANSKGFSDWLERHDRYSSWEAKWAFDFLETNNLEAFGTKGKNRLRVIAAKFWLLRPPARFIYMYFIRLGFLEGWESFIYCLLHAMYEFMTIIKIIELKRKKAGLSI

SEQ ID NO: 813 - protein, 253 aa, Unknown
  Description of Unknown: bacterium 336/3 sequence
MIKISVSIITLNEEKNIARCLESVKGVADEVVVVDSFSIDKTKDICLQYGVKFIEQTFLGYVEQKNFADAQAENDWILSLDADEELSEKLKKEILAIKNTLTADAYEMPRMTNYIGKWIRHTDWYPDRKIRLYNRKKAQWQGQSLHEQLTIHDDAKLIKLKGDILHYSYYSIHQHIAQFNKFTEIGAKEAVQKGKKAPLYKVFINPVWKFIYSYFFRLGFLDGYKGFLVCAISAFATFCKYIKMRELWRETKK

SEQ ID NO: 814 - protein, 253 aa, Vogesella sp.
MSRQLSVVLITKNAEALLEKCLQSCAFADEIVVVDSGSTDRTLAIASAYKAKVIHQPWLGFGPQKQFAVQQASHDWVLCLDADEWLSEKLRHEISNLLHNPALGAYRFARSNKFMGRFLKFGEGYPDYSLRLFDRRQARWSDDVVHEYVIANGEVGTLTGDLMHESGEDIALYLDKQNRYTSLQAETLYQRGKKVGIAKLVLSPLLRFVKFYLLRQGFRDGLPGLVHISIGCFNSYLKYAKLIELHRLRPQEK

SEQ ID NO: 815 - protein, 264 aa, Unknown
  Description of Unknown: Candidatus Thioglobus autotrophicus sequence
MYKISAYIITYNEIDKITDCINSVLWVDEIIVIDSHSTDGTTEIAEKLGCKVIHIPFEGYGKLRNEAIKHCSGEWILSLDSDERCTTEFRDEVMHITENSNYDIYKVPRKNYFMGRWIRHSGWYPNFRQPQLFRNGKMSYTLDPVHEGYVKNSNKDVQTTRSFIWQFPFKNTEEIMHKANRYSTLGARKLNSKGTVGSVNKAFFHGLWAFIKHYIFKFGFLDGGAGFVIAFGNFEGTFYRYLKLSEIQFKWEKPPTINPINKAS

SEQ ID NO: 816 - protein, 253 aa, Psychroserpens jangbogonensis
MIKLSGVIITFNEDKNIERCLQSLVNLVDEIIVVDSFSTDNTKQICLKYNVTFIEQEFLGYIEQKNFALKQASNDFIVSLDGDEALSETLQNSIIELKSNWQFDGYYCNRFNNFCGQWIKHSDWYPNKKLRVFDRCVAHWEGINPHDEIKLKDNRKTSRLKGDILHWTYQSYPEFNQKTEYFSTISAQAYYDKGEKAPLYKIVWNPIWAFFKAYILRFGFLDGKNGFVISAQTANITYLKYTKLKKLYRNKEF

SEQ ID NO: 817 - protein, 244 aa, Pigmentiphaga sp.
MRLSVIIITRNEARNLAECLESVRFADELVVLDSGSTDETVEIARRHGARVEVAPDWPGFGPQKNRALDMATGDWVLSLDADERVTPELAAAIAQTLRDPAYDAYDMPRLSSFCGRFIRHSGWWPDRVLRLFRRGTARFSDDRVHEKVVPAGSVGHLEPHLLHYTYPDLDSAIAKMNRYSTDSAQAMHARGRRASIGTAIGHGAWTFVRLYLFKRGFLDGRHGFLLAVTAAAGSFYRYAKLSLQ

SEQ ID NO: 818 - protein, 243 aa, Unknown
  Description of Unknown: Acidobacteria bacterium sequence
MEITATIITFNEEDRIGEAIASLSCCDEIVVVDSGSTDRTREIAEARGARVIQRAWQGYSKQKNFAAEQARHDWILSIDADERLSIELADDIVNAFPGASAWAAYSMPRRAFYMGRWINHSEWYPDRKVRLYDRRRCRWEGDHVHESMKVDGPVGRLHGDLFHFPYRDWNDHVTRIEKYTKLAAEAARSSGRRGNVLKLLFAPLLTFIRIFFLHAGFLDGWRGLAIAYMGARYVFLRESRILH

SEQ ID NO: 819 - protein, 265 aa, Unknown
  Description of Unknown: Acidobacteria bacterium sequence
MPKLSVTVITKNEAADIAEALESAAWADEIVVVDSASADDTVAIARRYTDRVIVREWPGYSAQKNYAAAAASHDWILSLDADERITPVLADEIRATLAAGPAEAGYRVPRVTWHLGRWIRTTDWYPDYQLRLYDRRSGQWTGRYVHESVAVAGRVGELHGELEHFAYRDIADHLETIDRYTTFAARQMHEGGRRAGLLQIGGHPPLAFARNYLLRGGIRDGIPGFIISALNAYYVFLKFAKLWELQVSARLNHEDTKVAKEHEKR

SEQ ID NO: 820 - protein, 252 aa, Desulfovibrio frigidus
MTSITGLVLTYNGERLLDETLASLSFCSEILLIDSGSSDATLDIAKKHNARVIHNDWNGAIDQHKFAVKQIKTPWVVTIDQDEIISPELKDNILKNLENPPKDLDGFYCPRKSWYFNRFILHSGWYPDKLFRIYKPEGISIGGIRPHEELRPKTKAGNLKGDIIHYPYENFKQHLEKINYYTQDAAEDLYSRGKRGSLGSAISHGIGKFFKQYILQQGFLDGRAGFIIAVHGFFYTFQKYIRLAELEPKDKK

SEQ ID NO: 821 - protein, 951 aa, Anaerovibrio sp.
MFDVKISAVYIAKNEAHNIARSLDSIRVSVDELVLVDTGSADETVKIFESYGGKVYHEKWADDFSAPRNIALSKATGDWIIILDADESFSMETRQNIRAVLAQASAETNGLLINMINYDKDTGKALDEFYALRIVRNIPGLNYKGRIHEMMYIGEDYFHGWQRVSPKLLTIDHTGYTASISLEKNQRNIRLMEAAIRDGEPAERYYTNLFESYSALGNMERALYYAQMDVARGRQSITYASRSYRGLISYYAKDTSSEGRLKHLQWVEKAVKDFPELPDFHAEYSECLYRQGRYREAKREIELALSLCENYDGLEPCLLTPEMKPLMEQRKREITRLAEKQSKITISACAIVKNEENNIYGWLENVSVFADEIIINDTGSEDRTKEFIAKFSEENPDLAMVLIESQWQDDFSFAKNQCLAEATGDWIVFTDADETFVTPEKVRSVIGEQINGNTQVIMVPMANVDRDDNNNIINTFSVPRIFRREEGLCYEGRIHEMITIGGRRPDNLATVWADKRLFMEHTGYSTGINESKAQRNLTLLLKDIEDGQDIEKLYQYLAESYYALGNYAEALNKALLAIQSAYQPMGHQGDMYWLALNAMEKLDYSPEDKMAIVEGGIRLLPELPDFYARKGSVQMEAGNYHEAIKSFNMAWAKMAKYDEEAVHTNASNLRSILHLLFADWGRCLYRTGYSDMAEEKYREALKIKPWTETALCGWADIYQGRTAKDFIASLEAIYADIENSRELLADIYAVNGFPELAGYFSKVKKCSLINDKDYSEIYNKSMKEMAEILPALFVCLLEKYNEEYVKLLPDNLKILVNYLHGKPVAGEIKECFADYSSFMKAVMDFGTQELLVKYLGFLDYFATDEEKREKQLLEVAGLLQKNHREKEALELYQLLPEGSSKADSVYYQNVGFCLFREKEYAKALEYFQRAEQSEIVKSYIIWCREAMENGN

SEQ ID NO: 822 - protein, 681 aa, Paenibacillus massiliensis
MKRLSVCMIVKDEEAVLERCLESVRGIADEIIIVDTGSTDATKAIATRYTDKIYDYVWTNDFAAARNESLKHATGKWILVLDADEYLSKDEHDEWNSFLDQETPLPYLAYTLPVINFTGDKGNKDEITTAPVTRLFPNHMGIIFERPIHEQLTRSSIHEKMQDNDDPDASDVLLKDLSRSRTHENLYHKKLSLNIFHTGYQVQTIVNKNKHERNMQIFETMREKQKLDYYDWFTLGNQYRYAKEEEKALECYENALGIENTSVVWFPHCLIGLITLYYKMSRLPDSWKLTEEKLSRYSDFSEYHTICGFHYETLGFFKEAVASYQQAVEIAELRARQGKEIWLTDPVHSFDSPVQQLVSLSFRINDNQQAIYWMSKQLNKNKQNPQILLQLVQWLSQNETESNVIEFFDRIYDRTNSSDAALIFKVALALGQTALVKHYEQYVQLHTLHETDQLRLAILNKDAVQGHKLLKSAIGPELAKQQQLWLQVVVGSLIWNKADMLEASLKHLGEAEGLEEATALILQAVKGQQPDQATHEQYAEWLFMVSKQLFLVQEYSIFDQFVGVFQSPALINQLANHFYSLNLMPQALQYYSLLLEQQQLDHTSIENLAIYHVNHGFNEEAVEFLKEAIAVQPGKRHLYSVLMRLLPNEQTSSLVQQFEQRFPNFSSISFVEEFIKDKALV

SEQ ID NO: 823 - protein, 265 aa, Nitrospira sp.
MSLSVYIIAYNEAKKIADTINSVLWADEIIVADSASTDETARIAGDLGARVVQIPFHGFGDLRNQAIKACTHEWIFSLDTDEQCTPEVRDEILRVLAGTPAHDAYLVPRRNYFMGRWIKHSGWYPNFRQPQLFRKGAMKYAESPVHEGYELLTSKPVGCLSQAIWQVPFRDFEEVVKKANRYSSLGALKLADRRVSMGAALGHGIWSFLKHYVAKRGFLDGWPGFVIAFGNFEGTFYRYAKRYEAQQRWPMPTQPALRRPDVQSK

SEQ ID NO: 824 - protein, 410 aa, Unknown
  Description of Unknown: Acidobacteria bacterium sequence
MRPVPPRRRIRRRAAAAKRRAARRARSAGPVSSHPSVDPRRRCAVELDHRPTSSTAVGASERLFWQASRRCRRAPSGPSRGSPSTSRRSCPPPSSVIRHPRARTVLDLLVSSPSSIEESTSSPSAAERPKISAIVTTFNEERHIRECLESLVWCDEVLVVDSFSTDRTPELVQEFDNVRFVQRVYYGSASQKNWAMDQTTHEWILIFDADERCTPALRDEILRLFAGGDPPHDAYTINRRVFFMGEVIRFSGWQRDRVVRLLRRGAGRYPNRRVHADMVTRGPAPCLEEAMDHLMVEDFVKYAQRIQKYSWWGAAQAWREGKRSGMLQVVGRSFWRFVRTYCLQLGVLDGMRGMVFCLLQAYGTYLKWSYLWSWQINERLGQEPNLPIFDESEETWQGLAEFGAPTTLES

SEQ ID NO: 825 - protein, 266 aa, Unknown
  Description of Unknown: Aquificae bacterium sequence
MQKKLTVIVPTLNEEENLQACLESVAWADEIIVVDSGSTDATLEIAQSLADRILEHEYINSATQKNWAIPQATHPWVMIVDADERVTPELKKEIQKVLEAPKHQGYSIGRLNHFLGHPLRHGGWSPKEDRNVRLFMRDKGQYEDKEVHADVIVEGSVGHLKHPLIHYSYRNLDQYFRKMERYTRWAAMDIAKKGSPVKWHHVTLRPLGDFIKLYFMKLGFLDGFPGLIIAFLSAYYVMVKYSRAWEIEKKGLDTQRANPVSRHKNK

SEQ ID NO: 826 - protein, 263 aa, Polynucleobacter sp.
MPKVSVYIIAFNEERKIADAIGSVAWADEIVVIDSNSKDRTAQIAEELGAKVVQVEFNGFGQLRRDAVSACSHEWIFSLDSDERCTPKVAQEIQQIIQNNLADVCYVPRRNFFLGKKIEHSGWYPNYRQPQLFKKSCLTYDNSPVHEGYDISAGAKIMHLKNAIWQLPFNDLSESIAKMNRYSSLGSVKSRQKGSTYAKALGHASWAFMRHYVFKKGILDGWAGFFIAFSYFEVTLYRYAKAVELANQNEWDEQWKKVQKTDV

SEQ ID NO: 827 - protein, 252 aa, Unknown
  Description of Unknown: Chryseobacterium sp. OV705 sequence
MPELTEKVSGLIITYNEEKNIREVLECFDFCDEIVIIDSFSKDNTVEIAKANPNVKIIQNRFEDFTKQRNLALDNAKNDWVLFLDGDERISQELKKEIIKTINDSKACDAYYFFRVFFLGKEKIRFSGTQNDKNFRLFRKSKAYYDTNKKVHETLIVNGDVGFLKNKLLHYSYENYDAFKKKMLYYGALKGSELTDKGKKYSVITHWSKVAFKFTKTYFLKLGILDGINGLKISYLQSLYVDETYRNLKNKK

SEQ ID NO: 828 - protein, 256 aa, Unknown
  Description of Unknown: Photobacterium ganghwense sequence
MRRHSLSVIVITKNEADRIEPCLQSVVDIADEIIVLDSGSTDNTVEICQRYTDNVTITDWPGFGKQKQRALDKATGDWVLSIDADEALDETMKSALIAMLEQEQIEHTAYRLPWGVTLYGKTLKYGRSARSVLRLFKREGARFTLDEVHETVVPAPGSTGVMKGLLLHYTHRDYGHGLDKAAKYAWLGSQKYHRKGKKSHGLVLALLRGMWTFFHIYILRRGFLDGSVGFIVAMTYAQVNFNKYVGLWLLEQEKNA

SEQ ID NO: 829 - protein, 260 aa, Polynucleobacter sp.
MPTLSVILITRNEEANLADCLASLEGIAQQIVVVDTKSTDQTLEIAKNHGALVSQPLDWPGFGPQKNRALDLATEEWVLSLDADERLTPALRSEILTAIHHPAHVNCFAIPRLSWYCGRFIRHSGWNPDYVDRLFKRGTARFSDDLVHERLIPQGPVAKLENPMLHYSFMNYSQVLQKVDRYSTASAEQAFARGKTSSPIKAVLHGAWSFLRTYFLRAGFLDGPQGFALAISNGQGTYYRYMKLWHLHQEAQNKHHPHSK

SEQ ID NO: 830 - protein, 302 aa, Unknown
  Description of Unknown: Candidatus Gottesmanbacteria bacterium GW2011_GWA1_42_26 sequence
MHLSAVVNTRNEERNIVRCLQHISPYVDEIVVVDMESSDNTVKLARKFTAKIWQHENTGYVEPARNFAIGKATGEWILLIDADEILPEALGLKLRRLAQHGVYSYYRIPRKNLLFGKWLSHSGWWPDYQIRLFKQGSVSWNDEIHSVPVTEGVGMDLPAEEKNALLHYNYATLEEYLTRLNRYTSQEAKQLVQDDYVFSWKNLVAKPGQEFLTRYFAWEGYKDGLHGLALAMLQAVSFAVVELKVWENTGFKDDVNAGQPDDVMKQLRKIKYQLNFWYFTKKAETSSDLTKTINKIRAKISL

SEQ ID NO: 831 - protein, 350 aa, Paenibacillus sp.
MIVKNEEQTLDRCLSSVSDLVDEIIIVDTGSDDQTKQIARKYTDRVFEFVWVNDFSKARNYAFSQATQEYILWLDADDVILPTDAEKFKELLAGLEWTVDSVSMNYILARDEYGNVMTSLRRNRLVKREKRFQWIGFVHEYLQVAGNIHYADINITHDRLHGNSDRNLHIYENHEATGELFSSRDLFYYGNELADHGLWERALEKYDQFLQRPDGWVEDRIRACGRAADCAAELGGISEAKAKALQSFVYALPRAEICCRLGHLHIKEEKFEDAIFWYKLATELKKPTDSFAILQHSNWTWVPHLQLCVCYDRLGQRELAFRHNEIAAGFVPNEPSVVGNRAYFKGLGLA

SEQ ID NO: 832 - protein, 249 aa, Unknown
  Description of Unknown: Chryseobacterium sp. G0201 sequence
MMNISGLIITQNEEKNIQQVLECFDFCNEIIIVDSFSTDKTVEIAEKFPNVKIIQHKFEDFTKQRNLALDTAKNDWVLFLDGDERITPELRKEIIDELNKDQQKDAYYFYRKFFFAEKPINYSGTQTDKNFRLFRRSKARYIAGKKVHETLEVNGTIGEFRNKLLHYSVSDYESYKQKMIHYGVLKGQELAIKGKKYSILAQYAKTAFKFFKAYIMRLGIFDGKEGYQLSYLQSLSVFETYESLKKEQN

SEQ ID NO: 833 - protein, 283 aa, Phycisphaera sp.
MSTESVKVTVVIPVKNEEKNLPECFSHLGRFSEVLVVDSGSTDRTLEICEAHGVEVLQFRWNGEFPKKRNWTLRNHTFQNEWVLFLDADEFLNPEFVSEVEQAVSDPQKVGYWLNYNNFFLSGKLRFGESMRKLALFRIGSGEYERIDECSWSHLDMEVHEHPVLDGPVGHITTPIFHKDYKGIGSYLAKHDAYAEWEANRYVALNAPGSDAQQWHTGRQKVKYRHLTKWWLAPAYFAYSYVYKLGFLDGRRGLVFCLLKFHYFFQIRLRILEKLAAQNSDGT

SEQ ID NO: 834 - protein, 256 aa, Helicobacter magdeburgensis
MQKLPISVTILVKNAQSTFSECLSALVDFDEVIVLDNGSDDGTLDIAKNFANVKIYQSEFIGFGALKNLAISYATHEWILSVDSDEILESSTLEQIRLALSSMQPHHIYAMPRKNLYNGEWIKACGWYPDYVWRLFNKTFTRFNDNIIHESVILPKNAKLIKLTSGLKHYAAPNMESIIAKMNRYTSYSAEQKHRHKKKASMLGAIARFWLTFFKDYFLRGGIKYGYKGFIIALLNASGAFFRYAKLYELDKQDKK

SEQ ID NO: 835 - protein, 260 aa, Emticicia sp.
MQKKTTKIPLSIVTLTLNNQRTLDSVLKSVADWADELLVLDCGSTDETESIARKYEANFLYRKFDNFGKQKAYAVSKAKNDWVFIVDSDEVVSDELREEILDVFQNASFEGYMIPNTLIFLGKPLRYGREYKMPHLRLFNRKHGNYNDKEIHEDVILNGKRGSLKNHVLHNSYADVTDFLNKINNYTTKGAVELHRAEKKVSVFNIIIKFPLKFFVEYLFRLNFLNGYRGFVWSFGQAFGSTMKYIKLHEINQNNFKSRY

SEQ ID NO: 836 - protein, 252 aa, Unknown
  Description of Unknown: Chryseobacterium antarcticum sequence
MLELKEKISGLIITFNEEKNIQEILDNFSICDEIIVVDSFSSDQTVEIARQNPKVKIVQQKFEDFTKQRNLALDQAKNDWVLFLDGDERITPELQTEIITELNKSDKKNAYYFYRKFYLGEKPIHFSGTQNDKNFRLFRKSKCRYVADKKVHETLDVQGSIGILKNKLLHYSFENFEQFKSKMLYYGLLKGNELADKGKKYSIITHWGKVALKFLKTYIIKLGFLDGIDGLKISYLQSLYVNETYKNLKVNK

SEQ ID NO: 837 - protein, 316 aa, Mastigocoleus testarum
MMSNKIPVSVLIPAKNEEANLPACLESLQKADEIFVVDSQSDDKSVEICESYGAKVVQFHFNGRWPKKKNWSLENIEFRNEWVLIVDCDERITPELWQEIAYSINNPEFNGYYLNRRVFFLGKWIRFGGKYPDWNLRLFKHKLGRYENLNTEDIRNTGDNEVHEHVILNGKVGYLKNDMLHEDFRDLYHWLARHNRYSNWEARVYYNLLTGKGDSGTIGASLFGDAVQRKRFLKKIWVRLPFKPLLRFILFYILQGGFLDGKAGYIYGRLLSQYEYQIGVKLFELRNCDGQLNTGNKTVNRDRSSSLTQKIEQTAT

SEQ ID NO: 838 - protein, 256 aa, Unknown
  Description of Unknown: candidate division NPL- UPA2 bacterium Unc8 sequence
MKVQKAPFSVAIITKNEEKRLPDCLKSVSFADDIVVLDSESTDRTVEIAKEFGCRVFVEEWKGDGPQKNSAVAKCRYEWVFVIDADERIPKETKNEIIKIVNYSHSADAYSFPRKNLFHGKWIKHSDWWPDYKVRLFKKNAGQFHFLTHEAWLTKGTVKKVTTPIEHFSFSNYSDMFNVLNERTTIMAKELFDAGKKATSFTPFLHGAGMFLRAYILKLGFLNGLDGFMIAATGAGGSFLKYAKLLELQWRRESTQ

SEQ ID NO: 839 - protein, 288 aa, Salinibacter ruber
MTDVSDEKSVPVSVLIPTRNEEANLPRCLDAVAGWADEVLVVDSQSTDGTIEIAGDYGAEVIQFEYDGGWPKKRQWALDTYDFDNEWILLLDADEILLPPIKSEIAEAIQTDAYDGYWLRFQLHFLGRPLRHGGFDLWKLYLFRHGTGRYERRFEGQDESMSDIEIHEHVVVDGEVGRLQHPVRHENWNSLYRYIEKHNEYSEWEARLYHEGDSGAVEPDLFGNQAQRRRWLKDLLVRVPGFPLITFLYHYVLRLGFLDGKPGFIYCVLKGVQRFHAKAKWYELELRE

SEQ ID NO: 840 - protein, 261 aa, Unknown
  Description of Unknown: candidate division BRC1 bacterium HGW-BRC1-1 sequence
MKPKLTVIIPTFNEERNIRQAVESASFADEVMVVDSFSTDATTSIAREMGVRLLEHEYINSATQKNWAIPQASHEWVMVLDADERITPDLREEILDFISAPQGDVGLRIFRANYFMGKPIRHCGWQDDSVLRVFPRDDARYLDREVHADVVLEGPIRIARSRMDHFTFDSFAQYMRKFDQYTTWAAGDRDRKTARVGYRHLLGRPLWRFFKQYILRLGILDGRAGLIVCMLSAFSVFLKYAKLWERRQATDDETAQTGTPT

SEQ ID NO: 841 - protein, 299 aa, Unknown
  Description of Unknown: Candidatus Woesebacteria bacterium GW2011_GWA1_39_8 sequence
MDKISVVINTLNEEKNLPRALASIKGFADEVVVVDMKSDDNTTQIATKFGAKVFEHPRAGYVEPARNYAISKTSGNWILILDADEELSADLKAEIARVIKSKEADYFRIPRKNFIFGKWIKHSRWWPDYNIRLFKQGCVSWSEVIHSVPMTTGIGKDFDDKEDLAIVHHHYETVEQYLDRLNRYTSEHAKNLVKEGYKFDWVDLIHKPSAEFLSRYFQGGGYRDGIHGLALSLLQSFSELTLYLKVWQLSGFTKSNPHIKDVVDELKNAESEVHYWEADTLLHEIGGLKHRIKRKLKIS

SEQ ID NO: 842 - protein, 256 aa, Cellulophaga baltica
MKEKLSVFIITYNEERILDKCLNKLSWADEIIVVDSGSTDATLEICKKYQVKLFHKDFEGFGTQKQFALEQTTHNWVLSIDADEILTDELIAEIQDVLASGTANNGYYLKRKHVFLGKVFEYGPESKEYILRFFKKNMGNFDGKKVHENVVLEGPSDKLKNDFLHFTTRSLDNYIEKLSNYASIFSEGKYLKNKRYGIAYIFIKVKFEFFKKYFLELNFLNGQEGFYWSYLAAYYMGIKYMKTNEQYKQVKKQLMF

SEQ ID NO: 843 - protein, 249 aa, Arcobacter thereius
MIKHISVVIIAKNSERTIKNTLDSLTGFEDVVVYDNGSSDKTIEIAKSFSNVNLAQGEFKGFGWTKNKATTYAKNDWVMIIDSDEVVNKDLFEYLKTKKLEDNTVYRLNSNGYYKNIRVKYCGWTLTVKRVFNRKITSFHKDVQIHEYIVSDGLKEEVLGGSINHYSYNSISELIIKADRYSTIFAQNNVGKKYSSPSKAFFNGLYSFFRTYILKQGFRDGYVGLLISFSNMVGSFYKYIKLYEANKEL

SEQ ID NO: 844 - protein, 251 aa, Unknown
  Description of Unknown: Candidatus Microgenomates bacterium sequence
MKISAVVLAKNEEKNIKECLDGLKWCDEIIVIDDDSVDKTAAIAKKQGAKVFKRQLEADFASQRNFGLQKASHDWIFFVDADERVGEDLAEEIKARLNQGSLPSGFFIKRIDFFGGKFLKYGETDSIKLLRLARRGSGEWKRAVDETWEIGGEKSELKSPLRHYSHLSLTDFLTSINERSTLNARVFYNEGKRVTFFEWLKPAAKFIRNYFFNLGFLDGTAGFVFAVLMSLHSFLVRGKLYLIWRREGGWK

SEQ ID NO: 845 - protein, 500 aa, Sulfurihydrogenibium azorense
MDIKVSACIIAKNEEKNLPRLLNSIKGKFDEIVLVDTGSTDKTVEIAKSYGAKVYHREWNGFADARQYAVDMASGDWIWFFDADTELEEEEYERFKRILLFIKDHPEYEGIGTVYKNLGLDGNIKSLSSTVHIHKKHPDIVWEGKIHERVVNKKTSTILIPPMKVHILHYGYAEINTQIEKAKRNLRLLFEELKSCKDNEKEYYVNIFYIIQSYSVLAAAIDLKKYSKKSLRYIKKFLRYKDNIPNESTFKKHFYVYATRTYISLENYKEAEKLLEDALNIDKFYPDYHFLLYTVYKAQEDTKKAVESLINFILSIDKTSKIYGVISDYISYKEKVISDLESYILSNEDRDYFKEIVKDHWNETKGENIGRVLFRILKDENQKEALKVIKKVATIHQSSEAYTDLGEYYYENQNMEDAFRSFLKAYDLNPFNIKANKYLSDLYFSFKDYERAFYHGLKYLNLSRDINFIKNLEDIVNLSQNLNLKESFEKLNKKLSQVVS

SEQ ID NO: 846 - protein, 345 aa, Unknown
  Description of Unknown: candidate division NC10 bacterium sequence
MAELTATIITHNEEHTIRACLESVAWAKEIVVVDSGSSDRTLEICRGYTDKVVINPWVGFIEQKNFAVSLATYDWILNIDADERVPEELRRAIERELCAPRYDGYRMARRNYFLGRWMRHGGWYPDRVLRLFDRRKGRFGGINPHACLVMPNGAVGSLDGDLIHLTYRDVSQYIRKQDAYTGTSVEERARTRRSGPVGRAELMLRPLVKFVQVYLLKRGFLDGMQGLIAALGAAYFNFVKYTKMRALGHDAPLNNHLVNPISEYLRRMDRDSTIAEAALEQEGRRTGPLDLLVRPLFTFLQACLRRGDILEGRRGLTMAGLHAGSTFAAYAKLWERHRLNREVEW

SEQ ID NO: 847 - protein, 285 aa, Unknown
  Description of Unknown: unclassified Achromobacter sequence
MKLSVIMITKNEAANIVDCLDSVTFADEFIVVDSGSTDNTVELAREMGATVLQTADWPGFGPQKNRALDLAQGEWVLSIDADERVTPELAAEICRKIGIDAGKGPGAAPGVSRDTDAKDAYEIPRLSEFCGRFIRHSGWWPDPVLRLFRRGMGRFTDAAVHEKVVPVGTWRAGRLQAHFIHYSYPDLDALIAKSNRYSSDAATMMYARGKRASIFSALGHGFWTFIRIYLIRRGFLDGRQGVVLAVTAAAGSFSRYAKLMFMGDEDKRLQDAAERRGDAGSHTRP

SEQ ID NO: 848 - protein, 259 aa, Prevotella maculosa
MNGNEKITVVINTYNAERHLNACLEAVKDFDEVLICDMESTDRTLDIAHSHGCKVVTFPKGEHRIVEPARQFAIDRAENPWVLVVDADEIVPCALRHYLYEAIQKPTGFAAIAIPRKNYFMGRMMHSSYPDYVLRFLKRERCHWPPVIHASPEVNGRVIKIPSARQDLAFEHLANDTVADIIAKNNTYSDYEVPRRRKKNHGIMALLCRPTFRFFKSYFLKRGCLDGLPGLIHAVLDAGYQFAIVAKLIEERQEKRHSS

SEQ ID NO: 849 - protein, 315 aa, Geitlerinema sp.
MSSSSSNSPAKVPVSVLIPAKNEEANLPACLESVARADEVFVVDSQSEDRSGEIAERYGAKVVQFHFNGRWPKKKNWSLDNLPFHNEWVLIVDCDERITPELWDEIDEVVRKNDRDGYYLNRRVFFLGVWIRHGGKYPDWNLRLFKHKVGRYENLHTEEVPNTGDNEVHEHVVLPTQAGYLKHDMLHIDFRDIYHWLARHNRYSNWEARVYYNLLTGQADDGTIGANLFGDSVQRKRFLKKIWVRLPFKPFFRFLLFYILRLGFLDGRAGYIYGRLLSQYEYQIGVKLYELRKFGGQLNKLEEKPKSTGATQSIS

SEQ ID NO: 850 - protein, 295 aa, Bordetella genomosp.
MNRIPVSVIVMTKNEERNIEKCLRALADFDEVFVVDSASTDRTVEMASRLGARVVPFQWNGRYPKKKQWCLENLPFSHDVVLYVDADEVMTPELAREIGDCLPRFSQGAGGAFVGFDYVFCGRRLNHGHRVYKLVLLARDRARFLDYNDLDVANMWEVEGHYQPQVDGQLFLLRNRMAHHDHDGLYHYFDKHNRYSDWEASLRVKGLLNDPREANIGLRGAMKRMFNAMPFKAPAAFLHCYVLRLGFLDGKVGLDYAVARAMYYWQIGLKSRELKAAMAAATPGGGTEPVRDGTH

SEQ ID NO: 851 - protein, 264 aa, Unknown
  Description of Unknown: Candidatus Roizmanbacteria bacterium CG22_combo_CG10-13_8_21_14 _all_34_12 sequence
MKLSAVVLTKNEEKNIDRCLGSLDFCDEIIIVDDYSTDNTKSKINPPAGGQNDRLNIKIFENHLNNDFATQRNFGLSKTANDWILFIDADEEISEELRKEIIGLDSRLRVNDTVAYSIKRRDYFWNKELKYGEVKKVRDQGIVRLVKKNSGKWMGTVHEVFYTAKNIGQLTGFLNHYPHPTLKEFINDINNYSSIRAEELFNRGTGTNVFEIIFFPFGKFVYNYFFNLGFLDGPAGFTYAFMMSFHSFLVRAKLYQHNHSKIVV

SEQ ID NO: 852 - protein, 248 aa, Elizabethkingia miricola
MEKVSGLIITYNEERNIAAVLSCFNFCDEIIVVDSFSTDKTVEIAQQNPKVKVYQQEFVDYTKQRNKALSLAENDWVFFLDGDERTTPDLEKEIIETINNKDSKDAYYIYRIFFVGQKKINFSGTQNDKNFRLFRKSKAFYTETKKVHETLEVQGSTGILKHKLLHYSFENFESFKKKMIYYGLLKGTELVEKGKKYSVFTRWSKVAFKFIKTYFLKLGILDGIDGLKISYLQSLYVDETYQTLKNKS

SEQ ID NO: 853 - protein, 262 aa, Unknown
  Description of Unknown: Candidatus Omnitrophica bacterium 4484_213 sequence
MNKFPLSVVIITKNEEEDIRECLKSVQWADEIIVVDDGSTDKTREIAREFTDKIIVKKMENEGRHRNWAYAQAENEWVLSLDADERITEELKEEIYQRLNEAGEFSAFTIPRKNFLGDYWLRFGGEYPAGQLRLFKKASFRFEEVEVHPRAFLEGKCGHLQKPMLHYSSKNFTDFLNKFNSQTTLEAKKWISTNRKVSLGHALRRTIDRFLRKYLFKKGYRDGFIGFMLALFAGLYQIISYAKYWEMKRQPTVNSLQSTAKN

SEQ ID NO: 854 - protein, 265 aa, Kosakonia radicincitans
MFKISVCLLTFNSARLLREVLPPLIFIADNFVVVDSGSTDATLEICREYGIDVHHRPFDIHGQQMNYAISIAAHDWVLCMDSDEILDEQVVNYILKLKAGEEPTPERAWQLPRYWYVLGKEVRTLYPISSPDFPVRLFNRQRARFNDRPVDDQVIGEMTCEKIPGRVRHDTFHTLHEMFNKLNSYTSRLIKYRDIRPSVLRGIISAIGAFFKWYLFSGAWREGKVGAATGLYATLYSFMKYFKAWYAHKEEKFSATTEDREKRTT

SEQ ID NO: 855 - protein, 259 aa, Unknown
  Description of Unknown: Parcubacteria group bacterium GW2011_GWC2_32_10 sequence
MNISAVVLTKNEEKNIKKCLESIDFCEEIIILDDFSTDKTIEIVHKILKIHKVYKVLQRKLNGDFAAQRNYGLSKATRDWVLFLDADEEISPELKKEIVSCIKDKDSIEAFYLKRRDFFWDRELKHGELSSVTKKGLIRLVKKESGKWMGNVHEVFHTAQNCKILNGYINHLPHQSLSEFIKDINNYSTLRAHELQRQGYETNLFEIVFVPLTKFILNYFLLLGFLDGAAGFTYSFMMSFHSFLVRSKLYQYTKLKSND

SEQ ID NO: 856 - protein, 257 aa, Unknown
  Description of Unknown: Candidatus Erwinia haradaeae sequence
MKKLQKLSAVIITHNAEEVLAECLESVSWADEIILLDFKSSDKTLDIAVRYGVMVYQSNTWPGYGKQRQIAQSYANYEMILMIDSDERVTTELQQSINLILQQPPAKIVYSISRCNVFLGQAMRHGGWYPDRVIRLYPSCYAYNNHLVHESLDVSAIPIRSLHGDLLHLTSRDFCTFQLKQCSYAKAWAKQRYQKGKHYSITKIIYRSFWSFIRTLLVRGSFLDGTRGWLLAIVVCQYTFNKYVALWDLNCTSRNRN

SEQ ID NO: 857 - protein, 252 aa, Unknown
  Description of Unknown: Chryseobacterium sp. Leaf405 sequence
MKDQKISALLIVFNEEKNIEEALESVEFADEIIVLDSFSTDKTVEIIKTKFPKVQLYQNKFEDFTKQRNLCISYAKNEWILFLDADERITPELKKEILKEIKKPVTKKAYFFKRKFFFMGEQVNYSGTQNDKNIRLFKKEVAHYDENKRVHEGLANVENPGTLQNYLLHFSFDSYEAYYTKVIHYSRLKAKDLYEKKTPYGLIKQLSKSIFNFFKMYFLKLGILDGKKGIILSYLSALSSFKTYEFLKEEYA

SEQ ID NO: 858 - protein, 250 aa, Unknown
  Description of Unknown: Candidatus Roizmanbacteria bacterium GW2011_GWC1_37_12 sequence
MRPKIAVLIITKNNQDTIGKTLESVKDFDEIVVVDSKSKDKTLEKSRNKSKIKIFRKEFNDIGKQRLYGLKQIKADWVLILDSDEVVSKELKKEIVKLLNGYIVKEKAFEIPYQNFFLGKPVNYGGENYKMVRLFRRDALEIKPSIVHNKLIVKHGKVARLKGKILHYSYRSLGQTYKKFTDYALKMAKIKAKNGEKSSLKKIFLYPVHMFWARFVKDKGYKDGMFRIPLDIGFAYMEFLTYFLLMLKTR

SEQ ID NO: 859 - protein, 312 aa, Nostoc sp.
MSSKIPVSVLIPAKNEEANLPACLTSLEMADEVFVVDSQSTDHSVAIAESFGANIVQFKFNGSWPKKKNWSLDNLPFRNEWVLIVDCDERITPELWAEIAQVIENDEYSGYYLNRRVFFLGKWIRHGGKYPDWNLRLFKHKQGRYENLHTEDIPNTGDNEVHEHVILQGKVGYLKNDMLHEDFRDLYHWLERHNRYSNWEARVYYNLLTNQDDGGTIGANLFGDAVQRKRFLKKVWVRLPFKPLLRFILFYIIQRGFLDGKAGYIYGRLLSQYEYQIGAKLYELRDCGGTLNTEKSQPLPSSLSQEMRQTAT

SEQ ID NO: 860 - protein, 259 aa, Unknown
  Description of Unknown: Acidobacteria bacterium sequence
MEALTATVITRDEEANIAEALERLRFADELVVVDSGSTDRTLEICRRYTDRIFHRDWTGFVDQKNFAVDCASHDWILSLDADERPSSRLEAEIRALRTSGFSRPGYRVPRVAYFMGRWIRHGDWYPDYQLRLFDRRRGRWHGGSVHESVRIDGSPGYLNGEIEHFTYRSLSDYLKRLEAYSSLAAADYHARGRRANALSLAAHPPLAFLKNYLWKRGFLDGVPGLMVAIMAATSVYFKHAKLYEIERAVRAGVKAQKCF

SEQ ID NO: 861 - protein, 255 aa, Capnocytophaga gingivalis
MQGLFSMKISVIINTYNAEKHLATVLETVKDFDEVVICDMRSSDRTIAIAEQYGCKIVYCERYPYVEPARNFAIAQAQYPWVLVIDADETIPTKLREYLYQITENPTIGGVYIPFKNYFIDQYMRSAYPDFKLRFFKKEGADWPKEIHSTVKVQGQVIKIPRHRTDLASEHLANDSVTTILSKNNNYSTQEVERRKGKRIGWGKLLFSPFFWFIKYYFIKKGCLDGKRGFIFAVLKAQYKFSCLAKIYEYQQLHR

SEQ ID NO: 862 - protein, 268 aa, Dysgonomonas sp.
MISIIILTKNEERDLPKCLDSLKWSDDVHILDSGSTDKTINIAEQYGAKLSFNPFKSFGDQRNFALDNLDIKYGWVLFLDADEIATTGFVEAIKEGINNADESVAGFYCCWKMMLENRWLKHCDNFPKWQFRLLRKGRASFTDFGHGQKEGEVKGDIMYIKEPYLHYGFSKGWAQWLDRHNRYSSLEAIDRLKKCPPLRNIFSKSKSIRNVALKSWLIRIPGWPFLRFFHAYVLNLGFLEGTPGLIYCANMAYYEFLIKIKIREAKFK

SEQ ID NO: 863 - protein, 253 aa, Geomonas terrae
MKITATIITLNEEKFIGDCLKSLDFADEIVVVDSGSTDRTEEICRENPKVRFVHRAWPGFGKQKNAAAELAQNDWIFNIDADERVSPRLKESILKVAEGGAPCYRVARENYFGDRWIRRCGWYPDFNKRLYDRRECAFSEKEVHEALECRGRVGELDGNLVHKTYSGLSDYVIRMERYSTLAARELVKKGKRPGLAHLLFKPLFTFFKMYVLKLGFLEGGMGFVLSTIYAHYTFYKYGKAIELNRAEKELRRG

SEQ ID NO: 864 - protein, 255 aa, Unknown
  Description of Unknown: bacterium TMED88 sequence
MKKPELRISVCVPTLNEDHNLRDCLKSVDFADEIIVVDSGSTDQTLGIAREFTDRIYSRDWQGIARQRQFAMEQARSPWVLHLDADERISDALAQEIQTALPKSPQKTAGFSMPRKTRYLGRWILHGGWYPDRKIRLVQREFSHCRGDGLHDHIDVSGEVKALAHPIHHFTYRHLSDHLQTMDEFSSVSQGDPAVQDIRLPALQMVVRPIAKFFSCYFLKQGFRDGIPGLVIAANSSFYVFLKHAKAWEKGSALK

SEQ ID NO: 865 - protein, 260 aa, Unknown
  Description of Unknown: Candidatus Gottesmanbacteria bacterium GW2011_GWC2_39_8 sequence
MAKKTEIKLSGIIIARDEEKMIGEAIKSLNFADEIIVADSGSKDRTLEKVSKTQRLKDSKIRTIRLKAEELNFSYFRSQGLKEAKGEWIFYLDADERVTKELAMEIKEAIRGSEFSGYKIRRVNYYLGKKWPKEEKLERLFRKDRLSGWYGKVHESPKYEGQLGELKNNIVHYTHRDLSKMVEKTIKWSEIEARVRYDAGHPRISWWRFPKLMFGQFWEYYVNQGGYKAGTVGLIESMYQVYSIFITYARLWEMQREERN

SEQ ID NO: 866 - protein, 264 aa, Maribacter orientalis
MVTNKEKLTALIITYNEMGYIEKCLDSVSFADEIIVVDSFSTDGTYEFLKSHPKVKVIQNPFENFTAQKSFALKQATNDWVLFLDADEIVSTSLQMEISETVSSDTEIAAFWFYRQFMFKNEKLNYSGWQTDKNYRLFRKSKASFSDCKIVHETLDVEGTSGILKEKLIHYCYKNHEDYKGKMLKYGRLKAIESFYREKKYSYAMMIAKTSWKFFNHYILRLGILDGKKGFIICHLNSLGVLERYRELKKLEQKNELAYYLVMP

SEQ ID NO: 867 - protein, 302 aa, Unknown
  Description of Unknown: Microgenomates bacterium 39_7 sequence
MKLSVVVNTKNAGNTLADCLTSVTFADELIVVDMHSIDRTKLIAQEYKAKFFLHDDLGYVEPARNYAISQATHEMILVVDADEVVSDGLKKKIQDILSKKTSADVYLIPRKNMVFGQWLQHTGWWPDYQARLFKKGKVSWSEAIHQPPLMLGKVVKLSPEADHAFIHHHYPTVHSYLERMNRYTNVQAEHSLKGFADKVSVDDVISSFYNEFFRRFFVLSGYKDGIAGIGLSFLQSTYELTVQLKKWERQTESNSSTDLDELAINSLELSRSSLNYWLADWRVKHSKGLLLLYWKLRRKFKI

SEQ ID NO: 868 - protein, 261 aa, Prosthecobacter debontii
MTPISFCCVTYNAERTLDATLSSLVGLADEIIVVDSFSTDSTLDIARRYTSKITQEPYLYHGVQMNKAIALASHDWVFCVDADESVNAELAQILRAWKEKGPVHHDAYRVHREWLFLGRSLHAFYPVSSPDRVVRLFNRQSVQFNDRPVDDKPVGFKSCSILPLPGLLVHDTTGSIHDLFGKVNHYTSRAARGTDQSEVTSASLGKVITRPWVAAFKWYLVKQGYKDGFPGVVLGMYAFLYTFLKYAKLYERKLLAKGKPN

SEQ ID NO: 869 - protein, 256 aa, Unknown
  Description of Unknown: Flavobacterium urumqiense sequence
MNLNLSKRISVLIITLNEEANMQALLTDLDFADEVVVVDSYSTDKTKSIAQSFCNVRFIQNKFENYSSQRNFAISYAKNDWILFLDADERLTPELKKEIKETLRTNEIFTAFLFYRKFMFKNSILHFSGWQSDKILRLFNKNFAKYKPEKLVHEKLGVSGKVGIFKNELIHHSYTDYKSYKIKMINYGKLKAQEKHIKNLKPIFLLPIFHPTYTFLYNYLVRLGFLDGKKGIIICYLNAYSVSVRYKELNLLWHKK

SEQ ID NO: 870 - protein, 282 aa, Winogradskyella sp.
MTKIKTPVSVVILTYNEEIHISRVINGVKDWADEVVVLDSYSEDKTVDIAKSLGVDVVFRKFDNYAKQRNYAIKEITLKNDWILFLDADELMTDELKVEITDTLRNPQKDGYEIKFRFYFMGKWIKYGGYYPTYILRLFNRKKASINRDINEHITVDGELGRLKHDFMDVNKKDFTFWVHKHNKYSTYEAEDLFKKNKTEDEKGFANFFGTQAQRKRWVRVKIWNRLPLFFRPLLYFLYRYFLKLGFLDGMVGLIFHFNHAFVYYMQIDVKYYQKKKNLFNE

SEQ ID NO: 871 - protein, 249 aa, Marinobacter sp.
MKLSAVLITKNAGEDFERCLQSLTFADEIVVLDSGSTDNTLAIAKRAGARIFTSQTWPGFGTQRQHAQQYAQGEWVFWVDVDEVVSDELALAVQAAIDDTPVNTVFEVSRLSWFFGRFIRHSGWYPDHIVRLYRRTEFAYNDALVHEKVHCDGAQVKKLSGELLHYTATDFQDYLSKSVRYAADWAEGRHRRGKKANLFDACSHSTAAFLRKYIFQRGFLDGRHGFLLAVFTAHYVFNKYAALWIKTRR

SEQ ID NO: 872 - protein, 286 aa, Pseudoflavitalea sp.
MNYSQLSPVAGSIPGIVVQVQTPTPTELKISAVIITYNEEKIIRKTLSQLYWCDEIVVVDSYSTDNTVAICREFGADVYSRTFDGYGSQKQFAISRATNDWVLCIDADEIPTDNLIREIRSINPNTAYAGFSFPMNMVFLDKEFHYGKESGRHFIRLFNREKGGVTADRVHESFHVDGPIKKLEHTILHYSYTSIHQCIEKLNRYSTLSSGISYSKGKNKSALAVLFGLPFNFLKYYLLERNCLNGMKGFYWSVFASYYHFLKYVKLKELKQPEKRPVIIPDTVYA

SEQ ID NO: 873 - protein, 304 aa, Unknown
  Description of Unknown: Candidatus Pacebacteria bacterium CG10_big_fil_rev_8_21_14_0_10 _56_10 sequence
MTSLSVVVNTKNAATSLEKALQSVKFADEIVVVDMKSDDGTVKIAKRYTDQIFSHRPLDYVEPARNFALSKANGDWILVIDADEEVPASLGKKIRQIITDDQAADCYYLPRQNIIFGQWIKHTGWWPDLVLRLFRAGHVEWLDEIHSVPITTGVVKELAAEPENAIVHHNYQSVDQYLDRMNRYSTVQARGELEVVKTKRVPEPIRFWQEFRAEWLRRLFAQRGVEDGAHGLALAMLQSCGEMAVELKKWQQFEFVPTQLSRSELSAELREFQRDLNYWLADWELRHSAASTAWWWRLRRKFKF

SEQ ID NO: 874 - protein, 283 aa, Unknown
  Description of Unknown: Comamonadaceae bacterium NML00-0135 sequence
MDRELPHPHAAPLAPGRAPAGAQRPRLTIAVLACNEERHIGQCLQSAAFADEVVVVDAGSTDRTVEIARSMGAAVHVHADWHGFAVQRNRLLEHASGDFVFFLDADEVISPAFQQELLAIVAQDDRQAVWCIRWQLVAFGRVLPRSMSRTRVVRLFPRQLIERFEGVVHEQALLRAPAPRKDIQALLVHYTNPDVSTSMAKVMQYAMLGATKRKAQGKRGGVLRGLAAALVAFVRYYLLRLGLLGGGAGFLYCFFKALESFLRYAALRYDYERLSDDVQRRRH

SEQ ID NO: 875 - protein, 260 aa, Unknown
  Description of Unknown: Sphingobacteriales bacterium UPWRP_1 sequence
MQQANKVSISAVIITFNEAKNIARCLNSLAGIADDIVVVDSFSTDDTPQICRSFANVRFIQHAFEGHIEQKNYANTQALYPHILSLDADEALSEPLRQSILEAKNNWQYDGYYMNRLNNYCGAWIRHGTWYPDRKLRLWNSQKGNWGGTNPHDRFIMDKTAKTGRLTGNLLHYTVHSIQQHIGQINKFSSIRAAGMFTKGIKPNFYRLYCKPVIGFVWSYFFRLGFLDGYFGFVISLNSAYSVFLRYAKLKELWKNNNPA

SEQ ID NO: 876 - protein, 273 aa, Dethiosulfovibrio peptidovorans
MKISLYTVTKNEEARLPLMLEAAAPLADEIIVVDSGSTDRTRDVAERYGAKFIHHDWTSIGHQVAFAESCCSNEWVLRLDADEVMSKELLEEIMKIKKNGPDCDGYKLRSGEMFPGYSKPNRWVKHYQLVRLYSRKAMRMSGKFGFDDVVFIKKTPQTRLLYNFINHYSFLSIRRTVEKRNVATDDQVKRALLEHKNYSPWRMVGCMVGNFFRYFILERYFLYGFWGFIHSVNVGYMRFLKFSKFYEYHQIREHGYMGCEKKNELYESEVGKG

SEQ ID NO: 877 - protein, 245 aa, Ulvibacter litoralis
MPTLTVIIPTYNEADYIKDALQSVAFADQIIVVDSFSTDATVEIAKPLASNFISRKFDNFSAQKNAALEHATGDWVLFIDADERVTRSLEAEIKCTLENPKHSGYKINFPHFFMTRFLYFQSNDVLRLVQRKGAHFTGLVHEKLHCNGSVGKLKQKMIHYTYKGLHHYITKKEKYAWFQAQQRFEKNKKTTYFHLFFKPSYRFFDSFIKKGGFRNGVPGLVLAAVDSYGVFSRYVKLILLQKGMK

SEQ ID NO: 878 - protein, 250 aa, Unknown
  Description of Unknown: Candidatus Amesbacteria bacterium GW2011_GWA1_46_35 sequence
MLTGIVLTHNEEKNIARCLESLKFCDAVLVVDSGSTDKTMSLAKKAGATVVNHPLDGNYAAQRNWALSQAKTPWVLFVDADEMVSVKLGEEITSAVKKIEYKGFLIPRIDYMWGKKLSHGDVGGARFLRLARRGAGEWHGAVHETWAIEGNIGTLKHPIFHYPHPTLVEFLQEINRYSSIRAQELHRAGQRANLFQIILYPSAKFLWLWIWKLGFADGTTGFVHAMTMAFYSFLVRGKLWLFQKGVTSPS

SEQ ID NO: 879 - protein, 344 aa, Unknown
  Description of Unknown: Candidatus Latescibacteria bacterium sequence
MEGDSGMGHWKRRQRPGDGGPRSVQDGRGNGGGVQSGLWCPQIRSGCLYAGLPSERERGPSGAFQTRQMRRKLSVCVVTYNEERNIERCLRSVSWADEIVVVDSFSQDRTVEIALKYTDRVYRHPWGGYGAQKNLALGYVGYDWVLALDADEEVLEELGRSIREVLEGKDDCDGYEVARRSFYLGRWIGHGGWYPDYQLRLFRKGKGKWMEVELHERVVVEGEVGRLKGDLYHYPYQDLSEHIRKMDRYSTIASREMARRGIKVRGWDLLVRPLFRAFKSYVLKAGFLDGVPGLVIALSGAAYAWAKYSKLWELQNGLKGSTRGHGPDVAGRGSPGALVDRGTP

SEQ ID NO: 880 - protein, 214 aa, Unknown
  Description of Unknown: Oscillatoriales cyanobacterium sequence
MTATSAKVPVSVLIPAKNEEANLPACLESVARADEIFMVDSQSEDRSEEICQSYGVNVVQFYFNGSWPKKKNWALENLPFRNEWVLIVDCDERITDASWDEIAAVIRADKHDGWYINRRVFFLGKWIKHGGKYPDWNLRLFKHAIGRYENLKTEDVQNTGDNEVHEHVVLNSKRGAGYLKEDMMHEDFRSIYHWLARHNRYSNWEAKIYYNLLT

SEQ ID NO: 881 - protein, 251 aa, Ohtaekwangia koreensis
MMKLSAVIITYNEEANIGRCLKSLIPVVDEVVILDSFSKDRTLEIISQHGLNFIQREWTDYSDAKNYANSKATGEFILSIDADEELSPVLQQSILTWKNNPSADAYQINRLTNYCGKWIYHCGWYPEYKVRIFKRGTQWKGLVHEDLVFDNEPKVEKLKGDLYHYSYPTIDSHLKKVLQYSKLTAEKKFKAGKKYTLLWHGILKPWVVFFKKYILQLGVLDGYYGFVISAFTSFFHFLRYIHFRALRKANR

SEQ ID NO: 882 - protein, 258 aa, Thermosulfidibacter takaii
MQEVGMREKLTVIIPTFNEEDNLEEAIRSVLWADEIMVVDSFSTDATLDIAKKYAHRILQHEYINSATQKNWAIPQATHEWVMILDADERVTPKLRDEILKVLENPQYDGYYIGRRNYFLGYPLDHGGWSPKEDRNIRLFRKSVSRYEDKEVHADVIVSTGKVGELKNYLVHHSYKSLKQYFRKMERYTDWAAKDIVKAGKKPNLFNLILRPIGDFFKFYVLKQGFKDGMPGLIIALLSSYYVMVKYVKAWELYHSKA

SEQ ID NO: 883 - protein, 257 aa, Unknown
  Description of Unknown: Nitrospirae bacterium sequence
MAERTDQKVSAVVIAYNDEPNMHGCLESLTWADEVIVVDSFSTDATAEISRKYTDKVFQHAFHGFGRLRNEAVAHASYDWVFSLDTDERATPEVRDEIRQKLREGPDADAYFVPRHNYFLGRRIKHCGWYPDYRQPQFFHRQRMRYTEDVVHESFEVQGRTGYFRSHVEQRPFRDIDHYLQKMDRYSTLRAKAMQEHGVRFRYHQLVTHPVFTFFKMSVLRLGMLDGMPGLILSGLYAYYTFVKYAKLWELEQAEAW

SEQ ID NO: 884 - protein, 282 aa, Erythrobacter sp.
MGSIPISVVIPVRNEEANLGQCLQRLGCFDEVIVVDSGSTDATCQIAANHGATVIQFEWNGRYPKKRNWVLLNQRLQNEWVLFLDADELVTEMFCNEVGAALAEDRFDAFWLKYTNFFLGQPLKHGDPQRKLALFKIGRGLYERIDEEAWSGLDMEVHEHPVIEGDVGEITAPIDHRDDRGVAKFIQRHKDYALWEAQRTRQLRSSGREVWAQLTDRQKNKYRNIDKWWFAWAYFAWTYVVKRGFLDGLPGFSYAFYKLWYFWTIRLLLKESENREVPASAS

SEQ ID NO: 885 - protein, 292 aa, Unknown
  Description of Unknown: Verrucomicrobia bacterium sequence
MNGWSGARVPLSVLVPVKNEAANLHDCLVSVSFAKEIVVVDSESTDGTAAIAEAAGAKVVQFVWNGKFPRKKNWALENVPWQHEWVLIVDADERITPELQGEIRKAICRRGVDGFYLNRRFWFLDGWINHCGYFPSWNMRLFRHWLGQYEHVETGDNFLSGDNEVHEHVLLHGQAEYLSTPMEHYAYPDVATFFEKHRRYAAWEAAASKKLHERTRERILRATPFGTAIERKRWLKKIVMKAPFRPSLRFLYHYVWRQGFRDGYRGWMLCRLLAAYERMIVSKEREFKDCSE

SEQ ID NO: 886 - protein, 259 aa, Winogradskyella pacifica
MIKLSAVIITFNEDRYIEECLKSLINVADEIVVVDSFSTDKTKAICTKYNVVFIEQEFLGYIEQKNFALSQASYDHIVSLDGDESLSETLQKSIIDLKSNWIFDGYYANRFNNFCGQWIKHSDWYPNKKLRVFDKRKAQWKGINPHDRIVIQSLGKTGHLKGDILHLTYQSYSEFNLKMESFSSISANAYFELGKTAPFYKLIWNPSWAFFKAYVLRFGFLDGFNGFMICYQTGHLTFLKYAKLRELKKEKQHLFPKLK

SEQ ID NO: 887 - protein, 275 aa, Unknown
  Description of Unknown: Candidatus Levybacteria bacterium CG22_combo_CG10-13_8_21_14_ all_35_11 sequence
MLSIVLATYNEEKNIKKCLSSNLVKQVANEVVVVDGSSTDETRKIATSLGARVIKTTNKLNFHINKQMAMNEAKGDLVLQLDADEVADEQLEIFIISINNKIEKLKVENSQWAVEWKKTNPVAWEIPRKNLFLSTWLKKGGQYPDPVIRLYINGFAKLPQKDVHEQMKVDGRVDPANGHLLHYANPKFGDYLRKFNTYTSFKAQQLKDDKLEITPFNALNYIFYKPIKTFFMLFLRHRGYVDGIAGFVFALMSGMHHAVSYLKLWELNQKEVIND

SEQ ID NO: 888 - protein, 254 aa, Halobacteriovorax marinus
MIKLSAVIITFNEEHNIERCLKSLEGIVDEIVVVDSFSTDKTQEICQKHNVRWIQNKFIGHIEQKNFALKAAKYDHVLSLDADEALDKQLKIEILKVKENFKADGYYFNRLTNYVDKWVYHSGWYPDSKLRLFNKNKGTWSGTNPHDIIKMQDGSTIKKINGDLLHYSYDSISDHVNQTNKFTTIAAKAAFKEGKRSNNFKIVSRPILKFVKDYFLKRGFLDGRYGFIICCINSLSALLKYSKLKDLQDGRSID

SEQ ID NO: 889 - protein, 252 aa, Thermovibrio guaymasensis
MSLSVAILTYNSEGKIEEVIRSIEGIADEVVVLDSGSRDRTLDILKSYGVKVYYRKFDNFVNQKNYLLSLATKDWVLFLDDDEVLTPELASSIAEELKSPSYDGYYLNRLTNYLGRWIRHAWYPDWQLRLAKREKCSWVGSEVHESLKVKGRIGYLKGELLHYSYSSVSDHLQKIDRYSTLFAQGALKRGKRFSLLKLLTSPAGAFLRRYILKRGFLDGFEGFVISVMASYYTFLKYLKLWELERSESSNRP

SEQ ID NO: 890 - protein, 283 aa, Legionella adelaidensis
MLSVIIITKNEEGNIRRCLESVKWADEVIVLDSGSLDKTVAIAHEYTDKVYLTDWRGFGIQKQRALSFASGDWVLNLDADEAVDEKLKKEIQHAITSGAADAYRIPIRMYFYGKPLRYSSSPTRHVRLFRKKGARYSDDIVHEKIMLPGGSKVSQLKNPLIHHSFRDLTHALYKINLYSSYTAKIRIQRGEKTNVVKIGFSTGWMFFRCFILQRGFLDGFNGLIFAGLNTLGTLFRGLKQLYPDRQLKDLPEVKKIEGERDKKLSLPDANKPGGKKLNEDGAK

SEQ ID NO: 891 - protein, 313 aa, Calothrix sp.
MSAKIPVSVIIPARNEEANLPACLTSLQRADEIFVVDSNSTDKSVEISESFGAKVVQFEFNGRWPKKKNWSLDNLPFRNEWILIVDCDERITPELWDEIALAIENTEHDGYYLNRRVFFLGKWIRHGGKYPDWNLRLFKHKAGRYENLGTEDIRNTGDNEVHEHVVIPGKVGYLKSDMLHEDFRDMYHWLERHNRYSNWEARVYYNILNGKDDNGTIGASLFGDAVQRKRFLKKIWVRLPFRPFLRFILFYIIYRGFLDGKAGYTYGRLLSQYEYQIGVKLYELSSCGGQLNTTSKPTNTTQKFTTEASQTAT

SEQ ID NO: 892 - protein, 293 aa, Synechococcus sp.
MNNKEMTQLHLKVIILTFNSEDSIAQVLDSCLQISSDFLIVDSFSTDKTLDIAQAYNCQIVQHEFENYAQQRNWAQSYANLEDNQWVLHLDSDEIISEQLVISIQKEFSDKSQDFDGYLFRRLPHFLGQPIRYGHLHPNWHLRLFKAGKGKCENRLYDQHFIVNGSIKHLSGWLLDLQLTSLERWTATHNRWSSLEAREIFNRTKHQSNDSTLQAKLWGDSRMQKRWLKNKVWYRLPLLLRPFLFFVYSYFIKLGFLDGRIGLIHSVLQAFWFRFLVDVKILELNKKSRWTNL

SEQ ID NO: 893 - protein, 245 aa, Olleya marilimosa
MDAITVIIPTYNEEAYIAQAIQSVDFASQVIVVDSNSTDNTVQIAKQMGCEVYLRAFDNFSNQKNHALQFAKGEWILFVDADERIPYALQQEIFEAIKSNKHAGYKLNFPHYYMNRFLYHHSDNVTRLVKRNNCKFEGLVHEKLIIDGTIGQLKNPVLHFTYKGLLHYISKKDSYAWFQAEQMLKKGKKATYFHLAFKPFYRFFSSYILRRGFMDGIPGLTVASVNAYGVFSRYVKLMLLQKGIR

SEQ ID NO: 894 - protein, 270 aa, Larkinella sp.
MSTLPQSGSPPVSAVMITFNSARILPTVLNALTWCDEIVVVDSGSTDQTLPIAREFGCRILHRDFNGFGLQKGFAVEQARNAWVLVVDADEVVTQELRAEIQLRLAEVEAGTLPFRGFEVPISLLFLGRLMRYGGEYKMPHLRLFDKRFGAYNSARVHEDVVLNGSVGRLTHHMLHDSYGSLHEYFEKFNRYTTAGARDLQSRGRHGSAAQVVFRLPITFLKEYLLKRNFLNGYPGFVWSLFSAMYPVVKYAKLRELENSPQNRPVPEER

SEQ ID NO: 895 - protein, 252 aa, Sediminitomix flava
MTLPKITAIIPTKNEEHNIREVLESVSFADEIMVVDSFSTDRTVEIAKEYTDFILQREYENSASQKNWAIPQATHEWIVLVDADERVTKELELEIKEILKGDKLKAGYWIYRRNHFLGKEVKYSGWQNDRVIRLFQKSKCRYEDKHVHAEIIADGEVGKLKNRLIHNTYVSFDHYLAKLNRYAAWQAEDYSDTQKITFYHLGIKPAVRFFKHFILQRGYKDGMIGFIIAYCQSYAVASRYIRLWISRNTNKK

SEQ ID NO: 896 - protein, 266 aa, Robiginitalea biformata
MNKAEGNTRLTALIITYNEIGYIERCLESIAFADEIVVVDSFSTDGTYEYLLEQPNVRVIQHPFENFTLQKSFALTQASNDWVLFLDADEVVPGALRREIQDTIAGNTDHAAFWFYRQFMFAGKPLRFSGWQTDKNYRLFRRSKARFTDRKIVHETLEVDGSSGILQERLIHYCYKNYEDYRSKMLHYGRLKAREDFFREKGFNYFFMMLKPLWKFFNHYILRLGILDGRKGMVICYLNALGVLERYRELKKLEQKNELAYYLLMP

SEQ ID NO: 897 - protein, 261 aa, Niastella sp.
MTPFSVVIITFNEEKNIGRCLESVKDVADEIIVVDSLSTDGTKSICASYGVTFIEQPFLGYVEQKNFALDRASHDYVLSLDADECLTDTLKKSILAEKQKGFAFDCYRMNRLSSFCGQWIKHGTWYPDRKIRLINRQKGKWGGVNPHDKIVMNEGSCLKQLKGDMLHYTYESIDQIMEQTNKFTTIQSKAMYERGKRSNVIKIVLNPLVSFISGYIIKRGFLDGYNGFIIARYASHATLAKYAKLLQLQRKMKQQAGATHR

SEQ ID NO: 898 - protein, 302 aa, Unknown
  Description of Unknown: Acidobacteria bacterium sequence
MNAPRPRLTVIVPTFNEEATIRDCLQSVRFADEILVVDSYSTDATLSIARAAGARVLQHEYVYSARQKNWAIPQASHEWVLLVDSDERVTPGLRDEILDLLASTPRHDGYWILRANHFLGRRIRHCGWGTDRVIRLFRRDLARYQDREVHAEIELPGPLPVLTHPLEHHSFRSFGQYWRKLQLYSEWGAAQLYKEGRRAGALEIFGRPVTRFFKMYIVRRGCLDGLHGLVLSMLGAFTVYLKYARLWEMRVLEGAARVPTQVEAGGALAREQIGRMVDEDRRPRPASAAARAGRHDESAQPR

SEQ ID NO: 899 - protein, 254 aa, Unknown
  Description of Unknown: Candidatus Marinimicrobia bacterium MT.SAG.3 sequence
MKISTLIICFNAERTIRKTLKSIGWSDEIIVIDSFSTDKTPEICKEFDLKFIQKEWQGFGKQRRWAVEQANNDWIFFIDTDEEVSIELKNEIVNIKKEGAESDVYAFPRKVYYMNRWITHSGWYPDHKARLFNKHKASWDESNIHEILVYEGEAIKLKGDLYHYTYRDIEDQLDRVNRYSTIAAEELISKGIKPSLIRSILGSIWRFNKLYFLKLGFLDGLAGLTIASMESYYVMVKYFKHAYKYNSDKTDSER

SEQ ID NO: 900 - protein, 306 aa, Unknown
  Description of Unknown: Candidatus Pacebacteria bacterium CG11_big_fil_rev_8_21_14_0_20 _34_55 sequence
MKLSVVIFTKNAETFLEAALKSVKFADEIVVVDMMSTDSTVKIAKKYTSSIYAHEDVGYVEPARNFGISKAQGDWILILDADEEVPQELARVIKGILKSDEKGQSTADCYYIPRKNMIFSKWIEKTGWWPNYILRLFKKGHIEWSDEIHSIPITSGEVREFPAIKEIAIIHHNYQHVDQYITRMNRYSNIQAEEISNSKDLELDSKFIFRKFSSELLSRLFSQRGINDGSHGLSLSLLQAISEASVAMKVWDQRGFPETDKFQEEELIGEIIQFKKELAYWIADWQVENNTGFTKFIWQVRRKLYI

SEQ ID NO: 901 - protein, 250 aa, Unknown
  Description of Unknown: Sphingobacterium deserti sequence
MEQKLSALIITYNEEKNITGVLSSLDFADEIIVLDSFSTDSTVTLAKAFPRVSVYQNKFEDFTSQRNLAISYANFDWVLFLDADERLTKEAKKEILDTINSLESKAAYFMYRTFYFCNEKIRFSGTQNDKNYRLFRKSKAKYDDKKKVHETLIVNGDTGILKNKILHYSFASYGLYRKKMVHYGVLKGQELSAKGKRYNLLTHIAKTAFKFFKAYFLKLGVLDGKRGIQLCYLQSLSVHETYKSLKKEGG

SEQ ID NO: 902 - protein, 252 aa, Unknown
  Description of Unknown: Comamonadaceae bacterium CG2_30_59_20 sequence
MQLSVIIITRNEEANIAECIQSVQFADEVIVLDNASTDNTVQVARSLGANVHISADWPGFGPQKNRALALAKGDWVLSVDADERVTPTLREEILQALALGKTAQAYEIPRRSSYCGQFIAHSGWSPDYVLRLFRRGSAKFSDDLVHEKVVFAGRPEKLVQPLLHLSFPDFESVLDKLNRYSSAGAQSMARSGKTASLASAVGHGLWAFFRTYVIRRGFLDGQIGLALAISNAQGTYYRYAKRWLMLRSDVKR

SEQ ID NO: 903 - protein, 260 aa, Unknown
  Description of Unknown: Candidatus Omnitrophica bacterium CG12_big_fil_rev_8_21_14_0_65 _45_16 sequence
MTTKTPITIAVMAKNEAHRLGACLETVRWADEVVVLDDMSTDQTVEIAKSYGAKCLKRQMDVEGRHRNFLYAQAKHEWVLSLDADEHVTPALADEISAVVKKNDPNFAGYSVPMKIYIGERWIRGAGYYPSARLKLFRRDKFKYEEARVHPRVFLDGKCGHLKGELMHYSFRDLNHFITKFNRETDLEADKWVKDGRRMSLGLALFKATDRFFRAYFTKKGYRDGYLGFLLSCFSSWYQLVTYAKYSEFKQSHTDARKKE

SEQ ID NO: 904 - protein, 269 aa, Unknown
  Description of Unknown: Candidatus Collierbacteria bacterium GW2011_GWF2_42_51 sequence
MKKISVIILAKNVANEIIPALKTSQFASEIIVVDTGSTDNTIEICRKLGAKIVHTTGDSFAKWRNDGAKEAKGEWLLYLDSDERIPVKLAREILSTLEAPQHQAYTISRYEIFLGKHLQHWGDPRVLRLMKKTALKRWEGKLHEQPKIEGKIGNLHHQMVHLSHKNIDEKVPNTLNWSKFEAKMLLDAGHPQMKGWRFIRIMFTEFWYRAVKQGLWKDGTEGWIEIIYQMFSKFMTYERLWEAQRKPSLSETYKKVDDDLLQEWQQENK

SEQ ID NO: 905 - protein, 492 aa, Centipeda periodontii
MKISACVIAKNEAENLPRWLASMRVFADEMIVVDTGSADATVEIARTGGARVYHFDWINDFAAAKNFALDQAQGDWVVFTDADEYFTEESASRVRPLIEEYDKKETMDGFIVHLVNIDMDTGALLGTTAQVQRIFRRAPHIRFVGSIHEHVENLSGDPGREMMMAPGLTLYHTGYSPRIIKEKSKRDLDLLLARRARGVYKKLDEYHLMDCYYTLEDYPKAVHYARLARDSKDRPVGSENRPHAVLLQGLILMGAPDAEIEDAYQVARQAFPEQADFPLIYGIYAWEAGYFARAREAYTEGVRLHEEYYRAGDFSGILAPRAYACLGAAAVLSGNVEGAVALYERAIELRPHDASALVGFVRLLGAVGADDATLIETLNRLYDETADAAFLSSILAGTDFPLASLYYDRRADIHFSERRRFLLAGDVSSAAASLIEDMERAAVVAAARGARFAPTQQGALAFLLPHVCRGESAAPEAQRVIRRIGRLARGTE

SEQ ID NO: 906 - protein, 271 aa, Thiothrix lacustris
MTNTHPQRPTLAVALIVKNEADNLAACLASVADWVDEIVVLDSGSTDATVSIAESLNARVFINADWPGFGKQRQLAQSHVQADWVLWLDADERVTPELRDEILAILQNTDTDTDTDTDTDTVFAMPRLSWAFGRFIRHSGWYPDYVLRLYPTQLTQYDDSLVHEKVLLPPNSKVHTLKTNLLHYTYRDMPQYLAKMSQYSNLWAEQKAHEGKSSSIGQAITHGIGCFLRMYIIRRGLLDGVQGFLIAVTNAYFTFAKYADLWVKRNNNAHP

SEQ ID NO: 907 - protein, 259 aa, Flexistipes sinusarabici
MSEEITGIVLTYNGEKYLDPCLNSLRACVEELVIVDSGSGDRTLEIAEKYSENVIHHNFENYGKQCIYAIGQASNRWIFILDQDEILENKLISEINALKKSGFAHDAYSIRRRNFLFNKEIKHGGWGNDFVIRLFDRNKAFPTDNNFSVVKTEGNVKRLKNRIIHYPCDSIDKYFAKMHSYASISAKEMLGKNREFRLYNLLFNPLYRAFKKYVLQKGFLDGMYGVILAVISYYFVFLKYLKLWEITNINHENKNNGDI

SEQ ID NO: 908 - protein, 257 aa, Unknown
  Description of Unknown: Candidatus Erwinia haradaeae sequence
MQQIQKISVVIITHNSEEVLVKCLESVNWADEIILLDFKSSDQTLDIAVRYGVTVYHSNVWYGYGKQRQIAQNYATYGMILMIDSDERVTPELQKSINLILKKPPEKIVYSIARCNLFLGRAMRHGGWYPDRVIRLYPSFCVYNDNLVHESLNVPEIPIQPIYGDLLHITSRDFCDFQFKQCAYAKAWAKQCYQQDKHYGIIKIIYHSLWSFIRTLIVRRSFLDGTRGWLLAIVVFQYTFNKYAALWALNCTSRDKN

SEQ ID NO: 909 - protein, 258 aa, Unknown
  Description of Unknown: Chryseobacterium wanjuense sequence
MPLSLAVITYNEEENIVRLLDSLKNTVDEIVIVDSFSTDKTKEICTQKYPQVKFFERKFNGYGEQKNHALDLCSHEWILFLDADEVPDEDLKNSIKKITSSDHPEFSVYKTKFNNHLGIHLIKFGGWGNVYRERLFRKDCARYSNDKVHEYLITNKKSGILGGTLNHYTYKSIQHHITKINKYSDLMAEKMFERGKKIKRFKIIVSPIYEFIKVFIFKLGFMDGFPGYYIAKTMSYYTFLKYIKLYEKIRLREIENTQ

SEQ ID NO: 910 - protein, 292 aa, Mucilaginibacter mallensis
MISVIILTKNEEADLPVCLESLEWTDDVHVLDSLSTDKTCEIALQYGANVLVNPFQSFGKQRNFALKNIDVKYDWVLFLDADEVASPEFVNEIQSATDNADDDVAGFYCCWKMMLEGRWLKRCDNFPKWQLRLLRKNRVTYTDFGHGQKEDKVLGNVLYIKEPYIHFGFSKGWSHWIERHNRYSTLEAIARLDKCPPLKNIFSKHGSIRNPALKSWLIKVPGWPLLRFIHTYIFKLGFIEGSPGLTYSINLSFYEHMIVIKRREILSGRKSNYNNVNQEVMINDNVQVGVNS

SEQ ID NO: 911 - protein, 253 aa, Flaviramulus basaltis
MIKLSGVIITYNEERNIEKCLQSLVPVVDEIVVVDSFSTDNTKAICQKYQVKFIEQSFLGYIEQKNFALNQASNDFIVSLDGDEALSETLQKSIIKLKDNWNFNGYYSNRFNNFCGQWIKYSDWYPNKKLRVFDRRKAMWKGVNPHDNVVLNNTRKNTGYLKGDILHWTYQTYSEFNLKTEHFSNISAKAYLKLGKKAPIWKIVFNPIWAFIKSYFFRLGFLDGLNGLVICVQTANITFLKYTKLRELIKNKN

SEQ ID NO: 912 - protein, 261 aa, Unknown
  Description of Unknown: Gammaproteobacteria bacterium CG_4_10_14_0_8_um_filter_38_16 sequence
MRRYYAQTEQKMKPSISIILITKNSEKTVEKCLESIQWANEIIVLDSGSTDQTLSICLKYTDHVFQTDWPGFGIQKNRALAKATSNWVFSIDSDEWITDALREEMIKTIKNPTALVFQLPRLNQYCGQWIRHGDVGKDKVTRLFKRGFAHFSDDRVHEKIMTSEKIGKLTFPLCHNTYDSIDALLQRMNLYSSLSAKMRFDRGKKTNLLKAIISACWSFTRAYFFRAGFLDGKMGFIVCAAAAQSSYYRHVKLMELMKQRC

SEQ ID NO: 913 - protein, 249 aa, Alkaliflexus imshenetskii
MKISVVINTYNAEQHLDKVLESVKSFDEVVICDMHSTDRTIEIAQKYGCRIVYHAKEKYVEPARNFAIQQAQYDWILVVDADEVIPAALKEYLYNQLDKKDCPAGIFIPRKNYFMGRFMRIAYPDYNLRFVKKDATFWPPYIHSHPIIEGKIIKIPAKYVGLAMEHLANDRIEQILTKNNVYSSAEVVRRANQKVSIGHIIVSPFFRFIKLYFFKGGFRDGMPGFLFSIYKAQYKFDTLAKMAESQYRN

SEQ ID NO: 914 - protein, 256 aa, Legionella israelensis
MLSVIVIAKNEQENIRNCLSSVHFADEIIVLDSGSTDNTVQIAREYTDKVFETDWQGYGVQKQRALSHATGDWVLNLDADEYVDDKLKKEIQKAIGADEADGYRIPIRMNFYGKPLRFSSSPKRHIRLFKRKNACYSEDIVHEKIVLPATARIRQIHAPIMHHSFHDVSHALYKINRYSSYSAKIRIAKNQNPSLIKTLLSTLWMFCRCYFLQRGILDGKPGFLFAVLNAQGTFYRGIKQIYKDSDLDNLPPIERV

SEQ ID NO: 915 - protein, 289 aa, Pedobacter xixiisoli
MNPVFSFIILTFNEEQHLPRLLNSITKLNAPVFILDSGSTDQTLKIASDFGAVLQQNAFENHPKQWDFALKNFEIKTPWIIGLDADQVVTPELFNQLANFREEDYQDINGIYFNRKNIFKGKWIKYGGYYPKYQLKMFRNGIGYSDLSENMDHRLLVSGKTIIWKKGHILEENLKENDISFWITKHNRYSDLVADEEIERMRNLRGQTVRPKLFGDPYQRTAYFKNLWWKLPLFIRPFIYFGIRMTFQLGFLDGRTGILFHFLQGFWFRLIVDMKISEKLDKNKNEQIK

SEQ ID NO: 916 - protein, 286 aa, Unknown
  Description of Unknown: Silvanigrellales bacterium RF1110005 sequence
MEVKEIYEQYQKSQNYDISTFVPEPEKLTAIVITKNEEKNIARCLSSLDFVDEIIIVDSGSTDKTIEIAKKFSKVCVIQTKWYGFVENKRIAVEKAEHDWILWVDADEVVPVDLAKEWDERVAEGTFHETAGIDVARKTFFLNHWVKHSGWYPGRVTRFFHKKRAYFNDNILHEGVVAKQGYIVESFKTDLLHYSYTSIYQYFDKMNKYGFAGANEIKRKRKIVFLPQLFLQPMWTFFRFYFLKKGFLDGRIGLIVCIGASFSNFIKYANYFFLKKYNYVEINEKE

SEQ ID NO: 917 - protein, 449 aa, Unknown
  Description of Unknown: Lachnospiraceae bacterium MD308 sequence
MGKKAGQIKISQCMIVKNEEQNIRRALSWGKGVVHEQIVVDTGSTDNTVKIAESMGAKVYHFEWCDDFSAAKNYAIEQAGGNWIAFLDADEYFSEQDAKKIPGILKKIENVSVKSGRIHMLRTAMYHLNDEGETFSAGQHDRIFRNMRGLRYKNRIHEVLSFSSGQTLRYALTDLTIMHTGYSDSVRDKKGNRNIPLLKKSVEEDPENYDLWSYLGESYAVGNQIEEAIDSMEHVIERITEGASIRICDDRLFAAFAVWFSAVSFLPEDALGCYEEKARRYYDIFLKQDKLFPDVEFYMGRFMLRTGKQTEGVDFFELALAKLEEYKGSSSLKLPSRLDMVYNVLMYHYEQHGDASKCVYYGTLSLRVDRYQEAPLEVLVRLLKADPNTAATQAYDFLARLYLFVNLKDKLFVLKTAMKLGYSELVEKIRLEMTEQEKGWLDGQEEFGK

SEQ ID NO: 918 - protein, 256 aa, Chlorobium sp.
MANYISVTVLTKNSEAYLCECLEALKPFSEVVILDNGSTDKTLDIAGSFENVRVYEHPFTGFGPMKNLAVDKASNDWILSIDSDEIVSSELARDILSRDLEGNCLYTVVRDNYYHGRLIRGCGWQNDHLYRLFNRKNNRFNNKLVHEGIEIKEGMKTALLKGRLKHYSYDNASQLLQKMQYYSTLWAEENQNKKKASPFKALMYGMITFFKSYVLQNGWLNGYEGLLISITEANGVFYKYIKLYEAVRFSSHKSRT

SEQ ID NO: 919 - protein, 304 aa, Unknown
  Description of Unknown: Candidatus Roizmanbacteria bacterium CG_4_9_14_0_2_um_filter_ 36_12 sequence
MLSAVVLTKNEEKTIERCLKSLMFCDEIIVVDDGSTDGTVEHVYKVNKCRDRSRPVRTKVFQRKLARDFAGQRNFGMSKTSNEWVLFVDADEEVTRELQREIEVTLRQAQGDNSRVMVSLTNHDKDAYYVRRRDFFWGKELKYGEVRQIRLIGLIRLIRKDSGKWLGNVHEEFKVKSQKSKVKSLNSFLNHYPHQTLKEFIKDINDYSSIRAEELYNQGKNVNVIEIMFVPAIKFIYNYLINLGFLDGAPGFAYAFLMSFHSFLVRAKLYMLKSSMPFFSPSSPRHKPTAGPQEIGEKKVSSLL

SEQ ID NO: 920 - protein, 249 aa, Bordetella genomosp.
MKLSVIIITKNEAKHIVGCLESVAFADEFIVVDSGSTDNTVELARDFGAHVEVTSDWPGFGPQKNRALDLATGDWVLSIDADERVTPELAREIQAVLAVPKADAYEIPRLSEFCGRFIRHSGWWPDYVLRLFKRGTGRFTDAAVHERVVPQGPVLQLKGHFEHYPYPNLDALINKINRYSSDAAAMMYARGKRATVFSAMGHGFWTFVRIYLIRRGFLDGRHGLVLAVTAAAGSFFRYAKLSFLSDQRK

SEQ ID NO: 921 - protein, 249 aa, Unknown
  Description of Unknown: Chlamydiae bacterium CG10_big_fil_rev_8_21_14_0_10_42_34 sequence
MPIFNKITVCILTKNAESTIEETLDSTHLFSEVLILDNGSTDATLAIASKYPNVVIHKAPFIGFGPLRNRLAELATNDWILALDSDEIVSPPLSQELDQLTLDPHFTYNFPRHNFYDGKQVRGCGWDKEYVARLYNRNATRFSDALVHESLITLKPLTLQYPLLHTPYRSTTEFLAKMQHYSTLFAEQHRGKKSSSFSKALLHGIYAFIRSYFFKKGIFCGKRGFIISLYNANTTFYKYLKLYEVNRNG

SEQ ID NO: 922 - protein, 361 aa, Clostridium tunisiense
MISISLCMITKNEEKCIDNCLKSVCDIVDELIIVDTGSTDSTIEIVKKYSDKVYNFQWINDFSAARNYSFSLATKEYILWLDSDDILSEEDRLKLLELKDSLDKSVDFVGMMYDYSFDDTGKCTYSFRRNRLVKNFKGFYWDCFMHERLNVWGNWKDYNIHITHTRKHDNNERNIENFRKKMLENYYLNPRETYYYGGELYAGGYYDDAIRVLEDFLTRDYDDNYDKVNALTRLADCYSVKGEYNKAIDSCIKSFKYEIPRAEICYKLASYFQHLKRYNEAIFWFKTTLSLKSSTDGNLMVVDDGWIDYLPHQQLCCCYYEIGDIESSNKHNELAARFIPNNPYVIQNRKLFNSLGYNLKS

SEQ ID NO: 923 - protein, 279 aa, Verrucobacter flavum
MSLPVSICIPVRNEEKNLPDCLASLGEFDEVVVVDSGSSDRTVEIARAAGATVLRFEWDGGFPKKRNWALRNHVFKHPWVLFLDADERMNTAMVNELGKTLPNTTHSGFWISFTNWFMGRPLHHGDVFHKLSLFRVGHGEYERFPEEFWSRLDMEIHEHPVLQGSVGELRTRLEHYDYRGLENYFARHNEYSTWEANRYQWFKRQASAEDWAKLNTRQRFKYRHLDKWWLGTFYFLMAYLAKKGFLDGYRGWIFNRLKQRYFADIRLKILEMESGKSSN

SEQ ID NO: 924 - protein, 267 aa, Flagellimonas eckloniae
MSELHTPRQKISALIITYNEMGYIEKCIDSVSFADEIIVVDSFSTDGTYEYLQKRDKVNVIQNPFENFTAQKSFALRQASNDWILFLDADEVVNTKLQEEIVETVNNPKACEAYWFYRKFMFQNTKLNFSGWQTDKNHRLFRKSKARFTDKKIVHETLEVDGNSCILKEKLTHFCYKNYEDYKGKMLHYGRLKAKEAFYKEKHFNYLFMIVKPFWKFFNHYILRLGFLDGKKGIIICYLNALGVLERYRELKRLEKKNQLTYYLVMP

SEQ ID NO: 925 - protein, 256 aa, Unknown
  Description of Unknown: Flavobacterium sp. ABG sequence
MILPEKQLLSALLITYNEESNIKEALLNLSFADEIIVVDSFSTDQTVAIASSFKNVKVFQHTFDNFALQRNYALSLASNQWILFIDADERITPKLQQEIKAIINEADSCPAYFMYRNFIFENKKLRFSGWQTDKIIRLFKKENAIYNIEKIVHEKLIVNGKTGKLKHKLIHHSYSNYEDYKQKMIFYGKLKAQEELLKKTNPNFFHFYIRPLYQFLNQYLLRFGFLDGKKGIIICYLNAMSVAIRFQELKKIRMTS

SEQ ID NO: 926 - protein, 261 aa, Unknown
  Description of Unknown: endosymbiont of Galathealinum brachiosum sequence
MHTLSAIIISMNEEDRITPCMESLKNYVDEIIVFDSGSTDKTVDIVKRYTDKVWVTETWPGDGFQKQLALDQASCDWVLMIDADEYLDIEMKSAITDILSQDMITETAFKLPWGNIILGKQLRYGRSARAPVRLFKRIGSHITQVVVHGQVVTEGKISTIKKGFLMHNSLRNFEHLLEKNRSYSWETTLKYFSQKKRSFGIEIAVLRALWTFIHIFILRLGFLDGHRGLLMAVMFAQASFNKYAGLWYLENEEKNKTNPDL

SEQ ID NO: 927 - protein, 247 aa, Unknown
  Description of Unknown: Candidatus Shapirobacteria bacterium CG09_land_8_20_14_0_10_39 _12 sequence
MISAIILTKNEEKNIRECLLSVSFCDEVLVIDDNSTDKTAEIADKFGAKVIKHSLDNDFGQQRNFGLEKAKGNWVLFVDADERVGSESQDEIKEKTKTNTVNGFCLKRIDFFMGRWLKHGEISSIKLLRLGRKNCGRWERTVDEIWKIKGTVGTLNKPLLHYSHPDLTQFLENINQRSTLNADYLFNEGKKNTLLEWLKPLAKFIRSYFFNLGFLDKTAGFVFAVLMSMHSFNVRVKLYLLIKRHEK

SEQ ID NO: 928 - protein, 235 aa, Campylobacter mucosalis
MKLSIIILTFNSEKLLSEVLTSTMFADEVIIVDSGSNDDTLAICAKFENVRVLKQSWLGFGAQKQYGVDNAKFEWIFVLDSDEVITNELKTELLDELKSPKFKAYKVARLNYFFGKSIKSMGLYPDFSVRFFNKNYAKFDGREIHEKVVLNDKNGDFGTLKNHFIHYAYDSVEQFINKQNRYSSLGAKKNVLKAIFNPFWTFFKLFILKGGFKDGWRGYVIARLYAQYTFWKYIK

SEQ ID NO: 929 - protein, 285 aa, Unknown
  Description of Unknown: Chloroflexi bacterium sequence
MGLVPLSVIILTYNEELNLPSALNSVVGWAEQVFVVDSFSTDNTLKIAEDYGVPVYQNPWTDWATQRNWALDNLPIRNEWVLFLDADERISSELAEEIKETLKNVPHQVSGFYINRRFIFMGCWLKYGGYSSNWVLRLVKKDKTRVLPAGDSEYFQVDGKVLRLKNYMIHEDKKDLHFFTHKHNKISDMAARKLFNKERVNFDSNNKRKGLEGKYRVWIKENILANLPLFVRPFVIFSYKYFLKLGFLDGKEGLVYCFLHDFWYPFLVDAKILELKKMKNGSEEI

SEQ ID NO: 930 - protein, 247 aa, Unknown
  Description of Unknown: Pelagibacteraceae bacterium TMED195 sequence
MTISALIVARNEEKRIEECLSSLTFVDEIVVILDRSTDQTFKICKKFSNKIFSGKWTCEGKRRNFGIEKCSSEWIFEVDADEIITKSLALEVKKKIKLNKYDYFYIPLMNHIYSTPVKYGWMACLAPDGKFCLFKKKNKLWHEGLVHPSYSLKGVKGPLLENHINHFMSKDISELLLRFNRNSSLHAIELKNKNLKKYFSFRKVFSRFLKSYFLRKGYKEGQLGLLICIFNALYPMVSAIKSKQDLT

SEQ ID NO: 931 - protein, 302 aa, Unknown
  Description of Unknown: Microgenomates group bacterium GW2011_GWA2_37_6 sequence
MKHKLSVVISAYNEESRIKDCLDSVTWVDEIIVVDNSSTDKTPDIARKYTSKVYLQPNDPFKIDLQKNTGFEKATGDYILNIDADEKVSRELKEEIQRLMVKANLKEGYFIPRYNFMFGKKIEHSGWYPDHQLRLFKRGKGKYEDSVHKGIELDGEAEYLKEHLIHNNYENIVQFINKNMIIYAQIKAGDLLKKNYSLRPGDLIRVPSKEFLSRFFAREGYKDGLHGLFLSLFMAASELAVLGYVWEKGGFKEGSREEILKDTESELKEFNKNLNFWFLSIKIKESKNPLRKLSLKLRNKLK

SEQ ID NO: 932 - protein, 273 aa, Flagellimonas pacifica
MAGLSAPKQKISALIITYNEMGYIEKCIDSITFADEIIVVDSLSTDGTFEYLQSHPNVKVIQKPFENFTAQKNFALKQAENDWVLFVDADEIVGHKLQNEIVQTVNDPNALEAYWFYRKFMFQNRPLHFSGWQTDKNHRLFRKSKVKYTNTKLVHETLEVDGSSGVFKEKLIHYCYKNYQEYKSKMLHYGYLKAKEKFDNGVSFNYLNLLIKPTWKFFYNFIVRLGFLDFQKGITICYLDALSVLERYRKLKQMHRSAVIKINLFMPASPEAR

SEQ ID NO: 933 - protein, 252 aa, Unknown
  Description of Unknown: Flavobacteriales bacterium CG_4_9_14_3_um_filter_32_8 sequence
MQIQLSVVIITFNEEKNISRCIDSVIAVADDVVVVDSFSTDKTKQICLEKKVRFVEHHFNGHIEQKNWAITQAKNQCVLSLDADEALTKELAIEIIKIKKNWQYDGYSFNRLTNFCGSWIKHCGWYPDKKLRLWDSTKGKWGGVNPHDKVIMNQGTKIKHINFDLLHYSFYTIEQHLKQIDYFTDISAKAAFEKGKKSNAFIIFYKSKFKFIRDYFLKLGFLDGYYGYIVCKNSAFATAQKYRKLLILINSK

SEQ ID NO: 934 - protein, 270 aa, Rudanella lutea
MQQSYLSVVLITLNAERTLPRTLASVANWADEIVLVDSGSTDATLDIAHSYGCRVLHRSFDGFGTQKQFAVDQATHDWVLLLDADETPDEALKGSIMDVLRQRPDPQQGFCLPRSLVFMGQLLRHGGEQNRPVLRLFNRQHAHISPALVHESVVTTGPVTVLQGTLWHDSYGSLHEYITKMNQYTSLNARQMGGRQRKQGALEVSVRFGFKFVKVYLLKGSFRDGLPGFVWAFFSAVYPVLKYTKLYEATQKKTKKEWMSGSKRLSVSGF

SEQ ID NO: 935 - protein, 245 aa, Aequorivita antarctica
MPKLTVIIPTFNEQAFLEDALFSVSFADEIIVVDSFSTDKTPEIAKKYATKFLQRKFDNFSNQKNFALKEATGDWILFVDADERVTHSLEAEIKETLQNPKHSGYKINFPHFYMNRFLYHHSDDVLRLVKREGAKFSGSVHEKLQCEGRIGKLKNKMLHFTYKGFDNYISKKESYAWFQAQQQFDKGKKTTWFHLLFKPTYRFFRSFILKGGFRDGVPGMTVAAVNAYGVFERYVKLMLLQRGMK

SEQ ID NO: 936 - protein, 254 aa, Unknown
  Description of Unknown: Candidatus Omnitrophica bacterium sequence
MPLLSVIVITRNEEKNIKEFLDMLSWVEEIVLVDDESTDRTVQIASTYPNVKIFKRRMKNGFGPQKQYALEQATGEWVLVLDCDERITEKCKEEILKKISFHQYDGFYFLRKNMIFGKFISDYKPRALRLFRRRKGKFTDAGVHENVIVKGKIGVINEPIIHYSRSTENIENYIDTLNLYTLFSAQEMFAKGRKVSSFGFFLYFILYPIYIFLRVFLFKKFYAKGIVGIVLATLRMFEGVIGYFKLWELSRKDI

SEQ ID NO: 937 - protein, 256 aa, Unknown
  Description of Unknown: Acidobacteria bacterium sequence
MSGKLTALVPTFNEEEVIRDCLESVRWADEVFVVDSFSHDQTVTIAREIGARVVQHEYVNSAAQKNWAIPQACHPWVLLVDADERVTPELRDEIRGLLAQGPSYDGYWIRRSNHFMKRRMEHGGWETDKVIRLFRRDCARYEDREVHAEINLPGRLPVLEHPLLHFSFRSFSQYWKKMQLYSDWSASQMWKEGKRAGWISIGLRPVQRFLKMYLVRRGFLDGLHGLVLSMLGAFTVFLKYAKLWELGLRHGRESEL

SEQ ID NO: 938 - protein, 265 aa, Metakosakonia massiliensis
MFKLSVCLLTCNSARLLREVLPPLLAVADDFVVLDSGSTDATLDICQEYGLTVHHHPYAMHGAQMNHAISLAAHDWVLCMDSDEILDEQTLNFILALKAGEEPAADQAWRLPRYWFVLGQEVRTIYPVSSPDFPVRLFNRRCARFNDRPVDDKVEGFSRSVKIPGRVRHDTFYSLHEVFNKLNGYTTRLVKYQKVRPSIGRGITSAIGAFFKWYLFSGAWRYGKVGVVTGLYATFYSFLKYFKAWYAHSDTKEVATEEKKKTRTI

SEQ ID NO: 939 - protein, 267 aa, Unknown
  Description of Unknown: Candidatus Daviesbacteria bacterium GW2011_GWC2_40_12 sequence
MLTVIVITKNEESRIKACLESVKFADEIIVCDNGSEDNTIRIAEKYTDKIFQTRLQDFAEIRNFATEKASGEWMLFVDADERVTEALRSEIETMISFSDFSAYALSRKNIVFGQEVKYGPFWPDWVIRVLKRTDFQMWVGKVHEMPHFSGKLGYSKNSLLHLTHRGVDQFMKKVLDWSAIEARLRLDANHPKMTKWRFVRIFITELLNQGFKRRGFFGGTVGIIDSFLQTFHLYITYVRLWEMQQPKSLTQTYDDLDQQLIDDNFKY

SEQ ID NO: 940 - protein, 252 aa, Unknown
  Description of Unknown: Candidatus Rokubacteria bacterium 13_1_40CM_2_68_13 sequence
MTTRPRLSAVVITLNEEARLRSCLESVAWADEIVVVDAESQDKTVQIAREFTEHVLVRPWPGFAAQKNFALEQATGDWLLSLDADEEASPELRDEIARILVQAGAADGYAVARRNVFLGQWIRHGGLYPDWQVRLFRRGRGRFVDRDVHESVEVDGRVARLSGHLVHRSYEGVSDFFDRANRYSALAAQELVRGGGRARARELVLRPLGRFLSMYLAQRGFLDGRKGLLLAALYAYYVFMRTARVWEATRAR

SEQ ID NO: 941 - protein, 257 aa, Marivirga sericea
MKIKLSAVVITFNEEKNIRRCLSSLTKVADEIIVVDSFSSDRTEEICSEFHCEFKKNPFEGHIQQKNFAVQQASNEYVLSLDADEELSEELIDSILSVKTNWEYDAYFFNRLSSYCGKFFRHGSWYPDQKVRLFDRRLAEWGGTNPHDKIILSSSSKKHLKGDLLHYTYHTIEEHLKQVNYFSTVAAKAAYDQGKRFTLFKLIFKPFWRFFRDYFLKHGFLGGYRGLTICLLTAVETYLKIIKLWEIERAKKTNSQH

SEQ ID NO: 942 - protein, 261 aa, Prevotella histicola
MEKKEISVVINTYNAEKFLQRVLDSVKDFDEIVVCDMESNDHTVEIAKRAGCKVVTFPKGNHTCAEPARTFAIQSASSPWVLVVDADELVTPELRTYLYQHINKPDCARGLYIPRQNRFMNILKKGFSKDYQLRFFIREGTVWPPYVHTFPQVQGTLEHIDNHLHNVQLIHLAENYLADMLEKCNRYTTDEVLKKKGKNYGVGALLFRPFWRFFKSYVMNGEIRNGITGFIDSVMTGFYQFILVAKVIEAKIKKQTEEEQE

SEQ ID NO: 943 - protein, 264 aa, Thalassospira sp.
MVQTEAVKTGISTPAVKLSAVIVAHNEEDRLASCLTHVAFVDEIIVVCDKCNDQTEQIAIDAGAKTFAGSWHIEGERRNFALAQASGDWILEVDADEHVSAELADEIRQVIATTNYDYHQLLVDNYIGDRLVRYGWGASFGKPGYAGLFRRGAKHWGPQRVHPAVKFQGRKGFELKYRVRHYVDRNISDMIRRLDSYSTARAADLRESGNIGSFSNNLRRMFSRFFKCYVRRKGYREGGMGFLVAICAALFPMISYLKARYEDN

SEQ ID NO: 944 - protein, 616 aa, Paenibacillus sp.
MTISLCVICKNEEHNITRCLEGVREAVDEMIVVDTGSTDNTVAMARELGAKVYYYEWDNNFANARNYALKQAKNDWIIFLDADEYFLPEHAKLIAEMIGRLRAQRNLTDAIMMRHISIDEGRGGVVVETNRLVRAFRKSTLEYERPIHESLTKKTGKIHLLDATDSKAVVYHTGYTLEWMKHKAQRNLELLLKDEQDGTGDELTQLYLSDSYMGLGQLEKALDYGIRYIDKGRVVYGFNAKPYSNVIRCLISLGKKHELIIDWIERAIERFPGHPDFVWLKGLQFLREQRYSTALGYLLEADQLKDNYDGSESVRITFSLAEIYNNIAAIYVLMHDHLTALEYYVKSLKIKKYEVNAFDGLFTITKPYPREELIALLNSIYGHADEDLTFLINRFCELREGQLLLYYAKRSEWIQRHKSEGQIPYYILYLNGKYEEAYHMLDKSTMDTAPDDVVQVYMVVNAMLSLSEDIIAMALRRVAPSFQRILGVYAGVSKQLFTEDTHSLIAIFSEIARVCSDEQLQAVFMIEQMIEVDLSQQMAAILVQRRRYKLALHYFNSVQQPLDGEAWFQRGICYYNEGLYTHALQAFDQAKLKGIDDNRVEEYITWTEGHIKTKRV

SEQ ID NO: 945 - protein, 245 aa, Unknown
  Description of Unknown: candidate division KSB1 bacterium sequence
MEKFSAVIITLNEEKNIERCLKSLTWADEILVVDSGSTDRTLEICKRYGAKVVQTEWRGFGRTKQFAVEQAGHEWILSIDADEEVTTALRERIRNILQHPDPAIAYRIKRQAFYLGKAVKYSGWQNDFPLRLFNRKNGNFNDKPVHESVQFKGQVQRLYEPLNHYTYPTISSHIRKMDRYTNLSAAGSERKSTIGGSLVRALFRFFKMYIIKGGFLDGRIGFVLCFNSAFGIYLKYIKLWEKTRK

SEQ ID NO: 946 - protein, 349 aa, Paenibacillus sp.
MNISVCLIVKDEELNIERVLKSIPSPFEVIIYDTGSRDRTVQIAEKYNAVIKQGEWNDDFAQARNQSVSWATGEYILILDADEELPPDAEAKLSQFITEHPGQAGTVVLENIMENDSARHRMIRFFPNRPSFRFKGIVHEQLYENDLPASFKDTGLLVKHYGYTKKEYHEKDKFNRYLTLYQKALDERQDEGYMLYQIGKLYNSLEQYKEAEHYLKRSLTYKEENQLYHPPMLVLLGYTLKELGRSKEAADLLARYGDVYKDFPDLFFLLGLLAMDTGEIHIIEPSFKEALRIGETPKYTSVLGTGSFKAAYNLGVYYEILGFKDKAKEYYRLAASWGYDPALIRLKNI

SEQ ID NO: 947 - protein, 310 aa, Thermogutta terrifontis
MSEGIVAERSNIAEEPDRPKQDTLPISVIVPVLNEEQNIAACLESVRFADEVFVVDSGSTDRTAAIAESMGAKVVQFRFVPGGPRKKNWALENLPFRNEWVLLLDADERVTPELEREIRQEFVQGPRFDGYYLNRKLIFMGRWLRFGGNYPSWNLRLFRHELGRYEKLDTEELESAGDVEVHEHVVLQGKAGYLREPLLHLDYKDLSRWIVRHNNYSTWDAKLRLNLLQGKDLSHSIPARLLGNPVERKRWLKKLWIRLPCRPLLRFIYMYVIRLGFLDGKPGFIYAVLKAIQEFHINAKMWEMRTKLSE

SEQ ID NO: 948 - protein, 356 aa, Unknown
  Description of Unknown: Firmicutes bacterium CAG:534 sequence
MPPISICVIMKNEQKNMENFLSAIQKHFKDYPHEIVLVDTGSTDNTISIAQKYTDKIFHFDWIGDFSAARNFSLQCAAYDWVLVLDCDEYIIDLDVRGFDALITYYPQCVGMLSRKNHYEMNGTDSVYTDDVERFFNKKLFHYEAIIHEQVRALDGTEYKRVALPLTVDHCGYNGTIEDLRKKAERNNELLLKMLAETPDDPYLYFQIGQSYNMLRDDEKACYYYGKGLEYDVDPNAEYVQMMVIGYGYALLHLGRFDEALQFQNIYDEFATTADFVCLMGLIYLRKGMLLQAMAEFLKATSFETSKTEGANSFIPTYNMACINEVLGDIETAKVLYKKCGDFKPARERLNELSCS

SEQ ID NO: 949 - protein, 256 aa, Capnocytophaga haemolytica
MILLEPKISVVINTYNAEKHLQTVLETVKDFDEVVVCDMQSTDRTIAIAEQYGCKIVYHERLSYVEPARNYAIQSAANEWVLLIDADEMVPTTLKDELLRRLQTEEFDALAVPRKNYFMGRFMRSTFPDYNIRFFKKSKVNWLPAIHSTPTIDGKLLYLKKDKRFALEHLANDSFTDVLRKIQLYTDAELLRRKPKRVSLFKFVCAPMIAFCKTYFIKGGFLDGKEGYLYAKIDAYYKFFMLAKLNEAYHQAHQNV

SEQ ID NO: 950 - protein, 264 aa, Arenibacter sp.
MIHNTERISALIITYNEMGYIEKCLESVSFADEIIVVDSYSTDGTYQFLLNHPKVKVLQKPFVNYTDQKSFALKQASNDWVLFLDADEVITEPLREEIKITATRDSKHSAYWCYRKFMFQNRRLYFSGWQTDKNYRLFRKSKVRFCDKKIVHETLIVNGSSGVLHKPLMHYCYKTYTDYKMKMMKYGRLKAKEAFQQKKTFNYFSLIVKPLWKFSYNYIIRLGILDGKKGIIVCYLNALGEGERYMELKRLWKKRQHVYSPSFR

SEQ ID NO: 951 - protein, 298 aa, Unknown
  Description of Unknown: Acidobacteria bacterium sequence
MSLSPFPHFPRFGRDDNAVNESREKLSAIVTSFNEAVNIKECLESVAFADEVLLVDSFSTDSTLDLARQVPGVRILQREYFGSAAQKNWAMDQTVCSWVLIVDADERVTPGLAREIRDLLVRGPEASYYSIRRRNLFLDRLIRHSGWSTDRVVRLLRRGAARYPRRRVHADIQPEGAAPTLRNPLLHYTFRSLGQYLEKLHRYAEWGAADAYRRGKRSGALQLFFRPAWRFVRMYVFQAGFLDGRHGLVLCTLQAYGVFLKWAKLWEWRRFDQNGWRFELPAYDESDETWEGAASAAD

SEQ ID NO: 952 - protein, 310 aa, Microcoleus sp.
MAFATSKIPISVLIPAKNEEANLPACLESLSRADEVFVVDSQSSDRSVEIAEQYGATVVQFHFDGRWPKKKNWSLENLPFRHEWVLIVDCDERIPPELWEEIEAAIQNADYDGYYLNRKVFFLGTWIRHGGRYPDWNLRLFKHKKGRYENLKTEGIRNTGDNEVHEHVILSGVSGYLKNDMLHIDFRDIYHWLERHNRYSNWEARVYLNLLNSKDESGTIGASLLGDAVQRKRFLKKLWVRLPFKPTLRFVLFYIIQLGFLDGKAGYIYGRLLSQYEYQIGVKVYELQKFKGQLNISQTSSVMPTPSIEG

SEQ ID NO: 953 - protein, 245 aa, Unknown
  Description of Unknown: Microgenomates group bacterium GW2011_GWA2_47_8 sequence
MKLSAVVLTHNSAAVIGDCLQSLRFADEIIVIDSGSTDNTLALASTARIYKRKLVSFAAQRNFALGQAKYPWVLMIDSDERVSAALAKEIRAVIQIGSFSAYRMKRLNYFFGRVMKHGGYWPDWQTRLFRVKDFLKYAGTVHESPHFNGPLGSLKTHLIHFSHNNISECLEKSIVWTKKEAEQFIKAGHPPVTWWRIIKVMVWEFCYRYFKKMGFLDGYVGLVESLLQAMNRFFVYQQVWEMQQS

SEQ ID NO: 954 - protein, 245 aa, Aureitalea sp.
MQSLSVIVPTFNEEAYIVDALRSVAFADEIILIDSYSTDNTVALAKPYITKLLQREFDNFSAQKNYALEHVSSDWVLFLDADERVTHSLEDEIKRTISHPKHGGYKINFPHFYMNRFLYHHSDDVLRLVKRAGAHFTGTVHEKLQCEGRIGKLKNHMLHYTYKGLEAYIEKKETYAWFQAEQLYKKGKKASWFHLWIKPSYRFFRSYILKGGFRDGIPGLTVAAVNAYGVFQRYVKLRLLHKGMR

SEQ ID NO: 955 - protein, 289 aa, Nibricoccus aquaticus
MTTTAKVPVSILIPIKNEASNLPRCLAALAWADEIFVVDSHSTDGSQAICEKTGAKVVQFDFNGIWPKKKNWALENLPFKHEWVFIVDADEVLPPETGPEFAALIAADGHGKNGYWINRRFMFMGQWLKHAYYPNWNLRLFKHKLGRYERLVAGATGSGDNEVHEHIVVQGETGRLKSEMDHYAFPSIDVFVEKHNRYSNWEAALDTQEGAHAAQHLQMGGTKFKRKLKQFVRRLPFRPTLRFVYVYFFQLGILDGRAGYYFAKLHGFYEFLSVAKAQELRRRKKSATS

SEQ ID NO: 956 - protein, 322 aa, Mesorhizobium sp.
MKSSRRAHRVRLVARGEGINPSALRAQRRTEDIVMRKMPPAKIEITVVIPVKNEEKNLENCLAALGRFTEIVVVDSGSTDRTRDIAQAAGARTIDFNWNGRYPKKRNWVLSSQTLVNEWVLFLDADEVVNDRFCDEVAAAINSGHHVGFWLNYTNYFIGRRLRYGVPQRKLALFKIGLGFYERIEEESWSSLDMEVHEHPVVDGSVGEIVAKIDHRDFRGVDKFLLRHIDYAMWEARRYLKLRAESDSRSSQLTFRQRFKYRNLERPWYSTFYFCFAFFFRAGFLDGGAGYAYAFYKAWYFYTVRLMILELRGRETSFLTRS

SEQ ID NO: 957 - protein, 277 aa, Unknown
  Description of Unknown: Candidatus Contendobacter odensis Run_B_J11 sequence
MIDRTQLSVFITTYNNGRTLMACLESVKWADEIVIVDSFSTDDTLAIGQRYGTQITQHEFMGYGPQKRMALAATTHDWVLLLDADEALSPDLQTEIRRLLEHKPTADGYEIPRQEQMFWRMYNPATRMNHYLRLFDKREGDIDDRPIHAAPKVQGRIARLKAPLYHYGETDIHTKVEKINAYSTGLVADKLKKQRWGIPLIMLFYPPLFFIRSYLFKRNFMNGWAGLINSVIAAFYVFLKYAKLYEHHQFAKHGTRLLPDDAPPLPSEYQSESADKP

SEQ ID NO: 958 - protein, 262 aa, Desulfonauticus sp.
MSVKATGLVLTFNGEKYLEKCLQSLSFCQEILVVDSESTDATREIAQSLGARVLVNPWPGPGKQFEYAFKHIKTQWVVSLDQDEILSPELQKEIIAHLQNPRDYVGFYCPRRSFYFDRFLKHSGWYPDYLLRVFSLPQTNLHISEPHYGFKPQGKTKKLKGDIIHFPYTNLSEHLNKINYYTQEAAKDLASKGVSSGLFKALGHGLARFLKIYLFKQGFRDGQAGFILALNSFFYGFLKYIKILEIKEKNLKKNIDNSQANI

SEQ ID NO: 959 - protein, 268 aa, Unknown
  Description of Unknown: Microgenomates group bacterium GW2011_GWC1_44_10 sequence
MKLSVIILTRNVEDEIIPAIKSSQFADEIIAVDTGSTDATLDICRKNGVKIVYTTTNSFSKWRNDGAKAAKGDWLLYLDSDERIPVKLAQEILATIDHPKHSGYTISRYEVFLGKHLNHWGDSRVLRFMKRSSLKCWEGKLHEQPKIDGTVGDLRQQMVHLSHKNIDEKLPNTLLWSKTEAIMLLNAGHPPMVGWRFVRIMFTEFWNRCLKQGLWKDGTEGWIEIIYQMFSKFVTYERLWEMQRQPSLKETYKDIDKQILSEWEKQAK

SEQ ID NO: 960 - protein, 314 aa, Chlorogloeopsis fritschii
MSLSKIPVSVLIPAKNEEANLPACLASLERADEIFVVDSQSSDQSIEISQRCGAKVVQFNFNGQWPKKKNWSLENLPFQNEWVLIVDCDERITTELWEEIAQAIQNPEHDGYYLNRRVFFLGKWIRHGGKYPDWNLRLFKHKQGRYENLNTEDIPNTGDNEVHEHVVLEGKVGYLKNDMIHEDFRDLYHWLARHNRYSNWEARVYLNLLTNQGNNDTIGASLFGDAVQRKRFLKKIWVRLPFKPFLRFVLFYIIQRGFLDGRAGYIYARLLSQYEYQIGVKLYELRHCGGKLNTKSTPVTTSPSLSQVVKQTVI

SEQ ID NO: 961 - protein, 261 aa, Unknown
  Description of Unknown: Alcaligenaceae bacterium 429 sequence
MAEDIYAHITPVIIVKNGAAHVRRTIGALKPFRQVVVYDNGSTDDTLSLLSEYPNVKVVQGSFMGFGPTKNAAASHAETDWILSLDIDEQVNQKLLDALADWPLEEESKVGEVLRNNYFCGKHIRTNGWGKDWLCRLYNRRQHRFTDSQVHEKVKLDGRSQVVRLKGGLEHEAVTDVGQLLVKTQYYSELYANSERARLYAFPVVVFKAAFRFFRSYFLQLGILSGSRGMMIAVGEATGVFFRYSKVYQRKKFTQKSDKNT

SEQ ID NO: 962 - protein, 251 aa, Flavivirga eckloniae
MIKVSGVIITYNEEEHLEKCLKSLVDVVDEIVVVDSFSTDRTLEICEAFNVVLIQNKFEGYIEQKNYALSRAKYDYILSLDGDEALSDTLKESILKAKENWEFDGYYCNRLNNYCGQWIKHSDWYPDKKLRLFKKGNGEWKGINPHDRYTLKKGLKAGKLKGDLLHWIYRDYDEHNIKVQNFSSIAAQAYFDLGKKSSLWKIIFNPSWAFFKAYFLRRGFLDGLNGFIICVQTFNVTFLKYIKLYRLHKNK

SEQ ID NO: 963 - protein, 313 aa, Calothrix sp.
MSSKIPVSVIIPAKNEEANLPACLASVQRADEVFVVDSQSTDQSAEIVKNYGANLVQFHFNGRWPKKKNWSLENLPFRNEWILIVDCDERITPELWDEIAEAIQNSENEGYYLNRRVFFLGKWIRHGGKYPDWNLRLFKHKLGRYENLNTEDIRNTGDNEVHEHVILPGKVGYLKNDMLHEDFRDLFHWLERHNRYSNWEARVYYNILTGQDNNATIGASLFGDAVQRKRFLKKIWVRLPFKPFLRFVLFYIIQRGFLDGKAGYTYGRLLSQYEYQIGVKLYELRSCNGQLNTAKNTEKTQQKFNQEARQTAV

SEQ ID NO: 964 - protein, 549 aa, Unknown
  Description of Unknown: Gammaproteobacteria bacterium sequence
MSTGKKHHRPYRLSVVMIVKNEAENLSISLPAVANWADEIVILDSGSSDESQAVAKQYGAKWHVNANWPGFGKQRQIAQSYASGDWILALDADEEVSDTLKQSILSVIDQTPGNVIYGIKRLDCIFGHQIDCPFWPVKAHWRLYPRQFQYNDNKVHESVDLKNAQTRSLKGFLHHHTAPDPHFWLSKRLEYAKTWAKERAEKGKKTNVLTIVFKTFWALIKQYVIDGRFIQGKYGFIYACLFTQYTFNKYALLYDMGRQPQTYSPDFEPHSINRHNLFNRPLPEKITGKKHSISVVMIVKDEQKHLPACLYNIYDIVDEIVILDSGSTDSTRSIAKYFNAKWHVNNDWLGFGKQRQIAQRFASGDYILMLDPDELLNETLKASILAIANTENMEKAAYSIRYANIFCGQAAHGNAWYFDQIVRFYPNRYFEYHDYEVHESLNYGSATVHNLKGYIEHFTNDNLYHFLFKNVRYSHDWAKEKYEKGGKSSSVISLPFRTFFSFFREFVIRGAFLGGAYGFFLAVSASGYNFNKYLMLFEKKSCDKNKKDK

SEQ ID NO: 965 - protein, 252 aa, Arcobacter sp.
MNISVVVLAKNNENTIERTLKSLLEFDDVVVYDNGSTDKTMEIAKSFSNVNLVQGEFKGFGWTKNKASSFALNDWILVIDSDEVVDNELLNELKNKNLDEKTVYRLNFKAFYKDIQVQYCGWNNQKIKRLYNKKTTSYNSNDVHEDIITDNLKMGELKGNVEHYSYHTISQFIIKADRYSTLFAQNNVGKKSSSLPKAFFNGLYSFIKTYIFKQGFRDGYIGLIIAFSHMVTNFYKYIKLYELNLEEKKSKK

SEQ ID NO: 966 - protein, 248 aa, Unknown
  Description of Unknown: Candidatus Collierbacteria bacterium CG_4_9_14_3_um_filter_43_ 16 sequence
MKISVVVLSKKSELNHFLLESLSFVDEILLIIDSSSVIPGSDPESISTTSRLKIFYRPLNNDFSAQRNFALQKAKGDWVLFVDDDEYIGSELRKEIIEVIDHAQFSGFLLKRQDVVYHLPLRHGETGNIKIIRLGRRHSGRFNRQVHENWDIEGRVGELKSPLYHNKDHFISEFISRVDQYGRIDSKLLVLEGKPFSWFRLLVYPMAKFKLNYYFRVGFLDGLVGLFLAYLMAVQSLSIRVFQWENKN

SEQ ID NO: 967 - protein, 270 aa, Zobellia uliginosa
MNGPNEKISALIITYNEIGYIEKCIESMVFADEIVVVDSYSTDGTFEYLENHPKVKVIQRPFENFTDQKSFALRQASNDWVLFLDADEVLTPKLQNEIQHTINSGTKKNAFWFYRTFMFKDEKVFFSGCQTDKNYRLFRKSKVAFAKDKIVHETLNVIGESGTLKTKLIHYSYKDYSDFKGKILKYGRMKAIESLRKGRRFSYGKLVIKPIWKFFNYYIIRLGLLDGFKGLVLSYIHARGVVEHYKALKALETETRTSTAPIKTILERAA

SEQ ID NO: 968 - protein, 253 aa, Unknown
  Description of Unknown: Candidatus Gottesmanbacteria bacterium GW2011_GWB1_43_11 sequence
MSEPTSITAVVLTKDEVDNITRCLKSLLWCEEIILVDDSKDKTLELARTIVSDKKLRIIKQSSTSDFAALRNMALKQARHVWVLFVDADEEVTPGLAREIKEAICDEGENGYFLKRRDHFLGRWLKFGETAEVRLLKLGRKDAGKWVRRVHEKWEITNPTGELVSPLLHYPHPTVAEFIARINRWTTLDAQEFYDQGVRSNWAKILIFPLGKFLRNYFIKLGFLDGLPGLIMAINMSFHSFLTRAKLYLLQTS

SEQ ID NO: 969 - protein, 251 aa, Unknown
  Description of Unknown: Flavobacteriales bacterium CG_4_9_14_0_2_um_filter_32_27 sequence
MQLSVVIITYNEQRNIARCLDSVLPVADEIIVVDSFSTDDTEKICSQYNVKFLQHPFKGHIEQKNYALAQAQFDYVLSLDADEALSETLLQEIKNIKTHCEKDAYSFNRLTNFCGQWIKHCGWYPDKKTRLWNKNKGNWGGANPHDKVMMQQNATTQHINADILHYSFNSIDEHLKQIAYFTDISSKAAFEKGKRSTNFKIAYKTGFKFLRDYLLKLGFLDGKYGFIICKNSAYAKFLKYSKLKKLHQNNF

SEQ ID NO: 970 - protein, 260 aa, Unknown
  Description of Unknown: Alphaproteobacteria bacterium sequence
MSSPPPPDPATGPKLSALITVHNEEAQLGECLDTLRFADEIVVVLDKCTDGSKEIAADYTTHLFEGSWEIEGERRNYGIGHCSGEWILEVDADERVPEALAREIRETIKDAAGGYFLIPFDNYIGKRLVRFGWGAYWGVSATVRLFSKGAKSWGGQRIHPSLELTGTRGRLETPMIHYVDRNISDMIARLDRYSTARARDLRDQGDIGSFSANLRRIFSRFFKCFIIRKGYREGIYGFLIALFAGLYPIVSYLKARIEEE

SEQ ID NO: 971 - protein, 366 aa, Brevibacillus parabrevis
MTPPLISLCMIVKDEADQIEACLGSVHSVVDEIIVVDTGSTDGTQELCRKYGAKVIEAPWENSFSKARNIGLKEARGEWVLWLDADERLEEADQEALRQAAIASKSDVLFLKLLHYQGPKKETASLHLASRNAQIRLFRNKKGFQFARDIHEVLQWPETVPQDGAIPLIPVRLHHYGYIEEVVTKKNKARRNLKLLLEERENPDRDPWCDYHLASEFYRAQKWEHAFILVNQALEGFLGKSQLPPSLFYKLKYEILFRHGSMRGAWPGIECAIRLYPDYVDLHFYKGVFLMEHGLYAEAIQSFERCLEIGEEHWEHLSQQGMGSFHALHYLGRCMERLGKSKEAHVYDQTSANMVRTCAHTPSTKG

SEQ ID NO: 972 - protein, 297 aa, Unknown
  Description of Unknown: Candidatus Pacebacteria bacterium CG10_big_fil_rev_8_21_14_0_10 _44_54 sequence
MKLSIVVTTKNAARTLERTLKSVRFADEIVVVDMMSSDETQLIARRFTDKVFTTADVGYVEPARNFSLSKAKGEWVLVVDADEVVSATLRDQILQVIELDSNVVCYAIARKNILFGKWVQTAGWWPDFQPRLFQRGCVEWSDAIHSKPKVTGESVHFPADEALAFEHYNYESISEFVSRMDLYTTIAAQNKVGRDTIVEGPVDVFRREMLQRLFPLRGIDGGYRGLLLAFLQGFSEVVQAAKFWQLQRSEEIETKPETLLALAELRAQLAYWIADEQMRNSNGIAALTWRFRRKLRL

SEQ ID NO: 973 - protein, 264 aa, Unknown
  Description of Unknown: Flavobacterium gilvum sequence
MTNSNAYKLSVLIITLNEEKHLKALLSDLDFADEIVIVDSFSTDKTENIAKSFHKVSFIQHKFENFSDQRNFAINQSKNDWILFLDADEVLTPELKQEIIETLQNNQTYSAYFFERIFMFEDSVLKYSGNQTDKIIRLFNKNLARYDEKKLVHEKLIVNGKIAFLKNKLIHYTYLSYQDYREKIIFYGKLKALEKFSEKTKPTVLHQLFHPVYNFLYNYFIRLGFLDGKKGVIICYLNAYSIVIRYQELKKLWNQNRRLISSKT

SEQ ID NO: 974 - protein, 574 aa, Hyphomonas sp.
MLDVLIITQNEEANIGRCLEALTGWTRRIFVIDSGSTDGTRGIVESHGAEFVHHDWAGYAAQKNWALDTLPFEADWTLIIDADEIVTPELRVEIMEVLDRNVDEVEETAFYLNRLFYFLDDPIRHCGYFPSWNLRLFKRGKARYEDRAVHEHMVVDGKTAYLEEPMIHDDRRGIEHSIAKHNSYSSLEAQEILRGREAAGPPASGLASSFFGNALQRRRWFKQRIYHLLPAPWLFRFLYMYVWRRGFMDGSTGRRFSLFISAYEFLISLKIKELRIDRAQRMPEPMTEGSPRGDLPVTVVVPVLNEEKNLPICLSRLGRFSKVVVVDSGSTDRTVEIAQEHGAEVVDFRWNGQFPKKRNWVLRNHEFDTPWILFLDADEYVTDDFCDELASTLATSPHDGMWLSYHNYFMGRYLRHGAAFTKLALIRTGSGEYERIDEERWSHLDMEVHEHPVLAGTTGRIGATIDHDDYKGLKSYIRKHNEYSSWEAKRYMKLVEGGGPGQSYFTRRQRWKYGAIRRWWLAPGYFFASYLFRFGILDGYPGFAFALLKWIYFFQIRLKIIELERAEHRGDAVA

SEQ ID NO: 975 - protein, 273 aa, Niastella koreensis
MRPMYFTETIEKPAPRNVIIRKAEPKNCPVFKVSAVIITYNEEKMIERTLAQLQWCDEIIVVDSYSTDRTAEICSSKGCKVLFRQFDGYGAQKQFAVSQAKNDWVLCVDADEVLTDELVKEITSLTEADKQYSGFAFRMNLVFLGKEFLYGKESGRYFLRLFNRQKGGITADKVHEGIHLEGPVKKLKHIVKHYSYTSIYQYLEKFNRYTRYAAEMGKRKGKHKSTFIILLAVPFNFTKYYLLERNCLNGLKGFYWSVFSTFYHFVKYAKINE

SEQ ID NO: 976 - protein, 249 aa, Sulfurimonas denitrificans
MLIENISCVIIVKNAASTLGSTLDSLADFRDVVLYDNGSTDETIEIAKKYKNVTLVIGEFLGFGPTKNLACSYAKNEWVFSLDADEVLSDEFIKNISNLELNDRNIYTILRENYYKSTQVKHCWGNDIIVRLFNRSKTSFSEEKVHEKVIEEGFKTILISGAVKHYPYNTITDFILKLDRYSTIFAQDNVGKKKSSPSKAFFNAAFSFFKTYFLKKGFLDGYAGLVIAFSHMATNFYKYIKLYELNKKL

SEQ ID NO: 977 - protein, 255 aa, Unknown
  Description of Unknown: Methylococcaceae bacterium NSP1- 2 sequence
MKSVLTLSVIIITKNESTHIGGCLQSVAWADEIIVLDSGSSDDTVNICRTYTNKVYSTDWQGFGIQKQRALDRATGDWVLSIDADEIVTAELKAEIMQAMQTNDINGFEIPRLSNYCGRQMRHGGWFPDYVLRLFRRECGQFTNHVVHERIIVTGKIARLNTPFLHDAFVDFEEVLHKVNHYSSLGATVLYEKGVRSSLPKAIVKGLWTFIRTYFLKAAFLDGQQGLMLAISNAEGAYYKYVKLWALQHLKTTQK

SEQ ID NO: 978 - protein, 250 aa, Arcobacter ellisii
MIKASVYIICKNEEKHIKRVLESVKDFDEIVVVDSGSTDNTLNIAKEYTNKIFHQDWLGFAKQKEYAKSLCQNEWVLNLDADEQLTEELKKEIEKVIEENKIDGLDIKISSQFLGKFNSEKSKFNRRIRFFRKSVGHYPDKLVHESILVKGKINKANGFIYDYGTMDLKTHLSKINEYSSLRADEKFAKNKKASFAKLLFVFPLSFFKSFIIKRGFLNGMRGFIAAMNNSFYAFLKEAKLYELNNKSEEK

SEQ ID NO: 979 - protein, 250 aa, Unknown
  Description of Unknown: Gammaproteobacteria bacterium sequence
MPQLSVIIITKNVATHIEACLSSVAYADEIIVVDCGSTDNTVALCRPFTDNVFITDDWPGFGQQKNRALAKATGDWVLSIDADERVIAALQQEMKQIIADTPYTVFRMPRQSQYCGRWIKHSGWSPDYVTRLFRRDSARFSDDLVHEKVLMLHGNMGTLKTPLLHYSFNSLEEVLDKVNRYSSANALRHYQQGKKSSLKKAIFHGLWTFIRTYFLQAGFLDGREGFMLAVSNAEGTYYRYLKLIYRCSEK

SEQ ID NO: 980 - protein, 272 aa, Unknown
  Description of Unknown: uncultured bacterium sequence
MGKVSGDIENKNNKEPFRYIHYGKMSKGMISAVILTHNDEKTIEKTLESVRFCDEVVVIDDDSKDKTVEIAKKFTSKIFTHEVKDDFAAQRNFGLSKAKGEWVFYIDSDEVVSDKLAKEIKKSIKIGDGYYLKRNDFVFGRFLKHGETSRVRLLRLGRKGTGIWQRPVHETWNITGAVGTLSEPLLHFPHPNVAQFIEEINTYSTINAHFLFNQKIQCPWWHIIAYPKAKFFLNYFWYLGFMDGTAGAVSAIMMSMHSFLTRAKLYLLWHKK

SEQ ID NO: 981 - protein, 276 aa, Unknown
  Description of Unknown: Epsilonproteobacteria bacterium sequence
MKKKQSLLLLKHRKNIKIKRILKRGSKEKKLSIKQMSVVMMAKNAEDTIAQSLDSLSAFDEVLLYLNHSTDATKTIVQNYANVKIVEGEFLGFGKTKNVAASHSKHDWILSLDSDEILNEKLIAEISQQDFSDITKLYQLKRDNYFLGHKTQSADLIVRIYNKNHTGFNDNNVHEKIIVPKLSQVMTLKHSFVHLNITNINQTLTKIIQYTDLGAENKKTCFFSVLIFKSMFAFFKTYILQGNIIRGWVGFALAVNSANKRYYKYMKQFINCQEKE

SEQ ID NO: 982 - protein, 256 aa, Unknown
  Description of Unknown: Flavobacterium sp. ov086 sequence
MILPEKQLLTALVITYNEEQNIKTVLDHLAFADEIIVVDSFSTDKTFEIATSFKNVKVVQHAFDNFAAQRNYALSLASNSWILFLDADERLTPELQKEISFIINQKNSASAYFMRRNFMFENKKLRFSGWQTDKIIRLFKREKASYNINKIVHEKLIVNGKIGKLKSKLIHHSYSNYEDYKQKMVFYGQLKAQEEILKETSPNYFHFYIRPAYQFLNQYLVRLGFLDGKKGIIICYLNALSVAVRFQELKKIKAKN

SEQ ID NO: 983 - protein, 260 aa, Unknown
  Description of Unknown: Candidatus Enterovibrio luxaltus sequence
MNQSKQRASISAIIITKNEEQILPKCLASLDWFDEIIVVDSGSTDNTIVIAEQAGANVYVSTKWAGFGKQKQLAQHYATKEWILAIDADEVISESLKNSILEVLAAPPERTIFSLWRTTWVFGRFLKYSGWYDKIIRFYPRKFTGYNDAVVHEKIIEPKGSQKQILDGDMLHYPYRDLHQYLEKSAFYAKSWADVCHAQGKKSSIIQGIIHATSCFLKMYILKCGFLDGKEGFLIAVLSAHSTFVKYADLWIRKNDRLAN

SEQ ID NO: 984 - protein, 254 aa, Unknown
  Description of Unknown: Candidatus Microgenomates bacterium sequence
MSQMKLSVVTIVKNEEKIIEKFLDQLNWVDEIVIVDNGSIDNTVTLAKKYTSNVYTFSQKHFGKLKQFALSKATGDWTLVLDADEFISKNLENEIRNVLKLKSKYIGYQILRVGYFLNHRLYARGFREYKVRLCKQGSGVITQVPIHEELIVRGKIGRLDGEIRHYSYRSLHQTIVKLTSYACSESTLSSSEKIRVGIKNFTLYPLHMFWTIFVDDKGYKDGIWGIGLALCFAYYEFARYYFLLKHKFLSNPTQ

SEQ ID NO: 985 - protein, 259 aa, Prevotella amnii
MKAMPQENKISVVINTYNAEKYLREVLESVKCFDEIVICDMESKDNTLAIAKEYNCKIVTFPKANHLSAEPARTFAIQSASYKWVLVVDADELVTTELRTYLYNIIKQEACPKGLYIARRNRDMNVLDKGRLRDFQLRFFIRKGTIWPPYVHTFPQVQGRIGKLTDSNGAVLIHLDENYLHERIEKINRYSDGEIDKRISKQYGLGALLWRPIWRFFKAYIMDQQYKKGLPGFISSCLSGFYQFLIVAKSIEKRKYKKT

SEQ ID NO: 986 - protein, 247 aa, Smithella sp.
MKLSIIIITKNEEKNIRKCLDSVTWADEIVVLDSGSTDDTIAICKQYTDKVYETDWIGFGHQKNRALKYASGNWILSLDADEWITPELKAEILMTIQNPGNYVAFDMPRLSSCCGQYIHHSGWWPDYITRLCRRDKARFSEQIVHERMIVDGCVGRLSNHIMHASYKDLGHVLTKLNRYSTDGADLLLAEGAKSSLLKAISHGLWSFIYTYIVRIGFLDGRMGFILAVYNAECTYYKYLKLMMLNKK

SEQ ID NO: 987 - protein, 282 aa, Robiginitalea myxolifaciens
MKDSRKDTGLSVLMITYNEISNIARCLNAVDFATEIIVVDSGSTDGTYEYLLNRPGVRVIRKPFRNFTEQKNFALDQARQPWVLFVDADEEVSPELAREIREVIARNDQSVSAYWFYRKFMFKNIPLQFSGWQTDKNIRLFRKDCARYSTNRLVHEKLDIKGKTAALKNQLLHYCYRDFASYKQKMVLYGRLKAQEVLEGKRRPKMALLLLKPIWKFCYNYLFRLGILDGMRGVTICYLDAYGYLVQFRMLRGARARKTSTSTTVRRPLPASQVPYPLPKAS

SEQ ID NO: 988 - protein, 270 aa, Unknown
  Description of Unknown: Desulfobulbaceae bacterium sequence
MKKLSVFITTLNNAKTLPCCLESVKWADEIVVLDTFSSDGTVAIAEKYGAKLFQHEFLGYGRQKQSALEKTTNDWVLLLDADETLSDQLQDEIKQILSTEPTYDGFELPRQEQLFWRMSSRFTRFNYQLRFFRKSVGALSTDAVHAAPKVSGRVGKLQHPFLHFGEINIHTKVEKINAYSSGMVEDKAKKGKQGSLLTLILYPPIAFIQSYLFKRNIVNGSAGFIASVTMAYYAFLKYAKLREYHKFQKYGNSLLPDNAPDFLSEPEVPK

SEQ ID NO: 989 - protein, 255 aa, Unknown
  Description of Unknown: Desulfobacteraceae bacterium sequence
MTISVCIICFNEEPSIKRCLESVAWADEIVVVDSMSRDRTLDIARQFTRSVHQRKWTGYADQKNYALSLASGEWVLSLDADEEATVELSREIIDIANSKEALEGYLIPRRSFYQGRWIKHSGFYPDRQLRFFRRNKALWTGKRVHEKVHVEGRVGFMKGEILHYPYGGILEGQLATVNSFSTLMALDLHEQGKRFHLILLLLRPFFKFLEVYFLRLGLLDGIPGLIISVTSAYAMFARYVKLRELEQGLAKRSSL

SEQ ID NO: 990 - protein, 249 aa, Unknown
  Description of Unknown: Candidatus Omnitrophica bacterium CG11_big_fil_rev_8_21_14_0_20 _41_12 sequence
MAKLSVVVLAKNEESCIAACLESVKWADEIIVVDDESTDKTMEIVKQYNAKVFHRKMDIEGKHRNWAYAQAANTWVLSLDADETVTPELKVEIEKAIESNEFVAYDIPLRNFISNYWVKYGGWYPASKVRLFKKDKFKYEEAEVHPRAFADGACGHLKSDIIHRGYPDLEHFLNSVNRQSTLEAVKWINTGRKMTLLWATWRTVDRFFRRYFGKKAYKDGMYGFVIAYFDSLYQILSYVKFREMKNKKL

SEQ ID NO: 991 - protein, 253 aa, Neisseria meningitidis
MKKVSVLIVAKNEANHIQECIESCRFDKEVIVIDDYSTDNTAEIAEGLGAKVFRRHLNGDFGAQKTFAIEQAGGEWVFLIDADERCTPELSDEISKIVQTGDYAAYFVERRNLFPNHPATHGAMRPDSVCRLMPKKDSSVQGKVHETVQNPLPQTPSEAFYVPLHVRQLGTIFQQVQQIYFHFSRKIPRAGKSPCVSLGTLSSARFGGFSKFISLNKGFLDGKMGWIMSVNHSYYTMIKYVRLYYLYKSGGKF

SEQ ID NO: 992 - protein, 235 aa, Campylobacter corcagiensis
MNKLSIVILTLNSQKYLKEVLESAKFADEILIIDSGSTDKTKEFCYKFNTKFIYQPWLGFGKQKRFGVNLAQNEWVFVLDSDEIITQKLKDEILKTIKNPKFMAYKVARLNFFFGKAIKKMGLYPDYSVRLFNKNFANFNQRDVHESVVFFDENMAFGTLKNHFIHKAYENIDEFIAKQNRYSTLGAKKNVLKAIFSPCWTFFKLYILKGGFMEGWHGFVISKLYSQYTFWKYIK

SEQ ID NO: 993 - protein, 257 aa, Unknown
  Description of Unknown: Rhizobiales bacterium sequence
  MOD_RES (15)..(15): Any amino acid
  MOD_RES (23)..(23): Any amino acid
MNEEAYIVNCIESLXCCSEIVIXDSGSTDATVKTIKKYQKDGWPIKFLHNDWPGYAAQKQFALDQCTQEWCFNIDADERLDEALKAALPALLNTDKDMVGWRIARRPYLIGYGYTPQWATERKNLRLIKKDKGFYDLSLKVHEGITPNGKVGSSKKGSLLHFRPLPIAEQILKENKYSSLKTEMRIEKGKKPNLLKLLFNPPLYFVRLYLKTGLWKCGVPGFTQAMYGAIYSFMTEAKMFEASALKHMPPKDDLDRK

SEQ ID NO: 994 - protein, 255 aa, Mitsuokella sp.
MRLAVIILTKNEEHNIEGAVKSASFADEVVVLDSGSTDRTREFAERLGARFVVHLMGEDGFAGQRNAALDETDADWVFYLDADERITDEAAKEMMRCVKANEWFAYRIKRMNILFGQVMRHGSHAPDYVMRLFPRTMVRWKGVVHESAITELPVRALKGVLCHYTYTDWDRYFVKFNQYTTLMAKKMEEGGKRASFLDILLHPSFAFFQSYILKLGFLDGKQGFIFALNHFFYTMIKYVKLYYATTRVREDRKGC

SEQ ID NO: 995 - protein, 249 aa, Sulfurovum sp.
MNISAVVLAKNNEKTIGNTLQSLTDFSDVVVYDNGSVDETINIAKSFPNVNLIEGEFRGFGWSKNKAASYAKNDWILIIDSDEVVDGELLEVLKNKVLEKNCVYKLNFKAFYKDIQVKHCGWNNQKIKRLYNKTVTSYNSNDVHEDIITDGLTMEVLAGNVEHYSYHSISEFIIKADRYSTLFAKNNAGKKKSSPSKAFFNGIYSFIRTYIFKQGFRDGYVGLIIAYSHMVTNFYKYIKLYEANKELTQ

SEQ ID NO: 996 - protein, 585 aa, Thermoanaerosceptrum fracticalcis
MNNTITLTMIVRNEAANIENCLNSVYKQVDEIVIVDTGSTDNTVEIARSFTDKIYFYPWQGDFSAARNFALDKAKGEWIIYLDADEELLCASDELKSLVSRDKATEAYLLPLNNPTTDFTGVYNRFFVLRLFKNNGSYRFKGKIHEQVIVPPKNAVGIAESPVINHKLLPAKERNRKRGRNLALLKQALAEDPHNNFLQYYLGVEWLMLGKPAQALSYFKSAYNNLTDEYLLFRGPALRYLLVCLQSLGRLDEAICLCLEADLKYPEYTDIYYLAGHLFEEKEEYELAIKWFTQAVKCGTPPPLFSHLAGTESFLAYYHLGFCLEKLGETEKAVDYYVMALKANEKYIYPIYNLFVLLLTKYGAHRTLAYFQEHKYLNNVELALAVAHLFFQAGFRALAIECLESCNIRGNKDEEVKFYLGKYSIFSGRLLSGLQNLSEISPTSPFYTQAQLQRTIAFLLGGSFPEARILALELWKNHQTRCHGYVLLNLIRFLERDEMITPPQKIRGMDVLKPVLELLNESSCCLPDPRLRQCLHYWKLRQGLEIFLKNISPEGYLRLVEHYQDKSSDLHNLVEYKFGCGGTKV

SEQ ID NO: 997 - protein, 255 aa, Methylomusa anaerophila
MTLTVLILAKNEEKNIRECIESAKFADEIIVIDDFSTDDTKAIAESLGAKVYQRAMNGDWGAQQTYAIQLARTEWIFFLDADERIPPALAVEIRNAVKLNEKYTYKVSRLNHIMGQALRHGGWYPDFGIHLLPREGSYVEGFVHPRIHHNYPEKQLKNHMLHYPYTSWEHYFNKLNLYTRLAAEKNRKNGKKANFFFDIMIRPHVAFFKMYILKAGWRDGKVGFILASFHYCYTMAKYVKLYYLQKTNKDNYSPL

SEQ ID NO: 998 - protein, 249 aa, Unknown
  Description of Unknown: bacterium BMS3Bbin11 sequence
MNTHLSAIIITYNAARQLVDCLNSLSFVSEILILDSGSDDETRNIAQQYNARFIHQDWLGYGPQKQKAVELAEHDWVLCLDADECISEELAVSIQSVMESPQFQAYQFPRCNRFMGRWLRHGEGYPDISLRLFNRQHALWSNDAVHEFVQTDVSTGTLKGDLLHDSAASLASYLEKQNQYTSLQAEKMYQAGKTAGVGKILLNPLFRFFKFYLFRLGFLDGVPGLVHICIGCQNTFIKYAKLITLQRTQ

SEQ ID NO: 999 - protein, 262 aa, Selenomonas sp.
MKLAVIVLTHNEEQHIEACIRSAAFADEILVIDDMSTDRTAELAQSLGARVVTHPLAGDFAGQRNFALSQTDADWVLYVDADERVNEGTEAELRRIMAADARAVYEIKRINIVFGQRMYYGGHHPDYIRRFFPRDAAHWTGLVHERTASELPVRRMGGSFLHYTYESWEQYLRKFNLYTTLMAERRYTEGQHTSFLKILFDPPFAFFRFYVIQRGFLDGRLGFIMAMCHGFYTMIKYVKLAVLWQMHGAESTAAGERAKNDD

SEQ ID NO: 1000 - protein, 247 aa, Selenomonas sp.
MQLAVIILTHNEEDNIGACVKSAAFADEILVIDDRSTDRTREIAEASGARVVVRPLAGDFAGQRNFARVQTDADWVLYLDADERVTEETGREMRAVMAAGTRAVYAVERVNVAFGQRMYYGGHRPDYPRRFFPRDAVRWEGLVHERVVSDLPVKRLRGSLLHYTYTDWGRYFQKFNQYTTLMAARRHAEGKRISFAKILLDPPFSFFRFYILQRGFLEGRLGFILSVFHGFYTMVKYVKLYYLQSRE

SEQ ID NO: 1001 - protein, 254 aa, Capnocytophaga sp.
MEISVVINTYNAEKHLATVLESTKDFDEVVICDMHSTDNTIAIAQKYGCKIVYCERYPYVEPARNFAIAQATHNWVLVIDADETVPEKLKNYLYQLAEKPELGGVYISFKNYFIDKFMRSAFPDFKLRFFKKEGADWSAEIHSTVKVKGEVIKLPRGRKDLASEHLANDSVATILNKNNNYSTQAAERHKGKKIGWIKLLFSPLFWFVKYYFIKKGCLDGKRGFIFAVLKAQYKFSCLAKIYEYQQTHYSGNAS

SEQ ID NO: 1002 - protein, 267 aa, Unknown
  Description of Unknown: Candidatus Shapirobacteria bacterium CG07_land_8_20_14_0_80_39 _12 sequence
MNKAKISVAMITYNEEGNIRDCLNSVRWADEIVVVDGSSQDQTREIAREMGARVIKTANKLFFDTNKNLAIKACSGDWIFLLDADERVSPELAKEINKTVQSWSPGQPEAYWLPRKNYFLGRYLRKGGQYPDPVLRLFKKGRALLPEESVHQQPSVKGKTDWLKNDLIHWATPEFSRYLMRERRYSTLEALQMGDDKVSLNLLNWLKYLIFRPKRTFFLLFIRHKGFMDGWPGFVFAFFSGFHHAWAFGKYLKMRMTKKKITMGEDW

SEQ ID NO: 1003 - protein, 249 aa, Unknown
  Description of Unknown: Flavobacterium reichenbachii sequence
MSKRKIKLSVIILTYNEELYIEDAINSVSFADEIIVLDSYSNDTTAEIARRLGAKLIYRKFDNYCRQRNFAIEAATGEWILFLDADERVSTPLEFEILNSINSNTYDAYRIWFPHFFMDRFLFHYTDKVTRLIKNNDISFENEVHEKLILKSKPGLLKNHMIHYTYRGLFNFISKKDKYAWFQAKMSFEKGKKATLFLLFFKPLYRFFHTYFVKRVYLDGVPGLAAAAIDAYGVFSRYAKIILLEKQLE

SEQ ID NO: 1004 - protein, 258 aa, Unknown
  Description of Unknown: Candidatus Shapirobacteria bacterium CG03_land_8_20_14_0_80_39 _12 sequence
MSQKISAIVLTRNEEEIIADCLESIKWVDEIVIVDNASTDDTLKITKKFKVDKIVETGDKNTFSERRNQGAKEAKNDWLLYVDSDERVTPVLRNEIEKTIEDKESGFAAYAIPRRNIRLTKELHFGGWWPDYVVRLIKKDKLKVWKGDLHEQPEIEGEIGYLKEALVHFSHRGSLENKLQNTINWSKIEAQKLYEAGHPPMTIPRFLSATWREFYFRMIKKQAFRDGTEGVIEAFYQVFSVFISYARLWELQTKKGKI

SEQ ID NO: 1005 - protein, 313 aa, Leptolyngbya sp.
MSTATKVPVSVLIPAKNEEANLPACLESVAQADEVFVVDSHSEDRSVEIAESYGAHVVQFDFNGRWPKKKNWSLDNLPFRNEWVLIVDCDERITPELWTEMAEVITADTLDGCYLNRRVYFLGKWIRHGGKYPDWNMRFFRHVKGRYENLNTEEIQNTGDNEVHEHVVIEGGNVGYLKNDMLHIDFRDLFHWLARHNRYSNWEARVYYNLLTGMGDDGTIGANLFGDSVQRKRFFKKIWVRLPFKPFLRFVLFYFIRLGFLDGYPGYIYGRLLSQYEYQIGVKLYELQFGGSLNLTDKDKTKENPKAALVGDV

SEQ ID NO: 1006 - protein, 245 aa, Unknown
  Description of Unknown: Candidatus Amesbacteria bacterium GW2011_GWA2_47_11b sequence
MLTGIVLTYNEEKNIARCLENLKFCDTVLVVDGGSTDKTVSLAKKAGATILNHEFVDFSSQRNWAISQAKTPWILFVDADEIVSVKLGEEIVSATKKIEYKGFLIPRTDYMWGKKLTHGDVGGVRLLRLARRGAGAWHGAVHEQWLIDGNVGILKHYIHHYPHPTLVEFLQEINYYSTLRAQELYTAGQHASFFQIVFYPLIKFKYLYFLKLGLLDGTVGFVHAMTMAFYSFLVRGKLWLLWRSR

SEQ ID NO: 1007 - protein, 259 aa, Unknown
  Description of Unknown: Microgenomates group bacterium GW2011_GWC1_43_11 sequence
MNNKSILLSAVVITKNEETRIAKCLESLGFCDEIIVVDNGSTDKTTDIAKRYNTSIERFTETDFSALRNFGKDKSKGIWILYVDADEIITKDLEKEIFQTIDPHPQSDNVNGYYLRRQNYYLGYKWPVQDKMQRLFVKDKLIRWKGKLHETAIIDGKMGVLTNPLIHNTHRTLEEMVAKTNEWSDFEAQLRFNAHHANIAWWRLIRVMMTGFFQSFMREGGWRMGTVGWIESLYQAFSMFITYAKLWELQRDEHVKKNT

SEQ ID NO: 1008 - protein, 245 aa, Unknown
  Description of Unknown: Flavobacterium enshiense DK69 sequence
MSTLSVIIPTYNEIDYIEDAVKSVDFANEIIVIDSFSSDGTKEKAISLGCKVLERKFDNFSNQKNHAIKEATGDWVLFIDGDERVSQKLKLEILDVMASGKHSGYKINFPHFYMNRFLYHKVDRVVRLVRNNNIHFTGDVHEKLNVPGSIGQLKNFMLHYTYKGLFHLLQKKDSYAWFQANTSVQKGKKVTYFHLFFKPLYRFFSSYILKRGFMDGVPGLALASVNAYGVFSRYAKMILIQKGLK

SEQ ID NO: 1009 - protein, 257 aa, Unknown
  Description of Unknown: Candidatus Shapirobacteria bacterium CG10_big_fil_rev_8_21_14_0 _10_38_8 sequence
MLSVVILTKNEERNIEECLESVKWADEIVLVDDCSDDKTLEIVRSEMREAGCEKIKIFSRSLDGDFARQRNFGLEKAKGDWILFVDADERVSPELRREIESVTSYKSPLVTGFYLKRLDMIWGRELKHGEAGSVKLLRLGRKEAGKWEGKVHERWEIGVKDLGELENPLVHLPHPTMTEFLEEVNFYSTLRAKELYDQGKKTNLLEIICFPLGKFFQNWIFRLGFMDGMPGFAVALLMSFHSFLVRSKLYLLWKQGK

SEQ ID NO: 1010 - protein, 257 aa, Unknown
  Description of Unknown: Flavobacterium tegetincola sequence
MELQPHEKISVLIITLNEEAHMYELLSDLEFADEVIVIDSMSTDQTKSICESFSNVRFVVNKFENYTSQRNFAIDQAKNNWILFIDADERLTPALKAEIIETVSQNQEISAYLFYRKFYFKKKVLRFSGWQTDRIFRLFKKDKCRYTHKRLVHEKLDVDGKITYFKHRLIHYSYADYESYKKKMITYGKLKAREKYQSGFKPTVFHYYGHSIYNFLYQYLIRLGILDGRKGIVICYLNALSVTARYKELERLYKENQ

SEQ ID NO: 1011 - protein, 355 aa, Unknown
  Description of Unknown: bacterium 1xD42-87 sequence
MLPVSVCMIAKNEDNHIEECLKRLRPCRFEIIVVDTGSVDRTVEIAHKYADKIFHFAWCEDFSSARNFSVQQAANDWVLIIDCDEYLENVNLAQLEDSLTGRREAVGMITRNNPYTVQGSRSIMSERIGRLFNKNYCHFEGSIHEQVRTMQGREPDTFPIPLTFYHEGYVSESDKRMRATRNLEMLLHDLALKGPSSYIYFQLGQNYISLNDMEKAAHYYKLGLDLNADPNSDFVQSMAETYGYCLMDLAKYDTAMTLRDKYDLLSHRADFVFLMGMLYQKKGEYAKAIDEFKKATTLTAYSRTGVNSYRANFHIAEIYECMGELEQAKAYYKKCRDYAPAVRRLRELSAGENAS

SEQ ID NO: 1012 - protein, 301 aa, Mesorhizobium sp.
MTREHAISLIVHTRNSEATLPRLLDSTRWAAERILIDMQSRDATIEIAQAAGCRVLNTPVVDAVDPIRNQYLGEASQEWILVLDSDEYLAADAHEALQQLIREHGANFDAFALPRFNSVAGHIMRGSGFYPDHQVRFFRKGTVAWQSGHHHLPTVLTGPLRLRRLEPPHCLHIHHENYVDVASFLERQLRYALTDDYDADPANFDFGSYVAEAYAEFARRHEPLQDGELSTAVATVLAWDRIVRGLIHWERLGRQQPLNGAFSLPIALAVPGKQTWKTVPMRNVPREISRWIRRRVSRRRH

SEQ ID NO: 1013 - protein, 257 aa, Pontibacter mucosus
MPVKLSVVVITYNEERNIARCLESVKRVADELVVVDSYSTDRTREICLSYGARFMEHPFEGHIEQKNYALTQATFQHVLSLDADEALSPELEQAVLAAKNNWQSDAYSMNRLTNYCGKWIHHSGWYPDTKVRLFDRSKAVWGGENPHDKIILSQGATLQHLRGDLLHYSYYTVTQHLGQINKFTDASSRALIRDGKTVSLPMVILKPLFRFFRAYILKRGFLDGPEGFIISVSSAESVYYKYLKLYMHNRQQKRGEV

SEQ ID NO: 1014 - protein, 252 aa, Unknown
  Description of Unknown: Candidatus Levybacteria bacterium CG10_big_fil_rev_8_21_14_0_10 _35_13 sequence
MKLSVVILSKNEEKNINNAIESASFANEILVIDDNSTDDTTTIAVKAGAKVIRRKLNNNFSSQRNYGIQEAKGDWILFLDADEIISKELQKEIGKTLNNSKNSVYYIKRRDIFWGRGLKYGELWNSYRKGFIRLVKKDSGLWKHPIHETYDYKGSFGRLDGFINHYSHNGIKDFIQKVNKYSSIRAKELNNRGNSTNIFKIFIYPIGKFKVNYLFKLGFLDGIPGFIYAFMMSFHSFLVRAKLYQYTKLSSK

SEQ ID NO: 1015 - protein, 261 aa, Pricia antarctica
MGDRKKKITAVLITFNEIFHIDGVLDNISFADEIIVVDSYSTDGTAEKVRERPHIKLIQRPFENFTDQKSFALDQASHDWVLFLDADERVTEALKDEIIETVNLEKPPANAYYFLRTFMFKDKVLHFSGWQSDKNYRLFRKSKVYFSEERIVHETLVINGKSGTLKNKLIHYSYKCYEDYKGKMIKYGQMKAFEEMDKDYSPNLYHFWFRPFYKFVNHYIFRLGILDGKKGIIICYLNALGVHARYKELARLREKNVRSEK

SEQ ID NO: 1016 - protein, 261 aa, Vibrio xiamenensis
MNKPTLAVALIVKNEQKHLQACLETVHDWVDEIVILDSGSQDQTESIARQFTDKFFTNLDWPGFGKQRQLAQSYVSSDFVLWLDADERVTPELKQSIQDAIANHTPQTVYRVNRLTTAFGKQIHHSGWSPDWVVRLFKTNETQYNDALVHESVKVPQGFNTASLSGRLKHFTYEQLHEYTRKTHQYMQAWADQREGKKSSSLLGAILHGFFRFLKMYVLKKGFMDGKHGLLLAILSANTTFTRYADLWLRDYVKKHRKDQE

SEQ ID NO: 1017 - protein, 309 aa, Anabaena cylindrica
MSSKIPVSVLIPAKNEEANLPACLTSLAVADEIFVVDSQSSDRSIEIAESYGAKVVQFNFNGSWPKKKNWSLENLPFRNEWVLIVDCDERITPESWAEIAELIQKDECNGYYINRRVFFLGKWIRHGGKYPDWNLRLFKHQKGRYENLNTEDIPNTGDNEVHEHVILEGQVGYLKHDMLHEDFRDLYHWLERHNRYSNWEARVYFNLLSGKDNANTIGANLFGDAVQRKRFLKTVWVRLPFKPLLRFILFYILQRGFLDGKAGYIYGRLLSQYEYQIGVKLYELSSCGGQLNTANISESTSSTLSQEVG

SEQ ID NO: 1018 - protein, 351 aa, Paenibacillus dauci
MIVKNESAKIQRCFDSVKLLVDEIIVVDTGSEDNTKDIALSYNAKVFDYVWNDNFAEARNFALEHSTGEWNLVLDGDEYIQRESWEEIKAFTKGPLRIGRIKQINIFEQDGELKESQALISRLLPRNIRYSGSIHEQVESQGLQRVNTNINVYHDGYFQTNKTERNVQLLKTALKSNIKDAYILYQLANEYRINTEYKKAEIYFERSYALVRPEDGFKPVLVVGYLYNIIAMKDNIEQGLTIIEKEQHHFYDYPDFYFVCGFYYMELVFSNIQKYISYFSYIEKFYLKCLEIGETNKYDSVKGTGSFRAAYNLGVYYETTGNLENAINYYQQSAALGYEVAMQRIIKLKGN

SEQ ID NO: 1019 - protein, 259 aa, Vibrio ishigakensis
MATIGILLITKNADKTLNKCLSSIQDWADEIVILDSGSTDQTLEIAKRYTQNIHVKTDWEGFGIQRQTAQSYLSADWVFAIDSDEVVTPELKESILNAVKTSDLKTCFSVNRLTWAFGKFIRHSGWYPDRIVRLYPRNHTTYNNSQVHEKVIVPNNTKIIKLNGDLLHYTIDSLTQYTSKTNLYIRSWADQREGKKRSSLGKAISHAFFRFFKMYFIKLGFLDGKHGLLLAVLSANTVFTRYADLWVREISKRNENINL

SEQ ID NO: 1020 - protein, 258 aa, Unknown
  Description of Unknown: Candidatus Omnitrophica bacterium sequence
MNKLSASIITYNEEKDIRGCLEGLSWVDEIVVLDSFSNDKTIEICKEFNKVKIYQVEWHGHIKQKNIALSKTSHEWVISLDADERLDPELKQEIVEIMRKDVSKFNGYCMPRISYYLGRWIKHSGWYPNYQLRLFRKSQAYWGGRDPHDKIILNGGCEKLKGHILHYPYKDLDEHLQKISNYTFIMAKSDYECGKKPNLLKIIFLPVLKFIDMYILKAGFLDSTPGLIAAFMGGYYVFLRHAKLLTMDVKLEDNIVAK

SEQ ID NO: 1021 - protein, 273 aa, Unknown
  Description of Unknown: Candidatus Pacebacteria bacterium GW2011_GWB1_47_8 sequence
MKVNVTAIIIARNEAAMITECLRTLSWCREVLVIDDSSTDQTAQQAENLGARVVEFSHPSFARKRNEALKHAQGDWLFYIDADERVTPTLAKEILVHIETDAAPVLRLARENFAYGHLFQHGGWQRDFVTRVFKKNALQRWTGEIHESPQFIGAVKTLRSPLLHLTHRSTEENLRKSADWTKLEAELLYKAGEKPVTFFTLLRKGGMEFFRRAIIQRGYRDGLAGLIEALAQGINRVTVYIQVWELQQKPPLSERYQKKDQELRQWWRKEKGI

SEQ ID NO: 1022 - protein, 245 aa, Aequorivita capsosiphonis
MPKLTVIIPTFNEEAYLEDALFSVSFADEIIIIDSFSTDKTPEVAKRYATKFLQRKFDNFSNQKNFALKEATGDWVLFVDADERVTHSLEAEILESIENPKHAGYVINFPHFYMNRFLYHHSDDVLRLVKREGAHFTGTVHEKLHCNGSVGKLQNKMLHFTYKGLRNYINKKESYAWFQAENLFEKNKKTTWFHLVFKPGYRFFSSYIIKGGFRDGIPGLTVAAVNAYGVFQRYVKLLLLQKGMR

SEQ ID NO: 1023 - protein, 262 aa, Unknown
  Description of Unknown: Chryseobacterium sp. G0201 sequence
MPLSLAVITYNEEDNIVRFLDSLIDTVDEIIVVDSFSTDKTKEICTQKYPQVKFFEKQFNGYGEQKNHALTLCSNEWILFLDADEVPDEDLKKSIKKIISSDSPEFNVYKTKFNNHLGIHLIKYGGWGNVCRERLFKKSCAQYSDDKVHEFLITDEKKGLLEGKLDHYTYKSIQHHITKINKYSDMMAEKMFEKGKKIKRFKIIVSPIFEFIKVFIFKLGILDGFPGFYIAKTMSYYTFLKYIKLYEKIRLIEIEKKHGKIL

SEQ ID NO: 1024 - protein, 232 aa, Unknown
  Description of Unknown: Bacteroidetes bacterium CG_4_9_14_3_um_filter_41_19 sequence
MTKLSVVIITLNEERNIARCLNSVATVADEILVVDSISTDRTKEICQQYRVRFVEHPFEGYIGQKNYATRLATHNHILSLDADEALSDTLKHSISEAKKHFDADGFTMNRYTNYCGKWIKHCGWYPDVKLRLFNRTKGLWGGINPHDRFIMEKGSTFSHLEGDLLHYSYHTESDHHRQIDRFTDIAARAYYEAGKKPSFIKQWASPLAKFMRDYYFNLGFLDGEAGLKICLL

SEQ ID NO: 1025 - protein, 258 aa, Bacteroides helcogenes
MKISIVINTYNAEKHLKEVLESVKGFDEILVCDMESTDHTIKIAQEYGCKIVTFEKKNYNIVEPARQFAIEQTSHSWVLVVDADEVVTKELRDYLYANISREDCPDGILIPRKNYFMGKFMHCYYPDHILRFFKKEKTYWPPIIHVSPEVKGTLYKIPPKRKELAFEHLANDLVSDIVRKTNDYTENEVTKKAHKHYTVFALLHRPLFRFFKGYILKQGFRDGVPGFIRACLDGYYQFVMVAKILERQHRKGITAKQR

SEQ ID NO: 1026 - protein, 253 aa, Unknown
  Description of Unknown: Syntrophorhabdaceae bacterium PtaU1.Bin034 sequence
MRIPLSVYMITYNNGATIEKALASVADWASEIVVVDSESTDGAKGIISKYTDRLYQLMTTNQAEKYGYAQSLCTFPWVLFIDADEWLTAEIKQEIARIVTEGTEYDGFMVNRKNFYLGRVIAHGGWYPDHEIRLYRREKGRWEGGIHAKVHVDGKLGRLKNYYMHTPYNDIAHQIRTVDRYSGAFADDLRASGHTFHLFNMLGRPVFRFFRDYIFKAGFLDGVPGLIIVASTMYYVFMKHARLWELERKNGKV

SEQ ID NO: 1027 - protein, 309 aa, Planktothricoides sp.
MTLTPSKVPVSVLIPGKNEEYNLPACLESLKPADEIFLVDSQSSDRSQEIAESYGAKVVQFHFNGFWPKKKNWSLENLPFRNEWVLIVDCDERIPPELWQEIAQVIQNSDCNGYYLNRKVLFLGKWIRHGGKYPDWNLRLFKHKKGRYENLGTEGVRNTGDNEVHEHVILSGQVGYLNHDMIHEDFRDIYQWLERHNRYSNWEAKVYYNVLHGEAQNESIGANFFGDAVQRKRFLKKLWVRLPFKPTLRFILFYFIQLGFLDGKAGYIYARLLSQYEYQIGVKLYELIKFGGQLNRPQLTPNNSPTDAQ

SEQ ID NO: 1028 - protein, 251 aa, Unknown
  Description of Unknown: Chryseobacterium piscium sequence
MKLSVAIITFNEERIIEKNLSAVHNLADEIIIVDSFSTDSTQEICSKFPKVKFIQQKFLGFGKQKNFAIEQCQSEWILFLDSDEIPNEELINSIRKIISEPKPEFNVYNVEFNNVFLGETLKYGGWGNIKRERFFKKGHGKYSEDIVHESFITTENKGKLKGKINHYTYKDIYHHIEKSNKYTSMMAEKMYRNGKKSNIFKILFKPMFQFFKSYFLRLGFLDGLVGYYAAATAAFYTFLKYKKLHEIYKFK

SEQ ID NO: 1029 - protein, 264 aa, Maribacter forsetii
MITKKEQLTALVITYNEIGYIEKCIESVSFADEIIVVDSFSTDGTYEYLKGNPKVKVIQNPFENFTAQKSFALKQAKNDWVLFLDADEIVSDALQNEITETVSSDTEIAAFWFYRQFMFKNEKLNFSGWQTDKNYRLFRKSKAVFSDCKIVHETLDVDGTSGILKEKLTHYCYKNYEDYKGKMLKYGRLKAIESFYKEKKFSYSMMVVKTGWKFFNHYILRLGILDGKKGFTICYLNSLGVLERYKELKRLEQKNELAYYLVMP

SEQ ID NO: 1030 - protein, 258 aa, Unknown
  Description of Unknown: Candidatus Erwinia haradaeae sequence
MSTRQKLSVVMITKNSEELLSECLESVEWADEIIILDANSNDATMTIAAKYGVKIYQSNIWSGYGKQRQMAQNYASHPMIFMIDSDERITPQLRRSIDFVLTQPPAKIVYSVSRCNLFLGRWMRHGGWYPDRVIRLYPRCFQYNNNLVHESVECFHAKIKPLYGDLLHLTNQDFCTFQWKQCTYAKAWAMQHYQQGKHYGLLNIFYRTVWAFIRTLFIRASFLDGKQGWLLAVVISQYTFNKYTALWALNYTSRHKNT

SEQ ID NO: 1031 - protein, 262 aa, Unknown
  Description of Unknown: Nitrospirae bacterium sequence
MERNRVSAVVIAYNDEPNIRACLETLTWADEIIVVDSHSSDATEKISREFTDKVYQHEFKGFGRLRNEAVAHATHEWVFSLDTDERMTLELRDEVRGVLASGPRADAYFVPRRNYFLGRWIRHSGWYPDYRQPQLFHKDRMRYREEIVHEGFDLEGKASFLKEHVVQYPFRDVDHYLQKVNRYAGLMAHRMVEQGAPFRTHQLVTHPLFTFAKMYVARLGILDGMPGLILAGLYAYYTFLKYARLWEMSVDRTLSVPGRRAL

SEQ ID NO: 1032 - protein, 455 aa, Unknown
  Description of Unknown: Lachnospiraceae bacterium MD308 sequence
MGKKAGKIKISQCMIVKNEEQDIRRALSWGKGIVSEQIVVDTGSTDNTVQIAEEMGAKVFHFEWCDDFSAAKNYAIEQASGDWIAFLDADEYFSEQDARQIPGLLKKIENASLKSGRIHLVRTALVDLNDEGEIFSVGQQDRIFRNMKGLRYKNRVHEVICFSSGQLPRCITVDLSIMHTGYRQSISAEKGNRNISLLKKSVEEDPENYDLWAYLGESYAGSDQAEEAIESMEHVIEHIAQNNASQIATSQNTTLNISEDRLLTAFAVWFSAVSFLPDTAVSSYEEQARRYYDVFLQIGKLFPDVEFYMGRFLIRIGKQDEAVKFLELALEKLEQYKGSASLRLSGRLDFVYNLLRLCYAQRGDAAKCVYYGTLSLRVNRYQEDTLTALTSLLQGDPNTAATQAYDFLAGLYKFDNLKDKLFVLKTAMKLGYSELEEVIRQNMTDEERGWLDGKR

SEQ ID NO: 1033 - protein, 279 aa, Prosthecobacter fusiformis
MMGLPVSVCIPVKNEEVNLAACLAALAEFDEVVVVDSGSKDATVRLAREAGATVLQFEWNGKFPKKRNWALQNHRFKHPWILFLDADERMNPSFVAELKDTLRNTTHVGFWITFNNWFMGVPLRHGDVFHKLSLFKVGAGEYERFEEDSWCHLDMEVHEHPVLDGTTGEMKVRLEHQDYRGLKHYLSRHNEYSSWEANRYLWLQSAGEDEWKNLTGRQRFKYQCLGRWWLAWLYWGISLWAMRGFLDGRLGFRFAELKRRYFQEIRLKIMEAKRTGKPA

SEQ ID NO: 1034 - protein, 248 aa, Parachlamydia acanthamoebae
MISVTILTKNSEKYLREVLEPLSPFDEVVIFDNGSSDQTLEIAKQFSNVSIHQGIFSGFGPTHNHASHLAKNDWILSIDSDEIVTPEMIAEIKQTPLSDTCVYSFPRHNYFNGKFIRWCGWYPDRQYRLYHRKKTSFTNAQVHEAIQTDQLTKIALQSPLIHYSYGSLSDFLSKMQSYSELFAKQNQGKKSSSITKAILHSSFAFFKSYILKRGFMGGYEGFVISTYNANTAFYKYLKLYEANKSDKC

SEQ ID NO: 1035 - protein, 258 aa, Unknown
  Description of Unknown: Microgenomates group bacterium GW2011_GWA1_48_10 sequence
MTKLSAIVLTRNEETNLARCLASLHWCDEIIVLDDFSSDQTPLLAAKSRKAKLFRRHTNGDLAAQRNFALDKASGEWVLFVDADEEVSPVLAKEINGVLSGNKNMSGYFLRRRDSFWGRWLNYGETGNVKLLRLAKKSAGRWRRRVHETWHVSGRVGEMQNPLWHYPHPTIHDFLASINRWTEIDAGELTTEGKSFRFFRVFVNPTGKFLQNYILKLGFLDGLPGFVSAFMMSLHSLIVRVKQYDLATKPANPAAKTP

SEQ ID NO: 1036 - protein, 267 aa, Unknown
  Description of Unknown: Proteobacteria bacterium CG1_02_64_396 sequence
MSKMPISVAIIAMNEEEKIDECLASVAWAEEIVVVDSGSTDRTLEIARTYTDRVVHRDWSGHIDQKNYALSLCSHDWVLSLDADERVGPELREALLQLREQGPGDFQGFEFNRVTWYLTRWIRHGEWYPDPKLRLVRQDVARWEGTNPHDRLVVEGKVGRLEGDLYHQSFSNIEEHLDTIQSFSSIAAREAIARGRDATVFTMLGHGLFAVFRYYVLQQGFRDGIPGVIIAVLSGCAAFTKYAKIWAYRRASQGVMPQEKGGSGVEQ

SEQ ID NO: 1037 - protein, 256 aa, Hanstruepera neustonica
MPKLSAVVITYNEAPNIDALIENLAFADEIVVIDSFSSDDTLQKLQNFKHIKTYQNTFKNFPNQKNFALSKATYDWVLFLDADERLTNELRDEILKEISKPNNPIVAYYGLFQYFFGKKPIKFSGFQSAKSFRLFKKSVCKYDESRPVHEHLIVKGKTEVLSNKILHYSFRSYDHYKEKMTQYAILKANKLHKQGKTANPLIKYIKIYYRFFNHYIMRLGILDGKVGYQISKLNAYEVKKRYDELKRLNKMSLSKK

SEQ ID NO: 1038 - protein, 249 aa, Chlorobium sp.
MAEKITVTVLTKDSEATLRECLEALRRFDEVVVLDSGSRDRTLEIARSFPNVVVYEHPFLGFGPMKNLAVEKASNDWILSIDSDEVVSDELAEEILGMQLDEACVYAVGRDNHYHGRLINGCGWDNDRVERLFNRNGVRFNDKMIHEGLEIGDGVRVVMLGGRLKHYAYDNASQLIAKLQHYSTLWAEERKGKKRVTALQAFLYAAFSFFKYYVLKRGWLYGYEGLLISVSNANGVFYKYIKLYEANRR

SEQ ID NO: 1039 - protein, 352 aa, Thermosipho africanus
MKKCLLSVAMIVKDEAHNIRRALESIKDIADEIVVVDTGSTDKTPEIVREYTDKLYFHPWEGNFSKARNQSLKYPTCEWVLIFDADEEVKEDFKGIRNFLENLPNDVNTVYLPTLSYLDWDFKKTEIASTPRLFRNGTVYYKNIVHNQPVYKGKVINAPFTVYHYGYIWTRKLRMQKYNRTRTLILKHLENKDLNPVEKIYYLVQLYKTENISKYKNRKIEVGWKTLKEIEKIGQIPAIGLEFLFLFGMDALNKENLELAENLFNKAIEAVPKYPDPYYGLTGVYEKKDDLESQYKYAKLFLEKIEYAEKHPEEFEWTVIGFKHKGAANAIITKYFLKNKDKKTLNIILEKQ

SEQ ID NO: 1040 - protein, 249 aa, Helicobacter brantae
MKKKISVTIIAKNAQKTLFECLKSVERFDEVILLDNQSSDDTLKIAREFSNVKVYQSEFIGFGALKNLAISYAKNDWILSLDSDEVVEEDLLNEIENLNFELGKYYSFSRKNYFHGKWVKCCGWYPDRVKRIFNKTEIGYREKLVHEGLQTGKAKEIKLKGSVKHYTMENIDNILSKMNRYTSLSAKEMKERGKRGSAIGGIGRFVFVFVKDYFFRMGWRYGYRGFVIAWCNASGAMFKYLKLYEMEQK

SEQ ID NO: 1041 - protein, 257 aa, Unknown
  Description of Unknown: Chitinophagaceae bacterium IBVUCB1 sequence
MPKLSVVVITLNEEKNITRCLDSVKGIADEILIVDSHSTDNTVTIAKQYGANVISQHFLGHIEQKNFAAQKAQYDWVLSLDADECLSTELADSILAVKKNPTYDAYKFPRLNNFCGKWIRHCGWYPDAKIRLFNRTKGNWTGENPHDKWILNNKEKEGDLRGDLLHYSFNSISDYVKKVDKYSEIAARARADKGVKYSIFKIIIVPKWKFFADFVLKLGFLDGYYGWLACRLSAMETMIKYAKTRQYAQWKKDGKSY

SEQ ID NO: 1042 - protein, 523 aa, Unknown
  Description of Unknown: Bacteroidetes bacterium sequence
MPLNNLKKISAVIIVKNSEQVIARTLDSLKDFDEVIIYDNGSMDKTLPIAGHYKNVKIILGEFTGFGNTKNVAAEFAHNNWVFSIDSDEVISSQLYESINNVDLDNNSVYWCYRYNYYRKRRIKYSGWGKEEVSRLYNKNVTHFNKRLVHEGLELKNFNHVKLKGELRHYSYFNIADFNKKRDFYSDLFALENKGIRKSSPLLAFISGSFDFLNTYITKLAFLDGYRGLLIAISNAHETFLKHLKLYEANLKNNYKVSLIITSCGNKDALELCLKSALNQFILPNEILIINAKKDKESHELITEFAKKSFIPVSYFEDESQNNIASLRNKAISKTRHDYLIFVDSNSILHKDFIIDHISCAKRGAYIQGKLVKIKEELSLQLINTKQIKLPGLFSGNYKNIFKGVRLTFLSKFYCLVKKKRPNGVGVYNFSLFKEDIIKVNGFNEDYNEWSLIDREILERLCNKGVRRIDVRFRAIQYHLSKSDVGSESVNKLKTQIENEKNIWCNNGLDKYLPEILKESKMF

SEQ ID NO: 1043 - protein, 315 aa, Unknown
  Description of Unknown: Acidobacteria bacterium sequence
MILEDADIPARAPVSVLVLTRNEEANIAECLESLRWAAEVLVVDSLSTDRTAEIAEALGAKVCPHAFAGYADQRNWALQNLPFAHDWVLMIDADERIPGALAHEIRKAVSRSNDTYSGFYISRRLFFMGRWLRHGGLYPTWLLRLFKRQLARVEERPVNEHVIVNGRVGYLGQPLDHVDRRPLSDWVAKQNRYAGLQAAEYLREKSRKGFESSIRASLRGSQAERKRWIKLHVWNRLPLLVRPFLFFARNYFLKAGFLDGRAGFIYHVLWSFWVKFLIDVKVIERQSGVGRPGDTAWSLDHLGRGDSKSEKVTAS

SEQ ID NO: 1044 - protein, 276 aa, Unknown
  Description of Unknown: Bacteriodetes bacterium sequence
MSKLSVILITYNEEKNIERCLNSVSWADEIIVVDSFSTDATISLTKKFTSYIIQHKYDGDINQRERGFAAAKGDWLFYIDADEEVNDELREDILNVMRNGAATDGYYAQRRNKIFGRWMYNGGWFPDLTFRLFNKEKYLAEHEEVHGGFTVRGAKGTLNGFLNHYPYETIEQYLAKMNDYTSLQVSNKLKQPDGVNISWIKIIFSPLSHFIRKFISNKGYKDGLHGFVLAMLGAIYTFSLYAKCKEYEIRLREEKGILPPITNLELLIYKRPGFKE

SEQ ID NO: 1045 - protein, 253 aa, Unknown
  Description of Unknown: Chryseobacterium sp. ERMR1:04 sequence
MPELTEKVSGLMITYNEEKNIREVLECFDFCDEIVIVDSFSTDKTLEIAQTFSNVKIIQNTFEDFTKQRNLTIDNAKNDWILFLDGDERITPELRQEIIEELNKTDKKDAYYFYRKFFFAGKPIHYSGTQTDKNFRLFRKSKSRYISDKKVHETLKVEGTIGELKNKLLHFSVNDYESYKKKMIHYGVLKGQELSAKGKQFNLLTQYSKTLFKFFKAYILRLGILDGKEGYQLSYLQSLSVFKTYESLKNVQN

SEQ ID NO: 1046 - protein, 252 aa, Halanaerobium sp.
MNNLTALVLTYNEEDNIAACLDSLMWVPRVVIVDSLSSDKTEEICLRYNNVKFFERQFDDFASQRNYGLEQIDTEWVLVVDADERITNSLQEEIKKTLSNPEAEGYNIARKNYFLGKWIKYCGWYPDYTLRLFKSVYRYRGLVHESPEIKGEIGKLDNDFIHYTYSNLKEYVDKMNQYTSLDAKKKYQKGKKIGVSYILTRPILEFIKKFFLKKGFLLGVQGLILSLLSSYYQFLKSIKLWELNNIFEDEIK

SEQ ID NO: 1047 - protein, 259 aa, Desulfohalobium retbaense
MNRERVTGLVLTFNGERVLEQTLASLAFCDEILVVDSGSTDRTLAIAEAAGARILTRAWEGPGPQFAFAFEQVRTNWVVSLDHDEYCTPELQEEIQGVLANPGEMAGWYCPRRSFYFDRFLAHSGWYPDYLLRVFRLERMELKISMPHYSFHPQGPTGKLQGDIVHYPYSGLAEHLEKINSYTQSAAEDKFARGERAGLGKALGHGLARFFKIYVLKRGFLDGRAGLILALNGFFYVFHKYIRVAELGKEEKKKGSVKF

SEQ ID NO: 1048 - protein, 309 aa, Leptolyngbya sp.
MFSIYILTYNEEIDIAACLESALLSDDVVVVDSCSSDRTLEIAAGFAERHPVRIVQHAFESHGKQRTWMLESIPPKHPWIYILEADERMTPALFQECCRVIQSDERVGYYVAERVMFMNRWIRRSTQYPRYQLRLLRHGKVWFDDYGHAEREVCNGPTGFLQETYPHYTCSKGFSRWIDKHNRYSSDEAAETLRQLQQGTVNWRSLFWGASEVERRRALKDLSHRLPGRPLLRFLYMYVGLGGWRDGGPGFTWCVLQAFYEYLILLKVWELQHAAAPPQAESGFAKSRVDAAMQQPEAVESGDRPSPRI

SEQ ID NO: 1049 - protein, 248 aa, Unknown
  Description of Unknown: Candidatus Rokubacteria bacterium sequence
MKRLSVCLITANEEDRLRPSLESVAWADEIVVVDAESTDKTVMIAREFTDRVVVRPWPGFAAQKNFALDQATGDWILSLDADERVTPELRARVEDILRADGPAAGYAVPRRNIFWGRWVRHGRLYPDRQIRLFRRGRGRFVDVEVHESVRVDGPVERLEAPLLHASYRDLSDCLTRFDRYSTLAAEDWIRRGRRVTIAGIALRPPGRFLSMYVLHRGFLDGWRGFVLAALYAHYVFVRSVKVWEKTKA

SEQ ID NO: 1050 - protein, 962 aa, Selenomonas ruminantium
MRISACYIVKDEEQNLGKSILSLQGIYDELIVVDTGSTDNTIAIAQKYGAQIDYFTWQNDFSLARNFTLSKATGDWIIFLDADEYYDCSLSIRDYLQEVDAKYPQKDAVIVPRYEAHQMKNPPIHVPRIFRNRPDIYYQGVIHEQLKKKDGDIDYIFAENMIFIHTGYHPDNMERKSQRNLQLLLADVEQNGERDAYYYYIAESYFGLQEYEKAIDYIKKAIASPVRHYREEANYYHILLESMRQRKYPAEEMTLVAEQAIKKFPDMPEFYGEQGIILSSMGRYGEAYRMLSQCIDKYEFTEREKNDYGYFNAESMGIIYARYARIAMMKGRQDAAKIAACYAACISKEKWGGAEKTEIARATGIAPDQEVIICIPVYKKELSPFEKASLKQLNHVLGKYPRVFVAPASLEFDYQEYAAGVGIERFPDYFFNNVTSYSALMLNVEFYQRFTQYKYLLIYQTDAFVFSDRLKEFCAMDYDYIGAPVSRFNPVWHAIDAQTGNGGLSLRKIASAIRMLRQWNDIMKGSPFVNLFMQWEDLFWGYCGRQKTLFFKTAPLKIAAEFAVQANVAHAHKRMQQGWRPFGCHDWYNLDYDFWQEIIESYGFDFSKIPHSGKEAYPRMKLYLATRSTVNMRILWGAYRNGTLNKALSLLDDWLLRYKEGHSGWYHNMEELVCMWRAVEYEDKYNKLWKELYLRKLSIGINRGINDNNFSPILWNLLVTLIPHLCKYDYVEMKTLIAEIESGWWKFWTGNSCYQKCIPEANKKIIAVVTVADESDVVESFIRHTLTFTDAIIIDERFATESVQNILHKLENEGLPLILHKKSLNIHDFDADVDYILKLKATDFILPQESMNYVRQIIEKLPAKQTYAIATGLFAPYQPYANRDKFILARPLVRLDKKPVITEAINIQKENGGDIAIADKLYIARFGQIDTKGLDYGIIPADTELLDISAYIVNQHLQYTGG

SEQ ID NO: 1051 - protein, 392 aa, Rhodopirellula sp.
MNPGRVHVLIWGQEYCWDAGLWQALAPWSPRALSLGKWSRAIRLRFSRSENSAMSSSETAWRYGAAETRPQAVAKTNPDERLLSSETPRAETLDSQRHIATVRNGLSAVVLAFNEARNIRRCIESLSWCDEVLVVDDCSTDATREVAESLGARVVQHRFESFAKQRNWALQNADLQQPWVLMLDADEVATPGFANEAQIAVNEAASDLQAICICRKTVFMGKTLHHADGFPVWIMRLVRNGMAAFEDLGHGERPVPSGVGTPKLIREPLLHFAFSRGMDDWWNRHVRYAKREAIRESNEGRDRCWRDLFAADSWKRRRQLRALTACLPGRGWMRFLYQYIYKCGFLDGTAGLQFCRMMACYEAMISVRRAETHLLSDSEQHSDFFSEPVTRA

SEQ ID NO: 1052 - protein, 304 aa, Unknown
  Description of Unknown: Candidatus Pacebacteria bacterium CG10_big_fil_rev_8_21_14_0_10 _36_11 sequence
MTNKLSVLIHTKDVAETLEKTLSSVKFADEIVIVDMESSDDTLKIAKKYTNNIFHHEDVGYADPARNFAISKATNEWILVVDADEVISEELREIILETINNKDSADIYHLPRKNFVFNKWIMKTGWWPDYQPRLFRKGTVSWQVGVHRLPDMTGTQEKFPAEEKYAIEHANYIDTSHFIKKLNHYTSIQAIERLDTNKQNKEQYSTNKLFEIFANELAKRSLMMNGTEEGLHGTSLSFLQATYEAVIYLKQWGETGYKETKPEDFGATLNHIQKIWRYWWADYKVRHSSGLTSIYWRIRRKLYL

SEQ ID NO: 1053 - protein, 268 aa, Desulfuromonas sp.
MNLSVAIITFNEENNIQACIESVQDVADEIVVVDSFSTDRTEEICGGFPKVSFHKNPFDGHVQQKNVAIEKCGGDWILSVDADERVTPELRDSIMEFLRSSPSKEIAGAKFPRLTIHMNREIRHCGWYPNARYRLFRRGRAHWGGENPHDKLLLDGSGVMLKGDLLHYSFDDLAHQVQTINSFSSIAALTRFNKGRCFRLWRLLFKPVSKFVEIYLVKRGFLDGLHGVIIAVSSSYSSFLKEAKLFELDQVGADKPSNLPDRYRKLRK

SEQ ID NO: 1054 - protein, 260 aa, Hydrogenivirga caldilitoris
MNRFTLSVAIITYNEEDIIGKTLESVKDIASEIVVVDSGSTDRTREIAESYGAKVYIEEWKGYAAQKNSALEKCTQEWVLFLDADEVVSEELRRSIIEELKNPKAEGYLINRRTYYLGKFLKYAWQPEWRLRLVRKEVDPIWESEPHEFLKIKSENIAKLEGDIYHYSYRSLRHQAEKGISFAIDAAVVKYSKGKKVSAVDIVFRPFWAFFRELFFKRAFLEGYRGIIISFMASFYTFLKYAFLFELEMKEKEGKNLWGR

SEQ ID NO: 1055 - protein, 254 aa, Lewinella cohaerens
MARSLSVIITTYNEADNIARCLESILELANDILVVDSFSTDKTVEIARRYPVRVLERKYLGPANQKNWAIPQAKHQWVLLLDADEMATPALCAEIKRLLVADQAPAADAYWIGRDNYFLNQQIRFSGWQGDRVIRFFHRDRARYNELQVHEEIATDGITVGSLNERLDHYTFRSLDHYLDKTRRYAHWSAQDHSKRTARVGYFHLLGKPFFRFFKHFVLQQGFRDGKVGLMVSAIMAWGVFLRYAFLLEQQKNK

SEQ ID NO: 1056 - protein, 266 aa, Unknown
  Description of Unknown: Candidatus Magnetobacterium bavaricum sequence
MQDNKAPDKLPVSVVIVTKNEELNIAGALQSACMAQEIVIVDDYSTDRTIDICRAYNARIYQNHWQGFAPQKQFAIDHAQGPWVFLLDSDERLTPELVQELHQVIAEAGAHFEPGAALSRGSLTPRPSCSGKEAAYDGFYVPRKNFFLGKWIRHSGWWPDNTLRLFKKDRAHMHQRQVHEKVLLDGRAGNLRNPIEHYSYRDISDFIKRMDRYTTLAAEELARTTVKSYTFAFKISLRLIWDFLAKSTAPSDLWTAYRTPLYMMML

SEQ ID NO: 1057 - protein, 258 aa, Unknown
  Description of Unknown: Sphingobacterium sp. ML3W sequence
MNYNRTTVDQKISALVITYNEEKNIQDVISCLDFADEIIIVDSFSKDNTINIARQNSKVRVYQHKFEDFTKQRNIAISYAKHDWILFLDADERLTKPLQKEINETINNPRALDAYYVYRTFFFCNKKIRFSGTQNDKNFRLFKKSKAKFCTLKKVHETLNVNGTTGILEHKLLHYSFSDYKSYKDKMIHYGVLKGQELYSNHKRYNILTHFGKTSFRFFKAYIIKLGILDGKHGLDLSYLQSLSVHETYVSLKRKEQV

SEQ ID NO: 1058 - protein, 272 aa, Unknown
  Description of Unknown: Verrucomicrobiaceae bacterium TMED86 sequence
MLPISVCIPVLNEEKNLPGCLESLKGKFSDVVIVDSGSTDATLSIAEKANLTVLSFKWNGAFPKKRNWALQNHSFKHEWVLFLDADERITLAFLDELKSKLDSKMVGFWLRYDNWFMDRQLHHGDVMRKLALFKPEAGEYERFPEDFWSHLDMEVHEHPVLDGPTEEIFSPLEHHDFRGLESYIAKHKEYAAWEAKRYQWLQSDPEAWTSLNKRQQFKYRHLNKWWLGSFYFLISYFLKKGFLDGRVGFRFSWMKKGYFEDIRRRILTSKTS

SEQ ID NO: 1059 - protein, 299 aa, Unknown
  Description of Unknown: Candidatus Parcubacteria bacterium sequence
MAQEVAGCPVSAGKVSVYVLTYNEEKNLRECLESAKLVSDDIHVVDSCSSDKTLEIAEEYGCYIHQRKFDTFARQCNWALETIPFKHEWIIRLDADERIPGSLAEEIQEYAHTLGEDVTGVMFKKRLYFMGRWIRYGRMYPMLRLAMFRKGSGYYEDKEEEQYVLTRGRYITAKHDFYECNQNNTLPFFTMKHLDYAEDEVKEALDEELDHEITPKLFGNKIERTRWLKVHVYSHVPLFVRPWLYFFYRYFFCLGFLDGIPGLIFHTLQAFWYRFYVDARIYEMRSNWREKRLNFEDIR

SEQ ID NO: 1060 - protein, 288 aa, Lysinimicrobium flavum
MIRLPISAIVLTKNEAEGIAECLRRLENFDEVIVVDSHSVDDTAAIAQEFGAKVVQFSWDGTYPKKKQWALENSGARNNWVLLLDADESPTAELIDELHARTDELQAGTFGAYDLVLHYKFAGRFLDHGHRVVKRSLLDTRVCRFPEVDDLDAPGIREVEGHYQPQSEKPIGRLRGRLSHDDKDPVGTWFDRHNRYAEWEAHLLATPGTGEHVAANRSTLGRVWARVPAKPLVFFVYSYVIRLGFLDGRAGRDYAIALSGYYWQIGVKYREQTRLRSTQVVAHVGAEG

SEQ ID NO: 1061 - protein, 262 aa, Legionella taurinensis
MLSVIIIAKNEAANIQRCLESVKWADEIIVLDSGSTDQTVEIAKKYTDNIYLTDWQGYGVQKQRALSVATGDWVLNLDADESVSEGLKFAIQQAMDLNEADAYRIPIYMNFYGKPMRYSSSPKRHIRLFKREGARYSDDIVHEKVVLPPEAKVEKLKQSILHHSYQDLSHAIAKMNRYSSYTARSRRKEGKPPSFISILFSAGWMFFRCLILQRGFLDGKEGYILAVLNAEGSFYRGVKQLYPDRRISDLPDTKEIKKEENG

SEQ ID NO: 1062 - protein, 309 aa, Paludisphaera borealis
MNTPCLDETTDQDRAARPRTARAPVSVIVPVKNEAENLRRCLPALDWADEVIVVDSQSTDDTCDVAVELGAQVVQFQFNGVYPKKKNWALENLPFRNEWVLIVDADEVVVPELAEEIATRIESGEAEGYYLNSKYFFLGRRIKHCGYSECWNLRLFRHRLGRYERMPDHTGGRSGDNEAHEHVELDGRVARLTHELDHHAYPTIAAWVEKHNRYAVWEAAMYERFLNEPVPATIGRGKALKRRLKKLYLRLPMRPFIRFVYAYIFRLGFLDAKPGLVFCTLLSFYDFLAWANVYEQKIARANELKSSGR

SEQ ID NO: 1063 - protein, 660 aa, Carboxydocella thermautotrophica
MNNSTITACLVVKNEGKYLERCLSSIKPAVEEIVIVDTGSSDNTLEIARRFTEKIYIQPWQDNFSQVRNFALQQATGDWILVIDGDEELHPDSIACLRNKISATEVEGYLLKIINYFNSGSEVLTAADVVFRFFRNRPQYRFTGAVHEQICDNILAVNPTAKIEIAEDIVLYHYGYLDEEIENKDKRQRNLRLLLKEVDSNPDHLLNRFHLGVEYFRAREYTEALSQFRLVQSRLAPQALYAPKLYRYIASCLLHLKNYQELLDFIEQEWRPLFPQQGDLYFIHGLVLKELKQPALAITSFRQCLQLPPQPAFYANVYSCQVDKVNYHLGELAEYFQDREGALKYYLTALQHNPNLVPALARIIAILEPRKYPQETMTDLEKVFDFSEPSARLLLGRLLFNEKAYQLALACFEQALSQLEDGPENIIWLAGLCQLKLGNILAAQSLFGRLSPAGSLFLSAQYHLILWYWVYGHRKHALQTLRNLQQFLSPTACLLHLLVYGYLPPTSSAAIEGEWQQAAWELLVQIAEYQKLKKFWQARKRLKPWLPPEPDLAWVELYLQQGWGAQAEKQARQLVSQSPDPYLKYLLAKSCWLQGKLAEAEQFMVKAYQQGYNEPRVARELARLYQELALSVLRTELAISPQHQECAQLLARIEACLIEV

SEQ ID NO: 1064 - protein, 257 aa, Mariprofundus sp.
MADLSVYIIAYNEEEKIADAVNSVLWADEVIVADSSSSDRTAEIASALGARVVQLEFTGFGKLRNDAIASCTHEWIFSLDADERCTAEAAEEIRRIINADDSADAYFTPRKNWFMGRWIRHCGWYPDYRQPQLFRRGALLFETGDKVHESYRVNGTTAHMQAAIWQFPFRNMAQALDKANRYSSLGVDRLEAKGARAGMGHALLRGLWSFFRIYILKLGFLDGWAGFVIAFSNLEGVFYRYAKLCERKYGWDRPPQS

SEQ ID NO: 1065 - protein, 295 aa, Achromobacter sp.
MQKIPISVVVMTKNEERNIVKCLKALADFDEVFVVDSNSTDATCVLAESLGAKVCNFQWNGKYPKKKQWCLESLPFSHPVVLYVDADEEMTPALAREIRDCLPRFAAGAGGAFVPFDYVFCGRKLEHGHRVYKLALLARERSRFLDYDDLDVANMWEVEGHYQPQVQGETFALRNRMVHNDHDTLFHYFDKHNRYSDWEANLRTKGLMNDPREANVGARALLKRIFQAMPFKGPVSFLHSYVFRLGFLDGKAGFDYAIARALYYWQIRIKTEEIRKERQAALGRAKGETVAGAAK

SEQ ID NO: 1066 - protein, 254 aa, Unknown
  Description of Unknown: Fusobacterium mortiferum sequence
MKLSVAMITMNEERILEKTLESVKDIADEIVIVDSGSTDRTEEIAKKYGAKFYVESWKGYGPQRNSAIDKASGEWILNIDADEEISPELQKKILEIKSSTDDRSVFNVNFTSVCFGKKIRYGGWSNSYHIRLFKKSVGRFNGNTVHESFETNEKIYTLKEEIYHHSYSTLGDYFTKFNRYTTEGAIEYYKRGKRCNIFQLAFNPVFKFLRMYLLRLGFLDGKEGFLLACTSSLYTMVKYYKLYEITKNGSYIKK

SEQ ID NO: 1067 - protein, 269 aa, Unknown
  Description of Unknown: Candidatus Roizmanbacteria bacterium GW2011_GWA2_35_19 sequence
MNISAVVLTRNEVKNIKKCLDSLDFCEEIIIIDDFSTDKTTEIIQNLKSKVKIYSRKLGGDFAAQRNFGLSKAKSDWILFLDADEEITPELKKEIANNIKSENSTEAFFLKRRDYFWGRELRHGELAKVTSKGLIRLVKKDSGKWMGNVHEVFHTARNCKTLNGHINHYPHPTLSEFIKDINKYSTLRAHELQRRGYETNLFKIVFMPIIKFIFNYFIMLGFLDGAAGFTYSFMMSFHSFLVRSKLYQLNYLGHPESSEGSSDEGSANN

SEQ ID NO: 1068 - protein, 246 aa, Unknown
  Description of Unknown: bacterium BMS3Abin06 sequence
MFPVSVVIVTKNEEINIEDALKSVADAKEIIVIDSFSSDRTVEICRKYTGRVYQHEWQGFAGQKQMAVDYAEGPWVLILDADERVTPELKAEIMENIANTDCSGFYMPRENYFIGKWIRHSGWWPDNTLRLFKKDKGHLEPREVHEKVVIQGNTGYLKNPLRHFTYRSVSDFAERMDRYSTLAAKEIRKNSGRSGLFSLTIKPFATFIKMYVLRLGLLDGTRGLMLAVLYSYYTFLKYAKTWEKQG

SEQ ID NO: 1069 - protein, 264 aa, Unknown
  Description of Unknown: Cellvibrionales bacterium TMED122 sequence
  MOD_RES (13)..(13): Any amino acid
  MOD_RES (51)..(51): Any amino acid
MRRPISCFVITCXEVDRIEQCLQSVVGWVDELLVIDSGSTDGTLEIARRYXDRVYETDWPGFGPQRNRALNWCTHDWVLSLDADEVVTEALQKEVDKVLSEADLNDNFLKFPWHTYLFGKPLKHGRYATPQGKLFEKTGAQFKDRSVHETLLLPDYRVRALKSPLIHHSWRDYQHVIEKHLKYGVLGAQEKSKVGRKSSILYAFARSIIDFLHQYVVRGGFMDGQRGLLMAVILSQYAFHKYAALWTLDQALIHENSTSDSSTS

SEQ ID NO: 1070 - protein, 348 aa, Longicatena caecimuris
MIVKNEEDVLARCLDCVKKFADEIIIVDTGSADKTKQVAKKYTDKLYDFSWCDDFSKARNFSFSKASMEYCMWLDADDVVENEDIEKIQKLKKELDKKVSIVMMKYHTAFDEDGNPSFSYYRERMVKREELHLWEGEIHEVIPLTGRLLYTDIGICHRKVHVSDANRNLRIFEAMLDKGKKLNPREQFYYARELYYHKRYKDAVKAFKKFLKEDSGWIENKIDACEMLGYCYYALHKEEKALESFLCSLQYEVPHAELCCDIAKHFMDRAKYKEAIFWYECAMKVPMNETSGAFIREDCYGYIPAIQLCVCWWRLGDKDRAVQYNELAGVYKPKSREVEQNRRFFEMK

SEQ ID NO: 1071 - protein, 258 aa, Unknown
  Description of Unknown: Omnitrophica WOR_2 bacterium SM23_72 sequence
MKEKFPLSVVVLTRNEEARIAECLESVSWADEIVVVDDESSDATVAIAKRYTDKIFIRKMDIEGRHRNWAYAQAKNEWVLSLDADERVTKELQEEIKRVLEDSPQEEGFTIPIRNYIGTYWVKYGGWYPAAKLRLFQKGKFHYEEVEVHPRAFMEGSCGHLKSDIVHFSYKNLEEFWNSLNVQTTREAQKWYNQGKPMRLGRFIWRTIDRFLRTYIRKKGYKDGLIGFVVAFNAGLYQFLSYLKYQELLLNAKLRQNS

SEQ ID NO: 1072 - protein, 264 aa, Unknown
  Description of Unknown: Flavobacterium glaciei sequence
MNLNLAPKISVLVITLNEEANMQALLVDLGFADEIIIVDSYSTDKTKSIAQSFSNVKFIENRFENYSSQRNFAISQAKNDWILFLDADERLTTELKEEIIETLQNNKTYSAFLFYRIFMFQNSVLHFSGLQTDKILRLFDKNFAKYSNNQLVHEKLIVNGKIGVFKNKLLHYSYSDYQSYKYKATRYGKLKAQEKFIKKHKPSFLLHIVHPSYNFLYNYFIRLGFLDGKKGIIICYLNAYSVFVRYQELKLLWGNRNLISRKNI

SEQ ID NO: 1073 - protein, 314 aa, Planctomyces sp.
MSGTKCPLSVIILTGNEERNIAECVADLDWADDVIVVDSYSTDATLEEARRARPDVRIFQNPFEDFGQQRNWALDKTGPRHGWILFLDADERCPPAFAEAIRRTVADPGEKVGFFLCYRNMFLGQWIKRSTFFPSWQLRLLKQGEVRYRKEGHGQRELTDGPLGFIQEPYDHYGFSKGVADWIARHNQYSTDEVELILRLAAEPLQLTDLLRRDPVVRRRCLKRIAARIPLRPMTRFLYSYIVRGGFLDGLAGWHYCLLRASHEIHVQAKLVECARQQESQRTAGAADRFKDAGVDRLRESQASPLGESSKSPP

SEQ ID NO: 1074 - protein, 272 aa, Unknown
  Description of Unknown: Ignavibacteria bacterium sequence
MERLSVVVITLNEEKNIERCLRSLRWADEIVVVDSFSRDRTVELARKYADSIIEHEYDGDIPQRERGFAAASGTWLMYVDADEEVSDGLKDEILGVLTSRETRDGYEIPRKVFMFGTWVKHGGWYPDYTFRLFRRDRYRALQAEVHGGFTVDGETGRLSGLLNHYTYDSIAHYLSKMNDYTSLQISGKIGGGGGRSAGARRLILSPLSHFLRKYVSKQGYRDGFRGFLLASLGAIYTLALYSKLWEYGFRDREGRGVRPPITNPEVRRLKGL

SEQ ID NO: 1075 - protein, 264 aa, Unknown
  Description of Unknown: Candidatus Wolfebacteria bacterium GW2011_GWC1_37_10 sequence
MKKSLISVIILTYNEEIHIERLLENIADWADEVFIVDSFSTDKTLEIAKKYGCKIFQHKFENQAQQFNWALDNLKIKNDWILRLDADEYLTSELKDEITEKLKNIPKNINGFYIKRRVYFMGRWIKHGAYYPIWLLRLFKKGKARSEQKTMDEHIVLLEGEAEKLKNDFIDDNKKNLEWWIAKHNNYSTRETADVLGGDYGQGKKKFYYRLPLFFRACAYFCYRYFIRLGFLDGKEGLIFHFLHAFWYRFLIDAKIYEYKNKNQ

SEQ ID NO: 1076 - protein, 264 aa, Muricauda sp.
MSTPKQKVSALIITYNEMGYIERCIDSIAFADEVIVIDSYSTDGTFEYLQNHPKVHVLQNPFENFTAQKSFALKQASNDWILFVDADEVVSNPLQKEILHTVNDPNACEAYWFYRDFMFKDQRLRFSGWQTDKNHRLFRKSKCKFTDKKIVHETLEVDGNSCILKERLTHYCYKNYEDYKGKMLKYGRLKAKEAFYRENQFNYLFMILKPAWKFFNHYILRLGFLDGKKGITICYLNALGVLERYRELKRLEKKNELAYYLVMP

SEQ ID NO: 1077 - protein, 261 aa, Prevotella sp.
MENNEHKISVVINTYNAAAMLEEVIRAAEGFDEVLVCDMESTDDTVAIAERLGARVVTFPKADHKSAEPARTFAIQSALCPWVLVVDADEIITAELRDYLYQRISQPDCPQGLYIPRKGYFMHRLFAYPDYQLRFFIREGTVWPPYVHTFPTVQGRIEYIPRRRRELALIHLADDSIRTRVYKTNEYTDNEVEKKRGKHYGAFKLVFDPLFRFVKAYFFKGQICKGVPGFINASLDAYYRFITIAKVIESKNAERDIRHRK

SEQ ID NO: 1078 - protein, 248 aa, Flectobacillus sp.
MISVTILTKNSEARLAQCLDALKGFDEVIVLDNGSTDQTLAIACQYPNVCVHEHPFLGFGKMRNLSVSFCKNDWILWVDSDEVLDPILIQNIQNLSLNPKHLYRFLRKQYYNGKYINGAGWGNDKVTRLFHKNSTQFNDKDVHEGLNTKGLQIVDIEGVIHHYSYETADQLLAKMNYYSTLFAVQNQHKKGTHPVIAYFKKTFHFWNYYLLKKGFLYGYEGYLISYCNAQGAFFKYMKLYEMNQKEKS

SEQ ID NO: 1079 - protein, 254 aa, Unknown
  Description of Unknown: Candidatus Shapirobacteria bacterium GW2011_GWE1_38_10 sequence
MNNISLLLLTKNEQDNLKGWSDWIHQLTAINEIVVVDDESTDSTVKILKSFFTKELSINIFKKKLENNFSDQRNFGLKKCQNDWILFLDADEVPTEKTINYLNHLSLKNGENYSFKRSVVYLGHTISHGQCLNDLPIKLFNKNEGKFINPVHEIWESTSTTIDTYQTILHYSIKSLTAFLQKINFYSSLRAQELFNQKHHPHLWEIIIYPKLKFLDLYFLRLGFLDGTAGIILSLSLSFNSFLVRSKLWHLSQK

SEQ ID NO: 1080 - protein, 251 aa, Unknown
  Description of Unknown: Nitrospirae bacterium sequence
MSKLSAYVLTFNEEAKIRDALDSIVWADEIVVLDSHSTDRTEQICREYTDKVYQCDFAGFGKLRNRALELVTHDWVLSIDADERATDELREEIQAELASGPRADAFFVPRKNFFLGRWIRHCGWYPDYRQPQFFNKHRLRYRDDLVHEGFDVMGRADYLRGHVLQYPFRDLGEYLRKMSRYSTLMAEQMASRGRRFHVHQLVTHPIFTFIKMYGLRQGFRDGMPGLILSLLYAYYTFVKYAKLWERGRASA

SEQ ID NO: 1081 - protein, 267 aa, Unknown
  Description of Unknown: Desulfobacterium autotrophicum HRM2 sequence
MMIDSRTDVKKKTLSVIVITKNEEDRLDQCLRSIQALADEIIIYDSGSQDSTLEIAAQYTDKIFETDWPGYGPQKQRALSSAKGDWVLSIDADEVVSDELAREIVGVLNQDPEEAAFRIPWAVINFGKRLDYGNSARSVKRLFRRKGASFTEAIVHEAVVLPPGSRVGKLKGRLIHYSIRDFEHYLMKNRTYSWLGAQKRFTAGKKGGGLPGAVFRAFWVFFRCYVIRRGFLDGQVGFLVAAMYSQGAFNKYAGLWTLQRMERINSK

SEQ ID NO: 1082 - protein, 304 aa, Unknown
  Description of Unknown: Candidatus Roizmanbacteria bacterium CG07_land_8_20_14_0_80_34 _15 sequence
MKLSLCIAVYNEEKNLHYPLDSAYDFVDEVVIVDGGSTDKTIQIAKSYGKKVRIINSDNPVMFHKNKQKAIEAAKGEWILQLDADEELTQELKQEIKDIIRYNQMESDKISQKETDSIRLNPISSNSIVAYNIPRKNWFLTGFLMKGGQYPDYTIRLYKNGIAKFPCKDVHENVEIINNLKSKIKNSESKEEKKINSQFLILNSKCNIGFLRNPILHYADPDFSRYLMRWDRYTTAEVERMPKDLKLSWFNYIIWKPKITFLMMYFRHKGFIDGFPGFVFALFSSIRFWVIYIKWYQRVHKVES

SEQ ID NO: 1083 - protein, 250 aa, Unknown
  Description of Unknown: candidate division Zixibacteria bacterium SM23_73_2 sequence
MDKISAVVIVYNSQDCLFRCLESLTWTDEIVVVDSYSQDDTKRIASNFTDKIYDVKWEGFGKKKEFARQKASFEWILSIDCDEVIPPELKSEISKAIKKDQGCDGFYIPRRSNFLGRWMNHSGWYPDYVLRLFKKTKGRFDQALVHEKVKVSGRLDYLKNPMLHYTDPDINSYLSKLDFYTTLSAKQLFQEKRKVVFWDLVFHPLGVFFKRFFLKKGFLDGTHGFLLAVLSSFQVFIKYTKLWDLQRIKG

SEQ ID NO: 1084 - protein, 257 aa, Selenomonas artemidis
MHDRSGKEDFVKIAVIILTHNEEAHIGACIRSAAFADEILVIDDESEDLTREIAAEAGARVISHLLAGDFAAQRNFALTQTTADWVLYLDADERVSPAAGETMRRIAEENPKAAYEIKRVNIAFGQKMRYGGHRPDLCLRFFPRDAVRWEGLVHERACTELPVRRLTGELYHYTYTSWDRYFQKFNQYTTLMAQRQHAAGKTCSFAKVLLDPPFAFFRFYILQGGILEGRLGFVLGAFHAFYTMAKYVKLYYMQAKD

SEQ ID NO: 1085 - protein, 293 aa, Unknown
  Description of Unknown: Microgenomates group bacterium GW2011_GWC1_33_28 sequence
MDTLKLSVVLATRNEEENITRCINSVKDIASEIIVFDEYSTDKTRELAEKSGAKVFLEPHHDIFHITKQKALEKAKGEWILQLDADEIVTPELAKEIGKVISSDGGPQGLLGGDSNKQKLFLRHQQLIEERDGKIGKDGGEIVGYFIPRRNMFLGKPLIHAGVYPDGVIRLVKNRFARFPQKSVHEQIELDGKVGWLNGDLLHYDSPTLKRYLSRLNRYTDLHAEELRVKKIPKNVLSFLKFTILLPTYYFLLLYIRHLGFLDGVNGFLWSFFSALHFPIAYFKFMTDNKNYD

SEQ ID NO: 1086 - protein, 247 aa, Unknown
  Description of Unknown: Candidatus Microgenomates bacterium sequence
MKLSVVILAKNEAEVIAKAIQSAKLLVPHEIIVIDDASYDGTVSIAKKNGAKVISHQKKDFSEARNFANFKALGDWILYLDADERISEELALEIKDIAAKSSEHGVYSIPRVNFYLGKKWPKVEQHVRLFKKSSLKGWQGNVHETAVIDGEIGFLKGNMLHYTHRNISEMVDNTNVWSELEAKLRFDAHHPPVVWWRFFRVMLTTFWDYYVAQGGWRVGSVGLIESLYQTFSIFITYAKLWEMQKKI

SEQ ID NO: 1087 - protein, 641 aa, Sporomusa acidovorans
MAKISACVITKNEAKNIQRCLQSVKNIVNEIIVVDTGSDDATVSIAERFGAKIFHYQWDNDFAAARNYALTQAKGAWIIFLDADEYITAETIKNVRPVIDKIHSNRKVDAIRCQMNNLEGIDGLLRSSNPSIRIFRNSPVIRYKGRVHEAIYKCGKPVNLINVTNQLIVIYHTGYTNKTIIEKIRRNTVILEAEVKSGVVRDLTYCYLSDGCWRNGQYEKSIEYAKKAIKQLARLSSELDYKPYVFLISSMTHLKTYSEEEVIANCNEAIERFPHHPEIWLFQGLYYRSIGRCEQALTSLLKAIETNACYSDFNRNNDFHALSPDAYLNVAQIYEMKNQSAQAFDCYTKVLQREKYNQNAFNGLVSIIRKQDPAEVIYFLNTLYNIAAEGDIRFLVTNLSHLKVKKVLDYYQQILLDKFGDNKLNGLVLLMNCKFENVFPVLADSFRKHGNYDMELLAVVSLLIGRRPDSMDLLGPQMKTSFRKIITAYFQIDSDIQLTDDDFPLFCDLVREMIYLASQQQMETLLQLGKNFFSDDAYTQISTILMQQRFFDYAVDMILNYINRASLEAKQLSLLYCDAGYCCYKLKDFAGASKYFSQALEFGYNRHYIFDFLEWSYQQCPDEAIKEKLMALKELYSNRNG

SEQ ID NO: 1088 - protein, 265 aa, Prevotella multisaccharivorax
MDQKISVVINTYNAELHLREVLESVKGFDEVVVCDMESTDHTLDIAKEYGCKVIKIARGDFKIVEPARNIAIQSATYPWVLVVDADEIVTPELRDYLYARIKEPDCPQGLYIPRQNRFMNMPMKGRVGDRQLRFFIREGTAWPPYVHATPHVKGKTARIPHLRNVMLRHLNESSLHTVIEKDNRYSDDEVNKRIDKHYGVFTLFYRPAFHFFKNYIIDGGYKNGVNGIIHATLKAFYQFILVAKVIEKREAGLSPSHADAAAPRP

SEQ ID NO: 1089 - protein, 264 aa, Arenibacter hampyeongensis
MLDQREKISALIITYNEMGYIEKCIDSIEFVDEIIVVDSYSTDGTYQYLNNHPKVNVIQHEFDNYTAQKSYALKQATHDWVLFLDADEVVTEELRKEIICKAKKESEHCAYWFYRKFMFQNRPLRFSGWQTDKNYRLFRKSKAQFAKEKIVHETLVVNGTSGILQQKLVHFCYKNYEDYKYKMLKYGRLKAKEAHKKEKKFNYLLLVLKPFWKFFNHYIIRLGILDGKKGITICYLNALGDFERYKELQRLGKKEKMAYFLVKS

SEQ ID NO: 1090 - protein, 264 aa, Unknown
  Description of Unknown: Candidatus Omnitrophica bacterium sequence
MEGDRFPLSVVVIARDEERDLEECLKSARWANEIIVVVDERSKDRTEEIARALADKVFIRKMKNEGEHRNWAYAQARNEWVLSLDADERITEELREEICQRLKKGEKRFSGFAIPRKNFLGDYWIKFGGEYPAGQLKLFKKDLCRLEEVEVHPRIFLQGEWTCLSSPLLHYSSRDISDFIHKFNSQTTLEAEKWWRTNREVCLFHILRRAIDRFFRKYVYKKGYKDGFIGFFLALFAGLYQIVSFAKYIEKKGRLERDEKRSAG

SEQ ID NO: 1091 - protein, 252 aa, Unknown
  Description of Unknown: Flavobacteriales bacterium sequence
MQIQLSVVIITFNEEKNIARCLDSVLPIADDIVVVDSFSTDTTKQICIQKRARFVEHKFEGHIEQKNWAITQAKYQYVLSLDADEALTKELQEVIIEIKNNYQSDAYSFNRLTNYCGQWIKHCGWYPDEKLRLWDSTKGKWGGENPHDKVIMNKGIRVEHINLDILHYSFYTEEQHLKQIEYFTDISSKAAFNKGKKSSSLKIFYKPIFKFFRDYVLKAGFLDGYYGYIVCRNSGYAAGLKYKKIAQLQKEI

SEQ ID NO: 1092 - protein, 261 aa, Prevotella melaninogenica
MEKKEISVVINTYNAEKFLQRVLDSVKDFDEVVICDMESTDHTVEIAQRAGCKVVTFPKGNHTCVEPARNFAIQSAKSPWVLVVDADELVTPELRSYLYQHIDKPNCAKGLYIPRQNRFMNTPKKGFSKDYQLRFFICEGTVWPPYIHSIPQVQGSVEHINNHLYNVQLIHLAENYLADMLEKCNRYTTNEVLKKQGKNYGVGALLFRPFWRFFKSYFMNGEIRNGVTGFIDSVMTGFYQFMIVAKVIEARIKKQSEDEQK

SEQ ID NO: 1093 - protein, 256 aa, Unknown
  Description of Unknown: Chryseobacterium daecheongense sequence
MPQLTEKVSGLIITYNEEKNIREVLECFDFCDEIIIVDSFSTDKTLEIVRTFPKVKVVQHTFEDFTSQRNLALDYATNDWVLFLDGDERITPQLKKEIIEELNKPDKKDAYYFYRKFFFAGKPIHFSGTQTDKNFRLFRKSKARYIEERKVHETLEVNGSIGELKNKLLHYSVTDYESYKKKMIHYGKLKGLELASKGKKYSASTQYFKTAYKFFKAYIMRLGILDGKEGFQLSYLQSLSAFETYESLKNEQKEFE

SEQ ID NO: 1094 - protein, 432 aa, Bacillus thuringiensis
MDIIYDSSTFDLINHKDLCLDLNQLAYLKRMTKYITNISNDIYKNIVTKSLDLKIEDVLDALEALEKIQPITISAIIICKNEEKYIKKCMESIQSCQFDEIIVVDTGSTDNTIDILQSLQEQIPQLKIYHTEWKNDFSKVRNYGLDLAKSEWVFFIDADEYYLNQEEHSIKEIISFFSIYYNDDLCMCPNIINSNNHELYNNPRIFKRAAGYQYYGNVHETLRKNKNSYDFVPNIGLNIKFGHDGYRNDIFITKDKESRNVDLLMKCIEMEPNNPLWKCYLVRDGMRKLSTNYIIQLCEETINLCEARESYFFTYCYYWAHTLLIDLYISMKEIEKTDPLIKNLRKNNAGLDETDIYYREQLIYMIKIEKDLEIKLNEVKKYRENHSKTNGSALNTQGYHLDDLIMRLNYFNHNMDEYHQYKNYLYQLNYLV

SEQ ID NO: 1095 - protein, 266 aa, Unknown
  Description of Unknown: Acidobacteria bacterium sequence
MRTSMPSISAIIITYNEQSDLPEALESLRGVADEIVVVDSGSTDRTGEIAQEFGARVVSRPFSNFGDQKNFAAGQATHDWVLSLDADERLSGELREAIAAWKQNEPDCAAYQINRKPNYLGGWIRHSGWYPEYCVRLYRSDSARFVGALHENVQVNGRVGRLRGDFLHYTVRSLREHYAKMEAFTTRAAEDLYARRRRHWRGGMWLAAPWTLVQRFFFQLGFLDGYRGVLIAWTSARYVWLKYRKLGVLVGGGKLEARPWPQARDV

SEQ ID NO: 1096 - protein, 534 aa, Unknown
  Description of Unknown: Aneurinibacillus sequence
MGTKKAKVSLCMIVKDEEQHLPACLESVQSLVDEIIIVDTGSTDRTVAIAKKYGAKVFHKPWEDDFSKARNVSLKKATGDWILQLDADERLEQEDRRKFQALIQSGTAEGYLFQILNHNFEFTGDVCVFPSVRLWRNRPEYRFVGALHEQITLSIIKRSTTDSLLMTPIRIHHYGYSAAVMQKKRKVERNIKIAEAEVKKHPGHPFHYYNLGTEYLNVKRYLEASQQFQLARKHLQDFQEIWVASLFKNYTSALLAMRNFPEAIHLLDEGIQLFPDFTDLIYLKAVCLFELGEYSQAIEMFHQCLAMGSSPIHKYPSNKALSNEKAHYALALSYRKLNQVDKAVHHFQQAYVCNRKWTEPLYQLFPLLCKKSSVEKATAKLHELVQPAQTVDYMLMAQLLITWYQFTAAKHYLLEAERIEPANQQIFYLAGICALREGNYAQGIYWLERLNKTFPNYGVSRLFLYYCYAASGQQEAALHLMSSIGNNESLLRALAKVYLEEAALLLQEGLFYHPDSSIINKEQIHQILEVMSLA

SEQ ID NO: 1097 - protein, 253 aa, Mangrovimonas sp.
MLKLSGVIITYNEERNIERCLQSLVGIVDEIVVVDSFSTDNTKAICEKYKVTFIEQQFLGYIEQKNFALQQASHDYIVSLDGDEALSETLRDTILKLKDNWQWDGYYCNRFNNFCGQWIKHSDWYPNRKLRVFDRRKASWKGINPHDNVVLHDPKAKTGQLKGDLLHWTYQTYSEFNQKTEYFSSIAAKAYFDLGKKASLWKIVFNPTWAFFKSYVLRLGFLDGLNGLVICIQTANITFLKYTKLRELYKNQD

SEQ ID NO: 1098 - protein, 271 aa, Unknown
  Description of Unknown: Candidatus Gottesmanbacteria bacterium GW2011_GWC2_39_8 sequence
MKISAVVLTKNEEKNIEKCLAGLSWCDEIVVVDDYSEDETLNIIKNLKIKMENDNLKLKIFQRNLGNNFAGQRNFGLSKASGDWVLFVDADERVTKELVQEIQSFNPSTSLRVKDSKLQRLKGFYIKRKDFMWGREMKFGETGDIKLLRLARKNSGKWEREVHEVWNINGVTNTLNAPLLHFPHPDVAQFVEDVNNYSDLNVSALQKTGKKTGFLIIFLWPLCKFSYNFVIKKGFLDGTRGFIAAVMMSFHSFLSRSKLYFRQYGKNNQEN

SEQ ID NO: 1099 - protein, 282 aa, Bergeriella denitrificans
MRIVAGYRVKYSKSCFQTAYAAHSNPKVVIMSTLSVLILARNEERNISDCIGSVAFADEIIVIDDFSTDRTRQLAEEAGARVIQRSMSGDWGGQQTFAVEQARCEWILFLDADERISPELAEEIKTTLKYGQPAAYWIQRHNRFHHNRATHGTLRPDFVCRLMPAAGVTVEGYVHPAILHPYQDKKLRHPMYHYTYDNWDQYFGKFNHYTKLSAEKYRKAGKSVSFTKDILLRPIWAFIKVYIFDKGFLDGKIGWIFAVNHYFYTMTKYVRLYYLYKSDGKL

SEQ ID NO: 1100 - protein, 265 aa, Unknown
  Description of Unknown: Candidatus Roizmanbacteria bacterium CG_4_10_14_0_8_um_filter_ 33_9 sequence
MNKISVIILTKNEEKNIERALKSVQFCDEIIVVNDESTDGTINKILDFKFKTLNKSKIILLKKELKENFAEQRNWAMTKAKNEWILFLDADEEISLQLKNEIVEMVTTNSKKAYSLRRRDYFWGNELKYGEIKEANKKGIIRLIKKGIGKWVGTVHEEFIPNTIGMVGRVKGYINHYPHQTISEFISDINIYSTIRAKELYKNKVHSNIIQILFYPFGKFIYTYFFKLGFLDGAAGFAYAFIMSFHSFLVRTKLFQIQNTNENRL

SEQ ID NO: 1101 - protein, 272 aa, Melittangium boletus
MNGPENSGILLSAAVMTKNSLRTLKDCLDSLDFCDEIVVVDDHSTDGTWEYLQSRGGKVRAFQRKLDTFASHRRAMCSRARGQWVLIVDADENALPGLGEEIRELLSQNPRHDAYHVPQKNTLPDHWPRPVHFWTSQKRLLRLGKVRWADSEWIHVPAIHEGKAGRLKHGLRHRSYDSVSHLLRKQISYAQSGARHFHSLGRRASLMKACTHSTGAFIKFYLLKGLFRFGMGGLTVATALSFHAFAKYAFLWELGSGVAESERELVPGDTRA

SEQ ID NO: 1102 - protein, 245 aa, Olleya aquimaris
MKTLTVIIPTYNEENYLENALRSVRFADQIIVVDSMSTDKTVEIAERYNCKVLSRKFDNFSNQKNHALQYATGEWILFIDADERVPNALKQEIIAAMNSNKHAGYKLNFPHFYMNRFLYNHSDNVTRLVKRDNCKFEGLVHEKLIVEGTIGQLKNPVLHFTYKGLLHYISKKDSYAWFQAEQLLKKGKKATYFHLAFKPFYRFFSSYILRRGFMDGIPGLAVASINAYGVFSRYVKLMLLQRGIR

SEQ ID NO: 1103 - protein, 269 aa, Unknown
  Description of Unknown: Betaproteobacteria bacterium SG8_41 sequence
MSLSVTIITKNEEAAIRRCLQSVAWADEIVVVDSGSTDRTLEVCHEHGAKVQQTSDWPGFGPQKNRALALAGGDWVLSLDSDEWVTPELRAEIERAMAAPGGVAAFRMPRRSSFCGRFMRHSGWWPDYVVRLFRRGSARFSDDLVHERVIVNGTIEKLRAPILHEAVRDLHGMVAKTNNYSTASAVMRHGRGQRGSLTAAILHGLWAFLRTYFFRLGFLDGREGFMLAVINAENSYYRYAKLMMLAKRETGNREQEMGNASPPPSQPSP

SEQ ID NO: 1104 - protein, 250 aa, Thermincola potens
MAEQKISVVIITKNEEKHIEECLESVQWADEIIVVDSFSTDATVEICRKYTDKVFQREWTGFADQKNYGIELSGCPWVLSIDADERITPALKEEITKAMQNDRFAGYYIPRKNYLNSRWMRYAAQYPDYQLRLFRNTARFDGREVHERVTVNGPVGYLKEPMVHCTYQNLDQFVEKINKYTCLEAVERLKKNRDIPIYLFLYLPLRKFFSLYIYRKGYKDGVLGLIISGLAAFYVFLELAKAWEKKNLTN

SEQ ID NO: 1105 - protein, 261 aa, Unknown
  Description of Unknown: Candidatus Gottesmanbacteria bacterium GW2011_GWA2_43_14 sequence
MTNDISAVILAKNSETKIRKCLESLDWCSELVIIDDFSSDKTLEVIDRFKDKNKIRIKIHQHQLKGDFSAQRNFGLSKAEFSRILFVDSDEVVSQELAEEIKNLLKSDDDRIKGYFIRRLDIFLGKKLNYGETGNISFLRLGKKEFGQWEGKVHEVWRIKGQTGNLRNPLLHHPHDTLGSFIGKLNKYTTIVAQSWKEQGKEVGFLEILFYPPGKFFNNYILKAGFLDGAPGLIMAVMMSLHSFLARGKLYLSNLKNVQNF

SEQ ID NO: 1106 - protein, 258 aa, Unknown
  Description of Unknown: Gammaproteobacteria bacterium sequence
MAKISACIISFNEEKKIEECLKSLQPVVDEIIIIDSLSTDDTLKIAEKYTDKIFQQKFLGHIEQKNLALKKASNDWILSLDCDERLSEELQQSILEIKDKLEHADAYRMPRKTFYIYRWLNHCWYPDIKTRLFNRNTSHWGGTNPHDHIVTEGKNIVRLKGDIFHLSFDSISDHLKTIDSFTEIGADELVRKNRTVTIFSPLTHASWTFFKLYIIKRGFLDGFAGLIVSVLSYMHVFIKYSKAHIKYKQLKHEQARNK

SEQ ID NO: 1107 - protein, 261 aa, Unknown
  Description of Unknown: Flavobacterium sp. JRR 20_7 sequence
MTLFKKQALTALVITYNEEHNIKAVLDHLAFADEIIVVDSFSSDATFEIASSFKNVKVAQRIFDDFASQRNYALSLATNSWILFIDADERLTADLKKEINTIINEQNSASAYFMYRTFMFQNKKLRFSGWQTDKIIRLFKKEEAYYNYEKIVHEKLIVNGSIGKLKNKLIHYSYSGYVDYKQKMILYGQLKAQEELAKKTKPQFFHFYIRPVYQFLNQYIIRLGILDGKKGLIICYLNALSVSVRFQELKKLRSKTTISKT

SEQ ID NO: 1108 - protein, 285 aa, Bacillus psychrosaccharolyticus
MLLSLCVITKNEEKNIKKCLESVNGILFEKIVVDTGSTDRTVELAKNSGAKVYDFKWIDDFSAARNYAISKAKGDWILFLDADEYIEPEQSLVLKNLVSIADNEKTECIISKLINYTPHPDRKIIQSVTNTIRVFKNLKNIRYVGAIHEVIQSNQNRPLYSLDASESLTVYHTGYSREEIERKDKSKRNLSLLFKELERRPNNSTTYVYIAESLMLNQKFEEAVPYLIQAKEFINNKNKTLLYKIYSNLLSCMCRPTYDLETLKKDTMTQLCLIEIVQISTTIWG

SEQ ID NO: 1109 - protein, 256 aa, Unknown
  Description of Unknown: Pectobacterium zantedeschiae sequence
MRKRLSIGIITKNESELIEECLQSVNWADEIIVVDSGSTDNTVEIAHRYGAKVYQHDDWQGYGKQRQRAQSYASGDYIFFIDADERVTPELRQSIEDVLSKSNLDDKIVYSCARKNLFLGRFMKHSGWYPDKVLRLYANHRYQYNDNSVHESLDYGDAPVQYLSGDLKHLTCRDFSVFQQKQLRYASAWAKERYIKGKSCSYISIFIHTIFSFLKTWLFRAGFLDGKQGLLLAFVNAQYTFNKYTELWSLNNNENH

SEQ ID NO: 1110 - protein, 267 aa, Unknown
  Description of Unknown: Candidatus Daviesbacteria bacterium GW2011_GWA1_41_61 sequence
MISVIILTRNEEDRIKACLESVKWADEIIVADNDSTDKTLEVVKKYTDKVFVYKGQDFAQLRNMAMGKVSGDWVFYVDADERVLKPLREEVEEITQKGDKSAYAVSRRNIIFGQEVNYGPYKDDWMVRLFKRDKFKAWVGKVHEYGTFEGNLGYTKNSLLHLTHRNIDHFILKSLEWSKIDAKLRLETQHPKMTKWRFLRIFLTELYHQGIKRRGFLSGTVGIIDSILQVFFFYMTYVRLWEMQQTKPLEEEYKEIDQKLMGNDFQY

SEQ ID NO: 1111 - protein, 265 aa, Enterobacter kobei
MFNLSVCLLTCNSARLLREVLPPVLAVADEIVVVDSGSSDATLDICHEYELVVHHHPYAMHGAQMNYAISLATNDWVLCLDSDEVLDAETIDFILRLKAGETPAPDQAWRLSRYWYVLGEEVRTLYPVSSPDFPVRLFNRQHAHFNDRPVDDKVEGFSTSVKIPGRVRHDTFYSLHEVFNKLNSYTSRLVKYQKVKPSIARGIISAIGAFFKWYLFSGAWRNGKVGVVTGLYATLYSFLKYFKAWYIHQDEKAALPKTQKDRRLI

SEQ ID NO: 1112 - protein, 253 aa, Unknown
  Description of Unknown: Chryseobacterium sp. NBC 122 sequence
MLKERISGLIITFNEEKNIQEILDCFTFCDEIIVVDSFSTDKTVEIASRNPKVKIIQNPFEDFTKQRNLALESAKNDWVIFLDGDERITPQLRAEIFKELNKSDKKDAYYFYRQFFFAGKPLHYSGTQTDKNFRLFRKSKCRYTAGKKVHETLEVNGSIGELRNKLLHYSVADYESYQEKMIHYGELKGKELFAKGKKFSSLIMYIKMAAKFIKTYFLRLGFLDGKEGYQLSVLQTLSVYKTYESLKNSEKND

SEQ ID NO: 1113 - protein, 256 aa, Waddlia chondrophila
MISVTILTKNSQKHLKEILDSLHSFDEVVVCDTGSTDCTLEIARAYSNVSLYEKPFAGFGPTHNFASERAKNDWILSIDSDEVPSPELIKEIMEESLDPRCVYSIPRHNFFNGKWIRWCGWHPESVVRLYHRGSTCFSDEQVHEAVIAQGLRVKSFKGALKHYSYDSIDQFLEKMQLYSELFAKQNVGKKRSGLGKAIAHGFYGFFKSFFLKRGFMGGFEGAVISFYNGHTAYYKYLKLREYNRKFFDGQRKTPDF

SEQ ID NO: 1114 - protein, 269 aa, Methylibium sp.
MLPRSSRRTTLSVMMIVRDEADRIEACLQSVAGWASEIVVLDSGSTDGTTDIVRRYTDKLWVTDWPGYGPQRNRALDHCSGEWVLSIDADEVVTPELRDEIDRVLDEPGRDFTVLKMPWKTYFFGRPLKHGRYTSPQAKLFLREGVRYRDHQVHESLLMPRRKDRVLKAPLEHYSWRSYQHVQEKHLKYGCLLAGQKFAKGQRGNLAYAALRFGTDFLQQYLLRGGFLDGSRGFLMAVILGQYAFHKYAALWALEADAATPPSRPPPAP

SEQ ID NO: 1115 - protein, 271 aa, Unknown
  Description of Unknown: Candidatus Accumulibacter sp. SK-12 sequence
MTDPTRLSVIVTTYNNGRTLRACLESVKWANEIVVLDSLSTDDTLAIARNYNTRIHQHRFMGYGPQKQMAVELASNDWVLLLDADEVLSPALQDELRQLLQEAPAADGYEIARQEQLFWRMSHPATRMNHFLRLFDRRQGGVDDMPVHAAPKVRGRIERLKSLLYHFGETDLHAKVEKINAYSTGLVEDKLKRRRWGLPLIMIFYPPWFFLRSYFFKRNFVNGWAGFINSVVAAFYVFLKYAKLYEHHQFARHGTDLFPEGAPPVPAARRD

SEQ ID NO: 1116 - protein, 257 aa, Cupriavidus pauculus
MKISVVLITKNEAHNIRDCLESVSWCDRAIIVDSGSTDGTLEIARAMGAEVHETATWPGFGPQKNLALSKVQSEWVLSIDADERVTPALRDEILAAIDSGRADAYDMPRLSRFCGRFMRHSGWYPDRLTRVFRAGRARFTDDIVHENVVTDGPIGHLQTPLLHYTYDDFSQVLRKIDQYSTLGARQAFQRGKRATVFSAWTHGSWAFLRTWLLRRGFLDGPQGLAVALMNGQASYYKYIKLWLLHQQAKNHPPASAD

SEQ ID NO: 1117 - protein, 263 aa, Unknown
  Description of Unknown: Flavobacterium sp. Kopri-42 sequence
MINNHNTKISILIITLNEENQMKSLLADFDFADEIIVVDSFSTDKTESICKSFDKVTFVQNTFENYSSQRNFAISQAKNDWILFLDADERLTPALKNEIISTVNTNQTYSAFLFYRTFMFKDKVLHFSGNQNDKIFRLFNKNHAAYTKERLVHEKLKVNGKIGLLKNKLIHYSYSNFQAYKSKTIRYGKFKAQEKFLKRQKPSIILHFFHPAYNFLFNYIVRLGFLDGKKGLIICYLNANSVYTRYRELEQLWNTEESLSPKQ

SEQ ID NO: 1118 - protein, 234 aa, Campylobacter lari
MNKLSIVILTYNSQKYIYEVLKSIEFADEVLIVDSGSTDETLSIANNFKNTRIIQQEWLGFGKQKQFGVEQAKNDWIFVLDSDEVFTKNLKEEVVKIMKEPHFKAYKVARLNFFFGKAVKRLGLYPDYNIRFFDKNFARFDDKVVHEGIICHEKIGTLKNHFIHYAYENIEQFIEKQNKYSSLNSNKNNFFKAIVNPYWTFFKMYFIKKGFLEGKQGFVIAKLYAQYTFWKYIK

SEQ ID NO: 1119 - protein, 260 aa, Unknown
  Description of Unknown: Candidatus Regiella insecticola LSR1 sequence
MSTKKSLSVIILTKNEAPLLADCLLSVAWADEIIIVDSGSEDETLSIAQRYGAKIYTHTDWQGFGKQRNIAQQYAKGEYLLMVDADERISPLLKNSIEAVLMAPDDNAVYSCSRRNLFLGRFMRHSGWYPDRVVRLYPPQYQYKEDYVHESLMCGSAKIIPLKGDLLHLTCRDFSDFQQKQLNYAKIWAIQRHQQGKSCHYLAIFAHTLWAFCKTGLLRAGFLDGKQGLLLACVNAQYTFTKYTALWSLNQIDRFRNRNQ

SEQ ID NO: 1120 - protein, 253 aa, Unknown
  Description of Unknown: Chryseobacterium piperi sequence
MPELTEKVSGLIITYNEEKNIREVLECFDFCDEIVIIDSFSTDKTLEIAKTFPNVKIIQNKFEDFTKQRNLALDNARNDWALFLDGDERITPQLRSEIVEELNKTDKKDAYYFYRKFFFADKPINYSGTQTDKNFRLFRKSKARYIAEKKVHETLKVEGRIGEMKNKLLHFSVSDYESYKKKMIHYGVLKGQELALKGKKFSKLTQYSKTAFKFFKAYIMRLGVLDGKEGYQLSYLQALSVFETYESLKKEQN

SEQ ID NO: 1121 - protein, 252 aa, Unknown
  Description of Unknown: Chryseobacterium piscicola sequence
MKLSVAIITFNEDRIIEKTLSSIYHIADEIVIVDSFSTDKTVEICKNFSKVKLIQHTFEGFGKQKNFAIDQCSGEWILFLDADEIPDEIAKSSIVKIISQEKLNLSVFNIAFNNIFLGKSLKYGGWGNIKRERLFRKDAGRYSEDIVHEYFLTTEKIGLLEGNINHYTYKDIHHHIEKSNKYTTMMAEKMYNRGKKYSVLKIIFSPIYQFIKSYFIRLGFLDGLVGYYAAKTAGFYTFLKYQKLYELHNVKK

SEQ ID NO: 1122 - protein, 255 aa, Unknown
  Description of Unknown: Candidatus Woesebacteria bacterium GW2011_GWA1_37_8 sequence
MNKKTISAVIIAKNEEKNIDDCLKSVTWCDEIVVVDTDSTDKTVKIAEKFTNTIYKTKGGNYSDWRNLGLEKAKTDWIIYIDCDERCSDKLKNEILEVINSETKYSLFVIPRQNIILGRLMKHGGWWPDYVKRLYKKNHLKKWTGDLHEEPIYLGKLGYLENPLIHLKHNNLTDMLEKTNTWSAVEAQLMFKANHPKMNTVRFITAMSRELWKRLFVEKGYLDGQEGIIYSIYQMYSKSISYAKLWEMQENKLKI

SEQ ID NO: 1123 - protein, 253 aa, Maribacter ulvicola
MNKATPKISALLITFNEEDNINEVLANLSFADEIIVVDSYSTDNTLKLIRENKNVKLICRKFVNYTDQKKYALEQANYDWILFLDADERITPSLKDEILKVITEPDAASAYFFQRTFMFKTKKIYFSGWQSDKNYRLFRKSKVHFDQDRIVHETLVVDGASATMKHKLLHFSYKNYEDYKGKMLKYGRMKAKEEAKKGKKARWYHFIFRPLYKFINHYIIRLGILDGKKGLIICYLNALGVYARYKELKQLQS

SEQ ID NO: 1124 - protein, 258 aa, Unknown
  Description of Unknown: Marinilabiliales bacterium sequence
MVNISVVIIAFNEERDISRCLKSVVDIADEIVVVDSFSTDKTVEIAKSFGSKVITHEFNSYIDQKNYALKQAEYNIVLSLDADEELSKKLKNSILEVKKQGFDYDGYSMNRLTRIGDKWINHSGWYPDTKLRLFDKTKGKWAGLNPHDEFVYYDKSNIYKLNGDLLHHSFYSFEELKKQSDKFAKLGAKAYYKKGKKAPFLKIIFNPALRFIRDYFFNKGFLHGINGIRVSYNNSHSTYLKYKYLHAFYTEKQDEKEN

SEQ ID NO: 1125 - protein, 298 aa, Unknown
  Description of Unknown: Microgenomates group bacterium GW2011_GWA2_39_19 sequence
MNAMLYRLSHEPLYLYFTSLGVVESRYNGSLFLLIMITAIVLAKNEEKNIERCLKSLKWCDETIVIDDFSSDRTLEIAKKFNATIYQRILENDFSSQRNFGLSRAKGDWVLFVDADEVVESSLKDEISSKILASPFEGFCIKRKDFMWGKELKFGETASLKFVRLARRDAGKWIGIVHEEWKIRGKVGEFDGFIEHYPHQILGEFIKEIDYYSTWHAKSKFDKGERSSLVKILVMPKAKFFQNWIIRGGFRDGTEGFLVSILMSFHSFLAWSKLWLLERKVSRGLRQVPLTHDTCSAF

SEQ ID NO: 1126 - protein, 268 aa, Unknown
  Description of Unknown: Kiritimatiellales bacterium sequence
MKITAYIIAYNEEEKIADCIGSVLWADEVIVADSFSEDRTAEIAESLGAKVVQIEFNGFGALRNEAIKHCSHEWIYSLDSDERCTPEVRDEILELIQDAPLDIYRQPRRNYFMGRWIRFSGWYPNYRQPQLFRNGKMTYDLKPVHEGFVSHSDKPIGALKCAIWQFPFKDLDEVLHKANRYSRLGVAKLEERGKKGSLGKAFAHGFWAFFKHYFLKLGFLDGGAGFVIAAAYFDQSFYRYAKLTEVQSHGWPPPEAKPVLRKDAGADV

SEQ ID NO: 1127 - protein, 254 aa, Unknown
  Description of Unknown: Alphaproteobacteria bacterium sequence
MKKISAVIVAHNEEKKIKDCIQSLDFVDEIVVVLDKCSDNTKQIVQQFNVVICEGSWNIEGMRRNCGLNLAQGQWILEIDADERVSKELKEEILEVIKTANPCGFEVGIANFVGERWIKYGWLRTMGVLKRHSLSYRGLKKYHEDKEIHPTFSFDGKVYDLQNYIIHLVDDNIADLWLRFNRYTNWRANDMFLKKQKLPNFLKLVISAEIRFYKSYFFKKGYKEGVLGVLIALLCALYPIVSYLKLKEKINENS

SEQ ID NO: 1128 - protein, 252 aa, Pseudogulbenkiania ferrooxidans
MSSALSVVLITKNAAQQIAACLESCRFADEIVVVDSGSSDDTIAIAKSYNAKVIHQDWLGFGPQKQFAVQQARHDWVLCLDADEWLSARLSSEIKDLPDNPQAAAYRFPRSNKFMGRFLRHGEGYPDLSLRLFDRRRARWSDHAVHEYVIADGPVENLKGDLMHESGEDIALYLTKQNRYTDLQAQALFERGKRVGWPKLVFSPLLRFFKFYLLRQGFRDGVPGLVHISIGCFNSYIKYAKLIELHRLENTQ

SEQ ID NO: 1129 - protein, 249 aa, Unknown
  Description of Unknown: Flavobacterium sp. A5.7 sequence
MSTKNKKLSVIILTYNEESHISDAIKSVAFADEIIVLDSHSTDATAEIVIDLGAELLFRKFDNYSNQRNHAIESAKGEWILFLDADERVTPELRDEILESIHSNKSDAYRIWFPHFFMDRFLFHYTDKVTRLMKNENLRFENEVHEKLVVKSKPPVLKNYMIHYTYKGLFNFIYKKDKYAWFQAKMSHQKGKKATLFLLFFKPFYRFFHTYFVKRVYLDGVPGLAAASIDAYGVFSRYAKMVLLEKDLE

SEQ ID NO: 1130 - protein, 287 aa, Unknown
  Description of Unknown: Deltaproteobacteria bacterium sequence
MPLRPSPMYGGGDGRGGLRGGTGDAMMEGNKVSVYIITYNNERTIERCLKSVTWADEIVVVDSYSTDRTLEICRRYTDKIYQRRWTNYREQYQFAADKTTNRWIMFVDADEEVSPELAREIREEIAKNDGRWAGYIAHRRTYYLGRWIKHGGWYPDYEIRLYDRSRGKWEGGLHAKVKVDGEVKVLKNFYFHYTYKDISDQLRTIDRYSEVAASDMWKEGKRFSLFDLLLRPPFRFFRDFILKRGFLDGFPGLIIAVLTMFYVFIKYAKLWEIEKGLKEGDGLPPRV

SEQ ID NO: 1131 - protein, 263 aa, Unknown
  Description of Unknown: Flavobacterium sp. A45 sequence
MTNSNAKKLSVLIITLNEEEHLKGLLSDLNFADEIVIVDSFSTDGTEIIAKTFPKVKFIQNKFENFSAQRNFAISQAKNDWILFLDADEILTPELKQEIIETLQNNQTYSAFFFERIFMFENTVLKYSGNQTDKIFRLFNKKSAKYDEKRLVHEKLIVNGEIGFLKNKLIHHSYSSYDDYREKIIFYGKFKAQEKFIKKVKPTFFHRFFHPSYNFLYNYFIRLGILDGKKGIIICYLNAYSIVVRYKELKKLWKQNQLPISKT

SEQ ID NO: 1132 - protein, 251 aa, Unknown
  Description of Unknown: Chryseobacterium gleum sequence
MNLSVAIITYNEERIIEKNLQAIDALADEIVVVDSFSTDKTREICEKYSKVKFIQKKFEGFGQQKNFAIDNCSGSWILFLDADEIPDEDAMKSIKKVLHSHHPFFNVFEIHFNNILLNKVIRYGGWGNVWRERFFRKGHGKYSDDLVHETFITKDKKGKLDGNINHYTYKSINHHVEKINNYTQLMAEKKVLSKKKVSLFKIIVSPFYEFVKIYFLRLGFLDGIAGFYISITGAFYTFLKYIKMNEILKAK

SEQ ID NO: 1133 - protein, 253 aa, Unknown
  Description of Unknown: Desulfurobacterium thermolithotrophum sequence
MSLSVGILTFNSERYLKEVLESVKSIADEIVILDSGSKDRTIEIAKSFGAKVFFRKFDNFVSQKNYLLSLCKKEWVLFIDDDEVVGNELKAEIERVKKEGSFDGYYVNVLTNYLGRWIKYAWYPDWHLRLAKREKCKWIGDLVHESLKVDGKLGYLKGNLLHYSYPSISHHLKKIDLYTSLYAEGVYRRGKKFSYMKLFLSPLGAFLRRYIFKKGFLDGFEGFVLSVMSSYYTFLKYLKLWEKEKNEKTFHSR

SEQ ID NO: 1134 - protein, 260 aa, Rheinheimera aquimaris
MRSRKISCFVICCNEEDRIEACLQSLTGWVDQLIVVDSGSKDNTVAIAERYADKVYQTDWPGFGPQRNRALAWCEHDWVLSIDADEILTPELKLEIDRVLSEPELDANFIKMPWHTYFFGKLLKRGRYSTPQGKLFLKTGASFKDRQVHETLLLPYEKVRVLKSAIIHHSWRSYQHCQEKHIKYACLGAEDKFARGKKAGLAYAILRFFIDFLQQYVLRLGFLDGWRGLLMAIVLGQYAFHKYAALATMVADAKANKVSG

SEQ ID NO: 1135 - protein, 247 aa, Myroides sp.
MMKLSVIIPTYNEEKYIADAIKSVSFADEVIIIDSYSNDATVEIAKELNCTVLQNKFKNFSTQKNFAIPHAKGEWILFLDADERVTKSLQTEILDAIATPGEFTAFKLRFPHFFINEFLFHKADKVTRLVLNKEVHFTGEVHEKLHTTAGKTGILKHHVLHLTYKGIFHYMAKKELYSWFQAAELFKKNKKVTYYHLAFKPFYRFFHIYFIKRGYLDKTAGLAGAALDAYGVFARYLKLMLLQKGLK

SEQ ID NO: 1136 - protein, 257 aa, Unknown
  Description of Unknown: Bacteroidetes bacterium sequence
MSHPLSVIVTTYNEADHIGRCLASVQGLSDDVLVVDSFSTDATVAIAHTHGARVEQRPYQGPAEQKNWAIPQARHEWVLLLDADEVVTPDLRDELTQLLANDVPPAAAAYWIGRNNYFLGQRIRFSGWQGDRVVRFFHRDRARYADVQVHEEIITDGLPTGSLRGRLEHYTFRNLDHYLDKTRRYARWSAQDHAARTPRVGYYHLWAKPTFRFFKHFVIQQGFRDGKVGFIVSAIMAWGVFLRYAYLAGQQRQRPAG

SEQ ID NO: 1137 - protein, 295 aa, Aerococcus urinae
MATLPDRHSFPRRSSRPLVAASMIVRNEERHLPDCLSSIAGLVDEIVIVDTGSTDSTIDIARSFGAKVLESPWQGDFAAPRNLSLDNCSSEWILYIDADERLRGIDRAGLEAALSEPGRVCLRPWLRPRIGYTPYREYRLFRNDPRIRFRSKIHESIVPGIEAVAASDGLRVGAIEAVLEHVGYEGDQTAKHRRNLPLLREQVMHSPDRIFLWWHLGHVLEGLGQIEEAEEAWAHGVELARRDVDGTTDALAYLSLIGSRVDRGEDVSALLADAKRRFPTNHYLRFLEARHHMNG

SEQ ID NO: 1138 - protein, 616 aa, Bacillus firmus
MPPFISLCMIVKDEEKVLDRCLTSVMGIIDEIVIVDTGSTDNTKNIAIKHTDFVYDFEWTNNFSEARNYAASKATGEWILVLDADEFVDPENLKQSISEIKQHDNQYGIYAVNIINFAGEKGESIAQHKHGRIYRNDGNIEFYRSVHEQLRAKHGSVNFAVSSLVIYHSGYLSNIVREKEKITRNSTLIQNELGNSTSVAFDYFNLGNEFKREGKMEEALDSFIKAYKEKNSNQLSWVSFCLCNIVECLISLKRYDNALEVIKDAEVVYSNSADFTFFKGEIYLLQHRYKEAKRIYSSLIRNSKKYYDIIKSPDFLEYYPYRRLGYIFELEGNLKESVKSYANAINIKSDCLESTFRLVKLLAKHHNDKEIFEFLSRSILHGKMSDRYFIQLIKLFLNQSLFKLCQMIGAKYLADDELIINLLQFKGQIISGEYRKEMFETIDTTFILSGLNLGLLDLNDLFIFFNDLGTAPSTIKNSVKVILNTNSVYEMLINGLIYNQSLKTEEIDTSIYLSLLEKCLIFNKVQLLENLIVHQETWNLHLDAKIASIFYRNGYEDLSINFYQKAQEEDLTEEDFNLIIKYLIKNDNELEAKRIAKIAFNIFDKDPQFERYLKQI

SEQ ID NO: 1139 - protein, 270 aa, Unknown
  Description of Unknown: uncultured bacterium sequence
MGISVVIHTYNADKYLEECLQSVSSVEEIIICDMHSTDRTIEIAQKYGCKIIYHENLGFADPARNFALSHATQDWVLVVDADEIITKELLDYLREVTQKPDCPDCYQIPRKNYVFGKFMRSLYPNCILRFFRRGNVSFSKHVHCTPDEIKGKEIKIDPKREELAMIHYNYDTVASFMSRTNTYTSLEIEKMVKRGFKFSLKFLIFRPLGEFIKRYFLKSGYKDGLHGFIVAYLLAMYETIAIIKLWEYEKNQKLVKKENPVPEKIEETVF

SEQ ID NO: 1140 - protein, 262 aa, Idiomarina planktonica
MQNEIPKISCFVITLNEGRYLDEVLESVRGVDEIVVVDSGSTDDTLEIAKRHGARIIHNDWPGYSKQKAFALEQCTHNWVINLDGDEVLPPGGFEMIQQRIAQGDINGIWVAHDDIFMGHSLRAARHHKYRRVYRKDKAHMNTAVLVHEHIEVEPPLAELPIRFKHYGYDSAHGYMDKLNTYSLLKAKQREEQGRGCSLPRLLLIYPLMFLKFYLGRQMIWSGWRGFIKANIDAFHFFLTEAKLYEREYRRKRGDDISRSEG

SEQ ID NO: 1141 - protein, 276 aa, Unknown
  Description of Unknown: Flavobacterium sp. 245 sequence
MSKIPISVIVSVKNEALNLPSCLDKLKRFDQIIVVDSGSTDDTIIIATALGAEVLQFQWNGKFPKKRNWALQNADIRHEWILFLDADEFVTDEFVSEIAIKTQDPSYNGFTIHFQNYFMGRKLKYGYGFKKSALFRKSKGAYEKIEEDLWSHLDMEVHEHPIIEGKIGIIKAKVAHKDFKNLEHYIAKHNAYSTWEAQRYLQLKETKNVLLSINQKIKYGLLNTGLLPVVYFLGAYVLKLGFLDGKEGFYLARFKSHYFFQIQTKVDSIRNNIELK

SEQ ID NO: 1142 - protein, 246 aa, Marinomonas piezotolerans
MIENVSAVLITKDVEHCIEKALDSLSDFQEVIVYDNGSTDRTLDIINSYSNVRCIQGEFLGFGPTKRKAVSYASNDWVLSLDADEAVSPELIGNLSAFIDTDPNVVGIIWRHNYFLGKRVRYSGWGNDWLVRLFNRQRHNFNEAMVHENVELSSASVRQRIDGVIVHDAVVDVGQMLEKVARYSSIRASTQRKRYSISMIVFKSIFAFFRTYVLRLGLLDGKAGLVISVSNANGVFWKNIKRYFRA

SEQ ID NO: 1143 - protein, 245 aa, Unknown
  Description of Unknown: Flavobacterium sinopsychrotolerans sequence
MRMLSVIIPTYNEIDYIEDAIKSVAFADEIIVIDSYSSDGTKEKSLSLGCTVLERKFDNFSNQKNHAISYAKGDWILFLDGDERVSQKLKLEILSVIKNGKHSGYKISFPHFYMNRFLYHKVDRVIRLVKNKNIKFTGDVHEKLVVEGSIGTLKNFMIHYTYKGLSNLLQKKDSYAWFQAKTSYERGKKATYFHLIFKPFYRFFSSYILKRGFMDGVPGLALASINAYGVFSRYVKIILIQKGLK

SEQ ID NO: 1144 - protein, 249 aa, Methylomonas sp.
MLSVIVITKNEAQHIGRCLASVAWADEIIVLDSGSSDETVAICRQFTNKVFITDWPGFGPQKQRALDKARGDWVLSIDADEEIGPALKAEILQAMQQNEVQGFEIPRLSSYCGKPIKHGGWWPDYVLRLFRRDVGRFSSEVVHERIEVKGAILRLNNPLWHEAFVDPAEVLHKINAYSSLGAEKMFKSGKRASLGKAIGKGLWTFIRTYFVQAAILDGAEGLMLAISNAEGSYYKYLKLRELCSKSASK

SEQ ID NO: 1145 - protein, 312 aa, Oscillatoria sp.
MTSKQSKIPVSVLIPAKNEEANLPACLASVARADEVFLVDSQSGDRSCEIAESYGANVVQFYFNGRWPKKKNWSLSNLPFRNEWVLIVDCDERIPPELWDEIAGAIENPNCNGYYLNRRVFFLGTWIRHGGKYPDWNLRLFKHEKGRYENLSTEEVPNTGDNEVHEHVILQGQVGYLKNDMIHEDFRDVYHWLERHNRYSNWEARVYYNLIAGTGDAGTIGANLFGDAVQRKRFLKKLWVRLPFKPTLRFILFYVIQLGFLDGRAGYIYGRLLSQYEYQIGVKLYELSKFGGQLNVSAAPGQKPQAVPVKES

SEQ ID NO: 1146 - protein, 281 aa, Unknown
  Description of Unknown: Candidatus Rokubacteria bacterium sequence
MAPAGAREPGWPARVPRRRGGLRRGPGGALSVRPRISVVVVTLNEEERLRGCLESAAWADEVIVVDAESADKTVQVAREFTDRVFVQPWPGFAAQKNFGLEQATGEWVLSLDADEEVSPELRDEIRAALATATPCAGYRIPRRNIMWGRFMRHGGLYPDWQLRLFRRGRGRFVERAVHESVEVTGEVERLGAPLVHRSYRDISDFLTRADRYSTLAAEDWVRSGRRPRTRDLILRPAGRFLSMYVVHGGFRDGWRGFLLAVLYAYYVFIRSAKVWERTRLE

SEQ ID NO: 1147 - protein, 276 aa, Tamlana sedimentorum
MILDLTIAIPVKNEEKNLLGCINAIGKDFAKQVVIIDSGSTDNTISIAESQGVDVVNFNWDGKFPKKRNWFLRNYNLTTKWVLFLDADEYLTDAFKTEIQQKINTDKIGFWLNYTIYFMGKKLKGGYPLNKLALFQVGAGEYERINEDKWSNLDMEIHEHPILNGEIGYIKSKIDHRDFRGVSHYMNKHNEYASWEAYRYIKTINDEEAKAKWTWKQKIKYKLMRSSLIGPIYFIGSFVFYGGWKDGATGFAFAILKMSYFTQIYCKIKELSNNEK

SEQ ID NO: 1148 - protein, 240 aa, Unknown
  Description of Unknown: Bacteroidetes bacterium sequence
MTSSSKISAVIATYNEEEHIRECVESLLPVVEEIIVVDSFSTDKTQEICLELGVKFLQRPWEGFSSTKNWANQQASYPFILSIDADEVISKELGTSLIKAKQELLDEHKVYKFNRLNNYCGMWMRYGGWYPDTKVRLFSNANAIWEGDVHERLIFDYPISEQLLEGDLLHYSIKDKADHIARVKKYCKLEKAFSNQFWALLSAINTFIRIYILKKSFLAGRLGYQLAFISALAKFWRGKT

SEQ ID NO: 1149 - protein, 316 aa, Pleurocapsa sp.
MSAKPEKVPVSVLIPAKDEEQNLPACLESVARADEIILVDSQSSDRTCEIAESYGAKVVQFYFNGRWPKKKNWSLDTLPFRNDWVLIVDCDERITPELWDEIAQAIKDPTYAGYYLNRRVFFLGKWIRYGGKYPDWNLRLFKHKLGRYENLKTEDIPNTGDNEVHEHVILEGKAGYLKYDMLHIDFRDIYHWLERHNRYSNWEARVYYNILTDSDESGTIGANLFGDAVQRKRFLKKIWVRLPFKPLLRFILFYVIRLGFLDGKAGYIYARLLSQYEYQIGVKLYELQQFGGRLNIPTPAQDSLSQTSPEPAELAN

SEQ ID NO: 1150 - protein, 259 aa, Aquimarina muelleri
MEKNTLHREKVTAIVPCFNEEHNIKEVLESVSFADEIMVVDSFSTDRTVDYAKEYTDFIIQRKFDYPSTQKNWAIPQATHRWILLVDADERVTPELKNEVLEILKNPGKDDFVAYWIKRMNHFMGERIHYSGWRNDKVIRLFHRDKCKYDNRHVHEEIVTEGKVGMLKNKFYHNTYTTFDAYINKLNRYATWQAKDYHKKTKYLTPYHFIIKPLWSFFKHYIIQSGFRDGVPGLVIGYVQGYAVFMRYVKLWLFRRDRK

SEQ ID NO: 1151 - protein, 299 aa, Nesterenkonia sp.
MGRQSDSVRCRSFRRSVFVKRISKISAIVLTKNEEAGLGNTLENLKDFEDVIVVDSLSEDRTLEIAVNHGARVVHFEWNSEYPKKKQWSLENANPLNEWILLLDADEFPTASLINELVDLQYSIESSSHGAFDINLLYRFAGRYLRHGHVVTKRSLLHIDRASFPVINDLDAPGIREVEGHYQPETAFKIGKLRNRLIHDDRDPVSSWFARHNRYSDWEAHLRLNQRLRKEIASKRTFKGRMFDMLPLKPILFFGYAFILRGGFLDGRAGMDYALALSAYYWQIGVKYRELVGLAESEI

SEQ ID NO: 1152 - protein, 268 aa, Selenomonas sp.
MRRHNIGEGRRVRLAVIILTHNEEHHIEACIQSASFADEILVIDDMSTDRTAELAQSLGARVVTHPLAGDFAGQRNFALTQTDADWVLYVDADERVNEGTEAELRRIMAADVRAVYEIKRINVVFGQRMCCGGHRPDYPRRFFPRDAVHWTGLVHERTESELPVRRMGGSLLHHTYESWEQYFQKFNQYTTLMAERQHREGRHASFLKILLDPPFAFFRYYILQCGFLDGRIGFILAMFHGFYTMAKYVKLHDLTMNGDRNVYEDRHI

SEQ ID NO: 1153 - protein, 259 aa, Lewinella nigricans
MQALSVIITTYNESTNIREAMASVQWADEIIVVDSYSTDGTPDVAEKLGAKVYERSYSGPADQKNWAIPKARNEWVLLLDADERLTDKLTEEIKSLLSGPEIDQDCYWIPRQNYFLGKRVRYSGWQGDTVIRLIRRDACRYDEKQVHEEIETKGLRVGKLKHKLLHYTFKDSGQYLDKIRRYGEWSALDHFEKTPRVTYYHLFIKPLYRFFKHFVIQRGFLDGRVGFIVSTIMAWGVFLRYLRIIELRKRDQPEDDVMG

SEQ ID NO: 1154 - protein, 272 aa, Parabacteroides goldsteinii
MKKIPVTVIVPVKNEEKNLSKCLSLLDDFSEVIVVDSHSTDHTPDIVKGFGFKCIDFSWNGQYPKKRNWVLENIPLENEWVLFLDADEYITDLFKEDLIKSIDTSNFNGLWVYYVNYFMGKQLRYGVKMRKLALFKKDKGKYEWIEEKSWSHLDMEIHEHPIVEGNIGAIKSPIIHMDYNGLEYYISKHNAYSTWEAKRYLNLTGLKKEFTWRQRIKYSLLDTWFYWIIYFLYSYFFCLGFLDGKTGLLFNLFKMQYFFQVKCKILELRGKY

SEQ ID NO: 1155 - protein, 257 aa, Unknown
  Description of Unknown: Latescibacteria bacterium DG_63 sequence
MRAKVTAIIPTFNEEANIRECLESVSWADEVVVVDSFSTDSTVEICREHGVTVVQHEYLNSASQKNWILPRVSNTWVLIVDADERVTEPLRKEILSILGSEPECDGYWIRRRNRFFGKEIRFCGWQRDKVLRLFDRDKGRYEEKHVHAEVSIDGRTGVLSGHLLHDSYRSFSSYLTKLDTYTDWGAQDDAQGGGRFVTARLLLRPPARFVRMYVLQLGFLDGLEGFILCVLAATSVFIKYAKLWRMLHLSAGQKQGS

SEQ ID NO: 1156 - protein, 257 aa, Parabacteroides sp.
MKISVVINTYNAEKYLERVLKAVKGFDEILICDMYSTDNTIPIAQKYNCKIIYHENIGYVEPARNYAIQSAKYPWVLIIDADEIVPPALKDYLYKRIQEENCLSGIRIPMKNYFMGRFMHCVYPSYLLRFVKKENTYWPSSIHSQPQIKGKIEVIPSNRKDLAFIHLANDSVSTNIRKTNQYTDNELDKRKNNKYPFWSLIGETTFRFFKLYILKGGFRDGKAGLTYCGLNAFYKFATIAKIWESRISENEIDPELK

SEQ ID NO: 1157 - protein, 249 aa, Unknown
  Description of Unknown: Microgenomates group bacterium GW2011_GWC1_38_12 sequence
MKISAIVLTKNEEDNIEKCLKRLTFCDEIIVIDDNSTDDTAVLAKNIGAKVYSRSLNGDFASQRNFGLEKAKSEWVLFIDADEIVTPSLREEIKQMWNEQIYKYSGFYIKRQDFFLGKTLKYGEAGNIKLLRFARKGKARWKRKVHEYWDIDGKTKTLENPLVHNSHPNLKQLINSLDSWSNLHALENKSEGKSSNLLKIITFPSAHFVKNYFFKKGFLDGVHGFTFAIFISFHSFLSWSKLWLNQKKD

SEQ ID NO: 1158 - protein, 492 aa, Selenomonas sp.
MKISACVIAKNEAENLPRWLASARVFADEMIVVDTGSTDATAEIARAGGAEVYRFAWTNDFAAAKNFALDRASGDWVVFTDADEYFSEESAPRVRALIEEHDAAEGLDGFIVHLVNIDMETGALLGTTAKVQRIFRRAPWLRFVGSIHEHVENLSGDPAREMMFAQDLTLYHTGYSPQVMRKKSERDLRMLLERRAAGQCDKMDAYHLMDCYYTLEDYEKAAAYAREAMALREQPVGGEERPHTVLLQSLILMGAGDTEIDAAYEAAARRFPQTADFPLIYGTYAWDRDYIAAARRAYAEGVRLHEEYYREGAYSGVLAPLAYERLGTAAELCGEQEAAAAFYIRSLRAKKRHLPALKGLLRLFSETGAAAADVIAALRGLYDEEADAGFLAEALTDTPFPYAALYYEKRSAAKFTPRRRLLLTGEVCAAAASLIEETERAAALAAAYLEAFSPEEQARIALLLPRSCREISAAPEDLRMRRRIGRLAKENT

SEQ ID NO: 1159 - protein, 314 aa, Gloeothece verrucosa
MSIELNKIPVSVIIPAKNEELNLPACLESVARADEIFVVDSQSSDHSGEITRHYGANLVQFYFNGGWPKKKNWSLENLPLRNEWILIVDCDERIPSELWDEIAIAIQNPEYNGYYLNRKVFFLGKWIRYGGKYPDWNLRLFKHKLGRYENLKTEDIPNTGDNEVHEHVILQGKVGYLKNDMLHIDFRDIYHWLERHNRYSNWEARVYYNLLSGQGNEGTIGSNLFGDAVQRKRFLKKIWVRLPFKPLLRFILFYIIRLGFLDGKAGYIYARLLSQYEYQIGVKLYELRNFGGALNIANLSQSAPVQAKSEVLTR

SEQ ID NO: 1160 - protein, 258 aa, Unknown
  Description of Unknown: Chryseobacterium gleum ATCC 35910 sequence
MYFSIKQSVVMNISGLIITYNEEKNIQAVLESFDFCDEIIVVDSFSTDKTVEIAKKFPHVKVIQNKFEDFTKQRNLALDAATNDWVLFLDGDERITPALKQEIIDELKKTGQKDAYYFYRKFFFAQKPIHFSGTQSDKNFRLFRKSKARYMAGKKVHETLEVKGTIGVLKNKLLHYSVSDYESYKEKMIHYGVLKGKELAAKGKKYNVLVQYLKTAFKFFKAYIMRLGILDGKEGYQLSYLQSLSVYETYESLKKEQN

SEQ ID NO: 1161 - protein, 245 aa, Ulvibacter sp.
MATLSVIIPSFNEAAFIEDAIRSVAFADEIILIDSYSTDETVAIATPLVTKVVQREFDNFSNQKNYALEHATCDWVLFLDADERVTHSLEAEIKATIAAPKHGGYKINFPHFYMNRFLYHHSDDVLRLVKRENAHFSGLVHEKLHCEGSVGKLTHKMLHYTYKGLNNYIAKKESYAWFQAEQLQNKNKQVTWFHLFFKPMYRFFSSFILKGGFRDGVPGMTVAAVNAYGVFSRYVKLMLLNKGMR

SEQ ID NO: 1162 - protein, 321 aa, Limnothrix sp.
MTIHPQQITSNTVPVSVLIPAKNEEANLPACLESVARADEIFVVDSQSDDRSVEICESYGATIVQFQFNGRWPKKKNWSLENLPFRNEWVLIVDCDERITPELWDEIAEAIARPGFAGYYLNRRVFFLGKWIRYGGKYPDWNLRLFKHQSGRYENLGTEEIRNTGDNEVHEHVLINPSHGQVGYLKEDMLHIDFRDIYQWLARHNRYSNWEAQVYLNLLEGRGKDGTLKGNLFGNAVERKRALKRLWVRLPMKPFIRFVLFYIIRLGFLDGYPGYVYGRLLSQYEFQIGVKLYELRKSGGQLNQQQKPKSSPRSASSSIHS

SEQ ID NO: 1163 - protein, 271 aa, Nitrospira japonica
MAGYSVYVIAYNDEPNMRACLESVAWADELIVVDSHSTDRTAAIAREFTDKVYQVEFNGFGRLRNQAVAHCSHEWVFSLDSDERMTPELREEIQRLLDQRPEADAYFVPRKNYFLGRWIEHCGWYPDYRQPQLFRKNRFRYREELVHESFECDGPVAHLTQPALQYPFRDLDHYIQKQNRYSTLMAERMVEQGRRFSILQLFTHPFGAFAKMYVQRRGFLDGMPGLILSGLYAYYTVMKYAKFWELTDGPTSTRSSAPRAASSGNRPGDAA

SEQ ID NO: 1164 - protein, 313 aa, Calothrix sp.
MSNKLPVSVLIPARNEEANLPACLASLQRADEIFVVDSQSSDRSVEISEKYGAKVVQFYFNGRWPKKKNWSLENLPFRNEWVLIVDCDERITPELWDEIAAAIQNPEYNGYYLNRRVFFLGKWIRHGGKYPDWNLRLFKHKLGRYENLNTEDIRNTGDNEVHEHVVIEGKIGYLQNDMLHEDFRDLYHWLERHNRYSNWEARVYYNILTGKDDNGTIGASLFGDAVQRKRFLKKIWVRLPFKPFLRFVLFYIIQGGFLDGKAGYTYGRLLSQYEYQIGVKLYELRNCNGQLNTAKSNPSPTDTLLPEAGQSAI

SEQ ID NO: 1165 - protein, 255 aa, Unknown
  Description of Unknown: Candidatus Shapirobacteria bacterium CG_4_10_14_0_2_um_filter_ 40_12 sequence
MSNISLLLLTKNESENLKRWKKWLPKLKRVDELVVVDDNSTDDTKKIVNNFQSEKLKINLFNRGLEGDFSTQRNFAISKAKNEWVLFIDADEEPSDKLIRFLNTEELNPKICFAFKRHLIYIDQVVAHGQAQKDYPIRLFTKNSGEFVNPIHEVWKTDSCVVRINKPLYHYSAPNLKTFINKLNTYSTLRAKELFEKHIPVNLFQIIFYPLAKFIQTYIWHLGFLDAIPGIIICTSLSFYSFLVRSKLWRLYHAS

SEQ ID NO: 1166 - protein, 250 aa, Marinomonas mediterranea
MSTVGALLIVKNEEEKLAECLDSLSTWVDQIVVVDSGSTDSTCEIAKKYTKHVYSHCEWPGFGKQRQVAQSYLTTDWVFAIDADEVVTDELKQSILKETKSTERALFSVNRLSSAFGKQIRYSGWSPDWIVRLYPREMAGYNDALVHEKVIASKDIPKRKLSGYLLHDTYESLHHYSVKTTSYLKAWSDDREGRPSSLSKALLHAFACFIKMYIIKRGFLDGTHGFVLAWLAAHSTFYKYIDLWLRGRKK

SEQ ID NO: 1167 - protein, 260 aa, Enterovibrio norvegicus
MSQAQQRASISAIIITKNEEQILPECLASLDWVDEIIVVDSGSTDNTVNIAQTAGAKVHINAEWPGFGKQKQLAQRYATKDWILAIDADEVITEPLKQSILNVLAKPSEKTLFILRRTTWVFGRFLKHSGWYDKIIRVYPREYTGYNDALVHEKIIEPQGCKKQTLDGDMLHYSYRDLHQYLVKSAFYAKSWADGRQARGKKSSIGQGITHAIGCFLKMYLLKRGFLDGKQGFLIAVLSAHSTFVKYADLWIRDNDSRAN

SEQ ID NO: 1168 - protein, 260 aa, Unknown
  Description of Unknown: Thiotrichales bacterium 12- 47-6 sequence
MSHKITAFVLTYNGEKYIEDCLKSLMWADEVMIVDSGSKDRTVEIAQALGVRVETNSWAGYGNQLNYALSVASHDWVFFTDQDEVVLPELAQNIRRELNGEMNYLAYKTGGQNSLFGHWLQWGGTIEANVRFVNRHYVTYCPVQHTYICEKLPKKTIKGVVRHDMAPTMIEWWDRSFKLATIEAEVDYAKGARFSAWKAGMFWWRFVRRYVFKLGFLDGWAGLYMALQRSMYILAYQACLLELDRSIRQPKEDPNTSKFR

SEQ ID NO: 1169 - protein, 253 aa, Tamlana sedimentorum
MLKLSGVIITYNEEDKIETCLQSLVGIVDEIVVVDSLSTDHTKAICQKYNVTFIEQAFLGYVEQKNFALSKATYNHVVCLDADEYLSETLKQSILNLKSNWVYDGYIAKRLNYFCGQWIKHTTWYPDKKLRVFDKTKAKWGGLNPHDSVKFFNKDSKAALLKGDILHHTYQSYSEFNQRVEKFSSISAESNFKLGKKAPVYKIILNPTWAFIQSYIVKLGFLDGLNGFIISVQTANIRFLKYIKLRELIKKNS

SEQ ID NO: 1170 - protein, 238 aa, Marinirhabdus gelatinilytica
MPTLNEEAYVEAALRSVRFANEIIVVDSFSTDDTPAIAKKYATTFLQRKFDNFSNQKNYALERAKTDWVLFLDADERITYPLQQEILAAMESGTHGGYKLNFPHFYMNRFLYHHSNDVLRLVKRKGASYQGLVHEKLTCDGTVGQLKNPVLHFTYKGLEHFLNKKESYAWFQAEQLQKKGKRTTWGHLFFKPTWRFFSSYIFKGGFRDGIPGLTIAANNAYGVFQRYVKLLLLNKGMR

SEQ ID NO: 1171 - protein, 253 aa, Unknown
  Description of Unknown: Chryseobacterium sp. Leaf180 sequence
MKLSVAIITFNEERIIGKTLSAIHSLADEIVIVDSNSTDRTEEICRSFSKVKFISQKFPGFGQQKNSALNHCQGEWILFLDSDEIPDETAKNDIQKIIYSEKPYFNVYDIEFKNIFLGQALKYGGWGNVKRERFFKNGFGKYSEDIVHEAFITDSPVGKLAGFINHYTYKDIFHHIEKSNKYTSMMAEKMYQKGKKSGALQVVFKPFYQFLKSYFAMRGFLDGFAGFYMAITSSFYTFLKYQKLHEIYLSKRK

SEQ ID NO: 1172 - protein, 251 aa, Unknown
  Description of Unknown: Nitrospirae bacterium sequence
MSKLSAYVLTYNEEAKVREALESVSWADEIVVLDSHSTDRTESICREYTDKVYQCDFEGFGKLRNHALGLLTHDWVLSIDADERATDELRKEIQAVLSQGPDADAFFVPRKNLFMGRWIRHCGWYPDYRQPQLFNRHRFRYREDLVHEGFELDGRVGYLRGHVLQYPFLNLEQYLQKMRRYSTLMAEQMALRERRFHVHQLVTHPLFSFFKMYGLRQGFRDGMPGLILSLLYAYYTFVKYAKLWERTKAGG

SEQ ID NO: 1173 - protein, 246 aa, Myroides indicus
MKLSVIIPTYNEEAYIADAIHSVSFADEIIIIDSYSTDQTVEIAEKMNCKILFNKFENYSKQKNLAIPHAQGEWILFLDADERISIALRNEIISAIESPGKNRAYKLQFPHFFINRFLYRKADKVTRLVYNKDIIFTGDVHEKLNIPEGNTKILNQPVLHYTYKGIYHYLSKKESYSWFQAGEMLKRNKKTNYFHLVFKPFYRFFHIYFIKRGFLDGIPGLAGATFDAYGVFARYAKLILLQKNLK

SEQ ID NO: 1174 - protein, 261 aa, Unknown
  Description of Unknown: Candidatus Roizmanbacteria bacterium GW2011_GWA2_35_8 sequence
MKDDISAIMITKNAESTIENSLKSVSGWVREIIVVDSYSTDKTLEIAKFYNTKIFVHNYEGEGKQRNFALSKARSNWILVLDADESVTLKLKNEVLKTTKSTKLSGFNVPIQSHYKKRKLNYGGENYRKMILFKRHKGKSTLDEIHAVCQIHDKKVGVLKNPLNHFSYNSYWQVLKKFTSYSFRAAKVKAKKNESPSLKKVFIYPIHMFYARFIKDEGYKDGLFRIPLDLAFAYMEFLTYFILLCRPLFDLRGRKRAVTKG

SEQ ID NO: 1175 - protein, 318 aa, Limnoraphis robusta
MTSTASKIPVSVLIPAKNEEENLPACLASVARADEIFVVDSQSEDRTVEISESHGAKVIQFYFNGNWPKKKNWSLENLPFRHEWVLIVDCDERIPSELWDEIAMVIQNPEYCGYYLNRRVFFLGAWIRHGGKYPDWNLRLFKYKQGRYENLKTEGVRNTGDNEVHEHVVMSGSQKVGYLKNDMLHEDFRDMFHWIARHNRYSNWEARVYYNILTGQDESDTIGANLFGDAVQRKRFLKKVWVRLPFKPFLRFVLFYILRLGFLDGRAGYIYGRLLSQYEYQIGVKLYELRTFGGHLNVSKPSAEQSNSVPSVPQAVQK

SEQ ID NO: 1176 - protein, 492 aa, Selenomonas sp.
MKISACVITKNEAENLPRWLRSMRVFADEMIVVDTGSTDATVEIARMGGAQVFRFDWINDFAAAKNFALDQATGDWVVFTDADEYFTEESGPRVRPLIEEYDKKEKMDGFIVHLVNIDMDTGALMGTSAEVQRIFRRAPHIRFVGSIHEHVENLSGDVGREMAMAPGLTLYHTGYSPRIIKQKSKRDLELLLARRARGAHKELDEYHLMDCYYTLEDYPQAAHYARLALDSEHRPVGSEDRPHAILLQSLILMKAADAEITAVYDAAREVLPEKADFPLIYGTYAWDQAYFTTACAAYVEGIRLHEDFYREGDFSGVLAPTAYVRLGEAAALCGHMEEALLLHERAVRMNPHCAPLLGTFIRLLDRTGADDATVIEVLNGIYDKNVDAQLLAAVLGGTSFRLAALYYDHRANVHFSERRRFLLAGDVGSAAAMLVEDMERTAAVAAACGAGFSPQQQGALALLLPDSCRENSAAPEAARMLRRIGRLARGMK

SEQ ID NO: 1177 - protein, 257 aa, Halothermothrix orenii
MAENSIGALVLTYNEEDNIKDCLESIKWVDEIVVVDSYSDDDTIDICKEYTDKVYARKFDNFSSQRNFGLGKLKTDWVLVVDADERVTPELKEEIYGALQSGPFLAYQVPRKNYFLGRWIKYCGWYPDYTLRLFKVSEGDYKFSGKVHEDVRVNGKVGILKNPLVHLTYRDLSSYIKKMDLYSTLWAEEKFKKGKEVGLLYILLRPPVEFIKKYFLKRGFLSGSEGFILSIVSSYYVFLKYAKLWEQNKSLSGAEDH

SEQ ID NO: 1178 - protein, 304 aa, Selenomonas ruminantium
MVRISACYIVKNEEQNLSKSLASVADAVDEIIVVDTGSTDRTMEIAKSYGARIFEQNWQENFAFHRNYALEQAAGEWIIFLDADEYFVNAEGLDAYLNRADAFPTCEGMLLPLININPDTGTEQAEIIDRALSLRVWRNKKNFRFMGCVHEMLYVFEEENTIRPLKTITAHDKFTLHHTGYRRNIMQEKHKRYLAMLHQEIEKHGEQPLSARYLADCYFGLEDYEQAAYYASRAIHREQELGITTVAGFYKLYRYWLESGRKLNYSKDEMTKIAQKALIETSKEAASQKMQEFIACLLNEGVLD

SEQ ID NO: 1179 - protein, 254 aa, Flagellimonas pacifica
MQKLTGLLITYNEEDNIKRCLDSLAFADEIIVVDSFSTDATTEIIKEYYPQVKLFQRPFKNFTDQKSYALAQSSNDWVFFIDADEEITPSLQEELKNVLASKEIKTNGFWIYRQFFFMEEKLRFSGWQTDKNLRFFRKSKSKFTAWRIVHETVEVDGHVGRLEKKLNHFAYDDYKDYKNRMIKYGRMRAQQEWPKEKKSYPFGQILRPIWKFFNHYILRFGILDGKKGIVICYLNALGVHARYRELNRLHKKQY

SEQ ID NO: 1180 - protein, 248 aa, Unknown
  Description of Unknown: Elusimicrobia bacterium HGW- Elusimicrobia-2 sequence
MKVSVIVIALNEEARIVDCLESIRWADEIIVVDTGSSDGTVDICRKYTDKVSQSEWLGFGPLKNFAVSKTSNEWVLNIDADERVSDELRAEILALSSNPAIAAYNIPFHNFFMNRRLRFGGLGGEKHIRLFNKNTAGFGAEAVHESVAVRGKTGNLKGHIAHRSYRDLSAYFQKFNLYTSMIAREKFQKGKKFPVSAFFRIPYEFGVRYFFKLGFLDGVAGFIYASISAFYAGVKYFKLYELTAGLKE

SEQ ID NO: 1181 - protein, 252 aa, Winogradskyella arenosi
MLKLSGVIITFNEEKNIEKCLSSLSKVVDEIVVVDSFSTDNTKTICQKFNVHFIEQEFLGYIEQKNFALAQAKYDHIVALDGDEALSEPLQKSILALKSNWVYEGYYANRLNKLGEQWIKHTTWYPDKKLRIFDRRKAKWTGTNPHDRIRLLDGTMKTGFLKGDILHTNYQTYSEHNQQIEKFTTIAAEAYFKKGKKASLFKIIINPTWAFFQSYIIKLGFLDGFNGFYISVQTANIRFLKYAKLRELQKKA

SEQ ID NO: 1182 - protein, 265 aa, Klebsiella huaxiensis
MLKLSVCLLTCNSSRLLREVLPPLLKVADEFIVIDSGSTDATLQICQQFGLTVHHHPYTAHGAQMNYATSLASHDWVLCMDSDEILDDDVVAAILALKAGDEPAPDCAWRLPRYWFVLGEEVRTIYPVSSPDFPVRLFNRTVARFNDRPVDDQVVGYKHSSKLPGFVRHDTFFSLHEVFNKLNSYTTRLVKYQKVRPSIGRGVISAIGAFFKWYLFSGAWRKGKVGIVTGLYATFYSFLKYFKAWYAHQDKQEPVAEKRPDSRQI

SEQ ID NO: 1183 - protein, 255 aa, Actinobacillus seminis
MPTLSVAMIVKNEEHELAQCLDSVKDWVDEIIILDSGSTDNTPKIAQQYGAKFYRHTDWQGFGRQRQITQQYVTCDYVLWLDADEHVSDKLRQSIQKAVSADLDNTAYQICRLSTAFGKQIRHSGWYPDYVLRLYKTQAAQYGDELVHEKVHLPPNTTVKKLDGDLYHYTYKTVHHYLSKVAHYSKAWAEQKAAKGKKTGITQCVTHSLGCFVRMYILRAGFLDGKQGFILAVLSAFSVFAKYANLWILNLKNRG

SEQ ID NO: 1184 - protein, 264 aa, Unknown
  Description of Unknown: candidate division KSB1 bacterium sequence
MPEARPLLSVIIITQNEAHLLRDCLASAAFADEIVIVDAESSDDTVKVCQEFSASSPALSVKIFVRPWPGFAAQKQFALAQATGEWVLSLDTDERVTPELAQEIQTLIKNTPPQAGYYAPRVSTFLGKFIRHSGWYPGYQLRLFRRDKTTIINSHVHEGFVVDGALSHLKHDLLHFTHRTLEESLARMNRYSSLEALDRSGKRVYWWDFFVRPFAAFWNKFIAHQGWRDGMHGLILALVTAMVKLALYMKLWEAQQSRRAENQV

SEQ ID NO: 1185 - protein, 513 aa, Sanguibacter gelidistatuariae
MSVLSAPKISAVLIVKDEEAVLDECLAALHWADEIVVYDTGSSDATREIAAKYTDVVVEGYWDDDFGAARNRALDHATHVWVLNVDADEVFVGPPEAIRSALRSGVTSRSILVESVDENAGASGTVSIIRLFRKDLYCFAGRLHEQAVQRPGATAPLSPRPLHHVKLLHSGYEAARIIERGKGERNLDLARRDLAESISRGDSDAAIALRKANVARSMSFGGSFDDALSFAEAAFAEGALADRDLATLAKAMCATAMLLDDNEKVERWWQRWHDSGENPVWALAWIAPWLARRGMVDELLSVLDRIPTTVVDPSGERFLKVDLAPLHVWALLMSGKHKRAVGVAIDAARKGRPSLVPGALTELFDHAGLHVSALLTEIDDSLWMTLVMQCVQDGSRSSRRFLEAMNAARPGDAAVLLAGSALAPRLSLEEAASWAIELRQQGFAEECPLVAIAGNEALDPRQRAIAGAMAVDIYGDDRALPGLGDALARVAPDDEAELIAQLDIVAPGLVSAA

SEQ ID NO: 1186 - protein, 249 aa, Unknown
  Description of Unknown: Flavobacterium johnsoniae sequence
MKISGLVITYNEEKNIGKCIDALFRICDEVIVIDSLSVDNTVKIAEEKGAKVIPQVFLGDGPQRIHGLQYCKNDWILNLDADEILAEDAEKFILSGKYENQDFDVYTFRLYNYLGGKKIDFAGWYPDKTARFFNKSTASPSKDRVHQKVCGSSKSHLKVHINHYAWENFDQFLNKKNLYTTWHAQQLYDQGKRVNAFKPVLNGTVSFIRCYFFKKGFLNGLDGITFSMIQAFFSYMKYAKLLKLQKSNK

SEQ ID NO: 1187 - protein, 397 aa, Bacillus methanolicus
MNFRRLSLCMIVKDEEDCINRCLSSVKSVVDEMIIVDTGSSDRTVEICESFGAKVFNFPWNESFSDARNYGLERATGDWILWLDADEEVDASDVYRLRDILYSDDDLLNVHLINYYGDRPDPNKTFDIAHTRLFQNHKGFKFKNKIHETLNVNEVFAASDKSPEIKTVPIKIYHYGYLDPVNETKKKFERNLSMLEKELEQKDYSPWIEYHIASEYYRAKQYTKAFDYVNRAIMGFLKQLKTPPSLLYRLKYSILISSGSIDGAWPGIDRAVSLYPDYVDLHFYKGIILYAKDSFKEALEVFEHCLELGEENLQHLTLKGVGSFQALYYKGCCNEKLGQIEEAAKAYAQAASLSQTFVSPVDALRKLTAEHPDIFGDLPEDCDNEALITRVLSKEIV

SEQ ID NO: 1188 - protein, 318 aa, Vibrio scophthalmi
MKYSVIVPIYNTFDYAQRIVEWFVQEVSSRSEQDVELILVDDGSKQGPNYSIDHQSIRLIRKENGGVSSARNVGIENARGEFILFLDSDDKYQPGLFRYLEKVLLERTNLDTILFSFEKVSDDKSEQAQNRAQHVTGQQALSQYLTKEIRLHICGLMVSRRLLSEHSLRFDESLHFSEDLLFIIDYLSFAHDCYISDEILYFHVMRSGSAINSPLTQKDTTHIDAFAQISTQAKKSAREQDVNFFISTCYINLIKFLIKNKTQDKDVLEKIISNQQFLFGELDAKLSRYSVIVMVLRLLFKLDGLTQHRVLRRLSYTG

SEQ ID NO: 1189 - protein, 367 aa, Bacillus subtilis
MKRPKLSVCMIVKNEERHIARCLESVQHIADEIIVVDTGSNDRTEDICSSFHAQIYHHKWEQDFSQARNASLQHAKGEWILVLDADEELDPDTGSLLPSLLTDSLPSLGCVNVVNYTGKQWDENEALEQRQIRLLRNQRNITFTGRVCERPEGQEASATFSLPCIIHHYGYLEQEAQQKHKRNMSLLNAALLTSSADPSLIFQKAAEYDRGNEHDKALRLAIDCINEHKRKKQIPPPAYYYLKYKLLIDAERYEEAEQDINEALAHYPDYCTLHYYKGIIKYQLKKAREAITAFEACQQTNSENHLYLQVKGAADFRSSCWLGVCHAELHQPMTAVLYAQKALKANPKCSRAQRLFSELTKDQAAHA

SEQ ID NO: 1190 - protein, 249 aa, Unknown
  Description of Unknown: Flavobacterium sp. Fl sequence
MEISGLVITYNEEKNIGKCIDALFRICDEVIVIDSLSADNTVKIAEEKGAKVISQMFLGDGPQRIHGLQYCKNDWILNLDADEILAQDAENFIMSRKYENQDFDVFTFRLYNYLGGKKIDFAGWYPDKTARFFNKKTASPSKDRVHQKVSGNNKAHLKVHINHYAWESFDQFINKKNLYSTWHAQQLYEQGKRVNSFKPILNGTVAFVRCYFFKKGFVNGLDGLTFSMIQAFFSYMKYAKLLKLQRKNK

SEQ ID NO: 1191 - protein, 538 aa, Bacillus sp.
MKRRLSFCMICKNEEKHLPRCLQSVASIADELIVVDTGSTDKTIAIAEQFGALVLHHQWNHDFAEARNIGLCAATGDYVLFLDADEELHPDDQLTLRNVVDTTNDEAIFLKIHNYVGKIETEQNRDISPVLRLFKRHPHIQFEGRVHEQIGFSISRTYENPSYAFTDIRILHYGYLDEVVQEKEKSKRNMTLLKKAVEEDDSNPFHYYNLAGEYIRIHKYEPALHLLRKAKQLCQIETMAFGHLVIKKEVFCLVMLGNVTEAIETCRAEICKFPDYIDLYFLWGKCAILLGHITEAKEVFTKGYVITSVPSYYSIDAANQTAHIPFHLAVLEEHDGNVYKAKQWYEILLLHHPTYPHAFFRYIRLCKTYQLDNWQPFLRNLQIWKENEQTKTFLHMLMLGGHFQFVQSIVKEHQLKEAIPQLFEICINEGSPKEQLFKRRNLSQHFQHFLYTGNFPDQATLSKEDYETLPLLFLLSSADEQAKLLKLWRYNMLLYKDNEHAPQFALHLVQRANYLLKGATDPAICSISYHLPLLIYNE

SEQ ID NO: 1192 - protein, 786 aa, Sorangium cellulosum
MTPVYSVIVVTWNNLQYTARCVDALLRTLPSDAEVIFVDNGSEDGTPAYLTDVARRLGDAAKTVFLDENLGLAGGANRGLEVATGEYLVLLDNDVVVTPRWLEGLRECMEEAPRAVPGARRVGLVGPVTNSARGPQKVQNPPPFQPEALNELAAEHREAFRRRWAPSFALSTFCLMMRREVYAEIGGLDERFFPVGHEGADLALRAQERGFECMIASDVYVHHEGSATLSKAFPGAQGGLGGAELFFEKWRARRAGKTRLVAAYRVRDAEATLRESLDATARFADAIVVLDDGSTDGTGAIARSHPAVARYERTELPPGVDDRRDRDRALQLAAELSPDWILAVDADEVFEMDRARAERLMQLADPHIKALGFHWYTFWEPTRTYFRADGALGAMSGYRMYRNEPGLRVARGEGGLPGGGIPEMPDGCGRFTDVRVRRLGYDTEASRQARLALHARPDRYAPPRAGAPPELADLASNTVTLRRYAPASGVSLCIIARNEAERLERFLAFLEPFVDEICIVDNGSDDATVEIARRFTDRVRVHRTDRLDLAEVRNVGLGMATRPWILSLDPDEELAHWDLPRVVRLMDDLDVHAYSFEIANHQKDGPPVMTIAVRLFRNDARIRYGRAVHETVQPSLDRHPELVVRAAGVEIQHYGFLKDDGVMEEKLSRYLEANQRMREEDPADPMPWYNEGLHLLNDGRDDEAIAFLERAMVLGQHFLSPRSSLAQIYQHRALALWQSMVAELPPGHPVRPTAEESAAALGRITPARMLVGQARRRRLQGPSHGE

SEQ ID NO: 1193 - protein, 546 aa, Unknown
  Description of Unknown: Microgenomates group bacterium GW2011_GWC2_46_7 sequence
MTSTINHQPSTISVIIPTVNAHEELDLAIASIKKNSDLDIEFCIIIDPDMNTGKVNEDILKVCKKHAVKAWVNKDNLGPYGNWNRGAEVATTDYLVFATDDQYFAPHWDSNLLKYWQPKRLVSGRLIEPGIIPVYKTNIQRDFGVLPSEFKEKEFIAWCASRRATGYTQDGFFIPMLQNRADYDALGHYPTAGKFGTSTAVSNDYLYVQAALKKGYQFGTAEDSYSYHFQASSWKKKTLKPSIAAVVLTKNEETDLRKCLKSLNWASKIIVLDSGSTDKTLSLAKQAGAQIFSRPFDNFSAQRNFALTKVGAFNWVLMIDADESCEPTLAKELQFFAKDIYLDGVRVPRKNYIFGRWIKHCDWYPDHRLVFFRPKMVTYTVGVHERVSFIKGNGTVATATHHLIHHNYDTIHEFVVKNLVDYPREYAKVLDADKVNFTALDLLSKPLSEFMRRFFLTEGYKDGLSGLVLSALMGVQTLVAYAYLWEIQGKRQDLTTQETQAIFTKLKGKGSELTFWLTTLAVESATGATKIFHRARRKLLKLTQGI

SEQ ID NO: 1194 - protein, 251 aa, Unknown
  Description of Unknown: Flavobacterium tistrianum sequence
MEISGLVIAYNEEKNIGKCIDALFRICDEVIVIDSLSADNTVKIAEEKGAKVISQPFLGDGPQRIHGLQYCKNDWILNMDADEILAKDAEDFILSGKYKNQSFDVFTFRLYNYLGEKKINFAGWYPDKTARFFNKTTASPSKDRVHQKVSGNNKAHLKVHIHHYAWDSFEQFINKKNLYSTWHAQQLYDQGKRINGFKPVLNGTVSFVRCYFFKKGFLNGLDGFTFSMMQASFSYMKYAKLIKLQKAKKDN

SEQ ID NO: 1195 - protein, 337 aa, Oceanobacillus chungangensis
MIVKNEEESIDRCLNSVIDVVDEIIIVDTGSTDKTIELCKNYNANIYPYTWDNHFGNARNYGLSQATGDWILWLDADEELDSSKKFNLKEFITEKKDIFFLLPVLNYYGDNLPVNTNHFFSYYQPRLFQNNKGIQFVNRIHETPQYPDEISIDEYKKIPLPIHHYGYMKDVVTEKNKLQRNIELLYMEYKKEEHSPWIEYHLANEFYSKKNYTVAYEFVKQSILQFLLQGLKPPALLYRLKYAMLMETNDFEGAWPNIEKALLLYPDYVDLHFYKGIILYEQKNYPEALEAFEKCLELGDDHPQYLVLKGVGSFQATHYIELCRARIDETNHNSPKQ

SEQ ID NO: 1196 - protein, 481 aa, Paenibacillus sp.
MTSEINHIITLIQSNKPREAEAELFQAIRYKPLEAQLWVLLGETLLLQQQAGAAKRVFDRAWLLDPQAKWVNHIYKAMQKIPQSASRPDIEDLLYVPKVTVTAAILSHNEAANIAKCIVALQGAVDEILLVDSSTDDTRKIAMQYPKVKVVPIVWEDNFGAARNIGLQHVTTDWVIWIDADEVLIPEDVGAIREVASVYDHSNITPALHVWHLNRINGTVQHDFSQVRMFPAQRGLRYYGRIHEQIATDKGVYQLDTYRRAVKIRLDHNGYDPAVIQSKGKLERNLRLLKLMIEEEPENPGHWLFYGRESLGIGLEEQAVTSLLEAEHLGLQTPLFGRMPEIYRLLIQIMMQRKNYAEAEAYCHKALAHSPDFPDVHYLLAQVRMRQADELLRLAETSIKQSLSSLPNYRGSVSADYHIGEWKAATSLGELAMRSGKLARAKQIFSRLKDKPGATEILSAKLNAIETERQRLNQVDQQHQK

SEQ ID NO: 1197 - protein, 292 aa, Unknown
  Description of Unknown: Candidatus Rokubacteria bacterium sequence
MIPVTVMVTTRNEEANIDKCLRSVHGLVDQILVIDSESEDQTVPIARRYADDVANLAYVHGAIIPWIFQWGLDNLPIRNEWVLILEADQVVPPDLGQELVRLFGRGRIEEDGFFIRRKQIFRGRWIRFGGYGSKYLLKLFRRSRGRLDEREQDTRVYVRGRVGKLRHSLVEENLKESEILFYLAKHLRYADAFAREEFERRKGGMAWLVRPSLFGTPDQRTLWMKAAYYHLPLYLRAALYFGYRYFFRLGILDGKEGAIFHFLQAFWFRLVVDVRLEELMKGQTRRADDPTT

SEQ ID NO: 1198 - protein, 261 aa, Cylindrospermum stagnale
MISIQEKITPLILTYNEAPNIDRTLQTLQWAKTIVVIDSFSTDETLEIIYAYPQVQVFQKRFDSFATQCNYGLEKITSEWVLSLDADYVVTDELINEIKALSATPGIESYSIRFKYCIFGKPLRGTLLPPRKVLYKREKAIYKPDGHAHRVCVQGESRMLSAYIHHDDRKPLSRWLWAQDRYMVIEAKKILETPVSELSLSDRIRKQKILAPLIILVYCLIIKGGIFDGWQGWYYAFQRVLAEILLAIRIFEYQKLPSSDA

SEQ ID NO: 1199 - protein, 314 aa, Sphingobium sp.
MTDAAPFFSVVIPLYNRADIVGDTIRSVQTQDWQDFEIVVIDDGSRDNPAPVIDAIGDPRVRYIRQDNAGGGAARNHGIEEARGRYIAFLDSDDLFLPGKLSIMAKALADDDGRTVLYSRMKVDRGVDRYWIRPDRGIRDGEDVGEYLFCANQFMQTSTMVVPAGLARKVLFDPALKKGQDLDFCVRLQGAGARFRMIEQPLTVWLDATEAGRTSYVRGYETSLDWLDRCGHMLTDRARRGYRATVLAYHMAPIRPVMALRDLIVGLFAGGVPPRVVARQVLRSYLPKPLYRSLVNGFVLRFGKGEAAHGGARS

SEQ ID NO: 1200 - protein, 267 aa, Campylobacter avium
MKNNKLPLSACILVKNAQKHIKECLENLQDFDEIILLDNESSDDTLKIAKEFNESYKNLKIYQSEFIGFGALKNLALSYATNEWIFSIDSDEVLEKECLDFLKDFFKSPPSKDIILALPRKNLYKNEWIKASGWYPDYVIRVFNKNYTKFNENIVHESVIVPKDAKIKRLDFGIRHYACSSIEDIVKKMNLYTSHSAKEKFKKGKKASISGAIFRFFFTFFKDYFFRKGIFYGYKGLVISLMNAQGAFLRYIKLYELNKDEKASHTS

SEQ ID NO: 1201 - protein, 250 aa, Unknown
  Description of Unknown: Sphingobacterium haloxyli sequence
MGVSGLVITFNEEKHIEKCIKGLQKVCDEVIIIDSHSQDKTVEIATSLGATVISQSFLGDGPQRTFGLQFCKNEWILNVDTDEFLDHDCYPFFEKKEYLQLPYDAYSFKRRNFLKNKEINFADWYPDYACRFFNRNTASPSSHLVHQRIIATNLKKSDMHLLHYAWDSFHQLIAKKNQYTDWQVEEFIKKGKKVNALSPVLHGVTAFFKAYFLKKGIFHGIDGVTFSLIQSFFSYMKYAKMLEVQRQRNK

SEQ ID NO: 1202 - protein, 632 aa, Alicyclobacillus herbarius
MKLSLCAILKDEAAVVRTMIESAVDIVDEMILVDTGSSDGTVEIIEEYISKYPDVIRLYHFQWVNDFSAARNYSLDQATGDWVLVLDADEFLDPSRKHSLREIIETTDAEGVSLVQKSYMGSIRSPNNMICVDTVRLFRNRHRYTRTIHEQIIPSIISSGGRIERLDIPIHHIGYTDEYRNMKGKSQRNKMLLEAEAQTLTYRDESERWYNQHQRLVEYVVAGEWERAKELGRTLVEDIKGCCGLRRKEWPPYGPRIYRLLSVALIELGERSYAERMLKEGISVFSDSANIWLLYGELCLDDERYTLAMEAMDRCRSIKNRQTDYQAEGIEGANTFIPARHLGRLWLRLGDEVTAREWFMTAFQEGVSAPGIIPWLVMLTPSQEFRELLSSTIPSADRYKEFIEFVAACGYEDTEKCIDDAEKRWGTRLDSSRARFAHEVRSGLAPSTRNPLWLGLYAYEQGDKSAAHEYWGQAGAMGQYLMRISMGKDQAITWNIAPVIQDLLAANAINFLRHHVHKATDLRVAFPIITHTTLHTGLLSNEFLNREPAFHEEADWKARMAMSQGDAHRAKEWLDKALIPSEEVRSVIGYLLECDLHPEGTENILRQARKVYPGSKLLSQIWLSRLKATPVV

SEQ ID NO: 1203 - protein, 253 aa, Unknown
  Description of Unknown: Flavobacterium aquaticum sequence
MAISGLVITYNEEKNIGKCIDALFEVCDEVIIVDSLSADNTVKIAEEKGAKVISQKFLGDGPQRTHGLPFCKNDWILNLDADEFLDKDAKEFILKEKYLEGNYDAFSFRVKNFLADELIDFSGWYPDHKVRFFNKKTAKPSEAKVHQKIETTNEKKVAVHILHYGWESFEQIIAKKNQYSTWHAQQLFDQGKRVGAMKPVINGLTAFIRCYFFKKGIFNGIDGITIALIQGFFSHMKYAKLLKLQRQEKLLKR

SEQ ID NO: 1204 - protein, 1918 aa, Unknown
  Description of Unknown: Syntrophaceae bacterium PtaU1.Bin231 sequence
MRRVYQSYADGPSHMALPADGEAIKKSGLRRDYFLNELLEFTAPVGRLLDVGCGWGAFLDNARDRGFEVQGIEVTRKCVAFANERLGIPVTDEPFEDVAFESGSLSVVTMLHVLEHLPEPSRAIENAYRSLKPGGIFCGIVPNIESLCSRELGETWYWLDPQYHYVHYSPSTLKMHLESAGFTVERLYTATGDYGRENVLQVIQRKQDVAAGRLEALIEQIERDGLGEEIRFFARKPTHAHRPAESPGNHKDSDRGEAATAPLPKGCASIIIPVYNQVEFTSRCLEALYANTPLDRVHEVIVVDNASSDGTAEFLEKARKRYPKLKVLTNPENLLFARACNQGADVAGGDVLVFLNNDTEPLPGWLDRALERLDQDDSIGAVGIKLLFPDGTVQHCGIQFFRNAHPSYTVWPLHRHLHAAADDPRVNIPGDVDAVTGACLFIRNRLFRRIGGFEERYGMYFEDTDLCFKVRRAGNRVFYEPASVVIHHEGKSSPGRDVVHSLKEASARRFFKIWREDLIRFELDTLVEKEEGRYAYMPENFWPEEVNPQAVVRMHALLANFPPCYVHFGGAGDALLLLSTFYDKDPGQTVVSVSNSTAMMRSFFDAFPKLKKVIFIPFPKNYTWHFIARQFFKSSDICQGMGATPTTTADYREWNADLDIFTTYGIRRRPEWAVRFDKCRIEPIQLVIQPRGSLKGMVGSKRNVIPPKDWPRLLSYLAKKGIRPVVIGTPDEAEEYPCLDKALDRRSYSFTEQLRLIAGSDFFVGADSWGKTFAALAGIPTFVFHAVRGDDLKGWKDDSDHVFLDPWEEITVVKDLGDFRRAFDAVRHAGDASGDGLKIRWEGSQFVHHSLALVNRELCLRLIAGGCELSVIPYERDQFSPKEEPRFKPIAERVRGPLSGPVDVHVRHRWPPDFNPPPEGHWVMIQPWEFGSLPREWVRPMSEHVDEIWVPSRYVRDCFIRSGVPAERVTVVPNGVNTDLFKPGNAPYRLSTKKGFKFLFVGGTIQRKGIDILLDAYSRSFSSADDVCLVIKDMGGQSFYKGQTAKEWIRRFQGDPDHPEIEYIERTLSDREIAGLYTACDCLVHPYRGEGFGLPIAEAMASGLPVIVTGHGAALDFCDETTAYLIPAKEVRLREKRVGEFETVDFPWLAEPDRDSLVGLMRHAASHPEEAASKGRLAAEFIRSRFTWDRAAEAVKKRVRELRGKPILRLEQGSESLHRLKPPCGTPETRRCEATAHHESSTVDTGVSISPYRAKAHELYQRGNLRAAAEAYLDAIKATPWDRECYLSMAEMLIGTKHYKEARDLLGEEMIGPPDARTLSLLGGTQEGLGNDDEAERLAAQALERTPGFAPALNLQGVIAFKRGDRADAERLFSEAAIADPSWGEPLTNLGVLLWAAGEKEKSLDLLEKGFALSPCAPDLAERYHAAAVAMGLHNRAERAFRDARSRHPQNRTIAFLLIDLLISQGKDEEAMARIEAAMAAFEVDDGFIDAALAVRGKIGPMAIERGNGRPTLSLCMIVRDERANLVRCLSSVKAAVDEMIVVDTGSTDRTRDLAAVFGARVFDFAWTDDFSSARNFSLSKAKGDWILVLDADESLSPRDHGALRSLIRKSPKRIGGYDLATRNYVMEANTAGWTANDGTYPGEEAGTGWYANRKVRLFRNDPRIRFSGAVHELVEASIAAAGMEIAACDVPVHHTGKLDRARVTEKGERYFELGKKKIEETGGTPRAVLELAVQAGELGRWDDAVDLWRRFLGVSPGREVGRAYVNLINACLNADRFYEALAEARKAAALGNGTKELLLNCAAAEFFAGNLRKAVRSTERLLQKNPDYPPALGLSAMVLALTGQEERGLKALRRLSQKGFEARSQLLPAIEKLRTAGRGEQANRLLEFVDRHVPGAADGRGSAPDRLTHRVGAGLPG

SEQ ID NO: 1205 - protein, 251 aa, Unknown
  Description of Unknown: Chryseobacterium lathyri sequence
MKLSVCYIVLNGERVIEKSISSVYEIADEIIVVDSFSTDKTEEICMGFPKVKFIRKKFHGFGCQKNYTLSEASGEWILFLDSDEVPDKMAVDAIKEILTSSNPSYNVYEIHFNNILLKKTIQYGGWGNVWRERFFRKGHGKYSDDLVHECFITQDKKGRLPGNIDHYTYKSIAHHIEKINNYTQLMAEKKVLNGKSVSLFKIIFSPFYDFMKTYFFKLGFLDGVAGFYISITGAFYTFLKYIKINEIHKFK

SEQ ID NO: 1206 - protein, 259 aa, Nitrospina gracilis
MGSHQKQKMLSVILITKNEAVRIRQCLESVKWADEIVVLDSGSTDGTPDICREYTSEVHDVDWPGFGLQKNRALDMATGDWVLSVDADEVVTDALRDEIERTLRKPKYNGYRIPRSSHYVGRCIRHSGWTPDYVVRLMKKGSGAFTNSLVHEKLEIAGKVGRLKNPLIHYSFDTFEDVLDKMNRYSTYNAQMLYEQDRSSSLLEAVARGMWAFFRTYFLKRGFLDGRQGFQLAVSNAEGTYYKYVKLMELHRKKKSEKP

SEQ ID NO: 1207 - protein, 268 aa, Lelliottia amnigena
MLKLTVCLLTCNSARLLREVMPPLLTVADEFIVVDSGSTDSTLAICREYGLSVHHHPYAMHGAQMNYAIDLATHDWVLCMDSDEILDAETVDFILALKAGEAPAANSAWRIARYWYVLGEEVRTIYPISSPDYPVRLFNRTRARFNYRPVDDKVEGNVQTTKMPGRVRHDTFYTLHEVFNKLNSYTSRLVKYQKVRPSIGRGVISATGAFFKWYLFSGAWRQGKVGVVTGLYAVSYSFLKYFKAWYLDQDKEQEESTAEKPVDSHLIE

SEQ ID NO: 1208 - protein, 252 aa, Unknown
  Description of Unknown: Chitinophagaceae bacterium sequence
MELLSVVIITYNEELNIAKCLQSVQGLADEIVILDSFSSDSTVEIARQFGAKVYQQKFAGYVQQKNSALALATHNRVLSLDADEELSSGLFASIAAEKKNFQMKAYKMNRRAFYCGRFILHGSWYPEPKVRLFDRRAVTWGGLDPHDRVVLPAGIPIGHLKGDILHYICDSVEEHRLRSVNFSNIAARSLFDAGKKTNWFKILASPAWFFLVDYIFKAGFLDGWRGWKIASIQTRYHFEKYRKLRKLWKIAK

SEQ ID NO: 1209 - protein, 259 aa, Unknown
  Description of Unknown: Candidatus Pacebacteria bacterium CG10_big_fil_rev_8_21_14_0_10 _36_11 sequence
MKKISVVLATYNEEKNLNMCLDSVVDLADEIIVVDGSSTDRTREIAQEYKAKVIKTTNKPNFHINKQMAMDKATGEIILQLDADEVVDHDLKKFIRSLAKFSDLTKLSEVAWWVPRKNLFLGRWLTKGGQYPDPVIRLYLANKARLPQKDVHEQMQVDGEVGWAKGHLLHYSNPSFTDYMRKFNTYTSFKAQQWADEGKRAQWWGIGYYMIWLPLLTFLKLYLRHRGYVDGYPGFVFALMSGLHFSIAYLKLWELQQKL

SEQ ID NO: 1210 - protein, 393 aa, Devosia insulae
MCRRRLDGESSPGCERHEFVSQPPRGGPTISACLIVKNEQPFLDGCLNSLRGLVDEIVVVDTGSTDASIDIARAHTARVLGYVWHDDFAAARNFGLDAASSEWILYIDADERLIKTTRDDLRAGLGAPDVYAARLLFRVTSNSTLYREFRLFRNDTRLRFKGAMHETIVPDLSLLQRDAGARVIDTTAKVVHLGYDGDMTTKYRRNLPLLRASVEREPDRSYYWHDLANTLAGLGELDEAIAISGQGLARPEPADRPGRIMRSMLIHTHARLRMQRGEDMRELIAVGLAFHPENWSLLFLRARASVNAGAFDAAIDDLLPLLAQDADTVVDDILAYDRRIFGAHAHDLMGVALLRMGDRPRAAEAFGRAARAAPDVLEYRVKAAALGGAAASA

SEQ ID NO: 1211 - protein, 254 aa, Niastella koreensis
MTPLSVVIITYNEEKNIGRCLESVREVADEIIVVDSLSTDNTKAICASYNVKFIEQRFLGYIEQKNFALDSATHEYALSLDADECLTDELKKSILAEKQKGLTFDCYRMNRLSSFCGQWIKHGNWYPDRKVRLISRKKGKWGGVNPHDKIEMNEGATLKQLKGDMLHYTYDSIDQIMEQTNKFTTIQSKAMYESGKRANLIKIVINPFIAFVSGYIFKAGFLDGYNGFIIARYASHATLAKYAKLLHLQRKNKA

SEQ ID NO: 1212 - protein, 257 aa, Unknown
  Description of Unknown: Candidatus Pacebacteria bacterium CG_4_9_14_3_um_filter_40 _12 sequence
MLSVVLAIYNEEQNLARCLDSVKLIADEIVVVDGSSTDNSVEIAKKYTKKIIETTNKSNFHINKQMAMDAATGDIVLQLDADEVVDDDLANYIKQLKNDIKEGTTPTDSAWWIPRKNLFLGSYLTKGGQYPDSVIRLYLKGKARLPQKDVHEQMEVEGSIGTANGHLIHYSNPTFADYLRKFNTYTSFTAEKLHKKHTTISFTTSLDYLVKKPLVTFFSIYARHRGYVDGIPGFMFALMSSLHFPIAYIKLWELSEK

SEQ ID NO: 1213 - protein, 260 aa, Unknown
  Description of Unknown: Chryseobacterium sp. YR477 sequence
MALSLAIITYNEEENIVRLLDSISDIADEIIIVDSFSTDKTKEICTQKYPQVKFFEKKFNGYGEQKNHALHLCSHEWVLFLDADEVPDQNMKRSIQNIVSSESTEFNVYKAKFNNHLGIHLIRYGGWGNVCRERLFRKKYARYSDDKVHEFLITDQKIGLMEGKLDHYTYKSIHHHVSKINRYSDMMAEKMFEKGKKINRFKIIVSPIFEFIKVFIFKAGFLDGFPGFYVAKTMSYYTFLKYIKLREKIRRLEIEQNTVK

SEQ ID NO: 1214 - protein, 251 aa, Unknown
  Description of Unknown: Chryseobacterium indologenes sequence
MKLSVCYIIFNGERIIEKSIRSVYEIADEIIVVDSFSTDKTEEICTGFPKVKFIKKKFEGFGDQKNYTLAQASGEWILFLDSDEVPDEVAVQAIKDILNSSTPAYNVYTVHFNNILLKKTIRYGGWGTVWRERFFRKGHGKYSEDLVHESFITQDKIGKLPGNIDHYTYKSIAHHIEKINNYTQLMAEKKVANGKKVSLFKIIFSPFFDFMKTYIFKLGFMDGIAGFYISITGAFYTFLKYIKINEILRNK

SEQ ID NO: 1215 - protein, 250 aa, Unknown
  Description of Unknown: Flavobacterium gilvum sequence
MKISGLVITYNEEKHIGKCIDALYKVCDEVIIIDSLSADNTVQIAESKGAKVISQAFLGDGPQRIFGLDYCKNDWILNLDADEILATDAEEFILSGKYEKDDYDVYAFRLYNYMDDKLINFSGWYPDRTSRFFNKKTASPSKDMVHQKVSGLKKIESNVHIHHYAWKDLNQFIAKKNLYSTWAAQQLYDDGIRVSGYKPMLNGSVAFIRCYFFKKGFLNGLDGLTISMVQAFFSYLKYAKLIKLQIKNKK

SEQ ID NO: 1216 - protein, 315 aa, Unknown
  Description of Unknown: Candidatus Parcubacteria bacterium sequence
MSNKNNLSVVISAYNEQKHIKDCLESVRDLADEIIFIDNTSEDDTLKIAKKYTDKVFTHPNNPMLNINKNYGFTKASCDWILNLDADERVTSELANEIREVIGCKSQVTSHKPIQGYWIPRKNMIFGKWIQNDMWWPDYQLRLFKKGKGSFPEQHVHEYLTVQGETEKLRESILHINYSSIDQFINKIGLYTDNETEQVLSSGRKIIWLDAIRFPAKDFIKTFFAQKGYRDGLHGLVLSILQAFYAEIVFVKIWEKQGFTEENNKTFLKEVYKEFIKIALEIRYWFLSILIEQASNPFKKIFYRLQRKNITRKLK

SEQ ID NO: 1217 - protein, 367 aa, Bacillus subtilis
MKRPKLSVCMIVKNEERHIARCLESVQRIADEIIVVDTGSNDRTEDICKSFHAQVYHHKWEQDFSKARNASLQHAKGEWILILDADEELDSDTGSLLPSLLTDSLPSLGCVKVVNYTGKQWNENEAFEQRQIRLIRNQQNIRFTGSIGERPEGREASSPFSLPCIIHHYGYLEQEAQQKHQRNMNLLDTELLTSCADPSLIYQKAAEYDRGNEHDKAFRLAMDCINKCKRKQQIPPPAFYYLKYKLLIDAERYEEAERDINEALGHYPDYCTLHYYKGIIMYQSKKVREAITAFEACLQIDSENLQYVQVKGAADFRSSCWLGVCHAELHQHMTAVLYLQKALKVNPKCARAQRLLTELTKDQAAHA

SEQ ID NO: 1218 - protein, 386 aa, Bacillus acidicola
MIVKNEEEFIDKCLTSVKDLVDEIIIVDTGSTDRTIEICQSHGAVIEKFKWNGSFADARNFGINKATGEWILWLDADEELDSLDKDKLHKGNHFADYDVLTIHLVNYHGKEAIKDQTTDIAHTRLFRRNTGIKFINKIHECLEINGINQERIGHVDIKVHHYGYLDPVVDKKGKFERNIKMLKEQLKAKENVYWAQYYIAMEHYRKGQFKEAFKRVNASIKAFLLEGLLPPSMVYKLKYSILISMGSFEGAWPGIEKAIILYPDYVDLYFFKGLILYSLKKYNEALKTFETCIEMGEDNIHHLILRGVGTFQAWHYKGLCEENLGKEVEAVISYLHSIAISPEYLHAFESMAKISKKVDINLEEIVNKNFQGEDKQSLKMMISQLE

SEQ ID NO: 1219 - protein, 307 aa, Phormidesmis priestleyi
MFSIFILTHNEELDIAACIESAALSDDVIVVDSFSSDRTPEIARDMAERYPQVRFIQHAFVSHGQQRTWMLRNIPTRHHWSYILEADERMTPALFAECEVAAQSGEHVGYYAAERVMFMDKWIKHSTQYPRYQLRLLDKAHVWFDDYGHTEREVVNGTHGFLQETYPHYTCGKGFSRWIEKHNRYSTDEAKETVKQLTDGKVSWRALLMGKTEVERRRALKDLSLRIPGRPIVRFLYMYFILGGILDGRAGFTWCVLQAFYEYLILLKVWEIRHYPEATATSLTLPGQTKEPEQTKDESNTSISNAV

SEQ ID NO: 1220 - protein, 604 aa, Clostridium sp.
MKISACMIVKNEEKNIEKCINSYKEIVDEIIVVDTGSEDNTVEIAKDLGASVYFFKWINDFAAAKNYALDKAKGDWIIFLDADEYFGQDSAKKVRGILKSLRGTKYSAVGCKLININKVNNKTIDSFMQVRIFRNDKNIRYKSSIHESLSKKNDKVHIMSFYDEIEVYHTGYSTDINKGKAKRNLEILLEDIKSNGENKEYYRYLCDCYFALEDYENALKYGELHLNSNVKVIGYESRIHKVILDCMWNLGRPRKEIEQRIKSTIDIFSDHPNFYCSYGFFLLDEKRYEEALNNLLAALSYNNSYNGIEVNLILGLIPYIHYRIGFIYEVKNSYEKAVEHYYLSLSKDRFNKDAFQAIFKIIRNEKLEDTVAFLNSIYDINNENDVQFIVDELIKLKPRGILAYYANIWYKNFGHEDSALTFTLLAEGKFETAYKIFSEGYGEESNEILAIVSGILSGDSAIMKELLNTNKPSFKRIISEYEGKSNILLEEDLDNYIALFRELCLFDRSDVIKRFLDLRSSFKSNVSIEIAKVLMSNENYKDALKFYNESVQEVEDKNILMYIGYCNYKRGEHNIAYINIKKAIQNGYSGNDAHEFLRWIGEKM

SEQ ID NO: 1221 - protein, 251 aa, Solitalea canadensis
MHHKLSAVIITYNEERNIERCIKALVDWVDEIIIVDSQSTDNTENICKRYPVKFYSTQWLGYGPTKNYGSTLATNEYILSLDADEEISELLRNNIIEARKNGLDAVYRFNRLTNFCGKWIKHGDWYPDTKDRIYPRNIEWNTAAAHEELLIPADIKRIHLKGNLLHYSYYSKEDLVRKYKKYAELLAEDRKDKSKVFLFLKTVFSPLVYFIKNYFLKAGFLDGKAGFIVYSQGAYYTFLKYKLALKKSSVN

SEQ ID NO: 1222 - protein, 403 aa, Helicobacter sp.
MKISVTIIAKNAQKHLSECLQSLSEFDEIILLDNESSDETREIAKSYPNVRIFSTEFIGFGAMKNLAISYAKNEWIFSIDSDEIAEPDLLEEIKNLKFKQNEIYAISRKNLYKNEWIKACGWYPDYVNRIFNKNFTKFNDNEVHESVTIPKNAKILRLDSHIKHYAYGSISQLSHKMEFYSTLWARNNAHKSATPLKAIVRSMWSFVRNYLFKKGFLYGYKGFIISFFNASGVLVKYMKLYELKTRENSVSLIITTYNQKESLRAVLDSTLRLNKMPSEILIADDGSKADTRELVESYKAKFHIPLIHIWHEDRGFRLSHIRNLAIDSANGEYIIIIDGDMILEPNFVSDHLEKAKKGVFLQGSRVILDEKVSKEILALTSQNGGNGLRENGGNNADNGGGSK

SEQ ID NO: 1223 - protein, 702 aa, Clostridium botulinum
MKLSIAMIVKNEERNLERTLIPLKKLQGYIDTEIVIVDTGSTDNTVEIAKRYTNKVYFHDWNNNFAAMRNISVNYCTGDWILILDADEVLYDIDELVSLLNSNSLNDFNAVFLKKIEFYKSVEYSVFNGYIALLLRLFKKDTISYEGTIHEQPKFNYPVMESSVRFIHYGYDNNDYEVMEYKFKRNLNLLLGELKGNPDSVYINFQIAVSYTMHNQLKEALEYIEIAYEKGKKDINKYLYVIDKYCFILYNMGNYKALIDKAIEGIKYCNDFLDFYFYLGEAYFNLKQYHSAIEIYSKYLKIHEKFNDTLVMPNNTLAVMTRRYKENIIYNLALSYHKNKCFKESLDTIKKIEDSNLIREKIVFLMKIIVEGKLYNEINIVEKYIDKYNYENLLLFVYREISIENLKELNNIKLHENLYEIFSLVKYFKENNNIDEKIAEDIRKIIDKAQTPYSIYVYYILKYDIYEIRNLVNFGKGKIENILINLCITYFDFNGVILQGLKKIRPNNISNILIRTVIEKSLIVASNLPTNERRNIFLNYIADKYFVILKLYNENSMERYCWILPSEERFIIKIKEGVSYKYKDPLKYIQYMKDIINEERIYIDYVKILIEEDCDFVLNNELKTLIPELISSIQLLINNEKYQEAYNTIEEGLSLVKFDFELMLLKYNLLLKFNYEDEALKCLRDIILYGDREKVNKLIKNI

SEQ ID NO: 1224 - protein, 333 aa, Ornithinibacillus contaminans
MADATISLCMVVKNEESSIERCLKSVRDLVDEIIIVDTGSSDNTLSICKQYTNHIHLVDWENDFAKARNYSLQFATGDWIVWLDADEEFDRTTFEDLKSVLQHKKETFLYVPVRNYIGDTISEHDVYTIFQARIFQNNKGITFQNKIHEQIHIPVEDFQYAILPSLIKHYGYLNAEIETKNKHERNLDILKLELESEGHSPWIDYHVASEYYNAKDYEKAFHFVNYAILKFVEEGVLPPAIVYRLKYSIIVESENYQGAWPSINKAIELYPDYVDLYYLKATVLFHLGKYQEAVEVLDHCLLLGEENHNYLILKGTGSFRAVDLKEKCLQKLQ

SEQ ID NO: 1225 - protein, 630 aa, Unknown
  Description of Unknown: Paenibacillus sequence
MSKTISLCMIVKNEEKYLSRCLESVCNKVDQIIIIDTGSTDNTMEIAKKYTNEIYHFTWVNDFAAARNESIKYATSDYILILDADEYLDPTADLQREISSAFDYYFIRIINEMSYGRTLKHTAIRLFANHKKLVYHNRLHEHLNVMDDNNDYKGTSGELIVYHTGYINEVIQDKDKKQRNLPLMLDEVKENPTGYNLFNMGKTYMWLEEHEKAIPYFQKAYSLSKNLIIIPEIIVSLCSCLKELHRYEEGLQILKDAIPLYPQETDMRFVQGCLYMESGYTKDAIMAFEKCLELGDQGITVTEGNGSYIARFKMAEIYEGEFQLTKSYDQIIQAFQTKKSFAPALIKYFELVSKANISSEEVYQNVNMVYNVSSITELQLLLDSLYNVRHPLLNKFLKTYKGVNVQSFVLATAAEYDKDYEQAKELWLKVSLNESYRSDVILLAFILRDIELYNLVVPLFNLSNKEAKTLKGIILNEPVNKIVLNSAIEEIILSIITKLIVLQEFDLFEQLTKVLLSSNNTAIKCRLCEILISYGFMEVAIDMLAQCFKEEPNNISVLRLLGDCCLRVGYLEDAQLFYSELLNLNSDYSTYERCYDLYEKCQDVQGMKVIKGEIKKYFPLAEWIRGFNVL

SEQ ID NO: 1226 - protein, 584 aa, Paenibacillus sp.
MSKSDKSKPLISLCMIVKDEERDLPRCLQSVQGIADQIIVVDTGSTDATIAIARKYGAQVVRSEWTGDFAAARNKGLARAKGEWVLFLDADEELDEATGKQLRLLARESEITAYFLNIWNYMSDGRSEGATINPVLRMFRNDARYRFEGRIHEQIAGPITQHTPLARFHLSDVIIHHYGYKREAVAAKNKLQRNRTLLEQAIKEDPDNRFNWYNLGVEYFRGGEVEEAVGAFRRARDGIEYASVSYAHLLVKHEVHGLQALRRWQEALAMLEESLVWYPDYPDLWHAKGVSLAVLGKSRRAAEAFAAAIQIGRAPAIYHTEDGMGSYQSAYWLGSMHEAELDYETAAHWYAEAVRYRGSLLLPLQRLCHMMRIASRPEQLAAFARDRFIVDSPQAAVKLAGVMLNNGCYRALQLWLDQRLAVATDEERAALKPWKALAEVCVRMEEGLGPEGTAAPTVLELAAAELMAAASWLDEAGGDRPYPSDGAVRWLPLLLRSSEAMRENSSTQAEGAIAKVRSVIGQHLDAKPPAAFDDSGSEKAIRASVQALCGLADYHLSRLQRMDASSLKQAAESIRLLLPAGSDD

SEQ ID NO: 1227 - protein, 341 aa, Anaerocolumna aminovalerica
MITISACLIVKNEEKILARCLDSIKDIVDEIVIVDTGSTDKTKDIARNYTDKIYDFQWIDDFAAARNFSFSKASKDYIYVADADEVIDQENRIKFLQLKEAMLPEIEIVQMKYANQLQFNTTYNFDVEYRPKLYKRVRSFCWIDPIHESIDLEPVIFDSDIEILHLPMSNHAPRDFEIFQKIINRGEKLSKKLINMYARELFIAGTKEDFLKAESFFEMLLEDDSYSFSYEERKAIQCVLVRCSSLKNDLPKLLKYSLNNVAGDKPSSEICYELGEYFFGLSDYKEAIIWFYNAAYETECELNIHYGGDYPLKKLSACYENLGNIEQADAYNELAKQWKAE

SEQ ID NO: 1228 - protein, 626 aa, Paenibacillus polymyxa
MTKSISLCMIVKNEEQVLSRCLESVKDVVNEIIIVDTGSTDTTLDIARNYTDKIYSFEWVNDFSAARNESIKYANSDYILVLDADEQLEAGADFQKDLEKNRDYYLLRIRNEISWDRNFTFAAIRLFKNHISLKYENRLHEHLNIINGTANYTMGESNQLIHHVGYTDDKMLEKDKHKRNLPLMELEVAENPTAYNLYNMGKTYFAIQEYGKAVEYFRKAYPLSKDRIFLPELLTKLAYALAEMKRLEDALSVLTDGVMMFPKETEMIYILGMIYQKAGYYHDAEACFRKCIELGDQGSLITEGSGGYMAHMRLSELYEETGRLEDSYKEVVCVLKLKKNFAPALQQILKLALKLNMCSEEIQAGIQQNYTIGSVEDLQQLLDIMYGARNPILAYYLTTYKITVQSNVLATSKIYDKKYKEARLLWNEIVDKENENGQDLLLLSFILRDDSNLADIQRLLNLSNREKVTLEKIITGTIGKCSLSSRLEEMLLEVCRHMIILQEFEHFQLLIEKIMIIKEETRLKICKLLSDYGFDELSIDMLISMFKNQPNNAVLVQLLGDLCYRNEYFEDAQLFYTKLLRLDSQYSSYERGYQLYERIGDYKNASIMKREIGRIFPLANWARENC

SEQ ID NO: 1229 - protein, 342 aa, Clostridium sp.
MITISLCMIVKNEERVLKRCLDSVRDLVDEIIIVDTGSTDATKRIAAGYTDKIYDLTWNDDFSAARNFAFSKATKEYIYSADADEVLSEENRRRFRLLKETLLPEIEIVQMKYGNQLQNGTVYNFDEEYRPKLFRRLRSFVWEEPIHETVRLEPVVYDSDIVITHMPEQNHAGRDLANFRKQIAQARRLSRRLYGMYARELFLAGEARDFLEAEDYFRAEVSSPDRSADEITEGCCVVARAARLRGAAVTFFKYTSKVIAGDGCSEICCELGYFYEETGDFEEAAVWYYNAAYETQPVLALRTSGAEPLAGLIRCYEQLGLPAQARSYAEELKHRQNEKTDN

SEQ ID NO: 1230 - protein, 362 aa, Lachnoclostridium sp.
MSTISLCMIVRNEEQVLRCCLDSICSLVDEILIADTGSTDLTKEIAKDYTEKIWDFPWIDDFSAARNFIISKARSEYFMWLDADDCLPAEQASSFSRLKEELSPQTDMVLLPYHTGFDPLGRPAFSCARERLIRNRKGYCFCGRVHEAIPLSGNVIFRDIPVEHRKKGASDPERNLKIYQNMISGGEPFEARDLYYYGRELLDHGDYEKSRNIFRSFLERKDGWAENKMDAVRQLACCSRALGQEQDILSILLTGLSYGVPSGELCCDLGRCFMEQNQYAIAAYWFRQALLSEKSAASGAFIQEECYGFYPAISLCVCYDRLGDLENAWKYNELAGTFQPESPYYLHNKIYLETSRISVQIS

SEQ ID NO: 1231 - protein, 383 aa, Roseburia inulinivorans
MPEIIVVDTGSTDNTKAIASQYTDRVYDFPWINDFAAAKNFAISKATNSYVMVLDSDEFIESLDIQKLQEELQKHPYQVGRIFRRNVFERNGIQQENTEWINRIFSKELFHYEGCIHEQVTAINGEAYKTYQTPVVILHTGYDLPEGERKQKAERNIILLRQELQRLLIAFLQKADLSDNANKTFVPVESEYDENQCVNKILSIIEAGDDLSDTLQHEEQLPYILYQLGKGYYMAGNYAEACVYFSCALSFDLNPKLEYVIDMVETYGYALINNGQASDTLFFESIQNEFGNTADFQFLMGLIYMNNARFGEAVAAFLKATKYKESRNVGANSYMAFYNIGVIYECLGMTDKAKQYYEMCGEYGPAEERLKGFCCSDEGSSVV

SEQ ID NO: 1232 - protein, 645 aa, Anoxybacillus sp.
MCTMRPLLSLCMIVKNEEKVLQRCLDSVYGIVDEIIIVDTGSTDSTKKIALNYVEKIYEFEWTNSFADARNYAQKQANGEWILVLDADEYVDRENLKQVVEELKNARETVDGYDVTIYNFMGSYGERVLQHRSTRIYRNRSHIFYYRSIHEQLKKNGSEALTTESLPFIVYHSGYMTQTVKAKNKNERNTELIEKELQSSNSKGFDYFNLANEYLSKAEVEKALQYYLEAYRLKPDFRFSWVSICVVQIILCLKYLERFADALHVISDAENIYSETPDFKYLRGEIYYLQRRHDDALTVLTELVNNKHKYSKSIKSIEYLEYDPHVLLGHIHKHKQNFQEAVHHYTSALSVNNKSYEALFHLLSLLAKFHSEHEIIHFLEKRSWFTNERDILLLLRVVFTIRMTGTAEYYVSMLEEGTTKKGFEIKLKILKEEYKAAIAELLNSSLSSLKVYIQNGSLDLYDVLVASMSIGKLDIIRLLINIVGEEKEKEFLRFILKETDDIPEQNFYLNMIERTIQLQKYDLFEELIKLRDQFDNRINLSLGHLLHRYEFIEVALGFYQSIEDFNDLDADAFVNIIEGLAMREQFAEAIQYGLLGMNLGHHDFRLYKYVLELMKLNEMNEERRRILESAKQIYPDSKWLMEQGN

SEQ ID NO: 1233 - protein, 323 aa, Butyrivibrio sp.
MEDIMPESSDSVSVSVCMIVKNEEAVLRRCLESLQGTYDQLVIADTGSTDDTINIARSFTDEVYAIPWEDDFGKARNISFSYAKCDYIMYVDADDILPSEEKEKFLQLKKDLSQMPVDERPKTIIMAYDAPEGGGLSYRHRMVARHDGPYWGGAIHERAFVLEPEMTTEIKFLHRKLVKPPKDRNCNIIRKIPRDELKEDFWLCIQCYLDMTLAEHHEEAKEYYLMAKAAKEHNASYCVWIARILIINEYFENALLWLEMALESEDNTPDQKLWIYQQLVKAYIGLGRIQEAIDYNDKVLEINPANLAARTNRLILEKKLKEE

SEQ ID NO: 1234 - protein, 358 aa, Clostridium carboxidivorans
METGKKNILSLCMIVKNEEKSLKNCLSKVVSFVDEIIIVDTGSTDNTKKIASEFTDNIYDFQWCNDFSKARNYSISKASGEWILILDADEVVTDFFRYSIDEFINNTLNENKVGRIKRINIMEDSFESKKYTEWVNRLFNKNNFYYEGIIHEQIISKDGQNYETEQLDITADHIGYTKEVLNRTNKIKRNIDMLKSAVSLNPEDPYLYYQLGKSYYMLKDYKTADLYFEKALTFELNYYLEYVSDLVETYGYSLINSRRYSDALIIENASEIYTNNPDFQFVMGLVYMNNAMFEKAVQSFLKCTKFPCGKVEGVTSFSAYYNIGVIYDVLGVKDKALQYYRMCGKYEPALKRIKAQLN

SEQ ID NO: 1235 - protein, 629 aa, Paenibacillus polymyxa
MYKTIALCMIVKNEEQYLRRCLDSVKDKVDQIIIVDTGSTDATVDIAKEYTDEVYNFKWVNDFSAARNEAIKYATSDYILIMDADEYLDEGSDLKADVSSECDYYFLKVHNLLSQGQKIENTSIRLFANFRGLYYRNRLHEHLNNLDEDKKAFTSGFGKSYLYHTGYTDEMMQDRDKQKRNLPLMLQEVKENPNAYNLFNMGRTYKWVGEHEKAVHYFKMAYPLSTNLIIVSDLITNLSQCLISLKREFDALQILNDATVLYPNETDLRHTQALVFLEVHYYKDAIAALKTCLQLGDQGITITEGNGTYMAYYRLAELYEKNYGFSKSYDYIVEAIKLKKHFIPSVAKYFQIVTLANIPLEDVYQNFNQIYRISDVSELKTLLEVLYSLRHPLLNRYLNDYQINSEANVSTVATQYDKQYDKAKLMWLGMENINAENGEDILLLALILKDSELFELSRSYLNLSVKEAKVLRSIIMNHEIDTPKFTTYLENKLENLVDRLLVLQEYESFQCILEYIWLGSLELKCNTLEKMMKYGFNEVAIDLLVKLFEVHPTDAKIIRLLGDACLNSGYLEDAQILYTKLLDLSPEYSSYERSYRLYEQLEDKEMMKSIVESIKSKFPLCLWVHEIAN

SEQ ID NO: 1236 - protein, 355 aa, Brevibacillus sp.
MISISLCMIVKNEEEVLARCLDTIKDIVDEINIVDTGSTDKTVEIAKQYTDRVFFFPWTGDFAAARNKSFEFATKEYILYLDADDVILEADRVKLQNLKETLDPSVDSVSMYYDAGTDEFGNVTLRYRRNRLVKRSRNYKWKGEAHVYLEVYGNIINSDISITHKKIRHSVGRNLNIYQQKLERGDVFGPRDYFYYGNELRENGHYEKAIESYQKNISMQEGWVDDKIHACLFMGDCYRFLGDSANELSAVLKSFEFGKPRVEALCRIGYHFHRKRDWKTAAYWYEIATQYPEDPEQWSFSYPAYRTWYPHLQLCVCYYNLNDFEKAYYHNEEARKYRPEDERILHNKRLLEPKI

SEQ ID NO: 1237 - protein, 727 aa, Paenibacillus jilunlii
MKKPTLGVHLIIRNEAALLPQCLDSLAGAADEIVVVDTGSTDNSAAIATSYGAKVYHMNWNYDFSAARNTGLSHAETDWILVLDADEILKTPVGTITEMLRNTDAMAFTVNIENWLGSLPEDRLTHNVIRLFRNGAGYSFQGIIHEGLDASIIGKHGASVIRSSGIEIIHLGYLPGLMAKKDKISRNEHLLRRALAKDPGNDFYSYNLAVTCCQNGQLEEAEALLIRTINRAPLQASYRPSMIRDLAKIQLSLNHIKAVNALLARELPRYSDYPDLHFIQGQSWESQGLTERAFQSYQRAAAGSEEPAAPVEASSTGVTLEAGAAVNAGATLTAGAALSGKYVSEKGMNSFRPLARMGAISLQLGHFEEAARWFHRALQHHVLYAPALQGIASAFQRLDVPDQDIATLLTQLAGTGQAAGRSAVIHALDAVCAYEAIAGLPQIDFPLEKETLPARASAWIITGRLQEAGAALREALSLLRDTTAMEGDMENLHRLWMIAAICRWQDNRPQPEPLEFADAPEPLRSALLLVDEQLTQHNTAPVLPGDAGNLSRVIAELIRLAVKLRCGGLAGRLAGLFPEHRTDWAEALYESGQLEEAGELLITLAGDQQARGKVPFYLAEMLFDKGHYGEAADWFQHMLAGTPGHEPSRIGLSLSYLHLARQELEEAADSFPEIYAHGPLQEDMKATEQAIAVLNRTAWHTQWNSHRYFRKEPHHEAANPDFPLHDC

SEQ ID NO: 1238 - protein, 629 aa, Paenibacillus sp.
MRPTISLCMIVKNEERYLRKCLSSVKGFVDEIIIVDTGSSDGTLGIVNEFDARVSAFEWIHDFSAARNFAIQQASCDYILQLDADEYLEDGATLQEDIVSNKDYYSVTIKNHKSDGGSFAHQAVRLFKNRIGLLYIGKLHEHLNILDPSLTLSTGDASSLINHLGYLDDTVQEKNKVERNYEIMLKELENNPSPYSLYNMGKVCMSQRKYEEALNYFKKSYELADNMSYVYYLFCYILTCLRLLHRYEEGISLAKVLIDRQPLYLDFHYELARLYEEYGCLQDAEIVFKHCLSDQPWSEKKVANEGANGYLSFYRLACIYEKQGRSGEAFESIFEAIQNNPVYQPAIKLYLRLVLKANINNEEVIAHLEKIYNGKDAEVIKMLLVAIYEARHPIMANYFSQREGQPLDKEINAVVQQYDHKYEQARDLWLEISNIKPDNIVDVITLSIILKDTDLINKCRDVANASHREWKLIKSIIKREPFNSDLGQSWIEPHLVNIAEQLIVLGEFEAFEYLSTCIMKASLAIQIELAILLTDYGFKDTAVDFLLEHYHTNPNHPDILQSLSAILLSAGNYEEAVSLSQQLIKYKNDFKSYQQLYLCYFHLGDDGSAQKVAQDMKKKFPFSSWVNSL

SEQ ID NO: 1239 - protein, 351 aa, Unknown
  Description of Unknown: Eubacterium sp. CAG:248 sequence
MISVSMCIIVKNEQSILKRCLDSYAGIYDELIIVDTGSTDNTKEIAAQYTDKVYDFAWCDDFAAARNFAFSKASCDYILSVDADEELDFHNNTALRSLKEAILPEIDIVQMYYVNESDFNSVYNVHKELRPKLFRRIRTFNWISPIHETIRVNPVIYDSDIEIMHKPTSDHSKRDFSIYFKALDKGIVLEDYVVTMLCKELFISGEASDFIAFKNAFENVFPYENRSENTLEDINCILARIYNITGEQDKFFKIALKSVADNPSSEMCYTLGLYYFAHKDYNEAAIWLYNAAFETKSILDISSSGKKPLYLLSECYKLLSEQCEDDYEKIQYVEMSNDYKSQADSWCMPEL

SEQ ID NO: 1240 - protein, 2077 aa, Unknown
  Description of Unknown: Syntrophaceae bacterium PtaB.Bin038 sequence
MTNGTNLPLISVIIPTFNRSAYLHQSLRSLVKQSIPQKNYEVIVIDDGSSDQTRNVCNQMRRLLPLRYFYQRNSGIAAAKNLGIFTSRAPILFFFDDDDVADKNLLREHLRSHNEHPDEKIAVLGYTAWSPKLKITPVMHYVTNVGHLLFSYSHLVDGQILDFTYFWGGRSSCKRSLLVRHGIHNQAFRLTQDIELGYRLSKVGLKVVFNQRAVSFMIRPVSYDDFCKRCEGKGRFAALFDQLHPDPVIHKYCKTRKAEEKWAFAEKNLARKVERVRELENTLRAVHDHGAGNGQLDELHKLYRWTFEAFRLKGIVQERQSRQSAACLPSPQTLCAGDRDYLDTKWGDEAFTLPKVRTSILVCDPLLPMFDRASGSLRLFHILKALVQLGYHVTFISRDSDHAERYVPILRDLGIETYAGDPSAKEHAGALIIAPFVDLEGILRERPYRAAILSFWHLAEYYLPLIRRYSPDTTVIVDSVDIHFLREIREAELKGDEHLKARALENKEREITVYGNADRVWVVTPDDRKAIESLIGDVPIDVIPNIHERIGHRKTYEETADLLFVGNFNHRPNIDSVEFLCDEILPLLQTELPGVKTYIVGNNPPEAVKKRASDRIIVTGYVEHIAPYLKNARISVSPLRYGAGMKGKVGEALSWGLPVVTTSIGAEGMGLVDGHDALIADDAGEFVSKVIRLYNDAELWNRLSANGKRTVESQWSPEAIQKRLALVLRDIDRRNEKVSIVILTFNELEYTKRCVESIRRHTPEPHEIVFVDNGSTDGTVKWLRQLIRDNPGYRLIENRENLGFARGCNQGIETASGEYVLLLNNDTVVTEEWLSGMMDCLRSVPDAGIVGPMTNHISGIQKVDTADCDAPEGLEDYARDFRRRNLRRRIETRRLVGFCMLFRKSLIDEIGPLDESFGTGNFEDDDLCARAALAGYRNVIAGDVFIHHVGSRSFIGNRIDYGSAMTGNRRIYAGKWRALEQEAEEGRKIRSLVARERARERFLRGDLQAAVDLWLAVIRDMPEDHRAYHEMAGGLIRAKRYREALEVLTEAPASPAPEERLILEGQCREGLDDLDAAEEFAAKALSVRVDCSSALNLKGVIAFRRGAAEQARECFEKAVEADPSFGEPHTNLGVLAWAEGRHDEAFELLERGFILTPCDSDLAERYHAAAVAIEAQARAERAFREARSLYPASRTIAFLLIDLLLSQGRFEEAMARIEDAMDAFEADDGFIAAALAVREKIGPHGAGRRPGVSLCMIVKNEEKNVVRCLRSVKPVVDEIVVVDTGSTDRTRELCRVLGAKVHDHPWTEDFSAARNVSLEKASGDWVLVLDADEALSQRDYPTLRKAARKAPKKPRAFTMETRNYLNLTQQTGWRANVGEYPAEEAGSGWFPSEKVRLFSRDARIRFENPVHEIVEPSLRRLGVKPERLAVPVHHYGKLDAEKAREKGEAYYALGRKKLEQGNGDVESLRELAVQAMELGRVEEALDLWTRVAELRPDMARAHVNLAHIHLEHGRYPEALESARKALALDPGMKEAGLNCALGEFYAGDIAETVRILEALLERIGAYPAAAGLLAAARIVRGERDQALDCIEELRRQGFGDLTFLRECAAKLECAGRIPEAAALLSFLGPAQADDPVPGTPVPTETDRAATPCPSLSLCMIARDEEAVIGRALSSVREAVSEMIVVDTGSKDRTREIALEKGATVFDFPWCDDFAAARNFALSKATGEWILVLDADEALSPADAMRLSPIVQEAPDDIAGYLILTRNYSAEMNTEGWTRNDGRYAAEEEGPGWYPSTKVRLFRNDPRIRYAGAVHEMIEPALTRHGFRWVPCDVTVHHYGPLAGRSKGEMYYRLGHKKLAEAGDPRALYELAVQAGRLRRFDEAIDLWERYLSLGSTEDLPLAHLNLGHAFLETGRYGSAADACARALALDPGLKEASLNLAMAEFYEGRLEEAAGRLETLLARTGDYPPAAALFCAACLVTGKSEKAEARIRALSAQDINPAAFFQVYASRLRASGRTDEAETLLETARRLWEDELRTRGLENGPGDVAQVMSAVEAEIPPVQTACDRYRRGESRLL

SEQ ID NO: 1241 - protein, 644 aa, Paenibacillus sp.
MEKLVSLCMIVKNEEEVLDRCLKSMKSAVDEIIIVDTGSTDRTKEIAHKYTKHVYDFTWVNDFAAARNESIKYATSKWVLIMDADEYMQEKDAEMLRSFLSNLIPREDQFFTVSVISYLGDVKNNNFSDAPVPRLFPNHMNFEYNRPIHEQIVSKKGIPAVSIAAPVNIYHTGYLADTLNKKNKSERNLDLLINMKKNSSLTQYDYFVIGNEYTVLKDYKKANYNYKRALQGTTSKHPWYIHCLIAYIQNLLIVNHVKEAWELIETKLIEWEEFPEYHTFKGAFYIDLGFYSLAKQSFLQALNAAEKRLEVDNNFWAVFPQLGSNIPYLNLLKIYATEKNIKEQIVIMTRMLMQNTSNLPLLAQWIELLAMNESESETIRLLGKFYPDQEDKLSVTKLFSTAVAVGQPAVAHHFYKQLDTSYISSVSHLQYAILTNNKELFKEELSSSSRLTADPKRINKCLLLAALVWNDAVLLKEISNADANYDLKIFVSEYLADRHTIENTVPEQLLYDLLTDLYNLHQFEAFDRLMQDIPFNPVIVNHLANYFYNKNQVDLALQYYSVLLDQDELDAISCENLAHLHVNQDCLEDALMFFEEAIKLSPNKKHLYIQYCIHCTDTDKKNLMKKKFLDVFPQYRQLPAVQNL

SEQ ID NO: 1242 - protein, 658 aa, Paenibacillus silvae
MTLLSVCMIVKDEEKVLERCLSSIQNLADEIIIVDTGSTDETKKIASKYTNHIYDFKWCNDFSKARNQSIQPATGKWILVLDADEYISQEDHRDWRNFLIQEEPVPHLAYTLPIINFTGEKEFEDEITTSPVTRLFPNHMGITFERPIHEQLTRGSKGELFHKTLNLHIYHTGYQISHIKDKNKHERNMSIFEQMMLEQDLCSYDWYTLGNQYRYAKNELKAIECYEKAMTGAERDEAWYPHCVMGLISLYYGQDQLKRSWELTEQYLVRYNQFPEYYTVRGIHYETLGFFDEARLSYIEAINIAEKRAKTKQDIWLIDPMYSFDSPVQQLIGLYFRLNDNQNAIYWMSKQLNKNNKNPGYVAKMMEWLLQNEDEESVIRFFEKIYISPSEGDYLLLFKVSLFLGNRVLVNHYKALAPMSMELSPADQLKLSLVDRDLNGMHQLLDKFALISQDEKHVCLQVITGVLMWNDTSLLDKISKKIQNKDVWLSAKTMVDVFLQVEPGNPSIIEMDDLFAVSRQLFLLKEFEVFDQWVNKINNDDLTNKLANYFYDMNHVELAMNYYSALLSGNRLSGMSFENLGFYHANQKYTEDAVEFLNAALLDEPGKRHIYKTFISLALKQDKLRLMKNFKNQFSDFDEISFVREFLDKEIEALNYTV

SEQ ID NO: 1243 - protein, 259 aa, Unknown
  Description of Unknown: Deltaproteobacteria bacterium sequence
MEKISVYVLTYNNERTIERCLSSLQWADELVIVDSYSTDGTLEICRRYTERIYQRKWTNHQEQYQYAADLTTNRWIMFVDADEEVPPELAQEIRQELGDNNGQWDGYIVHRRTYYLGRWIKYGGWYPDYEIRLYDRTKGRWEGGLHAKVKVDGRVKTLQNCYLHYTYKDISDQIQTIDRYSQIAAEDMLREGRRFSLANMLFNPLFRFVKEYILKRGFLDGIPGLIIIVSTMFYVFIKYAKLWELQRELKDGNEVRRDL

SEQ ID NO: 1244 - protein, 609 aa, Clostridium sp.
MSTQISLCMIVKDEEKNLPKCLESVKDLVDEIIVVDTGSTDNTVEIAKSYGAKVYYFKWCDDFSAARNKSLEYAAKDWILIMDADDEFCSEDKDKFKKLVNNLDINKTYFFETLCYFGTTKGNDLTVNLNPRLFKNKYGYHYEGAIHNQLVNLKHSINGVYEDIKIHHYGYLDSDVVDKDKNKRNIRILERQIKKDPKNKFNYFNIGNEYSSIYEEEKALENYYKAYDNFDPSAGFASKLIERIIISNYNLKYFNEAVKFVDEGIKYYPEFTDLYYLKGLILEAQHKPTMAIKAFEKCIELGEAPIVLKCIYGTGTFKASHELSKIYMDLKDYDMAYKYCIDTIRFKPDYLVPLYNISHILKQEKTPVDKFKQTIEAFFPDIPNQYPVIADLFYMEGYYTTALQYIEQYGTQGLSENLRFFKVKCLIRSGKFKECIKYAESIGEDDLYYFQTMMYKVICFAAMDEYESAETIMKQFNLNKKTNYNKKIIQVYRQFLNIFEGRSASILSEDENEKDYTSSIFEICEILLVSKEFDKFEKSLELLNLISDKSVLLQLGKMYYKYGYVDMAKKEILRSIKMFDVIDSESLDILEMCIQKLSGEKSSFTVLCF

SEQ ID NO: 1245 - protein, 631 aa, Bacillus sp.
MKPFLSACLIVKNEEDMLRRCLESLQDGVDEIIIVDTGSTDNTKKIANEFTDKVYNFEWTNDFAEARNFAGSKASGEWILAVDADECVEKGNIEVAIKEMKLNGAKYNTYNVEIISFLGEDGQNTTAHKMNRIYKNNGEIRFNGAIHEQLVAVSGTQKFGLSSLTLYHYGYLAHIIEKQDKKNRNLKIIKQDLKSGKNKGFSYFNYGQELRSLKKTKEALDTFIKAYKLKESIDEGWVRTCLFFIIESLMELKRYEDALKIVEDAEIMWPSVPDFIFSKGDIYLLQNRFDDAKQVYQAILANQEAYSEVVLHFDRKSFLPQERLGQIYEIEKNDEEALKHYIKALNENASSLPIINSIVRVLSEYHTAKEVYGFLLNQNIVKTDTIRLDVIKYLLNEGNADLVVELANDLEAGNKRLINVINLKGSMIASSPNEDETLIIEKHDVLLGIQEGIFDLADLCVLYHITKDEFIAEKIKSSKFKYIFTCLFEELKRSKKMKQEEYLAILRRALCYKQVDFVENLISLKERVHKDIDAKIADLFYENGYEDIAIDFYERLDRNQITKQGYVNMIEWFISQHAFEEAHLLAIEAIDKFKKDFRFYKYAIETTQSNRGAIVTKGLCEFPDSNWLKLK

SEQ ID NO: 1246 - protein, 586 aa, Desulfosporosinus orientis
MNQRISLTMIVKNESPHLAKCLESIKNAVDEIVIVDTGSDDDTVCIAKKYTSKVYFYPWNNDFSAARNFAIEYASGDWILSIDADEEVKYQKTDCLHTLLGLENDKEAFLLPLLNPISDSGEEYNTFYVLRLFRNNGRYRYVGKIHEQVFIPNQEMIGLATEPILKHQFLPRKQRHQKRDRNLRLLKKAFQKDPKNLFLHYYLGVEWLMLGKASYALPLLQSAYCGLGDNYLLFRSPALKYLTLAYKELGQHNDALTLCIQTSLEYPNYTDIFYLGGLLFEEKKEYPIAIKWFNQAISCGPPPALFSHFTGTESFLAFYHLGFCYEKLGKSLKARQAFETALKLNPKYPFPLYSLFLNLLSEKTPPMIYKHLDDLKFLATPLLCFTTAELFFLSNQAELAFLCLDDYKDRLLNEESFLFYYSKYSIFSGRMDAGLKSIGEIGIQNPYYEKAQVLSVVAIILLGDFQKARLLGIKLWQNPSSRGDAYLLLWLIRFIQKLTPPPPVSKIREQEIYDKVLKLYTDCRHYQSPIFTPQPIVDIYRLGLEELMKSSEKGFLQLLRDYDQRLNELKNHLTARFGTGWLPHGY

SEQ ID NO: 1247 - protein, 424 aa, Unknown
  Description of Unknown: Yersinia sequence
MLNRWVDNISFILEIDKRLTNLIEPEDLSVGDVLKKISFLFEDIEQTPNPTLSAIIIVKDEERCIKRCIDSIINSVDEIIIVDTGSTDSTLDIIKGIGNHNIIIHNMIWIDDFSHARNFAKSKASKDWLMFIDADEYLEAIDDNEIKDKLCILQTMSIKDEMVVCPFISNHNGYNIKTVRRFFLNNTDINYFGLVHEEPRIYDFLPYYISIDVKFFHDGYMDEIVKSKRKTERNLYLLNRMMLLESNNLRWKFFYYRDGIDNIDLLDAEVEIKSAISLNKENDFSADNVIDDEFTFALLDILANNLFRQGKFDDANLMAEIMNDFYPENSNSYYYKCLIKIIRLREEVKKLLNDTIIYREENINPQYGMIHSEGYHIDLLISILLFENGYIKQAVKYFTFLDEIDFKSNILNEYKEKIRVIKSF

SEQ ID NO: 1248 - protein, 359 aa, Jeotgalibacillus sp.
MVSISLCMIVKNEEDVLARCLDCVKDIVDEINIVDTGSTDRTVEIAKEYTDRIFHAEWNGFAPARNESFSHATKEYIFYLDADDILTEEDQKKLKKLKETLDPAVDSVSMFYNAGTDEFGNVTLQYRRNRLVKTAKNFRWEGEVHNYLNVSGNIINSDIAITHKKTGHSVGRNLNIYKMKLERGDVFGARDHFYYGNELRENGHYEEAIESYTKNIEMTEGWVEDKIYACINRGDCYRFLGDLDNELKSLFHSFVFSKTPRAETCSRIGYNFQRKKEFQSAIYWYTLATQIVPDENRWSFSYPAYHTWYPHLQMCVCYDRIGEAEKAYFHNEEARKYRPNDKSILSNKAYFDKKLGKTE

SEQ ID NO: 1249 - protein, 260 aa, Methylobacter sp.
MLTVVILTKNEEVNLPRCLDAIPERYPVVIVDSGSTDSTLVIAEIRDCGIYTNPWPGFAEQRNFAIHQCDIATPWILFVDADEIYPEQFYNWFEGQMAGTDSIDVVMVPSILYLKEKRLNYAPGYPIYHPRLVRRETTRFVSNHTGHGEAVINTCRIRYIDIPYQHYFYHGEIMEWMHKHINKGVQELRPIPTAGAVMTTRGRLSVLLGRSWLRIIARFLYHFVFRGGFLDGAAGLEFALMFTWYEATIYLQAKAGIQAR

SEQ ID NO: 1250 - protein, 584 aa, Unknown
  Description of Unknown: Peptococcaceae bacterium BRH_c23 sequence
MNERISLTMIVRNESVYLADCLESVKSEVDEIVIVDTGSTDDTISIARRYTPNVYSFPWNNDFSAARNFAIEHASGDWILALDADEEIQFQGPKSLHALLDREKDKEAFLLPLLNPVSDSTGEYNTFYVLRLFRNNGGYQYVGMIHEQVSLPDQQKVGLAKGPILKHKSLPLKIRHQKRIRNLNLLKKASQEDPHNPFLHYYLGVEWLMLGKPAYALPFLQKAYFSLSDENLLFRAPALKYLILSFRALGRLDEALSLCLEASLDYPSFTDIFYLGGLLFEEKEEYPIALKWLDHAITCGNPPALFNHLTGSESFLAYYHLGFCYEQIGKIPEAREAYETALKLNPSYPYPLYSLFLILLREKGSSLSYQHLEDSGFLNDPLLCLTSADLFFLVENVEQAYLCLEKRKNLFLKDERFPFYYSKYCIYSGRVHEGFNRLHQMTVDHSFYKDGQKLSIVALILLGDFQSARSLAISFWKHPSTRCEAHIFLYILRFMQNNKLPTPSLKVQETDILNPTLELLADCKRYRSHESYHNPLVATYSLGLESLIKFTEKGFHQLIDDYDQRLLDLKNLLVAKFGNCGISK

SEQ ID NO: 1251 - protein, 1323 aa, Zavarzinella formosa
MRCLFGPVGNPFLKQYLGESTRRERIIPFGPDHFPIGPTDTWETIRVRLGGKEPDCVIVNLGYTSVPDCVWTLPVPVIVLAPDWHLLWHQYRHCLPFAELAITDPAGVEAFRLAGFNAEPGELSAADRPTSRDPGAERDIDVVWVGNLNPAIQRDRAWVLQQLGRMSDRCRVVVRASRDQELFRDLCRRGKIVVESGGPGERRRQAWEASSAGSLYLAVGDGRLLPSPLGDIAFTEETLEGIIWRYLRHEEERRRLVREASASLPPVTFEESLNAIIDTIIRQFPELKARAARRPAMTPLGNLRLRTAQALHQPETADPTLTRDLLIAARDRSHASFCQNALGTLRHRGGGPNPSRNHQALDDFRQAVSAGPGDLLACLNLSEALALTGNPVPAVDEARRGLALIGGASLGRPVLIGDGTRFPPAYDWFRIEWERAGWEHAGDPAGERKARTELIRWRLHSLIAEHTGDLTHAYEAVTARPDLPVTRSALGLALARSGHASEALNHLWVAAELNPFDREAAAAVHALIDSRGEGFKARQFARRRRLLAETIPQALSLEPWFADATRPEADLASVIIPCHNQLTYTRLCVESVLRSVNGPFELVLIDNGSTDGTLEYFESLAGRPEPVRVAVIRNEKNQGFPAACNQGLRRAAGEYLVLLNNDTITPAGWLEGLIRAVRSSPEIGLAGPVSNNAPDAQFVNVPYVDREGMEAFAAERRRDWNGRLLPTGRLTGFCLLIRREAFEKIGGLDERFGLGFFDDDDWGLRAIQAGYKLVVAQDAFVHHFGNRTFKALGLNIRERLRENFRIFGEKWGPEHTKGYHLPGPPAETPDRLDPLNPAGSATPEDKLAPPMRARASGRPRVSLSMIVRNEEHHLPECLASVRDLVDEIVVVDTGSTDGTREVAARFGARVYEFPWADSFAAARNESLRHCTGDWIFWTDADDRFSEENRDRLRRLFAGLPDEIAAYSIKVRSVVEEGRSVRMLDQVRIFPRHPDITWRYRIHEQILPAVSDLGGATRWTDIVVDHVGYADSSRRSGKLDRNLRLLLLEEAEQPREPFTLFNLGRTYLDLNRSAEALDIFRRSLDNASPSLSIVRKLYPLIAQAHARLGQHAEAMAACREGQYKFPDDAELLFQEASLHADVRDPAAAEACLVQLLRTRQGEYFDMVDAGVRGYKARHQLANAMFDQNRPAEAEAQWLAAVGEREDFLPAWQGLGDLFVSLSRWDDAERVRRRLVELMPDSADAEVFGARILLARDMPGAVRELLANAIAGHPGDVRLRIMLTHALIREGKDWPATEAALRDVLKIDPNNADARHNLNVLLNTM

SEQ ID NO: 1252 - protein, 1308 aa, Selenomonas massiliensis
MKLSACYIVKDEVEELRRSLASVHAAADEIVVVATAGVARVAELAAEFHAALYEYPWQDDFAAARNEALRHVTGDHVVFLDADEYFFSPTEVRTGIAAAFDGMPHADIVMISLCSFRTPGVRTDAIYERVPRIFRMPGLHYEGSIHEQLVRDDRAERILVYADERLAAGHTGYLSVRSDAKIRRNIELLERDAAVHGWTAKHAFYLADCYFGLKDYARTLALSEEALRSDRAFIGYEGKIYHQMIESMRALHTPDEKMLPLAEEALARFPQLPDFYAERGMILCGLARYEEAAESLAKGLQIYDQVGRSTRDASFFNDAVAARVAERLSRIYTHLGDMERVKFWSKREQEYMGKNADAEEKTLLISACYIVRNDARHLKSSIESLRDQVDELIVLDTGSSDESAAVAASLGAVVHHFTWRDDFAAARNEVLTYVTGDWIVFIDADEFFSAETRGNLRTVIEDAAAKDHELLLLPWHNIDEASGETLLDSYAPRIFRRCTGRHYEGRIHETLHDADGSAPAVRIVPAELLTLVHTGYSAVLTREKGERNLRLLLDELAQTRHPERCWRYLAETYDNLGDERLAEHYALLDIGRGRQSVIYASRSYRILLRIYGANPMRREERLAVAAQAARDFHELPEMHAEYAEALAALHRYEAAIAAGERAFVREEQRATDISDFTEEMGAELRRRMAVWAQIAAHERQISITAAVFVRDDARDMKTWLENTALYADERIVLDTGSTDGTRTMAEAAGAVVVDFLWQDDFAAARNAALAHVTGDWAVVLDADESFFDPSELRAYLAMLDIVRPHVDAVLLPIVHVDEDAGEKETGRAPHIRLLRMGRGLYYEGRVHEALRKNGGDLKLHHEPAALAIRHVGYSSGRMRAKHERNLMLMERHIAEHGLQPGDCRYLADTYYGLGQYAAALAYARAAMEEDVVSVGAQSHLYHLLLDAMEKEHVPLREQITAARAACQAYPQLPDFHGRLGLLCAAGESGEALPELTRALELYERPIDTNGEASAFPAWAGAVSAARARLLVEMDEAAAAEAELMRSLSLDTAREEALDVYVELHRGMEAGQLAAALNDMLGADEEALSYLVRFADSYGWLSLAEAVRAESARALGNAVSPPAIYAHVQKLAPAEAGGFFVGTLAGHVREIPEILLRLERDRHVESLHLYHRLRALLPRGIRAFWRHYDEPDAVRCPADREGYDLVREAFVHHADAEQAERFLHIAAGYGAEVLDAAAQAFEDAQRWEGALIGWTLAAALKGETADTLYGTALAALHLGGRTEAEGALARLLALDPAHRKARELMELIR

SEQ ID NO: 1253 - protein, 254 aa, Unknown
  Description of Unknown: unclassified Rhodanobacter sequence
MTAAREPLSVVVTSFNSAATLDACLRGVRWADEIVVLDSGSTDATAAIAAHYGARVHVQPFAGYSAQKQAAIDLASHRWVLLLDSDESLAETAAVPLQQALHAPTHVAYQLWRREWQFWRWQSGRARLNHYVRLFDRQHARMSGHAVHEEVCVDGSVGVLDVTIDHHGERDIAGRVAKADRYSSLQLGDLARRRVRWLRLRMVAYPTVAFLRFYLLRGHWRSGWAGFIAARIHAFYAFLKYAKLYESRRQRRDQ

SEQ ID NO: 1254 - protein, 651 aa, Geobacillus vulcani
MNEERRKNMMKPFLSLCMIVKNEEKVLQRCLDSVYGIVDEIVIVDTGSTDSTKEIALKYTDKVYHFEWTNSFAAARNFAQQHATGEWILVLDADEYVDRTNLQEMIQVLKQADNGVEAYDVNIYNFMGTYGERVLQHRHTRIYRNLPHLQYDRSIHEQLRKTNGEYVQAEQGILTVYHTGYMSYVVTEKKKHDRNAPLIEREIQAGDSVAFDYFNLGNEYLSKGEVEQALQSFIQAYQHKKDIRLSWVSYCLVQIILCLKYLQRFDDALRVIADAENLYSETADFQFLRGEIYYLQHRYDDAAQQLEYLLENKNKYPYTIKTVEYVEYDPHMLLGHIYKHKGNLQKAIYHFSCALSFNRKSYEALYHILQLLARAHSEEEIVQFIENKQLANDLFAVSLIARIASNLHLEKVMCSLAAKLGDEVIQRGFEIKVNILQKRYDEALQQILKSSVADLQTYVRSGSLDSYDLLVAAFKTNQLDVVRLLFHLVSEHREKEFLLFMMNEYEETPEPTFYLLLLERTIQLKEYELFEQLLALKGKFPENIHIQIAHLLHRYEFMELAFQLYRSVENMNKWDAESFVNVIEALAVKNEAIEAMQYGMLAISLGHHDFRLYKYVIELMTICGMDEEKKKMVQQAKQLYPDSEWLKEKER

SEQ ID NO: 1255 - protein, 635 aa, Paenibacillus sp.
MTKSNISLCMIVKNEERCLERCLESVKGVVSEIIIVDTGSTDRTVEIARKYTDKIYYFEWTNNFAEARNFGLNYATGDYILHLDADEYIGKGIEHLSEPHDKDYYYMRIRNELPFGNAEMHQFVRLFRNDPELRFVGALHEQIDLLKHKDLQWGLHDAMIYHDGYLEDIVKEKKKNDRNMKIIQVEAREHPNAFNFFNLGVQYSLEGNHEKALEVLKKAYSMGQHLSYAQRILTFIIKSLMELNRYPEALEISQDSALLYSNSADFQYRVGLIYEHLRYDKDAEQCFQRCLEIGEESSRTEFNHYEGLGSYLAHGKLTELYLRNGNIELAQKHFLLGVKEGPDLMFFTKLFTDLFPHLKGKEFVDGLMKIWPLDSAKRIEQFVIYLYSIRHQGTLDLINCYDIDIPQEVKAWLATLEGDLSKAEELWSHAQGIHEYHFRDLLLLSFLLKSPAPMKQYKHIFNVRDKEWKWWEDVVSRKKTTEISLSKDIQTHWRNLCEDIIRTNEFSALEDLINSTNNPDLRVIIAEILYRRGFAEVALEVIIEANSKEGNKKIYPVVRDILRGIGQHEDATYYAEQAYGLEQSFSNGYELLKLYVELDDRKMADAVFNILKVMKPASPSMQVMDFSEWLGQYNS

SEQ ID NO: 1256 - protein, 361 aa, Bacillus shackletonii
MITISLCMIVKNEEEVLARCLDSVKDIVDEINIVDTGSTDRTVEIAKEYTDRVFFFEWIGNFAAARNESFKYATKDYILYLDADDVILEEDQKKLMELKQSLDPSVDSVSMYYDAGTDEYGNVTLRYRRNRLVKRDKYYKWRGDCHQYLDVYGKIINSDISVTHKKIRHSVGRALNIYQSKIERGDIFTARDYFYYGNELRENGHYEKAIENYNKNIELTSGWIEDKLYACINKADCYLFLGDSENELKSLFQSFEFSKTPRPESCSRIGYNFQRKGDYRTAVFWYGLATQLPPDSDQWSFSYPAYYTWYPHLQMCVCYYYLGDFQKSYEHNEKAFQYRPNDKRILQNRELLRNKLAINNE

SEQ ID NO: 1257 - protein, 364 aa, Ruminiclostridium sufflavum
MIVKNEEAWLDNCLQSAGNIADEIIIVDTGSTDGTKEICRKYNACIYTFLWNENFSEARNFGLEKASGKWILWLDADEELEIDDTASFLNMLEKSDTDFQMISLINYFGSPPPDPNKSYLFSSYRLFRNNRGIRFTGSIHEHLDIQISSASANYEVIPNARIYHYGYMEHVVEIKEKHKRNLYLLQKEKQGSDYSPWIDYHIASEYYRVKKYIEAFNNINLSLKRFLEKKTIPPSLLYKLKYDILLALGSFEGAWPGINNAIALYPEYVDLHFYKGLILFEKQKPEEAISAFQQCVKLGDNNPRYLTMTGCGGFRAWYFIGRCSEAMGNPSEAINAYSRAISLYPDCQEASDRLFYLKSITIGQ

SEQ ID NO: 1258 - protein, 658 aa, Paenibacillus sp.
MKLLSICMIVKDEERVLERCLSSVQDLADEIIIVDTGSTDKTKEIAKKYTDKIYDFKWCNDFSKARNESLLHATGKWILVMDADEYISEEEHQDWRNFLQKEERIPHLAYTLPVINFTGEKEYDDEITTAPVTRLFPNNVGITFERPIHEQLTRGPQDELYHKAVSLHIYHTGYQVSRIIEKNKHERNMGIFDQMLADQELTSYDWYTLGNQHRYAKDELMAIECYEKALSDAHQNEAWYPHCLMGLVSLYYSQNQLKRSWELTEKYLIKYNEYPEYYTVKGIHYETMGFFQEAEQQYLRSIGIAEKRAQENREIWLIDPMYSFDSPVQQLIGLYFRLNDNQNAIYWMSKQLNKNNQNPGHLVKMMEWLTQNEGEESVIRFFEKLYTSPTDRDYLLLYKVSLVLGNKRLVSHYKKLVPTDTEQSLSDQLKLFVINGDFAAIHVLLDNTTIITGDEQLVGLQVIVGTLLSNDRSLLNKLSKKLENEKLFSVLKVVTSIIDQHEVSDDIVLDTDVIFAIARQLYLMQEFEVFDQLVNGFNNSDLINRLANYFYDVNRVELAMNYYSALLSRNELNGTSLENLGYYHANQDYRDDAFEFLNGALQDEPGKRHIYKTLISLASNQHKKKIITDFEYNFPDFNEISFVKEFFANELKMLKYTV

SEQ ID NO: 1259 - protein, 657 aa, Desulfotomaculum nigrificans
MISLCMIIKNEEHNLPRCLSSAKDCVDEIIVVDTGSDDNSVEIAKQFGAKVFFYQWDDDFAAARNFSISKATGDWVIYLDADEELEPDCASRFRALAENPEVEGYYFHINNLCDNDDALRHINVRMFRNKPQYRFDGQLHEQILNAIQDSNPGHQSPVVDSGITILHYGYLYSEFLAKNKAQRNYRINKRLVDQWPDNPFYLYTLGCSCINLGNLTEATDYFRKALKYIDFRATYAPSVFISLISCLIRTGELDEAMEQIHRCQQQFPDYADIYFVEGELAARLGLVEKARVCFEKCLSLGEQVQGKFTTKTGVGSFRPMFELAQLYQAQGDLEKAIHYQLQGIKYKDDISQYVTLARLLKTYLKDDVRLLSILRELCQQKDKVKECLTLGQILYDIGAYDLAIRLLDEAPAGPGEIAYLKAQCLLKINGYREAIETLKQIKPGSQLYQNSLPSLVLAHWLATPPLDAAGLLRSGNRQHGEAYETFLCINEHLFKRHPETKIDANSKAFKKLVDQLISLNQAELLVQILTLGGLDTPYSKVWYLTQPPMNPTKLELAAKLALLELKQGSRQPDYPYVLGWYFYDHDELASAQQMLLQAIKLNPADRYKKLLKETYRKQCLNMVKTALQHYPDNPKFSRWLIDIQKDRIQYAGLKGVH

SEQ ID NO: 1260 - protein, 343 aa, Acetitomaculum ruminis
MISISLCMIVKNEEINLKRCLDSLYGLCEEIIIVDTGSTDKTKEIAKNYTEKIYDFDWCDDFSAARNFAFSKATMDYIYSADADEVLDEINQKKFLDLKKVLLKEIDIVQMSYKISEDFNTTQNFNSELRPKLFKRLRTFTWIDEIHETVRLEPLVFNSDIEILHLPSGLHSRRDIGIFINLCKKNKRLSPRLLSMFSRELLISAGTEELFEVAPYFIEMINDTGRGEDEIMQCACILSRYFRLKNDISNFFKYALKSITANGCSEVCYELGEYFFSINDYNEAAIWFYNAVYETKAILNALTGGKAGLLGLSKCYEALNNEDLSDFYKNEADMWSPPKDDYS

SEQ ID NO: 1261 - protein, 362 aa, Unknown
  Description of Unknown: Bacillus sequence
MVSISLCMIVKNEEAVLARCLETIKDIVDEINIVDTGSTDSTVEIAKQYTDRVFFFEWIGNFAAARNESFKYATKEYILYLDADDVLLEADQRKLEELKETLDPSVDSVSMYYDAGTDEFGNVTLRYRRNRLVKRAKNFVWKGDCHQYLEVFGNIINSEISITHKKIKHSIGRNLNIYQSKIERGDEFSARDYFYYGNELRENGHYEKAIEAYNDNIALLEGWIEDKVYSCINKADCYRHLGDLENELRSLFQSFEFSKTPRAETCSRIGYNYQRKREYNAAIYWYNLATQLVPESDRWSFSYPAYYTWYPHLQMCVCYYNLGDFSNAYNHNEEAGKYRPEDLKILHNRKLLEGKLGIGQGI

SEQ ID NO: 1262 - protein, 357 aa, Lactobacillus vini
MKLNLSICLITKNEVANIERCLASIEKIAQEIVVIDTGSTDQTKQLCQQYTNKVFDYQWQDDFAAARNFAISKASHDFIWMLDSDEQVEEIDLHAVNKFIENSDGRTVGRILRKNYTSFNSAKNTQIKTERINRIFPKKYFKYFGRIHEQIVPTDSSVSSNKPIDLPVEIEHFGYQLPAVLTAKAKRDLKLLKLELNDQPNDPYILYQIGKSYNILQENPLAVSYFQKALAAADDPRKDYVYDCVETLGYALNKIHQSKSGIALLNQYPLYQKLADYWFLMGILQMNAALFQPAVSSFLQATKCQHCHTIGCNSFLANYNLGVIYEVLGNQAMARDYYQKCGDYGLAQKGLQRIRKK

SEQ ID NO: 1263 - protein, 587 aa, Desulfotomaculum sp.
MMNETITLAMIVKNEAGNLENCLISVRGQVDEIVIVDTGSTDGAMEIARKYTDKVYSFFWREDFSAARNFAVEKASGDWIFYLDADEELVPGSGDLKCLAARDLCPEAYLLPINNPIDGVTGEYNRFFVLRLFKNNGRYRFKGIIHEQVAVPENGVVEIAEGPVINHRKLPAGNRNRKRGRNLSLLIKASSADPRNRFLQYYLGVEWLMLGKPERALQFLQQAYRNLTDENLLFRGPALRYLIICLNALGRLDEAICLCLEADLKYPEYTDIYYLGGILFEEKQEYQLAIKWLSQAVKCGTPPPLYSHQNGSESFLAFYHLGYCHEMIGQTDAACGYYLQTLTANPKYIYPVYNLFLIILAKSGPLRALEYFKEKGCLNNIEIAFTAAGLFFKSGYPDLARLCLEENGTDRNKDEKFRFYLGKYSIFSGNPGQGIEFLKQISAESEFFVRSQIYQAIALLLQERYSESKSKALALWKNRLARREARILLGLTRQMQKKGILDNCPARIGEDDMLGAVREILEECGRCLPDGRVSAGFDSIGLIEELESITKNFSHKGWLTLYEYYRDKTCAWRDFVNYKFGLGGGRS

SEQ ID NO: 1264 - protein, 342 aa, Unknown
  Description of Unknown: Lachnospiraceae bacterium 10-1 sequence
MVTISLCMIVKNEEKILARCLDSICDLMDEIIIVDTGSTDKTKEIAAGYTQKIYDFTWTGSFADARNFSFSKAECEYIYTADADEVLDRENHEKFRTLKRRLLPEVEMVQMYYGNQLSYGTVYNFDRELRPKLFKRLRTFQWIEPVHETIRLLPVVYDSDIEITHLPEESHAGRDIEIFQKMIDAGQKLSLRLMNLYAREVLIAGSGQELVKAEEYFTQAAEDPQTGEEQLKEAVCVIVRAARIRGDYLKMFRYAMKDIAGNEGGVSEVCYELGEYYLDEGEYQEAAIWYYNAAYETASILNIHCSQELPRLGLCRCYEAMGFYEQAESYKKEAEELASFAG

SEQ ID NO: 1265 - protein, 357 aa, Bacillus sp.
MVTISLCMIVKDEEATLWNCLDSVKDIADEIIIVDTGSTDRSKEIASEFTDKIYDFEWVGNFEPARNFSFKHATMDYILWLDADDVLLEEDQKKFLELKKDLDPSVDSVSMIYNYGFDEYGNVTLSFRRNRLVKRSRNFQWEGDCHVYLVVSGEILDTDICVSHKRVHHSTGRNLAIYEKRLEKGDSFSPRDFYYYGNELSENGHFERAIESYTACLDMEEGWREDKIAACSRLADCYGKIGELEKQRLALYKSFQYDVPRPEVCCRLGDLLAKEKNYRAAVFWYECAIDYVQPSENWGFTYKAYSTWIPHQNLCKCNYYLQNFEKSYEHNEIARKYRPEDSGILHNKKLLEDKLKI

SEQ ID NO: 1266 - protein, 300 aa, Unknown
  Description of Unknown: Candidatus Collierbacteria bacterium CG09_land_8_20_14_0_10_ 46_12 sequence
MKPGISAIVVVHNQQDLLHNCLKSLTSWVNQIIIIDLVGLDDIKSLATSFKAKYILHKNVSIVEEIRQDSLKYAEHEYILFIDPDETIPPSLSQDLKDKLKTSQFDYFLIPRQNFVFGKWLKHSRWWPDMQTRVFRYNKVTWGTTLHAEAVATGEGYAYPSEDRFAIHHENYRNLDEYIEKNMRYAKADALERAKSGTNFTLVVATKLSISELISRFFLDAGYRDGMHGLVLAILQSFYYFMVYAYYWEAKKYKDLESESTIQSFPRVWFSHGLSEVLYWDKKHNFLANIKSKLVRRLIK

SEQ ID NO: 1267 - protein, 256 aa, Niastella vici
MNAITAVIITKNEEKNIQRCLDSLKPVAEEIIVVDSNSTDNTVALCQQAGAKVIVQNWLGYGPQKNLGNNAASHDYILSIDADEALDEQLTQALLEEKRKGLQGIYQISRFNYYYGKFIKHGADYPDKKIRLFNKINTHWDEKDVHETLVIGPNQKTTALKGHLLHYTYYRVEEHILKINYYTNLAAQDYIKRGKKASIFKIVFSPLSTFIQSYIIKRGFLDGLHGFILAIMHAYAAFARYVKLWELSVADKKPLK

SEQ ID NO: 1268 - protein, 366 aa, Bacillus pseudalcaliphilus
MVTISLCMIVKNEEAVLARGLDTVKDIVDEINIVDTGSTDRTVEIAKEYTDRVFFYEWTGNFAAARNESFKYATKDYILYLDADDVLLEEDQKKLKALKETLDHSVDSVSMFYNAGMDSYGNVTLRYRRNRLVKREKNFKWGGDVHNYLNVFGNIINSDVAVTHKKIKHAVSRNLSIYKTKIERGDTFSARDYFYYGNELRENGHPEEAIESYDNNIAMEEGWIEDKFYACINKADCYRHLGDTKKELESLFQSIMFSKTPRPETCSRIGYNFQQKKEYVHAIYWYELATKLKPDTNQWSFSYPAYSTWYPHIQLCVCYDRTKKYAKAYEHNEKARAYRPKDPSVLHNKSYLEKTYGFGSEENQED

SEQ ID NO: 1269 - protein, 341 aa, Clostridium populeti
MITISLCMIVKNEEKVLARCLDSICDLMDEIIIVDTGSTDRTKEIAACYTDKIYDFQWNNDFSAARNFSFTKASKEYIYVADADEVIDEENREKFRILKEAMVPEVEIVQMYYTNQLAFGTTYNFDEEYRPKLYKRLREFMWVEPVHEAVNLEPVIFDSEIRIQHLPLSNHSKRDFGIFKKIMQDGNGLSKKLHNMYAKELFISGEKQDFIEAADFFEASASDSLRSEEEVLEAICVLVKTGRLENDMNRLLKYALRGVATQSSSEICFEVGEYFYQKSDFAEAVLWFYNAAFETECILNIRYGKEFPFARLAECYRRLGNETEAKEYEKLLVSDKEEGII

SEQ ID NO: 1270 - protein, 816 aa, Thermanaeromonas toyohensis
MKKATISLCMIVKDEEANLPKCLESIKDWVDEIIIVDTGSQDRTREIAKEYGALVLEEPWRDDFSLARNAGLERARGEWILFLDADEEVLHENLSCLAYLAHTDMDGFFLHILNFDDQGNCIKQPSLRLFRNHPRHRFKGAIHEQIIDSILEQNPQAKFGVLDIKIKHFGYQGKMVAQKEKTKRNLAILKAEYERGPKTGFLLFNLATEYLRSGEFPQALRYFNEAERLTSPALSFAPLLGKKKIQTLMLLNQYQEALETIDRYLKLYPDYTDLVFLKATLFYSLGRFTEALELYRACLALGEAPYQYVSEKGVGTFKAEVGVREALALLERERLCHHLLPGISLCMIVRDEERNLARCLDSAAQVVDEIVVVDTGSEDRTREIAQSYGAQVYTFPWMNDFALARNFALRLARYEWILVLDADETLRTEEHKRLRQLIATAGELQGFYLKVVNYFGWGDPEDFVVDAICRLFRNKPEFNFSGTLHEEISQSIISYSGPSSLAPVEIHIDHWGYLKRAGLQKKSYRNTALLTSWLNFQPGDGYARYALGVELFQQSDFRGALEEFYKAFTALKGSGILADLYFKMAVCCLELKEFQQGLKIVRQGQEAFPDFTSLWYLEGMLEFHLGNWPGARQAWEKALQMGDPPWYRYTFPYGIGSFRTAAALAEGLEKMGWLEEAEELLEAFLKKRQGLSTLLLPFCRLLVQRYDTVSCLFRLYSLSLPSCFRESLLLAEVFYRLDRPDLGQIFLQKAKEFLEQSPLKSLFLKLAGLQLGLAGQCCIQGLKSGGFSPALKTVWDKISALLEGVAQGEMFNIGIQ

SEQ ID NO: 1271 - protein, 288 aa, Unknown
  Description of Unknown: Deltaproteobacteria bacterium SG8_13 sequence
MQERDMSERQTLSAIIITYNEEDNIRACLDSVSDTVDEIIVVDSFSTDATPEICRHHPKVVFYQHTFDDYSSQRNRAMEYASSQWILIIDADERLSGELSRSILDFLKGDPAVSGAMFPRLTPYMQRDIRHGGWYPNQRYRVWRKGAAHYEGAIHERVVLQGKGVSLKGDLLHYTVKDLSDHADNVNKFSSIAALDRYHKGKKFSLMRLLFKPAGKFIETYLIRLGLLDGLQGFIIAVVSSYYSFLREAKLFELQLPGSDKPSNLPDSYRKRGESESPAPAPPAATRS

SEQ ID NO: 1272 - protein, 340 aa, Clostridium sp.
MATVSICMIVKNEQKVLQRCLESLKGLYEELIIVDTGSTDNTKNIASAYTNKIYDFIWIDDFSAARNFAFSLCTQQYIYTVDADEVLNETNRNKFLLLKQNILPEIEIVQMYYVNVHNENSVYNFQKELRPKLFKRLREFEWIDPIHERVRLQPIVYDSDIEILHMPEGEHTNRDLTILTKLAQQGKVFSDTLFNMYARELFKAGTTQQLITNKNYFLNVFENNALGEKRQLCQIILSKIALIENDTHSFLKHCLSQKAEGITSEICCLLGEYFYNQNDIQEGLSWYQYALETLPCIDIHCCGDKALFAIAKCFELLGQQQQAQYWLQMAQNWTPPEQSD

SEQ ID NO: 1273 - protein, 653 aa, Unknown
  Description of Unknown: unclassified Paenibacillus sequence
MNMLLSLCMIVKNEQDVLERCLESVKSAVDEIIIIDTGSTDRTKAIALSYQARIYEYAWSNDFSAARNEGVKRAAGKWILVMDADEYFAAGDAEKLRQFLEMTEPSPHLIYSINVINFVGKSMEQASITSGEIPRLFPNGYGIEYYRPIHEQLRSESGELLSSLAPVSLFHTGYLEEMVNSKAKLDRNAGIFKELKEKQGFTAYDYYTLGNECAVGKDFQKAVYYYERAIKKQNKLINSSWFPHCVISLIHSYLVQNRMFDAWKLTEEKLSAWKDYPEYAFYKAAILHHLGFMEEAEMAYIQTIETAAIKSRESQVFWLESAEYATTIPMRKLSSIYEWQKKWSDSVHYLTKLLMQDLYDYSALRALLKIMTRFETVEATIQLLDKLYEPDNSKHRYILFRSALANHAEELSRHYYESIADDLALSIEDKLEYFFLVKDKKEYEKTIALIPSGFTQERLARIHALASRAWGLTLEPPLAIEDTEEQNQAAHRIEAIRSYLGGDTEAEDVTEENAGPLLDLLKDSFHLGEFSIYDQLINRYSHDFVIQHMADYMFAQEQTEIALSYYSLLLDQNALNGKNMENLAIHHLHQNLVENGLAFLEEAIRELPGQIYLYVLYLKNAVDLRKKEEYRQKLLAQFPGARKLPIFTDLLTR

SEQ ID NO: 1274 - protein, 356 aa, Unknown
  Description of Unknown: Blautia sequence
MISVSLCMIVRDEEKVLERCLSGVRDLVDEIIIVDTGSKDRTKEIAGQYTKKIYSFPWTDDFSEARNFSFSKASMEYCMWMDADDVLSEKDRGAFLKLKRELSPDTDIVMMRYDTGFDENGNAVLGYYRERLIRNLRGFLWQGAVHEVIAPEGNIVYSDVAVSHKKTGIGNPDRNLNIYKKMLAEGKCLNARELYYYARELYYHEEYKEAAETLRGFLERADAWIENKIEACRVMAECYEKTGERAVSLRTLLKSLEYDVPRAEICCDIGKYFMEEGRYEIAEFWYKTALECKMDLTRGGFVLPDCYNYIPAMQLCVCCDRLGRYAEAEAYNDRAGEYKPDSPAVLYNRNYFRGRT

SEQ ID NO: 1275 - protein, 502 aa, Paenibacillus sp.
MAEQRKRISLCMIVKNEEKHLPGCLDSVLGIADEIIVVDTGSTDETIAIAERYGAQVIRSGWEHDFAKARNKGVERASGEWILFLDADEQLDAATKPQLLEYAGHAELSALLLQIRNQVGPDHDQGSTIHPVLRMFRNDPAHRFEGRIHEQISFSILRKNPSARFHLTDVIIHHYGYRTQVVAEKNKLQRNMELLELALAEDPDNTFHRYNIGVEYLRNNRAEEALEAFRIAKRSAGFEQLSYAHLVLKYESLSLQLLGRWEEAAAPAKEGSAIFPDYTDLWHYIALCSASTGRFKNAMEAAEKALELGAAPARYHTEDGMGTFRTAYLQGRIYEALHDEQGVEQAYMKALRFKPSLLPPLFRLCKYMRTAGREGQLAAWMARRISCPDEAAMLKLAGVMVASGCPASAAAYLEWQGELYKEPGLRHSLAVQANALRDGDYSGLPFAGWLGKDEAEDTLSSAVYWRARAEQYLERVQQSKERPVERQAVQSIRMLLPGFEGW

SEQ ID NO: 1276 - protein, 566 aa, Unknown
  Description of Unknown: Lachnospiraceae bacterium XPB1003 sequence
MDLSFCIIGKNESSHLRRCLTALKKCGHEIVFVDTGSSDDTVAIAREYTDKVFFFEWINDFSAARNFAMEQASEDMVFFVDCDEYLEDDSSCIEAIALMEAYPDALGQILRRNLCDDSNGGQTIYEDLVERFFDRRLYKYTGRIHEQPVRRDGSVPSACRLPMIFSHDGYLGTPEQKKKKGLRDQELLLRDLEENRKNNIPDDPYIFYQLGQASTLMADKEKALEYYKSGVALDIDPSLTYVQMMITNYGNTLTDAQRCEEALALARYEDRIDDYADYFTMLGFAALQEKKYLTAIYYYKKALGASGHNLIFAAGALPHHNLGCIYEAFGNYKKAIEHFEAADKAGHEGSAARASALRNKQENTSDKDNGIFHNFIFICDEATDLTRLNASMDSLRAQTVGFEHVMATFVCRADSKSDPLYTQIRAWENESPDNILVLESDIVDKNTARAEILYTVLQYSSAPLITIAEPGEMIHIDHVRTVRSFSDLLISYSPAVIRCGYVKNIKELYIEPAKEKEPQAWQIPGEEFSRIITSASAGYSFSADSLSGDKTGGYVLADIGLNLIMA

SEQ ID NO: 1277 - protein, 627 aa, Unknown
  Description of Unknown: Paenibacillus sequence
MKKSSISLCMIVKNEERCLERCLNSVQNIVSEIIIVDTGSTDRTIEIAKQYTDKVYSFEWTNDFSEARNYALDQATGEYILHLDADEYLYEGVENLQCELDKAYYFLRIRNELGMGRTQTHQFVRLFRNQPSMRYEGKLHEQINLEKNAHLPSGYMNCVIYHDGYLDSIVKGKNKSKRNMEIIKNAILTSPTSFNYYNLGLQYYHEGQYANAVNAFKKSYSIAKNQTFTSRMLILLINSLLKLEQYPQALEIASDSILLYPENPTMWYEVGSVYQQIGYVEDAMICFNKCLELGEDSGIKEYDHHDGSGSYLAHSRLSELYLLQGEYEQAQEHFFLAVKEAPDLLYLVKLFTDLYPNLSGQDLLAAMIKIWPFNDVKRIQQFLSLLYELRHPVTYELIKCYRVEIDDEIRAWIDMIDGDYDQALMKWSHISKLQPYSKRDLFLLSFITNSFDVMARFKSELGLRDKEWKWWRELIEQHQDNGLELSQESEEFWSHLCSDLIKLQKYDCLETLIGTTVNPRLRYLIAKELNKNGFAELALEVIIESENKKENINIYELVSDILMKLGQVEDAIYYAEKLYQLDKNYQTSYRLLRLLKMENKIAGAALVQELKRNSLKSPWIESIIVND

SEQ ID NO: 1278 - protein, 702 aa, Gracilibacillus massiliensis
MNSILYYNTGRSILSMHKENSYLISICMMVKNEESNLSRCLQSITPLLDRSDVELIIVDTGSIDNTIEIANKYTKKIFYRKWQDNFSEIRNYSISAANGKWVFIIDADEEFIELDKIIKLLNSNDIDNYNAIQLLTNNILYKDGSKTIITPSCRIFKNGNLSYDGAIHNQPIFNGPVYNTNIYFNHYGYINDDRELMDNKFNRTATILKREILKDPNNVYYQYQLAKSLGMHGDHIEALQQIRTAYKVMKENKQIKLYIYLTYANLALLNKCYNEAVEISEEGLQFNDQYIDLFFILSKGLYNIKMYHEAIHAYRRYLKLYEIGENLSIFDDASLEVIYFEENYKLNVIKELIMTAIEINEFKIANEYIHLVNNTKAKNKLAIELYLKSEDYTALKEYLIVHFHETEYPTEIENLVEEVLNNKDDKVIRDISAIFADEETSYGMLNNIRSMDDERVQSILIKEFFQSYDITTLGKNYYVIFEIAISVNFPILKELKKASSRYIKHLVLYSFEKSTDLSSYFYDYMYSTSNIRTSDFQTNRVYCAISNPILLHEQEKANKEENKQLKDERLFEAFNQYIASGENYINLLYQVDRLRINYSVVDDMEHQLFILLYLSAQSAKKGDVKTTISYYKKAVDVYKPFAKYLEIYLGKLYQDIAKGLIEKNMYEEAMEMYEEALIKSESDEEQDDILNKITSLEGSQQP

SEQ ID NO: 1279 - protein, 309 aa, Unknown
  Description of Unknown: Candidatus Shapirobacteria bacterium CG_4_10_14_3_um_filter _35_13 sequence
MKPLISAVINVINEANNLDKCLHSLKNFANEIIVVDMESTDESVNIAKKHGAKVFSFKPMKYVEPARNFAISKASGKWIILLDPDEFLPKSLKHELTKITLRHNVDYVKIPRKNIIFGKWFHNSRTWPDYLIRFFKKGSVTWNKEIHSQPETKGNGITLLDSEKLAIRHNHYSSVSQFVIRSLRYSSIQAEELDKAGTKLKMSDFILKPVQEFNSRFFFAQGYKDGIHGLVFSLLQTFSIFLIYTKLWEKQGAIEKIVSRDSFVSASQEAIYEYSYWFTKYFKEEYTHNIFKIGILKLKLLINRFTKNF

SEQ ID NO: 1280 - protein, 628 aa, Paenibacillus polymyxa
MKTISLCMIVKNEELHLDKCLKSVVNKVDQIIIIDTGSTDQTIDIARRYTDELYHFEWINDFSAARNEALKYAECEYILVLDADEYLDENADLQKDLVSEADYYFVKIHNFLSGDRAIDHLAIRLFSNNKGMFYRNRLHEHLNTMDEERSYVAAHAEFKILHSGYTDEMLQDREKAKRNLPLMIQEVEENPNAYNLFNMGRTYMWIGEFEKAINYLKRAYPLSKDLAITPELVTSLCRCLGEMSRYSEALEILKDAVKVFPREVDMLHMQALYFMEEGYFKDAVATMEACIELGDQGITVIEGNGSFIAHYRLAEWYETKNDMLKSYDHITKALQDKKRFAAGLNKYLQITMKANIPLEDVYKSINQLYPLKDVKDLEHILEVLYALRHPLLHRYLHEFKVKVQESVQTVALQYAKEYKNAESEWLMMETIPVQNAKDVLLLAFLRKSDELLFKANSLLNLSNKEKKIIKKIYNNYFSPNDKLTSSIEEILLDISSSLIALKEFDLFEQLLKIIWEGSMEVKYKICQKLASHGFDEIAIDLLIKLFEKYPREIKVIRLLGDICLSKGYLQDAELFYAKLLELYSKYSSYERCFDLYERLEDNQSSARICESIKDKFPLCIWASKLSLS

SEQ ID NO: 1281 - protein, 357 aa, Unknown
  Description of Unknown: unclassified Clostridiales (miscellaneous) sequence
MITISLCMIVKNEEDVIARCLDSVKDIADEIIIVDTGSKDNTKEIIKKYTDNVFDFEWIDDFSAARNYSFSKATKDFILWLDADDVILEEDRKKFKQLKRDLDPNVDVVMMKYNVGFDEDGNVTLSYFRERLLKRINNYQWMEPVHEYLELRGNIINSDICITHKKERPAIQGRNLAIYKKAIMEGRTLTPRGLYYYARELFYNEKYDDAIEYFNKFLDTRRGWVEDNIAACYTLSICYENINDKRNMLKILLKSFEYDIPRAETCCRLGDYHFSNEDYRKAIFWYKLALELEEPINSWGFIQHDYWGYIPCMKLCLCYNILGNIEEAIKYNDKAGEYKPNDSSVAHNKIYFKSISK

SEQ ID NO: 1282 - protein, 327 aa, Trichomonas vaginalis
MEKQLAELSVYILIIFLILGFIMAILMRFGDDTTLFDLTQLPKNNPKKLNYYVQPAKNPNENVPFKTIFDKPQVYVSFIVPAYNEEKRLPKMLEETIEYLEQRRYKDNNFTWEIVVVNDGSKDRTAHVVLEYAERYSNIFLLNQPHNMGKGAAIQAGCLHARGQLVLMVDADGATKISDFGLLENEIKKLMKNNKEAIVVGSRTLNEDKSKVHRTFIRKILGLGMHILIVISGVHGIKDTQCGFKLFTRDACKMLFMNQHVQRWCFDPELLVIARRRKMKVSEISVEWNEIEGSKMKISGMIKMAIDLLRIAVFYRLNIWTIRDRKF

SEQ ID NO: 1283 - protein, 359 aa, Baia soyae
MIVKNEEKNLENCLSSVKDVVDEIVIVDTGSTDRTKEIAKRWTNRIYDFEWIDDFSAARNVSFQYATKDYIFWLDADDVMEQKEIEKFKFLKKSLSEEEIDVVYMKYFLPSNKIESHTTRIRMIKRGLSAKWGGIVHEDITVNGEHRYTLSDVVITHTKDLNNTDDRRPSRRNLEIYELNIARGHKLSVADMFNYARECSIHKDYPNAIKYFELIRDHPEVSLQNNMFIYHKLATCYVLNGQPEKELELTLQSLSLDMPYPAFSCRMGEHFIKTGQIEVAIFWYKTAYMQPLSDSYSFSVADATYHTWLPHQQLAICYEALGEMDQADFHNRQAEYYKNRLVNQTKKVNTSLNTMDSRS

SEQ ID NO: 1284 - protein, 319 aa, Unknown
  Description of Unknown: unclassified Clostridium sequence
MTTFSLCMIVKNEENVLARCLDSLADLMDEIIIVDTGSTDKTKEIAARYTDRIYDFTWIDDFAAARNFAASKATMEYIYTADADEFVDPENHRQIRQLKEVLLPEVEIVQMYYCNDLGDYNTTGNFERELRPKLYRRQRSFTWIDPIHETLRLDPVVFDSEIEIIHRPEESHGSRDLSALKRLHEKGIVLSSKLHHMYAMELFIAGEDADFLAAEESFLESVEQPSCSTDEILEAICVLTHIYRLKGDIHHFMTYALKGTAMGGCAELCCELGAYYEACGEDQEAAMWYYNAANETESVLNIACHTTIPQKALERLTTR

SEQ ID NO: 1285 - protein, 642 aa, Paenibacillus ginsengihumi
MTKKISFCMIVKDEEQNLHRCLGSLRPILDQDYAELIIVDTGSTDRTVEIAKEYTSHIYFHEWNGNFSSMRNISISYATGEWIFIIDADEELETPDELIALLHDPKLSNFNTVRIREKNLLSIQSKKYVYHVQERMFRNDGTFEYRGTIHNQPIYKHPVLIKDIWLMHYGYISEDKELMEKKFKRTATMLKKELEKDPDHVYYRFQLARSYMMHNESATALEEMTKAYQSMKKQPKELIVHRYYVFGEYARMLLNAKKHETVIEICKEGLSYSPNYLDLYYYMGHSYVEMEQYEEGLSALEKYVQLHEKYNAGQLELSNFTAIEMYTLDELSYNITLNQLVRLIYSKHIHFEPSKYKKWIKNISNKNLSDKLNTQLLLLEDNYVELRKLYQGIDEKEKGPFVNYLESLKKEWPIERKELFTNAFSELEDSYGLLNQIRLSENRKPLLIQFINQYNIIEYSDEVILEFVHYLLEEKCLNRLFKKLDSSTIKKIVKVLIDQEGKEPYFLQSLRNDFKYSDFHNNRIFIAIANVILLSKAEEKNWPVDLDEQMIRDLFNQYIHKGIEFIKSLYNIERIRLTYPVITNKEEKFLILLYLAECAKQAGDRLGYHRYIKEATEEYPYLSRLLREYVIDGLANLETINR

SEQ ID NO: 1286 - protein, 319 aa, Catonella morbi
MIVKNEEKVLARCLDSLKGLYEELIIVDTGSTDSTKEIAAGYTDKIYDFAWTGSFSDARNFSFSKATMEYIYSADADEILNEENRQKFLELKQCLLPEIDIVQMIYTNQLEFNTTYNYDEELRPKLYKRLRTFEWIEPLHEQVRLETVVYDSEIKITHAPENNHSKRDFSCYKKLIESGEKLSKHLFEMYVRELYIAGDESDFIEAEPYFSREIEIRESVDEVVMAALVLIRAAGYQRNTLCLLKYSSRIFALAAEPSAGVSIPSELCYELGEYYLGVNDKAEAKMWFTNALTETESLVSLDCGDKLPKERLKELEGTE

SEQ ID NO: 1287 - protein, 361 aa, Bacillus farraginis
MITISLCMIVKNEEDVLARCLDSVKDIVDEINIVDTGSTDRTVEIAKKYTDRVFFFKWTGNFADARNESFKYATKDYIFFVDADDVLLEEDQLKLIELKKSLDPSVDSVSMFYDAGTDEYGNVTLRYRRNRLIKRERNFQWQGDCHNYLEVYGNIVNSDISITHKKIHHSTGRNLNIYQAKIDKGDIFSARDYFYYGNELKENGHYERAIESYNKNLELKSGWIEDKVYACINKADCYRFLGDTDNELKSLFQSFEYSKTPRSEACSRIGYNFQRKREYIPAIFWYEIATKSKPDSNQWSFTYPAYYTWYPHLQMCVCYYNLGDFQKSYEHNEKARSFRPHDERILQNKALLEEKLRIEVN

SEQ ID NO: 1288 - protein, 580 aa, Desulfacinum infernum
MPWPCWNRLRHWMKTTKRWRRPLPMFVNGSGKRRKKMKSRARCVPEVVWVGRPLISLCMIVKNEEKNLPRCLESVQGQVDEIIVVDTGSSDRTVEVASQYGARVLTHPWNGDFSAARNVSLDHASGGWVLWLDADEELLQAPDGSTLKQMADSGTAEAYLVPVQNMRLDGSFTAHYAVRFFRKLEGIRFEGKAHESVGDWLLRQNARIERSPVAIRHWGYAVTDAELQRKLDRNLELLKAQLERDPNNSYVHYYIGMTLVGKEDFEGSFHHLQRAYELGPETPNMECLVANMLAYHQLHRCNYGEAEKWARRSLAITPQQHTAKMFLGIALYNQKRFAEALPLLQSAYQFQRLPLERRRSDISLEHSYGEKELLWAVARSAYETRSYPLAHQFLQRLARSGGSDAAALTLQGLTALALESFRSAVAHFDHAKVLGASWQQIGAPWTYGLLQLGRLDDALAVLSEAGASFFLNENAEQTFALLVERCFESSRIGPLVRALERIAQNAHVPPHVLDALAVCHIKSGNYEKAAAALDALLEKDPGNLEVRRRLAAVWVRLGRETMAARLLRSYRRDGTASAAP

SEQ ID NO: 1289 - protein, 359 aa, Paenibacillus thiaminolyticus
MIVKDEQDTLERCLSSVQDIVNEIIIVDTGSKDNTKQIARKYTQHIYDFEWIDDFAAARNFSFDQATQDYILWMDADDVLEEEDLQKFIVFKQQLDVDIDRVMMPYHLALDVDGKPTCTLRRNRLVRRDRGFRWEGAVHEALIVSGTVIQSDIAITHRKEKKPTDRNLLIFRKRKQANAEFSPRDLYYFAIELRDHGFYEEAVAAYKQFLATKQGWVEDCFHACMNLSDCYSSLGKDTESVKALLHSLSYDTPRAEMCCRLGSFFLESNHLEKAIYWYHTATRLGQPDHYLGPVAREYWTWIPHFQLSICYDKMGQWTKAQLHNEIASFHNPEHPLLLNNRKYFAQKIIETALSASPPF

SEQ ID NO: 1290 - protein, 365 aa, Bacillus clausii
MRSFSICMIVKNEADILEETLESVKGVGDEIIIVDTGSTDNTKDIAKKYTDLIFDFKWIDDFAAARNASYSYATKDYILFMDADDFLPDEERAKLLQLKKNLDMSVDAVSMFTVTGVDEFGNPIFKFRRHRLVKRSNHFKWHGSVHEYLEVGGNIFHSDIYILHRKQKKKIDKERRRRNLNIYEKKLKRGDVFSPRDLFYYANELKDHGKFQKAVEQYTKFLNSREGWVEDNIRACIYLADCHRSLGNHLEEMEALAKSIVFDIPRPEVSCRLGDMYKEKNMFDKAIIWYRLAIEIDVSDLLGFQYEQYSTWYPHLQICVCYWHIGNKELSFYHHQKAKEYRPDDKRIQYNEQFFKKIEENNAEG

SEQ ID NO: 1291 - protein, 343 aa, Anoxybacillus tepidamans
MGNPSISLCMMVKNEEDFIEQCLASVQEVVNEIIIVDTGSTDNTISICGKFQTKIYQYAWNNHFADARNFGLSKASGDWILWMDADEELEQGKSDLIRQSIQKTKSPVLLLPIINYYGDGFPVQENQTFLCYQPRLFRNRVGIQFLNRIHETLHLPDDFLSYDLSETVDVSLHHYGYIKEVTQRKNKGYRNKQLLMEEMNDPNHSPWVEYHLASEFYRENNYTLAFSYINASILKFLLHQMKPPAIAYRLKYAILMETNSIDGAWPGIEKAILLYPDYVDLHFIKGYILFQKGMYKEALAAFEKCLELGEDNINYLILRGTGSFKAIKYKELCLNKIETENTF

SEQ ID NO: 1292 - protein, 308 aa, Coraliomargarita sp.
MPITIIIPVKNEAGNLPECLSRLEDFEHVVVVDSGSTDETVAIAEKAGAEVLHFQWDGRFPKKRNWVLRNYDFKTDWVLFLDADEFVTPRFVEELRAALADGSKVGYWLNYERWFLGKQLRYGDEFQKLALFRVDAGEYERIEELNWSALDMEIHEHPVVDGEVGEIKAPIEHNEYRGLRHYIAKHNEYSSWEANRYLRLSGYEGGKVESGKFKPTSLGDAESRGRRFGGSEWEKLTERQKKKYRHLTKWWAAPVYFLRGYFWKRGFLDGAAGFHFAFLKAVYFYQIRLKIKERLGGGSGFSAIRRDK

SEQ ID NO: 1293 - protein, 390 aa, Unknown
  Description of Unknown: Lachnospiraceae bacterium sequence
MNTYNHQSEICGLSICIITRDQADKLEKCLKAIHDNLIPILPENTLEIVIVDTGSTDNSKDTSLKYTSALYDFPWINDFAAAKNAAVSHASNDLVLILDTDEYIEPFTSTTFFSEVLSHMSEAPCSVGRIERINHYTNPDGHATEYREWINRLFDRRYFHYEGRIHEQLVTVSDSDVTYSTWKTPFKILHDGYDLSPEKMKEKAERDASLLRISLAETPDDPYLWYQLGKSCFAAENYISAEEAFMKGISLSPAPNLEYVEDLLETAGYTLLKINKAPEALQLLAPYNDQEPFHSSADFQFLFATILMNCGRFEDAIDNFVFCTTLPASRTTGTNSFMAWYNAGVILEIAGLPAEAAEYYKKAGDYIPAVEGLKRLSDGNSTNGFHPVSS

SEQ ID NO: 1294 - protein, 335 aa, Unknown
  Description of Unknown: Ruminococcaceae bacterium HV4-5-B5C sequence
MVTVSVCMIVRNEEAVLVRCLDSLAGVADEIVIADTGSTDRTKKIAAAYTPKLYDFPWGGDFSAARNFAFSKASMEYIYSADADEVLDAESRQKFMELKRTLSPETEIVQMRYANQLRYNTTYNFDAELRPKLYRRLRTFRWTGPVHEAVELSPRIVDSEITVFHMPQSLHSPRDFSILEKAAAAGSMDERLARMYAKELFISGTDRDFLAAYPYFAAVLHDEARSLDEVRVAQCVAAHAARLKNDGTELFKAALKNVIAEPCAEVCCELGAWFFRKGDWEEAATWYFTASSGVESELDVRTSGSIPLLCLAQCYEKLGMVQEAQNCRAKAAHCA

SEQ ID NO: 1295 - protein, 372 aa, Paenibacillus pinihumi
MSDNIQVSLCMIVKNEEAVIGRTLKQAEKHVDEIIIVDTGSTDRTKEICLEHGARIYEFGWTNNFADARNYGLDKAQGTWIVWLDADEELEVEDAGLWRSSLEQGKPLLWAIPIINYFGSAPADPNRSYLAAQHRVFRNGAGLRFAGAIHEQLQVGHLPDDALELRQLPARIHHYGYMDAITVQKNKHQRNVSLLEREKIGEDYNPWVDYHLASEYYRVGQYEAAFENLNTSIRRFVESGKLPPSLIYKMKYDILLALGSIGTAEQGIEKAIQLYPDYTDLHYYRGLILFMKERYRDAETAFRHCLELGEQRLPYLILKGVGSFHALYLIGRCRESVGDRDGARIHYRKSLELYPEYGEALERLGGLDTDQG

SEQ ID NO: 1296 - protein, 359 aa, Unknown
  Description of Unknown: Chryseobacterium arachidiradicis sequence
MKISLCLIVKNEEEVLGRCLESARDFADEIIIVDTGSTDETKEIARQFTDKVYDFEWINDFSAARNFAFSKATMDYQMWLDADDIVPEKSVQEINNLKTALSDDIEIVTMKYVLSFDHNNNPTFHSTRERLFKRSKNYQWIDPVHECIPLIGHLQYTDIEIWHKKTRQEVVSTRNVDIYRALEKSGKAFSPRQLYYYARELKDHNDTENAIIYYEKFLATGLGWIEDVIACCHQLAIEYKKIGSEEKILPTLFKTFEYDIPRPEICCELGYYYKEKQNYNQAFKWFDLATKVVVSDNVGFVFSDYSGYIPNLEACVCLSFLGDYPKANEYNERASVSRPDCPSVNQNREYLKSMMADYF

SEQ ID NO: 1297 - protein, 236 aa, Campylobacter jejuni
MNISIVILTFNSQKYLQEVLQSVNFANEIILIDSGSTDNSLIIAKTFKNVKIFHQAWLGFGKQKQFGVNQSKNDWVFILDSDEIVTQELKEEIMQTLKQPRYHAYKVARLNFFFGKTIKTMGLYPDYNIRLFNKNYAQFDDREVHESIICQEKIGKLKHHFLHYAYENIEQFIDKQNKYSSLNPKKNNLLKALINPYWTFFKLYFIKLGFLEGKRGFIIAKLYAQYTFWKYIKSEF

SEQ ID NO: 1298 - protein, 335 aa, Clostridium sp.
MITISLCMIVKNEEKVLKRCLDSVRDLVDEMIIVDTGSTDRTKEIAASYPGAKIYDFTWVDDFAKARNFAFSKATCDYIYSADADEEINEENRKKFMRLKQVLLPEIEIVQMKYVNQLSYSTVYNYDEEYRPKLFKRVRGFIWEGAIHETVATGPIVYDSDISIQHKPESLHTGRDFAAFERLIKRGEPLSKRLKNMYAKELFIAGGKEDFRQAADYFEQIADTAEDEEELKEALAVVVAAKRQRKDTDNFFKYALKSVILGGCSEVCFEIGEYYFSKGDYEEAVLWYYNARYETEAILCLKKKEREPLEKLVECCEKLNRPEDAYTYRKELEQL

SEQ ID NO: 1299 - protein, 356 aa, Cohnella phaseoli
MVSISLCMIVKNEEAVLARCLESVCDLVDEVNIVDTGSTDQTVAIARRYTDRVFFYEWTGNFAAARSASFSYATKEYILYMDADDVILEEDRHKFKKLKEMLDPAVDSVSMFYNAGEDSFGNVTLRYRRNRLIKRSRDFQWKGDCHNYLEVTGLIVNSDIAITHRKIKHSVSRNLNIYKMKLERGDPFTARDYFYYGNELKDNRHYAEAIESYKRNIELNTGWVEDKINACINMADCYRYLNDQDNELTALFQSFRFDSPRPEALSRIGDQFKRRQVYRTAAYWYEQAIRIPENNTQWSFSYPAYRTWYPNLQLCVCYYYLGDLDAAYRHNEEARKYRPQDPHVLHNKQLLEAKRA

SEQ ID NO: 1300 - protein, 460 aa, Paenibacillus odorifer
MDKTITLCMIVKNEEKYLKRCLESVKDKVSEIVIVDTGSTDGTLVIAEEYTTKIYHFKWVDDFAAARNESLKYATSEYILVLDADEYLESDADLQKDIKPDYDYFLLKIYNDVSYGRAFTHTAVRLFANNRGLHYNNRLHEHLNILDAKTNYKSQYGEVIIHHTGYTDEIMQEKEKTKRNLPLMLQEVEENPGAYNLYNMGKTYLSINENAKAIEYFQRAYPLSSGRMFLPELITKLCYCLGELNQYDDSLKILNDAVKVYPLETDMRYMQGRIFMDAGYIKDAEITLKSCLEFGGDLGVSVTEGTGGYMTRFVLAELYEDQNQLDESYKYIVEVLQEKKTFAPGLSKYFEIVTKSNIPLDDVYQNIIQLYNISNINDLQLLLDVLYGLRHPLLNRFISVYSITAQPNVAASAMQYDKKYIEAKDMWLSMEDIQIENAVDILLLSFVLDNEELFNLAKPH

SEQ ID NO: 1301 - protein, 601 aa, Clostridium populeti
MNREKTVSLCMIVKNEENYLTECLNSVKGIIDEIILVDTGSTDNTLLIGESFGAKIFHYQWDNNFANARNFSISKASSDWILLLDGDEIFDRNYLDDFIQLINESPYDGYLFTIYNYTGHLKDKDFSIHHAFRLLKNHKGYTFKGAIHEQIVSSDQQVTSLPFEASPIVIHHYGYLIDVVAEKDKRARNIPIIEEQLKDDPENAFYLFNLGNEYLAAHQLEKAFEIYSLSRQHLSKNPAFAPYLYYRMIICCTILKRNEEAILLADEILTQYPSFTDIVYCKGILFFNMHQYTMALDTFDQCIKMGPSPLLLTFLDGCSTYKPYLMKADIYRRLNDLDRAIYCFSQSFYLDKKTPQVLYDIAALLHKKHKEEKKTAEELAHYLSDSLPDSVLYIDILISEQLYETANELLQQLSRTHPSSVEILFLRGKLHFYLQENPLAIDCFQQVLDISCTSEILKDIDLESLKYLFTLNLMEQQDKLDSLIQQIETKGTPNLLKIYQEIYNLHLDKKDTLFTEEDDPGIYLPLIFDFLDKLLKIKSFDLFEKYVYLLNRLETNVVLLELARLYEKNGYQEMARKTFIKSLRDLDVIDIRSLDFLATMY

SEQ ID NO: 1302 - protein, 355 aa, Bacillus nakamurai
MISISLCVIVKNEEEVLAGCLDSVKDIADEIVIVDTGSLDQTKEIASRYTDKIYDFEWIDHFAAARNFAFSKAEMEYILWLDADDIFLEEDRRKLIELKASLSKDVDAVSMYYHVGFDARGEVNFKYRRNRLVKRDIGFRWIGAVHEYLEVYGNIMETDIAVTHRKSDKKHSPPSDRNLNIYEKMAENSETMTPRDLFYFANELKDHGQYQRAITYYHHFLSTKQCWIEDEIRTCQYLSDCYKAVGHEEAALTSLLKAFLIDCPRPEFCCRLGDYFTEKQQYPQGAFWYELALSAKSNDTSFTQVEFSTWYPHLQLCVCHWQLGDREKAKYHNDKAASYNPSHPSVLYNQGVLGG

SEQ ID NO: 1303 - protein, 252 aa, Sporocytophaga myxococcoides
MKVPVSAVVITYNEERNIERCLKSLARITDDIVVVDSFSRDNTEDICRRYKVNFLRRNWEGYGPTKNLGNSYARYDYILSLDADEELSEELIEEIKSELNHPQFDCYEIPRKSNFCGKWLKFGHWNPESHVRVFRKDKIKWDNSPVHEKLNMEKGTSVKKLKGAILHYTIYSLDQYDQKNDKYSTLAAERLFKEGKKPGFMKLYISPFYRFFHSYILKLGILDGYYGYIIARETGKVTFQKYNKLKKLRAEK

SEQ ID NO: 1304 - protein, 595 aa, Ruminiclostridium sufflavum
MKNEISLCMIVKNEEDNLQRCLNSVKDIVDEVIIVDTGSTDKTVYIAESFGASVYNYIWDNNFSEARNESLKYASKDWILIMDADDEFCRDDKEAFLQLISSSLEEKTLYYFETLNYCGSFADSSNISINLNPRLFKNNLGYKYEGEVHNQLVNHKISTKDVCVSIKIYHYGYLDSNIKGKDKRKRNIFLLEEQLKKEPDNKYALFNLGNEYFASNEIAKALDYYYKSYENFTPAAGYGFILVLRIVLANYFIGLYTKALEFTDIGIQYYPGFTDLYYFKGCIYKSMDRPLMAVRAWEKCIEIGDPPSGLKFLYGTGSFKAMYELALICMEQKDYHSAYKYFNETIRIKPDLIISVYKIAYILKEENVASDEFKYILELFFEDDAKAAIVLADICYSVGYYEAALEYIKKCEENGIKSDDVRLLEIKALVRTGDFEKGIQINNFDSNHYFFPSFSMYKVICAIMLKEKLLAFYIIDSLKNNSFQDKNKKIYESYTQLVNLFFGKETQVLTEDEKEKEYTAIIFEILEIFLINKRFDEFYIAINLLNLISDKSVLLHLGKLYYKYGYFDMSKKELIRSIKEFEIYDKDALNILKQL

SEQ ID NO: 1305 - protein, 364 aa, Bacillus oleronius
MVTISLCMIVKNEEDVLARCLETVKDIVDEINIVDTGSTDRTVEIAKEYTDRVYFFEWTGNFADARNESFRHATKDYIFYIDADDVLLEEDQKKLKELKESLDPSVDSVSMFYDAGTDEYGNVTLRYRRNRLVKRARNFLWKGDCHNYLEVYGKIINSDIAIKHKKISHSTGRNLNIYQTKIDRGDIFSARDYFYYGNELRENGHYEKAIESYDQNLSIKEGWIEDKVYACINKADCYRFLGDLDNELKSLFQSFVYSKTPRPEACSRIGYNFQRKREYKNAIYWYSIAAQSEADTNQWSFTYPAYYTWYPHLQMCVCYYNLGDFQNSYEHNEKAYSYRPNDERILHNKKLLEDKLNINSKNPT

SEQ ID NO: 1306 - protein, 377 aa, Clostridium hathewayi
MITVSLCMIVRNEEDVLARCLDSVSSLVDEIIIVDTGSQDKTREIAARYTDHVYDFTWIDDFAAARNFSFSKATMDYQMWLDADDVMEEEDREKFLQMKNTLNTRQKENAEDGPDSTPDVIMLPYHVAFDSHGRPAMAYYRERLLRRKSHFIWQGAVHEVIAPAGKIIHGDAAVCHRKIHPSDPDRNLKIYENMVDSGRKLEPRHQFYYGRELYYHARYEEAARILETFLKEGNGWVENNISACLNLSECFMKLGKSEEALTALFGSFRYDEPRPEICCAIGKWFLERGNQDRQYLKQAVYWYLQAKGQVTDEKSGAFVNPDCHDFIPDIQLCVCYDRLGENAKALEYHEKAKAKKPDNPAVLYNEEYFAKKKGSTV

SEQ ID NO: 1307 - protein, 585 aa, Desulfotomaculum reducens
MKNTITLVMIVKNESENLGTCLDSVRDQVDEIVIVDTGSTDNTLEVAAKYTDKVYFYLWDEDFSAARNYAIARAGGDWILFLDADESLVCEPGQLKELVSRDNKIDAYMLPLDYPIAKSTDEYNRFLVLRLFRNNKGYHFKGKIHEQVVVHNHEVVGLADNIFIKHSMISPKERNRKRGRNLTALKKAISEEPDNYFLQYYIGVEWLGLGKPARALPFLQSAYQNLTDNHLLFRAPSLRYLLICLNALGNYDQTICLSQETAFKYPDYTDIYYLGGIAFEEKAEYKLAIKWLEQAVKCGVPPVIYSHMNGTGGFLAHYHLGFCYEKLGQVDVAQECYERALEVNDSYIYPVCNLFLLMLGRFGPGYTLNYFKKKGYLKKSDLALTVADLFFNSGYPGLAKGCLELLEEISHKTEEVVFQLGRYNIYSGRFQMGLNYMVQIPEASDLFTTAQTHRAVALLLAGRFKEGRNLGLEMWKNKMSKDTARAVLTLSNFMQGEEILRYPAKVNDLELMKSSITLLDMCYHYLPDRDGQRCPYLNQVISILEKMITGSSPDGYLTLEQYYKNKSNNLKEFFNYKFGTGGFMA

SEQ ID NO: 1308 - protein, 553 aa, Paenibacillus macquariensis
MIDTHHPLISLCMIVKNEAEHLATCLESVQEVVDEIIVVDTGSTDSTIQIAQHYGANVISFPWTSDFAAARNVGITQAQGTWILILDADEELDHSSKEELKLCAIHLEYEGFFLRIHNHTGKEKSSPTATVNPILRMFRNRPEHLFRGIIHEQIAASITEFRPNAALHLSTVMIHHYGYADHTVSEKDKIQRNVTLLTKELRRSPNDPFQHFNMAVEYMRLGEHQKALDHIHKSMALIVPDTSYGHLLHKYEIRCRYALGQIDEALNCCNQAIGIYPEYTDIFHLKGAIFFANRMLYEARSTLMKAIVLGPAPTHYHTETGLGTYLSCNMLGQIAEEVGHDSEAITWYTKSALFQPDWVQTSNRILRMMKCVDREQDIPELLANHFPLHIQDTEIRNEVIKWLALDGSYQAAQSLISQLDTFKTDESEASWRSLISSDHPFISDIPQETLTLAIPYAYQFGQENKAFNLLRQWEHRYQNESRNSTDILHSTEQIQDEVLEPKQPTESLMNEAYHLGRTWIALTDAILSRNEPSSPHYSAIHRVRLMLPLPRIK

SEQ ID NO: 1309 - protein, 320 aa, Unknown
  Description of Unknown: Eubacterium xylanophilum sequence
MIEISLCMIVKNEENVLARCLDTIADLMDEIIIVDTGSTDKTKEIAARYTDKIYDFEWIDDFSAARNYSFSKATKDYIYCADADEVLDEVNRRRFRQLKELLLPEIEIVQMRYCNQLDKGTVYNFDAEYRPKLYKRKRDLVWIEPIHEMIRLDPVVYDSDIDIMHMPEENHNSRDFRVFQKYINKGNGLSKRLHHMYAMELLMAEDDEAILEAEEYFTQIVNDPNRDIEQVKEAACIVARAARIRDDAGTILKMCLKDLLSEGSSEMCYELGEYFYGKGDYNEAALWYYNAMNETQNICNIHTSTDWAEERYNMCAEKLR

SEQ ID NO: 1310 - protein, 337 aa, Unknown
  Description of Unknown: Lachnospiraceae bacterium V9D3004 sequence
MITISMCMIVKNEGKVLRRCLDSVADLVDEIIIVDTGSTDNTKAIAAEYTSKIYDFEWIDDFSAARNFSFSFATKDYIYTADADEVLDDTNRERFLLLKQALLPEIDIVQMYYCNQLENGTAYNFDKEYRPKLYKRLRTFTWIERVHEMVRLDPVIYDSDIEILHMPLNNHSGRDFKVFLKQFNTGARLSKRLHHMYAMELYISGKDEDCINSIPVFEDTLSDTTRNEDELNEAMAVLTRAYRLNKDERSFFTTAIKAVANAPSAEVCCELGEFYYSIGNYNEACIWFLNAATETESILSIKTSGIIPYNRLADCYEAVGDAETADIYRKKAEEINV

SEQ ID NO: 1311 - protein, 362 aa, Unknown
  Description of Unknown: Bacillus sequence
MIEISLCLIVKNEEAVLERCLTSVKEVVDEVIILDTGSTDRTKEIAASFTDKVYDFTWVNHFAKARNKAFSYATKPYIMWLDADDILKEEDRHKLKELKSTLEEKVDAVSMDYHLAFDGNGGVTSSIRRFRIVKRERGFVWHGAVHEYLEVFGELHHSDIAVTHLSADDGHDLTRNLDIYEGMKASGQAFTPRDLLYYANELTDHRRFEDAVEYYLKFIKTDKGWSEDLIRSCNKLADCYINLGLPKVAKDWTFRALEYGKPKPETCCRIGHSFMEKQAFSEAVFWYEMAIRNKEENAYFQNVACETWIPNLQLAVCYDKLGFTEKANEHNEQAATFLPNDSRIEYNRSYFKEQLQLLKQND

SEQ ID NO: 1312 - protein, 367 aa, Cohnella sp.
MITISLCMIVKNEEAVLERCLESVRDAVDEIVIVDTGSTDRTVEIARRWTDAVYHFDWIEDFAAARNASFAYATQSHILWLDADDRLLEKDRLALLQLKKSLDPNVDAVSMLYHCDFDSAGNVTLAVRRARLVKRSRDIRWEGVVHEDLIISGACIDGDIVVTHGKLKEGSDSGRNLRIYAKLLESGGTMGARDLLHYGMELHQHRRYAEAHEIYSKFRSLPSTKGEEHIFVCIRQADCYYHLGDRDKELLATFQAFQYDTPRPESCCRLGYYFMEQGRYAQAIYWYKEALDAPIPENRWAIRNEVSRTWLPHMHLGNCYAQLMEYDTAFEHYFKASAACPGNAYLEERVEETARLVRQQSARSASS

SEQ ID NO: 1313 - protein, 662 aa, Desulfosporosinus orientis
MAEKISLCMIVKNEELSLARCLRSVSGIIDEIIIVDTGSTDSTCDIARQYGAVLHHFPWNGNFSEARNASLELAQGDWILFLDADEELSPNSRDILLRLIENETVEGYFVKIINYLGKEGWVETVPDLVFRLFRNKKEYRFRGAIHEQIADVILENNISARYQVAENLVIIHHGYLDQVIQEKDKKYRNLMLIEKELELNPTNHLLQYHYGVELYRAERYAEAEAVLIKSASDIDPNTIYFPKLIRYIVLSQHSSGHLQEALNSAAVGLKLFPNYADLYFYSGLILFDLKKYTQARDAFLQAASMPEQPPQYASFGGVRGFRAYYYLGQIAESYLDEEEALKFYLYSLRDNPHFTHALEQLVRILKPTKEPLYTKECLEKVCDFCTPAANRLMGDIYFRHGAYGLALQYFDQVEEGFPVSSDIKLRKAICMIQERRFFEALRILEDFSPESPEYPLATVNRLLCFWIQDRPQKVRSLWKELHALGLAQDTENVISLFLAFSEKTSPSPQFVLGAEGMQLLLDIVQRLVAMKEIKRALFFLHALNLNSLTDYYLNIAQIFMNYNEEIQAIPFLQTAIEMAPSAAAHFQLAEICSQLNRHFEAEQHYRHALQFDPDSPRHYIRLINLYTEWRQVILNEALAKFPQNDLFKILAKEVSSSNEPAD

SEQ ID NO: 1314 - protein, 1482 aa, Oscillibacter valericigenes
MNDLSIVMAIDGEEAEKSAEMLAPLFDEFDLELLVISNKETVNLRFPYKIYQFREDPRGFLNFCLNTSLADKIMIIPAGWQLVPDLFGQITKYLRRKDYRNLSCGVKSYLAEDKSKYYVHDEVLIYTRGVWGFNESCHCEIEDISFLNVDEKSITAGITRLLDTEHYCELADWYQSFIQEKTRPIRERFLTILERQKALSISPDASRKLDSLFIQLCKDSRYKKYLNLKKQLAVGGGRPERFHPTIRLRHPPAYICWLLRPLLKEYRSLELLSRFSEKTLRYALGQLLCQDGEAPQYLYDYIENASESVTGAVFPALFDAYINFQKDRSDSPDLKKRLLFVCNLYLETFSAEKSKKGAADLMEFLDAIQKAKKLETAGRFGAAVALLDLASGHLSEYRKPLRYYIQKIRYAHRLYSHVLSICMIVKDEEKNLERCLKSLLPLMRSGMAELIVVDTGSQDKTLEIASQYTNKIFSHPWNGDFSEARNESILYADGEYIFILDADEEFRPSDLEALIQNFSAEDYRDAKTFSIRLVSFTAQDLKQYSIMMQPRIFQNDGMFYYSSAVHNQPVSEQPLAALNIELLHYGYIMTRQIREAKFQRTATLLRQELQRNPGHIYYRFQLSASYAMYGDLKEARKQVDLYMRLLGAEALPNDIVLMYYNNAAIIYTECQQYDEALKICDLGLKAQPDYIDFLYCKGYICFLREEYQEAMACFLNYLRLIEAFYTHEIAEDGRFAFYSISGKEYVKKWYVAAGYRLRRFEDVISMASRFTEPVLFKDSFHEISGAYFKTGRFHDLQVLLESGAARCPDAGMEYVFRHFLLARFHELDKTAQKDCLSSFDPAFREKYLETAALSRPDYPLFSFDLIGKYDLNGVDYESLYSFLAESIPAVLSFSVSDCSNPAELGNQKTLAALLLRWVKELLLSCASSEDLAKVFNKYMEISAKLVAMKQQDLLEAKERLFIGKMLMAFEYLKTGDTKKAAECMEDSTLHYSEMHDFVNFAVDSLIPKETVTENSGNGGARDDVGSSALQLQIAGLSASTSPESVLKLCGEAGSRGACDAEFYRIQSAALMAADRTEEAASTLSHALEQYPDDPGLQRNLYYASLLKKDYPAAQQAYSRLKIENPRNKSVPLSPCLTAHSRGDGQNSTRVLQGTLDLSSQTAFQADVLKRKGIYSRSLNYAPEINAEFKSDYALDVSRLKTRDDILHTTRDITSKIIPQFDVFHFHHGYTLTFDHFDLLALRDLGKKVFMNYWGRDVRPTSKVPCGYKRGNREKDCDESILRRLESLSALIPECIVCDEEVYEYVRDFFQSVHIIRPMIDLERYKPAYKSKRGGRLTILHACPPGMAEESKQIGASIEAIQENYPINYRIVQGIPHEKAMELYREADLIIDQIRPGSYGKLAIEAMALGKPVICGISDFMQENYPSELPILRASPDTLRQTVEYVLNNRELLFELGKKGRSYVEKYHDSSREAEKLIKLYGC

SEQ ID NO: 1315 - protein, 355 aa, Massilioclostridium sp.
MVKISLCMIVKDEQDVLARCLDHIKDIVDEIVIVDTGSTDNTKQIAMRYTDQVYDYIWQDDFAAARNFAFSKGTKDYLFWLDADDVVLEQDAEKLLQLKQTLSPEVDMVMMQYHVAFDKEGNPSFSYERERLVKREKGYQWKGAVHEAITPSGNILHTDIAITHQKLHPSDPDRNLRILEKIKKNTGLDPRQQFYYARELMNHHRDKEAILVFRNFLDSGKGWVENNINACLDLSQCCQRLGQKQKALESLFYSFIFDRPRAEICCEIGACFLREERYQQAIYWYQAALQCDKEDSKGGFILPDCYDFIPNIQLCVCYDRIGKHQTAYQYHQVTERLKPHHPMVVHNKNYFQSIL

SEQ ID NO: 1316 - protein, 342 aa, Lysinibacillus sinduriensis
MQMPSISLCMIVKNEEEFIERCLKSVHELVHELIIVDTGSNDRTLEICKKYNAAIYPYQWGDHFADARNFGLSRANGDWILWLDADEELETSKSQLMMDFITQTDASMLFMPIINYYGDTLPVKQEQAYYYHQPRLFRNNLGVKFYNRIHETPNFPEQEDSRYKSETLEVPIHHYGYIKEITTKKKKSQRNLHLLQEEYQNPGHSPWIEYHLASEFYRNQDYGIAFTYINESILGFLLQGLKPPAILYRLKYGILYETNSIDGACSSIEKALLLYPDYVELHFIKGLMLFYKEEYSDALDSFEKCLKLGENHSEYLIMKGSGSFNALHYKESCLSKLNSTKI

SEQ ID NO: 1317 - protein, 249 aa, Unknown
  Description of Unknown: Candidatus Amesbacteria bacterium GW2011_GWA1_47_16 sequence
MLTAVVLARNQAHNLPQCLKSLRFCNEILLIDDDSSDNTSVVARTYGAKVFRRSMNGDFSAQRNYALSLVKTGWVLFVDSDEEVSWELSREIANLPQDSSVKGYFLKREDIVWKRRLKYGDLYGFRILRLGKHDAGIWKGKVHEVWNISPPLGTLESPLLHYPHQDTASFLHKINRYTSIRARELYDRGRKSGILSVVFYPVFKFLFNWLIKMGFRDGLPGFIHAVIMSFHVFLVRGKHYLLTKGVSDS

SEQ ID NO: 1318 - protein, 584 aa, Paenibacillus sp.
MSIADPSPTEDPNSNPVYTRNEYGHYWPEEYIWRVAALKDWILSYAIEEGYDALFLLDSDLVLHPSTLTQLLNGEEEIVANLFWTRWQPGTIEMPQVWLRDEYTLYEERRNEQLTEEEKQRRSAEFMRKLRKKGRYEVGGLGACTLIRRSALEKGVRFARIDNLTLWGEDRHFCVRAQVLGIRLYVDTHYPAYHIYRDSDLDGVTAFLQSAFKHTIEGTEASKHILISLCMIVKNEEKSLARCLDSVREIADEIVIVDTGSTDRTREIAKEYDCRIVDYEWKDHFADARNFAFSQAEGEYILWLDADDVFEEKDRQQLLDWRERLDSSIDGLSMEYHLAFDGSGNVSHKLRRNRLVRRDKGFEWHGAVHEYLAVSGNIIHTNIAVTHKKDKEYTDRNLRIYKRLEERGEIFTARDQYYYANELRDHGLNEEAVQWYTRFLDSGHGWIEDNLSACLKLAECMGRLGMKEQELAALFRSFTYAIPRAEVCCRIGTWFAERTEWDTAIHWFETAVALKRPQDPLANIDEPSWTWIPHLQLCVCYDRLGNHGQANYHNELALRYHPTHPSMLYNQQYLKEKLQNGVLR

SEQ ID NO: 1319 - protein, 371 aa, Ureibacillus thermophilus
MSSISLCVIVKNEEEVLANCLESVKDICDEIIIVDTGSTDNTKEVARKFTDKIYDFTWIDDFSAARNYSFSLATKEYILWLDADDVILPEEQKKFKKLKKNLHSKIDAVSMIYVTATDENGNPTFYYRRNRLVKRSKGFKWIGAVHEYLAVSGNILEADISIHHLKKNKKPDPDSIGRNLRIYENRIKNGEEFSPRDLFYYANELKDHKQYKKAIIYYQEFLDGKKGWVEDNIRACIYMADCYAYLGEKDNELMSLLKTFAYDEPRSEACCRIGDIFQERKNFKNAVFWYELAVKMKNKKTGGFQHTSYTTWYPHLSLCVSYWQLGNVKESIKHHEITKQYIQNHPKVLFNEEFFQNYLKKHKNNEGRMKQ

SEQ ID NO: 1320 - protein, 658 aa, Lucifera butyrica
MLSLCMIVKNEEKNLARCLSSVSGAVDEIIIVDTGSADNTLEIARSFGAKITSFLWNNNFSDARNASLSLAGGDWILFLDADEELAPGSINFLKQAMEAEDVEGYFLKIVNFLGNEGWQDTCPDLVFRLFRNRPDYRFHGAIHEQIVDVILEKNKQARYQRAENVIILHYGYLDSQIEDKDKKARNLQLIEQEVGQDPENRLLRYHYGVELFRDGRYEEAAAELIRAANGIDPQTIYLPKLLRYIVLAYHAAKKTEEALNILKTAIPVFPDYADLYYYQGLLHYERKEYDRSFQAFNLAVTMPEQAVHYAPFAGTRGFRAYCMLGQLAELFCNPEEALHFYIAALRDNPRFTTALEKIIAILDPVKEPAYTKTALFQLCDVSTPSANLFMAQILFSQAAYGLALEFLDQGTVHQPLAPETSLSKAICLIQNRRFFEALRIIETFEPGHPLFPLAKLNQLFCFWLQGNRRQVRLLANDLLSLGLSADTAAVVGLLRDSLTKKNPKPVTLGEDGTALLADILKRTLSLDEAAKAESLLGSLNPEIMETFSGTAGKLYLRFGFPALAEHYLRQYSARFSEDAETLEHLATALTEQDRPEETILCYQQCIRLEPKMPRYYIKLIRLYEQLRNNLLQTLTHKYPQLEMFRVAQSRDDTAWWSP

SEQ ID NO: 1321 - protein, 355 aa, Cuneatibacter caecimuris
MKTISLCMIVKDEEEVLERCLRPVRPFVEEIIIADTGSKDSTKVIAAGYADQVYSFPWNDDFAAARNFAFSKASMDYCMWLDADDVMTQENLEKLKIWKNQEDRADVVMMKYLTGVDEKGRPSLSYYRERLLKNHSGFWWKGKVHEAIPLAGTIQYTDMEVLHQKVKKGDPDRNLRIYENMRKEGGLQEPREWFYYGRELYDHQNYSRALEVLHHFQEMPGAWLENKIESCLQAAACQEALGNETEAMGELVRSFLWSAPRAEICCEIGRLWMKQKQWKNAAAWYQQALRDTRSLQSGAFIREDCRGFLPAIQLCVCYDHMGSRKRAYGYHCLAKKFRPDSEWVLYNDRYFSDTN

SEQ ID NO: 1322 - protein, 675 aa, Paenibacillus prosopidis
MTDALLSIQLIVRNEETLLPFCLDSVKTIADEIVVVDTGSTDRSVEIARSYGAKVIVSKWNDDFSYARNQGLAHTQAQWIFYIDADEVLTEGKESLRERLTATNAEAFWVNIENVLGRLPEERLQHRMIRLFRNNPSYRFRERIHEQIIPSILERCTPDRLELSNLKLTHLGYFAEIKNQSEKRERNERILASMLSESNQDPFVLYNLAIAKEQRGDTQEALKDLLSAKASAPAAAAYRPVLIRDIAKLYLTIERPDEAARMLNEECGNYQDYPDLYFLLGRSYRLQGLYPEALQAFQKAAGCQPSSAPYAIETGTATFRAYTELGELLAKLGQYESAKTCYEKAMEFHAGYMPALLGWTAALDALNVSIDTITAGLQQLLAKLPDRAKKYAEAMIYLGRFEELIGTHNDERDPAEPELEYFTALAHLHLKQYDQAILILQNLSATVLPDRRTDISQMLALATWSRGSALGYEFYWELDADVRRLYRSLERRLWKRPKEAMDPAMLQMAREMIGKAVQTGLLDTASELAGSDPALLMHAAKCLYRSGYVQLAADLFIHLLEGDSLDAEATVCLAEILYDRAHYGEAAALFEQAVPEIGDAARIGAVLSYLQTSRSLLQQALEFTPDSSLLKGELQKTATGIELLNKIGWRTEWTPAQRRSAGVVTPDFLMHDRER

SEQ ID NO: 1323 - protein, 362 aa, Ruminiclostridium cellobioparum
MITISLCMIVKNEEETLARCLDTVKDIVDEINIVDTGSTDRTKEIAQQYTDRIYDFPWTNSFAEARNESYKYATKDYILYLDADDVLLEDDREKFKKLKETLDPSVDSVSMYYNAGIDEFGNVTLRFRNNRLVKREKNYRWYGDCHNYLDIHGKIINSDVAVTHKKLRHSVGRTVSIFESKLARGDTFSPRDYFYYGNELRENGRFQEAIDNYDKNLEMKGGWVEDKIFACIYKGDCYRSLGDKTKELASLFQSFNYSPPRGEACSRIGYNFHTRRDYKTAIFWYELATKLYPDPDRWSFVYMAYYTWYPHLQLCVCYYRIGDFQKAHEHNEEAAKYRPSDPSVINNRRLFERLFQKSDAEQ

SEQ ID NO: 1324 - protein, 595 aa, Unknown
  Description of Unknown: Clostridium sequence
MKNQVSLCMIVKDEEEYLPKCLKSIKDIVDEIIVVDTGSTDKTVEIAQNYGAKIYYFKWNNNFSEARNESLKYATKDWIFILDADDELSLEGREAFKVLLDMELDEKAIYHFETLSYYGSVIENGNIAVNLNPRLFKNYRGIHYEGEVHNQLIRVDGDYNAVCNDVKIYHYGYLDKRIISKDKRNRNIPILNEQIKKDPNNKFAYFNLGNEYGAEDDTNKALECYYKAYENFTPNIGFGSLLILRIIVSNLILKKYDEALKFISIGNSNYPKCTDYYFYESIVWKEIDRPTLQIKALKKCIELGEPPSEFKFIFGTWSYRAYYELGKAYMKYKDYYTAYNYYVDALKSKPDYIEPLYDIADVLKAQNVSLEEMKRIMEEFFPEDKKVHYGTIADLFYHIGYYNIALEYIKEYEESVNVTENTIMLKSRCLIRTGDFKECTSINYNDKKSSNYVILSMYKVLSFVLLNRYEDALFIVNSFNAKNLSNYDKKYLGVYSELIKLVTQKSTSMLAEDENDKEYMNIILEVIEILLINNKFDELTVAVNLLNLVNTKYALLYLGKLYYKHGYVDLAKKEILRSIKEVDIYDAEGLDILKY

SEQ ID NO: 1325 - protein, 590 aa, Natranaerovirga hydrolytica
MNKTVSLCMIVKNEEKNLSRCLKSIDGLMDEIIIVDTGSTDKTIEIAKAYNAKIYHYEWQDDFSAARNESIKYATGDWLFFMDADDELCHKDRERLLELIQKGAKDIYFFETHSFVGRTPGANITVNLNIRLVKNDGQYYYESPIHEQLKNKKQALTNLKTSIVDIKIFHYGYLKENISSKNKRERNKSILQDLMKKEPNNMFHYFNLGSEYFAENNYIKALECFNQVYKNFDEKTLYAPKLILRMVLCCYFLGLYEEGIELVEIGLLKYYPKYTELEYLKGLIYHKQKKYTLAIDAFNKCIQMKDSPSALKFIFGVGDYRSFAALADIYMALEDYYKAYEYAVKTLLYKKDYAQGVYHLVKILKAMQAEEKDVFKIMESHKANGKISNLIIGDALLKEGYHTLASQYIQLEKKESIHKDTLKAKYLFKSKAYEEVVRFLEHKPFTIDTFKMLSLSLILLKDEKIFKYLETIEDKEALKACRDLVKVYGELAHILFEQPTAVISYEKKERVYTQIIMEILNQLLQNNEFDVFEKALELLNLISDDTVLLQLGKLYHKNGYEKMAYKEIIRSIKDFDVIDKEGLRILEQCV

SEQ ID NO: 1326 - protein, 353 aa, Clostridium sp.
METISLCMIVKNEEAVLERCLNSARGIWDELIVVDTGSQDRTREIAARFTDQVLSFPWQDDFSAARNASFERASGSYCMWLDADDVLLPEDRDAFLAVKEQDLPEADVVMARYQTLDADGAPVLSYYRERIVRNVPWLRWSGAVHEAIPPLGRVVYTEAAVTHRKERPGDPDRNLRILEGLRASGRNLSPREQFYYGRELYEHGRYEDAVQELELFLTVGWGWRENNLEACRVLSACYSALHRPRCALRALLESLAFDAPRAEICCDLGNFFLEREDYRSAIRWYEQALSCTRDDRSGAFVRPDCYGYLPAMQLCVCYHRLGEREQAVAWNERAGAFRPDDPAVLRNRAFFAG

SEQ ID NO: 1327 - protein, 352 aa, Unknown
  Description of Unknown: Lachnospiraceae bacterium XBD2001 sequence
MVSISLCMIVKNEEMVLERCLESIHDLVDEIIIVDTGSTDDTKSIAAKYTRLIYDFSWVDDFSKARNFAFSKATGDYIYSCDADEVLDDVNRNRFLQLKEVLMPEVEIVQMKYVENGLQSVLNSNWEYRPKLYKRLRTFKWIDPIHETVRTEPVVFDSDIEILHMPESLHQKRDFHIFATAYKTDGRLSKKLYSMYAKELLKCGSTEDVRIGSEIFAEVLEKEELDADLFRQLCCIVARNARLQGSDADFLKYAMKVNAVAPCSEICCELGEYFFAKKDYEEASLWFYNAIDGTESILDVHSGGNLPMLRIADAYSHMADAMDPEEAPTGRIEELQRLATEYRNKAKEWTMP

SEQ ID NO: 1328 - protein, 363 aa, Paenibacillus sp.
MIVKNEERTLARCLDSVASVADEIIIVDTGSSDRTMDIAARYTDRVYTYAWHEDFAAARNESFAKATQEYILWLDADDVLLPAERAKLEGVKQQLLPEGEANAVILNYTLAEGPEGSPLVTDRRLRLVKRDAGCRWHGRLHEQLSFPQSGVITADIAVTHRREAGNHSARNVRILRKWIAEEGVAQGRLLFYYAGECYDRQCYAAAARGYAKLLEQSSGYREDRLIACARLAECYERLGEPGRKLGALLQSFQYDLPHADFCCAIAACFHERQEAVSAIYWYMQAVDVSSRDPGLRPVPVPCRTWLPHARLSLCYAHLGNWEQALMHNTKAREYLPNDPGLLANRQKLEVVVRKEMKEREERD

SEQ ID NO: 1329 - protein, 649 aa, Paenibacillus beijingensis
MLISLCMIVKNEEEVLERCLDSVKDIADEIIIIDTGSTDRTKNIAAKYTKHIYDYVWTNDFAAARNEGIRRANSKWVLVMDADEYFNPADALKLRSFLETETPQESVIYAVNVVSFIGSSMEQSMINTGEVPRLFPNHSNLFFTRPIHEQLHSLNGTALTVYLAPVSMYHTGYLKGVVEAKEKSKRNASIFTELKKTTGYSAYDYYTIGNEYGIKDDIPKAIYYYERALKKSEKLTSRSWYPRCVISLIQCYLLQHRFYDAWTLIEQRLSNWRQYPEYNCFKGNIYYYLGLFEEAKLAYEETITAADELAKSTHLFWLDSAEFASTIPLQKLLEISNAENNTEKTIYYLTKLLMQNPYDYKALAQLMELLLLSDPPASVMTFLSRTYNENDVKHLLILFKVSLSLGSEELAAHYYHQLKTNDQELKPADLLDFYLLVGDRKRYESTLQQFEAHMKMSEELLVNRISASLIWNDSDYYNRISIEQNDGLFTTYKTYQQIINRENIDLESIQVSLIVYKLLSRLFQLRQYEIYDQLVNKISNSDIVNSLANFLYKKKQFDLSMNYYSILLQENQLDGTSLENLAFYHFNNGFVSEGLEFLEAAIEKRPHEPYLYVLYLQRCTDRVKKETYRQQFGFNYPQLKKIPAINKFL

SEQ ID NO: 1330 - protein, 653 aa, Unknown
  Description of Unknown: Paenibacillus sequence
MNMLLSLCMIVKNEQDVLERCLESVKSAVDEIIVIDTGSTDRTKAIALSYQAQVHEFTWGNDFSAARNEGVRRAAGKWILVMDADEYFAAGDAEKLRQFLESAEPSSHHIFSINVINFVGKSMEQAVITSGEIPRLFPNGFGIEYYRPIHEQLRSPSGELLSSLAPVSLFHTGYLEEMVNSKSKLNRNASIFKELKEKQGFTAYDYYTLGNEFAVGKDIQKAVYYYERALKKQNKNINSSWYPHCVISLIHSYLLQHRLLDAWKLTEDKLSAWKDYPEYAFYKATILHHLGFMQEAEKTYVATIETAALKSKESQVFWLESAEFASTIPMRKLSSIYEWQKKWSEAVHYLTKLLMQDLYDYSALRALLKIMTRFDTTEATIELLDKLYEPGNSKHRYILFRSALANHAAELSRHYYESIAGDLALSHEDMLEYFFLIKDKSGYAQTAALIPSGFIHERMARIHALADHAWGLSLALPLSLDDSEEQNQAAHRIEAIRSYLRGETEPEDVTLENFGPLLDLLKDSFNFREFAIYDQLINRYSHDFVIQQMADYMFVQEQTEIALNYYSLLLEQNALNGKNMENLAIHHLHQNLVENGLAFLEEAIRELPGQIYLYVLYLKHASEPLKKEEYRQKLLAQFPGARKLPIFTDLLAR

SEQ ID NO: 1331 - protein, 381 aa, Paenibacillus sp.
MIVKNEQRTLARCLDSVAGIVDEIVIVDTGSSDRTKEIAAQYTDRVYTYEWKDDFAAARNYSFDQATQEYILWLDADDVLLPAERAKLERLKQQLPSGGETAAVILGYTLAEGPEGSPLVTDRRLRLVKREAGCHWHGRLHEQLGFPQSGVITADIAVTHRREAGHHSARNVRILRKWIAEEGVAQGRLLFYYAGECYDRQRYTAAVRAYAKLLLEPSGYREDRLIACARLAECYDRLGEPGRKLGALLQSFQFDLPHADFCCAIAACFHERQELVSAIYWYMQALDVSSRDPGLRPVPAACRTWLPHARLSLCYAHMGNWEQALLHNSKAREYLPNDPGLLANRQKLEAVVSKVNSGLEEKEKEKEKEKEKEKEKEKEKE

SEQ ID NO: 1332 - protein, 351 aa, Clostridium diolis
MLSLCMIVKNEEENLKSCLPKVLTFINEIIIVDTGSSDNTKMVAKEFGAKIYDFKWCNDFSKARNFSISKASNDCVLVLDADEFVLNFNKDIVYEFISNPENENKVGRIQRINIMEDSNGSKNYIERVNRLFNKKYFCYDGIIHEQLVALNGKEYETENVDIKVDHVGYTKDELNRTHKLKRNIDMLQEALKNNTRDPYIYYQLGKSYYMLQNYSKASIYFEKALEFQLDFRLEYVENLVETYGYSLINSERYSDALILENCFEIYSNSADFNFIMGLIYMNNAKFTKAVECFLECTKFNQSKVEGVTSFIAYYNIGVIYEVLGFKEKAIEYYSMCDDYEAAKKRLNMLII

SEQ ID NO: 1333 - protein, 734 aa, Anaerotruncus sp.
MKAKVKKPGQRPLVSIGMIVKNEEKYLEDCLKAMSPIREAVPSELIVVDTGSTDRTVEIAEQYADQVLHFEWCDDFSAARNVSLEAASGEWFLYLDGDEILEENCGPIIEFLKLPNNPYGTASLIQRNYSDYEHTEYSDFHMIRLYRNIPGMRFQGSIHESINPFIVPTKDISVIAHHDGYVQGVNEKKQQRNQKLLLLELEKNPEDVRILRHLADTYGLQKVSDVEERTRIAREIIRILGGNRPDHTEWIYAYHTMVFSAIIRREYAAAQQLIKEFFQDKNEGDLAADMEMRYYQGNIYFDCEEYPSAREAYLEYQRLYQLYQDGKLNTRDVYSVPIAFAVPYNYAMSCYAVAKCWQVEENYPEMKAALEHAGSLTEKTLERSDASLMMECLYAYEAEDFSRLPMLLEQASSLKEGEGWKDFTIWFEKRFDLFLVRKKDACLTIAQTDLQNPFAQLCRLRTAQTREQAQELLEQLLDDPDAVKTPLFADLLYATVFYQFDLQHTLSALDSSLVERYWETLAKQRPDWPELLDTYLMEHPLQESDPPVCWFWQTRLMLSLLLSPEPDTKVLFQQPWLDEERFASLAQRYLDAMTHYCRMVYQPAMLLPENRVALPAEYRFVIGWQEAEALQKEQGDGACLQRLGEMLQEFPLMNRLIGLFTARTRQRLEAQKQQREEFEALAENVKQQFYRLASDGQIAHAAQILESYRALCPDDPELLLMQSQLDGPRYTLES

SEQ ID NO: 1334 - protein, 352 aa, Unknown
  Description of Unknown: Lachnospiraceae bacterium C7 sequence
MKTISLCMIVKNEEKVLARCLDSVADLMDEIIIIDTGSTDKTKEIAKHYTDKVFDFKWTGSFSDARNFSFSKASMEYIYAPDADEVLDEINHKRFHDLKEVLLDEIEIVQMYYVTPKEHNTVQNAKKELRPKLFKRNRTFTWIDPIHETVRTSPIVFDSDIEILHLPESSHGKRDFSIFEKTFKEEHNLSEKLIKMYAKELYKCGDKNDFFNALPIFLELYNIASSSSSNITNCIPEILCIIAHCYRLKNDVLNFFKYALSNMVENPCSEMCYEIGYIYKENNDPSEAILWLYNCSNETSPVIDVSIPGEKAYILSSQCYKELFDITNDSTYLNKSNECISKANSFSLPDIL

SEQ ID NO: 1335 - protein, 363 aa, Alkaliphilus transvaalensis
MITISLCMIVKNEEALLARCLDTVKDLVDEINIVDTGSTDKTVEIAKQYTDRVYFFEWIGNFAAARNESFKYATKDYILYLDADDVILEEDRIKLKQLKESLDPSVDSVSMYYDASTDEFGNVTLRYRRNRLVKREKNFVWRGDCHQFLDVKGKIVNADISITHKKIKHAVGRTISIYEKKIERGDVFTARDHFYYGNELRENGHYKKAIESYDKNIATKEGWIEDKIFACIFKADCYRHLGDLENELTSLYQSFKFSPPRAEACSRIGYIFQRQKNYKIAAFWYELATKQVPEADRWSFVYVDYHTWYPNLQLCVCYYNLGDFEKSYFHNEEARKYRPQDERILHNRQLLKDKLKSLMTQEN

SEQ ID NO: 1336 - protein, 341 aa, Lachnoclostridium phytofermentans
MITVSACLIARNEEEVLARCLDCVQRIADEIVIVDTGSTDRTKEIASRYTNLIYDFTWVDDFSAARNFSFSKASMDYLYVADADEIIEEEQIYNFLRLKETLLPEIEIVQMYYCNQLEFNTTYNYDKEYRPKLYKRVREFRFYDPLHEAVRLEPMIYDSEIEIIHKPLSNHAPRDFATYQKIIAREEKLSEKLRSMYARELFIAGKDRDFIDAFEYFCNVALHNTLGLTELKQCQCVIARGARLQQIDHEFFKVCLKNVACGEPSSEICYELGEHYRLSGDNVEAVLWYYNAAFETEAELNLHYQGDYPLNQLALCYHNLGNEEEALKYERLRDEWKAQKR

SEQ ID NO: 1337 - protein, 1771 aa, Weissella soli
MGIFKKKDSVQKSGISISDMVVLDNHLLFNSKTEITKFQMNIVDNVVEIPVNKHGHKYVLDLREILETVKQKGTFNIYGLVNDKVSTLVLEKGNLETEIFLKVDLTSTLVNKATIKISQNGSVALQVTSVVENNAQTAVFNTQAIDVKKIDGESIYFGIFNEIAIHSLSDNSFEIIRLRDGQLFLEDLKQKLVNRNTPEGYYEFGFFNEDNEFILFEKSKLKFPSIKQIAVVGEYDNQKSYEVIVATWGKSIGVKVENLRTTIQITDEIEVSNDEIRINGAFNSILSVDLVNRKTLQDIELPFEKIQNGIQIDFSKLTELQENGRYNLYVRTSDGVDYRIQNPQKKKLSNYLSSEEVKLENGRHLSIMYTYTGRLIVDISSTPLAIRTSDSKLSDLVSVTKVISDETATRFTLNSMLPIEDAIIFDGINFQTANEINDNYLVFDLKNILKRTKYTLYIKVQGNNNYSVVSNNVDDNKRDHVIYVLKNMEVFSFEKAEELNLTTIVTFYNVEDYLEELLESLTHQGLALTEHEILMINDGSNDRSREIAVAYQDQYDNFRLIDQENAGLGEARNTGLANAKGKYINFADGDDIIIENGYREMLDRVLKTGSDIITGGVKQYKNGKEIISGVYRKIFTHEIKQTSLAETPILVYDTTAWNKLYKRSWFTALGFHFPTMLYEDIPVTVPAFSKANSIDVYPGTVYLWRIRSNPNKPSITQRRTEISNWNDRLVAIQAALEGTKSNPVALLEYQTKVLTMDYPMYIKLQQKLSGEYKRSLQSTAKWFLETFDKQAINQMSYLDTLRLHLASQGDWRSLTELENDLKNDVFYPEIIDGTVVTSQYSKVAHLEDYHLKPGDITGWLSVISAERHDDKLIQLTVESNISVNGRLEHTFQDMSVALTVNNQIIAEGQLIAETIEDIKTKLIFYVTPEAITRALGESDTQLVSVQVRVAGVEANLEIVNRYRAAFDRQTIRQNGHRIGLGETTNFALIAFDYVTTTNIEKLNVNNHELIVTLDNPVSGLILHNMDNNNEYQFGKISDTQFSLAIYKVKFNSPATKQFRLEEINSTKEIGISTSIGNTYSEYNYQAISVVTNNLGQTVIDFDYRPVLVSEFLEAENTVDLVVLVPESVIRMVFEDSDVILRQLNVQIQDGQTIEAVLPVGNIEQLNHQYQATIRIPKSLNFTGNETKELNFVVYDGVFNKVWNSIVRLGRQTPMQLENTTFKFVADTTRKNHPLFIQAQVHSFENISDSILHEWKKKYRDSNTKKQTNNYAYFRQFLPIEDDVILYESFFGSGMTDNPYAVFKHILENDLEQKYLHVWAVKSLKLTPQMARYIAYPNVVFVQHNSDAYRHFLAVAKHIIVNTSMMSYFARREGQRVIQLWHGVPLKALGRDMKTTRGANRNVIRSLAQATTFLNPNLYTETKVMDTLDLKDIQNVNRVIAAYPRWERVLNAKQENYLLDVLAKEVPIDTTKKIALYAPTWRGDNKQVKNATADFIKQYQLIKENLPADYQLVLKVHANAYKDLIRSGVDVGLFIPEYLDAAEILSVTDVLISDYSSIMFDFYLTKKPVISWMYDKDEYVSEQGFYPEIFSEMPWIADNERQLVYYLNHLDEYEANDSSFISDHIDMNHVQNLLFTDEFKTEATKVDVQLVSTDQFRKNTSKILEEITRVNQHPLVLMHYGDYSQADNLLFSKLPDDTRNFYRVGPIVSSEAEFLLLMKYVSGYSINDQELSVLQQLKEIEIQRSLGNINVSKVSALDKVSADYWISKLLIL

SEQ ID NO: 1338 - protein, 624 aa, Paenibacillus polymyxa
MMKTVALCMIVKNEQEYLRRCLDSVKDKVHQIIIVDTGSTDDTVSIAKEYTSDIVQIEWTNDFSAARNESIKHAKTDYILVLDADEYLGENFNLSEEIESGADYYFTKIYNVMSSDRGITHLAIRIFANNKGLHYRNRLHEHLNTMEHEDKLKAGYAKLTIFHTGYTDEMMESREKANRNLPLMLKEVEENPTVYNLFNMGRTYMWVGEHEKAIKYLQKAYPLSKELTIAPELISTLCRSLGELKRYQEALIILKEATAIYPGEVDLIHLQALFYMEINYYKDAIEKMNKCLEVGDRGITVTEGNGSYIAHFRLAEWYESRNDLVKSYEHILKAFKLKNDFVPVMGKYFKIIEKAGVPSEEVFSSTKQLYPISNGGQLEKLLEVMYQLRHPLLEKYLTEYNVTVQNNVMATARQYARDYDGAQALWLEMADVDEQNGEDILLLSIILKDETLFRKFKPLLNLSQKEIKKLYKIIMNEPSQDVKLTPHLENILERALIQLIRLQEFETFEMILDYLWQGGVNVKVKVCEHLVTYGFNEIAIDLLVKLFEIYPRNVRIIELLGDICLSSKYYQDAQLFYTKLLELCDDYDAYERAYELYERVDDQISKSSILEQIKLKFPLCAWVK

SEQ ID NO: 1339 - protein, 799 aa, Paenibacillus silvae
MQNRLLGIHMIVQNEEKHLPRCLNSLRHKNLECFITDTGSSDRTPALARAYGAMVLHARWEDHFAQARNISLPLATTEWILCLDADEYVIEGLEELMKFLPDVHKSITRLCITIENQFGEGAEDKVMSYPVRLFRAHHGYRFTGRIHEQLIRAHDHEQNYTVIPKGNTSGVNEAVDSSNANEEETFVDIEPLAPLRLGHDGYLASVIASGEKPKRNLRLIQKELEDHPGQPFHLYNLGVARCQLGELEQAVNAFHESLRLAHLQAPYRPTLVKDLAKVLGSLERYEEAHTLLALERQRYPEYPDLHLLYGEILERQGLEERAYQCYARASTCSVKPFNQMKDYNGEFEPVYVSEAGSGSYRGYTSMARLAEKRGFGEEAIRLYTLALEHLFTYQPAWTGLAETLQQQGHSDEHIAERLLEQFKRLGQKQQQSNQSGDINSSSNARNDEASPLPIVYALAASGAYKQALLLVDDQACHICIPAGDLIHWLLCANRITDAWHLAEESWGARNQQDSEQMPDLSDSGSEIQNDRQITLRPDERADWALACWASGQHLSASFLARTSPLERDMWRVADRLLLDYRLSPSACNPGSETADEQLLHWSEAAELAANQVVTRAVQNGQLVIARQLHERLAGMMFTKERAEMTTLRNYAGLLVRHGYTMLAADMLIQCMTEGELDAEGLFWLGETLYAKGYIEQALSLFEQALERDSAFTQARAGAAVCYLKLALELIGQERERSQKAAVLEARQRNLVQQLLTAEGMPWRTIYRARERRNHHAGRAATDTAASEGAADIAVYDREG

SEQ ID NO: 1340 - protein, 355 aa, Unknown
  Description of Unknown: Virgibacillus sequence
MVTISLCMIVKNEEHVLERCLDSISHLVDEINIVDTGSNDHTVAIAKKYTDRVFHFEWTDNFSEARNQSFSYATKDYIFYLDADDVIDKMEQEKLFHLKKHLNPEFDAVSMIYLAGIDEYENVTLQYRRNRLVKRRKQYQWFGDCHNYLQVRGKIFHSDIAVSHKKNAHAYGRNLHIYEAMICKSRSFTERDYFYYGNELRENGFYQQAIEAYTNGINMKYGWIEEKIFACIFRADCFYYLNEAELALESLFQSFRFSKTARSEACSRIGLLFQKKREFLLAIFWYELALRVVQPKSSWGFSYPAYSTWYPHQQLCICYYNLQAFDLAAHHNNKAMEYRPNDELLRFHQTLLKGK

SEQ ID NO: 1341 - protein, 760 aa, Paenibacillus amylolyticus
MKNRLLGIHMIVQNEEHHLPRCLDSLKHISTECFITDTGSSDRTPEIARTYGATVLHACWEDDFAHARNITLPLASTEWVLCLDADEYVTQGLEELLNYLPKVHKSISRLRITIENRYGEGVEESVISQPVRLFRAHQGYRYAGRIHEQLVRSSPSRLGQDEAIDMNKSETYTDEQSQLIETEPLAPLCLIHDGYLASTIAQEHKPRRNLKLIERELADEPAQPFHLYNLGVTYCQLGEVEKAIEAFSESLHLTELLAPYRPTLVRDYAKTLVGSERYDEAHAILIVERQRYPSYADLHLLYGETLELQGLEEHAYQSYARATEYWEGIDRVGHSDGGSTLDASYVTEAGSNSYRAYTAMARLAQKRRFYKESAHLYGLALDSMFTYAPAWAGLADVLQHSGETDENIAETLLARCRGIEKSGHGDSICGEMPHSYAVTNEDHLVMVIYVLTGCGAYEQALKMLDTDACTARIHVADQIHWMLCANRVSEALQLAEEHWSVGCVHEVNLPAEHRMDWALACWTNGLRLSEAFLATTLPQEKNVWKVMDRLLDQLSKEPRSMEPASQEQKLIQWGPQAEMVAEKVVQQAVKTGQLTLAEQLHELRAMMMCDHWGTTLTRRRKFASLLYRQGYTMVAANILIQCMTESALDAEGLFWLGETLYAKGHNDQALSLFEQALEREPDMWQARVGAAVCYMRLAMEAIRQELVRSPSSGVLAAQHNALEQRLRTTEGMPWRTLFHAKERRNQLASGTNFPMHDREG

SEQ ID NO: 1342 - protein, 364 aa, Ruminiclostridium sufflavum
MVTISLCMIVKNEEETLARCLDTVKEFVDEINIVDTGSTDKTIDIARQYTERVFNYEWTNNFSAARNESFKYATKDYILYLDADDVILEGDQVKFKELKETLDPSVDSVSMYYDAGTDEFGNVTLRYRRNRLLKREKNFQWYGDCHNYINVRGKIINSDISITHKKIRHAVGRTVSVFEQKIERGDIFSPRDYFYYGNELRENGRHEEAIKSYDNCIAMKEGWVEDKIFACIHKGDCYRTLNDPNNELTSLFESFKYAPPRAEACCRIGYIFQRKQEFKTASYWYEQAAVQIPDPDRWSFIYTAYYTWYPHLQLCVCYYRMGEYQKSYEHNEEAARYRPTDPSIVSNKKLFERLKSTDTTLQQG

SEQ ID NO: 1343 - protein, 360 aa, Salipaludibacillus agaradhaerens
MITISLCMIVKNEEKVLDRCLQTVKGLVDEINIVDTGSEDRTVEIAKEYTDRIFFYEWTGDFAAARNESFKYATKDYILYLDADDVILEEDQEKFKKLKKSLDPSVDSVSMFYNAGVDEYGNVTLRYRRNRLVKTDKKFKWGGDVHNYLNVSGHIINSDVAITHKKIKHATNRNLSIYKTKIERGDVFSARDYFYYGNELRENGHREKAIEAYEKNIQMTEGWIEDKFYACINKADCHRQLGEQERELEALIQSFIFSKTPRPEACSRIGYHFQTKRLYDHAIYWYEQALNLKPDTNQWSFSYPAYSTWYPHLQLCVCYDRIGKKQKAYDHNEKAREYRPRDRAVLHNKTYFEKTLNLTE

SEQ ID NO: 1344 - protein, 473 aa, Acidibacillus sulfuroxidans
MNRISLCMIVQNEEQFIAQCLQSAVDLVDEIIIVDTGSTDRTLEICKSFGAKIYSFSWNDNFSEARNAALSYAHGEWILVLDADDELSISTHDFIRDLLNQKSYDAFFFITKNLVGDPKNPSFLNYAQLRLFRNQPSFRYSGAIHERIPKLPNITYQLVPVMITHYGYLDSVVQAHHKVERNLAILHAELQTKPFDRFLHYYSGNEWLRSGQPNAAIEHYEQAMRSKTESEEQDWLPDLPLKYAFALWQTGQIGRAILVVLKAIKEFPEYTDLYFLLGNMYLEQQEWELAKEAFDRCLHLGEPSPVFPTQAGCGTYLPAFLLGVIEFTNRNWTNARIYFEQSVHDDPDYLPAVTYLCLCDWCEARYSLVNERIQFLRVQNGDKNSLWGLIYSINQSLMTKKIYIDLDNLTHTTSFFTCLATLTSCEGQVQRLGQLLLQLPIQWHRLAMREEWYYALYGKYHLMSCTTLREIRR

SEQ ID NO: 1345 - protein, 473 aa, Paenibacillus odorifer
MNRSRRKPLISLCMIVKNEGDSLSQCLKSVRGVVDEIIIVDTGSTDASVQIALSFGAKIIQHPWSGDFAAARNAGLQQAHGQWILVLDGDEELSEESKGELLLCAEHMEYEAFFLRIHNHKGLTPASQTITVNPIIRMFRNRPKYRFSGIIHEQIAEAIITATPQAPMHLTTVVIHHYGYAEGVVVKKDKIKRNVELLKEQLRLNPKDPFHHFNMAVEYMRLGEYQPALKHIQQSLEEAPPDTSYIHLLHKYEIRSLAELKDYPGALAACDRGISSHPDYPDLAHIKGALLLQLGAFAEAKVALLQALIIGAAPPGYHTEAGFGSFLTYYMLGQLCEEMGDETEAIACYTKTAQLHPEPTPVIARLLRALKCAGRESEIYGWFHAHLPDYTVTKNRILLELLQTEGCNEAAAQLINATEQPISIEVAFNQASEQGRSQIVLADRLLASLSSSATYSPAVKRVRLALPLPKVSE

SEQ ID NO: 1346 - protein, 360 aa, Neobitarella massiliensis
MIVKDEEAVLARCLDSVRALVDEVIIVDTGSTDRTAQIAAAYTDKVYSFDWCDDFAAARNFSFEKASGDYILWLDADDIVLPDDLRQLLRIKKKGIGADVLMVRYNTGFDKLGRPTLSFYRERILRRSMGFHWVGRVHEVIQPRGKVLYTQAAITHHKLHRNDPGRNLRIFETMRREGQPFDPRQQFYYGRELYYAGAYDRAKKELQTFLQRPEGWVENQVEACRTLSQCCRALDDPSGALQALFSSFLYDQPRAEVCCDIGHLFINRRQYRQAAYWYQQAAARPRIEGGGFYSPACYDFIPYLQLCLCCDRLGDYQKAWDYNEKAAALRPDEPAIAHNRQYLGELLGRKQTKKRAKTAR

SEQ ID NO: 1347 - protein, 661 aa, Desulfofundulus thermocisternus
MSTEIILSICMIVKDEEKNLPRCLNSLKPLLESMKAELIVVDTGSIDNTVEIARRYTDRVYLHQWNNSFSDMRNISISYARGKWIFIIDADEELENPAELVSLLKSGRVNKYNTVRFKEKNFLSLDKQRYVVHVTERLFRNDGKFRYFGTIHNQPDYRYPVLNSDIWLVHYGYINDDQELMEKKFKRTSEMLRKELEKDPDHIYYRFQLSRTYSMHKDNDRALEEIRKTYSILKNKFPERIDSCYYVLGEYARISLNAEKYEETLRVCREGIKIRPNYIDLYLYMGYALFALEQKEESMATFQKYFDLYNKYHEGQVNLSEYTAVELYTIDTEVKDLTAHKIAAYLYYIEKYEEALKYLELIKGNKKKIDLLIKIHLKLSNYKILREYYQNLQNKNEKALFIKILEKEKNVLEELSRQKLEKEFAQGDDCYALLNRIRQEEDPVVTIKVFLSRYDLNKLPVFPYSEIVRLMIKNKMNIIPVFTKLENGVIRNLVKDLIDRDGKARDYFYNFLLNEKVGGGDFHSERIYISIASVVLLTDIEEAGKNNDGLNERCVNIFTKYVQHGVSYIKNLYQVERLRLIYKTLDNIEDKFFILMHLARDAADRGVYKSAMRYLKEAVEVYPYMAKLINLHTDKFIASISKGGSLNGSATGARKSKNNKI

SEQ ID NO: 1348 - protein, 357 aa, Clostridium beijerinckii
MITVSLCMIVKNEEDTIGRCLDSIKDVVDEIIIADTGSTDKTKEICSKYTSNVYDFKWIDDFSAARNFSFSKASKDYILWLDADDVLLPEDAEKFKALKETLDTSVDSVTAKYNIGFDEYGNVTMSYRRNRLVKRENNFKWIGFVHEYLQVAGNIINSDIAITHKKLKQTPKRNLDIYKGKLKEGLEFTPRDTLYYANELYDHNMYDEALEYYNKFLDSKQGWFEDNIRVCGKICDYYQSVNKVEDARKYAFKSFEYDTPRAEACCKIGFSFLHERKYKQAAFWYEEATKLEKPKDSWGFFNDACWTWLPHLQLCVCYDKLGDHKLAYEHNEIAGKFRPNDSRILYNKKYFKDIGVS

SEQ ID NO: 1349 - protein, 676 aa, Bacillus methanolicus
MRERQIGIHIIVKDEAEWLPQCLESIQGADEIIVVDTGSTDDSPILAESYGAKVVNMLWQDSFSDPRNEALRHANTEWIFYLDADECLVSGLDAVRDVLQTTNAEAFTVLIDNKLGPHPEDRLKHRALRIFRNGRGYQFRGRIHEDIGQSIVDKCGSSFIKDSTIQIDHYGYLPQILNKKNKVVRNEKLLKKELAEKPNHPFYLYNMGITYCQAGHLEEAKAYMQKALIHTPDVAPFRPTLIRDLSKIMLELQEVQQVETLLRKELLTYPDYSDLSYLLGESLGMQGLLEASLESYHRATEHNNDRYVMEVGINSYHAFNKMAETAVFLGHLEDAARWFHRALQVHNTYVPALQGIAEAFQQLNVSDKEISILFQDIVRPQSSDDYAVLTEALYNVGAFREVVDLIPETQLTDPRLLFRYATALIQNGNYADADQILSRYANISETDDIERLFFLRSICQWQLVGYLNEKFLVEIPDFIRGPLSDLNRSFTNETKSTEEPVKDQRLSEYAQKLIRESVSLQCLDTANRLAVLNPDNLLLYAKELYHLGKTLQSADLLLDILHQNRYDKEAMFMIGELLFDKGHYMQAAEIFETSINNGDENPRTRTGAALCYLHLAAVNLKEAISRESDVQTLSNDLKNIDESIRLLNRTLWHTKWVGYRRRIRDEETSHLLVHDC

SEQ ID NO: 1350 - protein, 257 aa, Rhodanobacter sp.
MGREPLSVVVTCFNSAATLDACLHGVSWAEEIVVLDSGSTDASLAIATHYGANIHSQPFAGYSAQKQAAINLASHRWVLLLDSDESLDEAAATSLQRALLAPACAGYQLWRREWQFWRWQSRRARLNHYVRLFDRQRARMSGHEVHEEVQVDGPIGVLDVVIDHHGEPDISGRVAKADRYSSLQLADLARRRISWLRLRMVGYPTVAFLRYYLLRGHWRSGWAGFIAARIHAFYAFLKYAKLYEQRRSGSAEPRGRH

SEQ ID NO: 1351 - protein, 385 aa, Phormidium ambiguum
MVNESAKFLNKPLISLCMIVKNEAENLPRCLASAKPCVDEMIVVDTGSEDNTIEIAKSYGAKVSHFQWCDDFSAARNYSLSLASGDWILVLDGDEQLIVESDNWRQELTDNSEVNAYGLVRLEANVSHIIGGFHGRIFRNLPDLKYVNRFHEQLQFTDKRNLQFGRLEGVKIIHYGNVESEKVIEKAARRDIPILEQMRSESPLNFWLLDCLARKYTHIGEEEKAAECYAEILDKLTPNLIDGNPPEEFFWIPTLLHFLGVKYFEEEDYETARLLCQRGLEWCPNYPPINNLAGEVVKTLGFPLGAIAYFEKCLQLGQTGNYYVGEPFELSFLTTYPAYNIGCTYWEMDRPQEALTALEMALNFDAEFTPAQDKVTEIKQTLGLQ

SEQ ID NO: 1352 - protein, 3377 aa, Unknown
  Description of Unknown: bacterium sequence
MEHQMKPLAQYQELAVNKFFSLLPSGAQRILEIGSDVEYAVVDNIATRFDGTVTGINPAAGFVKRSPAEGPANVTILGADGCCMPFDDRSFDAILSIATMEHVLDIPKFLEECHRVLKPNGMFYTNFSPIWSSGIGHHVYALAGRKEARFWKPDRNPLPDFSHLLWDEDEMREYLLDSSYDDRLIEPIINWVYHSDNINRCFFEDYKDAFSAARLQVKDFTAGVYKAPSQQLLEELRAKHGQHRDFSHHFIELVMSRPVLASSLPQHPPTPAGVEGAAGAPPTLGDQSETQNVVINFHRGDQSSAESLLNLLMVVDEGIDCTYHLQYGDPPDTLLIKETIERFREKKEVVLHFDLPDITVPMAFVENDPNLAEYPGNQARRTREQKRSILQWNLCVYKFIQLLDSFLMIEPDCVILKHDWLADIYAAYRDVNLPIFGHLKSGIINGTPIPTHWAGCSVYNGRMLRELDLERTFTERYENPWWRFRNLHETSNGNNCFYGPAFSGYDISFDYFLFAHFWRKTTGSSNPFQWPVSEIANRDDLIFCDFRSTLTAAEIFNRYHDRLPVLHGVKSDESRLMMTGYFSSGGTSTMTETRSDQVAADTANHAESPRQLPQRCLSPEELFVMTNRRLGQFRNKHQGQRCVIIGNGPSLNKMDLSFLEDEITFGMNRIFLMFDQWKFRPTYYVSVNPLVIEQSAGDILRIIAPKFLSHKGIPFFDDPGDIHFLQSIPQWFFSKDPRNGICEGWTVTYVAMQLAYFMGFEEVVLIGVDHHFVTKGDPNKEVVSEGDDPNHFHPGYFGKGARWHLPDLERSEGSYRMAKETFESEGRRIIDATVDGKLTIFPKADYRELFQSKRTTGTGRQDTPAQKGAKPLLFSVITPSFNQAQFISQTIQSVQNQDYPHWEHIVMDGKSDDGTVEILKSCQHLKWLSENDRGQSDAINKGFRLATGDIIAWINSDDWYEPGAFKAVADFFTANPGKNIVMGDCNLVDADGVIFDRVINQERGFDELRKYWISRSIPTQPAIFFRRNLLDEFGLLDESLHFAMDYDLWMRFSQKNRLYHIDRTLANYRFHSDAKGGDQDWSKFIPDCRIVYDRYSPPQVSVIIPCYNYGQYLAEAVSSVITQTYQEFEIIIINDGSTDNTAEVAEQIINSNPHIRIRLINQANSGQPAFSRNKGISEAKGKYILPLDADDKISPTMIEKMVRILDDDQAVDIVYCDTIRFGDVDNAYQTEDWSLTRLASDNIINYCALFRRKVWDSVGGYRLDCGYEDWEFWISAAEKGFIGFRIPEYLFYYRIKPTGRLLLDEQNDAKNKAKIVSFHPKLYDDATRMWSQQLLAENADKENKLQVLIVVHNFPPNWYAGVEIYSYQLAISLIRLGVEVSVLYPLHQEKLLRAEIEESSFDGIRIFRLLSDRSLPEHGGLTAQVANQEQELLFAEFLRQRNFSAIHFHHTLGMPFSFIDVARKQGVPVCVTLHDCWYLCLGVHLNDTTTNSLCSGPEFPEHCADCFLAKTAITPSREDRTNLSTWIQFRNSQARDALQNVDCIASPSQYLADLHHKYGISRSIEISPLGMNTVRKSRRTTSSPIAFAFLGNIHELKNTYLLAETFKKVTGKARLIYFGDGEKHFIEKLNTTIAGDGRISYQGAYSPSQLPEILDQVDMVVVPSISENYPLVVREALSAGIPVLASRVGGIPEIITHLHNGILFDPNNQDELQKWLQDIADNPSLLDDLKKHIEPVKTIEQDAGEWITRYTQLSSDHVVNRHLGVLSDAAGKADRAPTDYTAAACTSASNPREYGAREANPCPNPQVNITAREFSQTPHPDTAAMDYGSIRILIDGLETHESIAIIERFLQEQPLHAEAHNDLGVLYYRVSNKLQTLGHYEKAVRFCPLNSNFRKNLASFYFVEMGWTMDAIAIYTDILKTDPSDIEALTSLGIISNSIGRPEEARTFFCRVTDLDPLNDEVRKALVDLDPPSSTRMNNVSAELIDMDKSANVSTEELYRKILKLTDDGFIEQAIGDLHRLLLQDTDNALFHNDLAVLYSRTGDAENALFHQEKAVGKAPLNRNYRMNLAGLYYRSVNRIDDAINLYTELLKEKSDDIDTLGALAIISSENDRPEEARIFLNKIVELEPGNIDAHRLLERLDSINNYDFFFDGRPDDATEPHKIKKEFTDCPTGTVTIIIPVYNRLEFTEKCLETLSRNTTAGSYELILVDNGSTDGTADFLQKQEIISKVISNPVNLGFAKACNQGAEVANGLYLVFLNNDTEPQPGWLDALLKTIQANPEIGAVGSKLLYPDSTIQHAGVVIVDDRNIHDPLLGKHIYCGKPSNLPQANIPFCYQALTAASLMISRSAFIDAKGFDECFWNGYEDVDLCFKLRELGYLIVYTPESVVIHHESKSGPERFAKAGQNIDLLHKKWRGKITPDFIITENETTIDTAKGTIFPYKSPNSPPVSEDKQRFPLVSIVILTFNQLGKTKDCIDSIQKHTPELHEIIFIDNGSTDGTSTWLRELCNNNDNYTLIRNKENRGFAAGCNQGIAAAIGEYVLLLNNDVIVTENWLDGLLECLLLTPDGGITGPMTNNISGIQQVPGVQYESVEEIDAFALMFREKNRHRRIPYRRIVGFCMLFRKNLVDAIGLLDENFGSGNFEDDDFCLRAELEGYRNVIAGDVFIHHVGSATFKGNNIDFTSAMTGNRKVFNDKWSRQVRNENEAIKILTLKTLEKAESLYQRGETDKAIDTLLKEGISNASKEHRFYFALADYFIDQERFNDALDSLKELPDSAEGERKYVLLGRALAGMGNLEEAEKLAQLALQNDPSSAPALALSGRIAYDSGRQQEAISLFEAAIKANPGYGEPYTCLGLIALQEDRLEDAVNLLEKGFLYLPISAEAANHYHSLISASGKFDRAEDLFREMHRFYPQHRTLHFLLIDILIRQEKYQQAIAEIEEACTIFGIEDGMLAAGLDLRQKIGPLSVDPKKKKAGTSVSLCMIVKNEEKNLPRCLLSLKPIVDEIIIVDTGSTDRSRTVAELFGAKMLEQPWTGDFSEARNVSLEQATGNWILVMDADEVLAPQDHEQFRQLIKTSTGKRMAFSITTRNYMTKMNAEHWQANNGHYPDQETGGGWVPSDKVRLFSNLKTIRFVDPIHEMVDQSLTQAGIPISKAQIPVHHYGYLDKERQQEKGEQYYLLGIKKLAETGENDCTALSELAIQAGEIGRYAEAVELWSKVLCLAPDLPLAYFNLGFVYLQMGRFTESRDASAKAMKLKRNYYEAVNNYAMAELCLGNFQEASKVLKKTLTAIPEFPNAMAMLAVTRLYANKKDEGLKLFRKLSDNGVNFVEFIHESVKKLISAQRFNEARTILDTALANGYGNEKMHAINTSLQQGQ

SEQ ID NO: 1353 - protein, 642 aa, Parageobacillus thermoglucosidasius
MKPFLSLCMIVKNEEKVLSRCLDSVYGIVDEIVIVDTGSTDSTEEIALKYVDQIYKFEWTNSFADARNYAQQLANGEWILVLDADEYVDRDNLQEMINVLKQTDEHVDAYDVTIYNFMGVYGERVLQHRSTRLYRNSPNIRYYRAIHEQLRKENGQPLNSMLGILNVYHSGYMHQAVTEKDKHKRNAPLIEKELQNRENVAFDYFNLGNEYLSKGEVEKALESFVKAYKQKNDFRLSWVSFCVVQIVLCLKYLERFEDALNVIADAENIYIATADFKYLKGEIYYLQHRYDDAAEELNDLIQNKDKYTHVIKTFEYLEYDPHILLGHIYKYKGDMQRAVQHYTSALSVNNKSYEALYNLLGLLAKFHSEDEIIQFLEKRNWFVNERDISLLLRIVLSLGLETIAEYYISKLKEETLKKGFQIKLNILKGEYEEAIEQLMSSYLYSLETYIKNGCFDLYDVLIASLGSGKSEVIRLLTNIVSDDKEKEFLLFIINETDHIPEQTFYLQLIERTLQLKKYDLFEQLISLKDKFENKINLYLGHLLHRYEFIEVALDFYQSVEDFNDLDAQGFANIIEGLAIRNQITEAIQYGLLGIHFGHNDFRLYKYVLELMKLNGMSAERNNILKKAKNIYPDSKWLMQQGN

SEQ ID NO: 1354 - protein, 259 aa, Campylobacter lari
MDLKQISVIMIVKNAQKTLKACLESLQEFGEIVLIENDSNDDTLKIAYEFSKSYKNIKIYQHKFIGFGPLKNLAISYASNDWIFNIDADELAKKEFLQELRKIEPNKEDIIALPRENLYNGEWIKACGWWPDHVMRVFNKTHTSFNENLVHESLILHEDSKKIKLQNGLRHFACEQMSEIISKMNLYTSYSAQEKFKYNKKPSATKAILRFIFTFIKDYFFRKGFLYGYKGFVIAILNANGAFFRYMKLYDQVCKNEKD

SEQ ID NO: 1355 - protein, 1656 aa, Syntrophorhabdus sp.
MKILYCFPEADNPNHYGYNNIRSSLIELGHSIVDFDFLGMKDRFGKEGMVSELNSLMDREKPDIFLHGIVTDELPVSFLDEVRDREDIRSVVFFSDDDWRIYNHSLSWVGHYNYATTNDINALAVYRQFGYRHVFPMQYAANPRIYYPRETAKRYDVTFVGQAYLGRPQVVEELLARGIDVRVWGSGWDRVPALASVAGPPLPTEEMIETFRASRIVLGMAWCSVTTDAGTIIPQIKGRTFEYPACGAFQITFEDRRLQHYFDMEKEIATFRDGKDLAEKIGYYLDHEREREEIARASHERVLREHTWKHRWDGFFPFMTEENMNIRRRRAWGTWGAPEAGKGAEKRGAGPLVSVVCFVYNRERYMAATIESVLGQTYSNIEFVILNDGSTDGTEAVIKRYLHDPRLKYHYQENIGQTMDRFDELNNRVVALSSGEYICAIGADDVYLPGRVERQLGEFLKNPGLDVSFCNAQIFNDAGQLLPTQFRHERALTFNRFNLLRWLFTVNFIAHPSVMIRRSSLIEQGGYETGFATDYQLWLKTARNLNFKHLDESLWLYRVHDDSSTSEKNADRCAAATIDVLESVYRSNSIDDFYPEIALCSDRQKALYSAHLDFGNDMMRNSFFYLPAFAVREYEAALAVNPGGMEARNNLAVACAIAGDREKARSIFGSLSASEPHNETIDHNISTFLASDPQGNHRPDYRLLAESIGASELKTNVALVEKGAATAPGSTLPAGTSSAALGREQESTSVCKTRKGHTTILIPSVDPGNDLKACLEAIDIHMDEPHDIIVIKNAGAVPKWLKQHVRSGNTIFIDVPASSGYAARCNRGMEKATGEYVLIIGEDTLLLKDSFSRMLHHLGGASNRGMVVPLANHALGTQKIPGAEDLSVDEFSEYAADLGKRSLFRRAETFETGSFCTLFRSETMEVVGPFNEDIASPFFVINDYRLRLLLKGHTAAVAADAAVFRRHPETRGKGRDRVFHETWDTISPGTEKGKRLWHFVATKNARDHYRKGSLERAMNALSEGMRISPDEPRIYYCAADILMEEKHYRQIVDMTEFWPAAEKLKPPYYELLGYCAYYLERSDEARNLAEGALGLSPDTPGALNLLGLLALRAGDSRGAEGLFRRAIAADPSFGDPHVHLGVMAWQGNDTATGLTLIEKGFILSPEKNDFLATYQSAIESTGNFARAETVIREALGLFPKNRNLAYALIGTLIRQEKYLAALTNIQDAIVEFGIDDEMLGAAIAVRDSLGEDILARHGEDRGTLSVCMIVKNEEKHIARCLKSLVPVADEIVVVDTGSEDRTPRIARVFGAKILQFPWTNDFSEARNYSLDQARGDWILVHDADEVISPRDHDRLRKIVHGKPVRAVAYDIVTRNYVVEPATEGWTANAGEYAEEEAGSGWFPSNKVRLIVNDRRLRFRNPVHELLEPSVAEAGAERLACDIPVHHYGKMPSDTPSVKSDLYYELGKRKLSSSQGNPAAFRELAIQAAELEKFEESIEHWKGFLRLVPDDSIAYFNIASMCMEVGRFEEALQCARRSVELNPNSVTAVQTLIVALIYSGKTKEAVERLGSLLEKSPDYPPAFVALAVAHFIEGSEEKGLGYLERLEGMGYRCGPALHSSLKKIIASGNRAAARQVYGYISKSRHSLPEMERLFDQE

SEQ ID NO: 1356 - protein, 646 aa, Paenibacillus baekrokdamisoli
MQPLISLCMIVKNEEKVLEQCLSSVQELADEIIIIDTGSTDGTKEIALKYTEQVFDFQWINDFSAARNEGINKATGKWILILDADEYVKQDEVDSLRNMLNLTETDKPVGIVVDVMNLTGNSLTSTTGFYQSSGTRIFTNGHGIHYENKIHEQVICQDIMAQFKVSFTVFHSGYVTQIAEEKKKSDRNMEIFNELKKTGKKSGPYEDFTIANELAAARKLKESVYYYSKCIKRSKITDPWYSHCCYRLIIIFKILKRYNEAYAYIEKGLQLWGQYTDFHYLKGAVLNEFGMYEQAVKAFETCLAIAEENGKQNKQFWLIDTDTCRLFPFISLAEIAYMRKDIGKTVFFLTKVLQENSKSFIHLYRLTRLLLQSEPPDEISRLLEQIYPQNQPFNCYIVFKVFLELGHELLASKYLDNCKALNLSMEANDMVRYALLTRNEKIASEWLEKLPSNSDSMYSNALIAALASKNPSWIYQYVKDSSQPYYDIGQYVICILEQNQVEQYAGNHQDQLYALIVDLFKLGYFEEFDQLMNLVENEALLNKVADFFYEENLLEIAIQYYSALINQEALSAAGYMNVANLYLSQNEEEEGLMFMQKSIDMDPAIDRIPYLISLLSDTELISAYQDKFADLHAGYNQLPFIKNLNA

SEQ ID NO: 1357 - protein, 348 aa, Roseburia faecis
MITISLCMIVKNEEPVLARCLDSVASMMDEIIIVDTGSTDRTKEIAAQYTSRIYDFTWCDDFSAARNYAFSLATMDYIYCPDADEYLDLENQRRFLRLKGALLPEIEIVQMNYITPPDFNTVQNCKKEPRPKLFKRLRTFSWVDPVHETIRTDPVIYDSDIDILHRPHVMHAKRDFAMFEKAFRENRVLSEKITRMYARELYKCGDEEDFLRATDYFSLHYEAHADAESACILAHAARIQNSVDDFFSICLKDMCSSSCSEICYELGQYYRERQNPQEASLWFYNAAFETQPVLDIEISGKKALLQLAECYRTLAENELCDPCSAGDLLSRASEYEQQAQAWELPEEL

SEQ ID NO: 1358 - protein, 688 aa, Carboxydothermus islandicus
MGKKLAQTTETREKLISACLIVKNEEDVLERCLKSLRNFVDEIVIVDTGSEDNTVEIAKKYADIIDYFPWNGDFAAARNASIDKASGEWIFIVDADEELILDNYNELQNLKQFLKTASIDVGGIGIGILNISNITFLDVNSIYVNQIRIFRNKPEYRYRGAIHEQIVGKILENGNKIHIYGGKILRHYGYISEIVQKKDKINRNMVILERELKKDPKNSFNRYNLGLEYDRIGKFDKAIEEYKLAVKYLPNYNVGYANNLFKRLVRDLIELKRNKDALKILLDVVKIYPEDSEFYYYYAGTLVNLKKYENALKIIDKAIAMGEPPPYIMHLRGVGSFRAWHLKGRIKEALGDYKDALTCYEEALKIEPFFLEAVDSLIFFLYNQLPREKAREEVKKRFSNVDHEVVIGNIAAFLGALKEYDLALEFTEKIPDSLELKLKKAEIFFWQKKFNKSSELLREIIVEELKKKNPFLYSTGLYLAVLVEVCLNDIDNAKNYYKLLAKEELLSFNEKNYILGCFLESLSSGKLKQVEYKDEFDREKLEKELWQLAATFLSLDKFDEFEIVYNLIESNHFINNKKDKFGKLFYRQEFYDLAAEALLEAVKKHEADDETYYILGKICEMKNLKEEAISFYQKALSEKREFKYYLALITLYNSLQRYEELKEILSEAIRKYPEAEILKALNAVVKKL

SEQ ID NO: 1359 - protein, 323 aa, Unknown
  Description of Unknown: Firmicutes bacterium CAG:194 sequence
MPMITISLCMIVKNEEEVLDRCLSSIADLMDEIIIVDTGSTDRTKEIARRYTSKIYDFTWTGNFADARNYSFSKASAQYIYCADADEVLDAENHAKFRLLKKGLLPEIDIVQMYYCNQLSYNTIYNYDKEYRPKLYKRLHTFTWVNPIHETVQIQPVIYDSDIEIGHFPTSSHASRDIQAFEKMYTDGLRIPASLHTLYARELLIAGQYSELMHAIPVFTDTLQDNTRSLDEWMEACCVLTRAYREKNDIPSFFKYAMKAVTFEGDGCAEVCYEIGCYYLSVSDPQEASIWLSAALSAPCILQLEVHKRAESALQKCQGKLSE

SEQ ID NO: 1360 - protein, 636 aa, Listeria grayi
MRPLISICMIVKNEEAVLRQSLASFHEFVSEIVIVDTGSTDDTKKIASEFTDKVYDFEWVGNFSEARNFAAKYATGKWIVVVDADECLEKENYLAVESFLKRLTQKEEIFTGEIISFTGEKGSVTVTNKMPRIYRNNGDIAYRGAIHEQLFNRRTGNTAISDSPLKIYHYGYMSEVVDRQDKVARNLEILKKEMKEEESSGFAEFNLGQELYREHKFEEALQAFSRAFQKRTSNRLVWAKISALNIAKILEAKKEYADALAILEEARIIWPDTPEFFLKKADIKRALHQLPDAKKIYHYLIEQTAVIFQPIAYYEATSFLPYKALGDIYQVEKDYVKAIKHYSLAYQQNSSDYEVKYQMIQLLSKFHSPSEVYDFISRHGFIENEEDGTKILSFTTQLGLGNLSAIILNSMPDLNIVLQEIMQVKIQTIQNIFPVISKQAILAGIRTNLIDVADLCIWHFENGTLPIEQIMKNSNAGELYQFLYENGPAVEEEIYLFVMERGIALGKGEFIDQLLVLRSHYEDSINSRIADLFFQYDYKDIALDLYNTVDASAVTKEGHLNLIQYLVEENITEEALSIVERGLDNFAADFRFHEWAILLDETNREMRISEAIDEFPDSTYLAELQGNLIDLESVNK

SEQ ID NO: 1361 - protein, 616 aa, Tumebacillus flagellatus
MIVKNEEKVLPRCLESVKGLVEEIIIVDTGSTDRTVEIAKQFGAKVYHFEWIHDFSAARNFSLQQATGDYILVLDADEYLEKNATLPEDLKLSADYYSVPIKNLMTDSVVVHMAVRLFKRSAGLTYRNKLHENLYVLEHEDLTNADATFTILHTGYLPDVVKSKNKKIRNLELVEQEVSENPSGYNLFNYGVSLMNTGQYEKALASFKKAYPLSVKYTFVRFLLLNMAQCLHYMKRYEESISIMQDAIAVHPGFTDYYYAMGIAYEELGYWKDAEEIYQTCLQLGDTRDDVSFEGAGSYQSVYRLAVLHKKQGRLEEAFDMAFQALQQKPDYRPALKFYLKTMFESGVSAEDMYQQLNLVVPLSDLSVLKTIIAVCYEIRHPLLDRYLQLFPDEVFSPEIRGVSRLYAQRYEDARDEWSKQETFSPDVLKDLMLTAFLLQDLSLFKRAEAFLNLRTKDKKFIGDLMKRQTPKQEPLTEDAADLLLHLAVQLLVLKEYDLFEWLSPYLTQMPVAFQCSMAKALDDAGHTQTALDLLLPLYGGTQPSVEVLLTLGDLCFRRHFSEDAEVLYQKAFQREATYANHERLARLYEQLGKTERLQEIKSAIARTFPLCKWVR

SEQ ID NO: 1362 - protein, 261 aa, Unknown
  Description of Unknown: Candidatus Peregrinibacteria bacterium GW2011_GWC2_33_13 sequence
MTISVVINTLNAEKYLEGCLESVKNFDEIIICDMYSTDKTTEIAQKFDCKIVYHEKIGYVEPARNFAISQAARDWIFVVDADEIIPEKLVEFLKNFAQEQEKNNFQYTTVAIPRKNWFFGKFVNGDWAIDRPIRFFKKGSVNWKDEIHLFPKVDGQIFEIPMENEELTMIHYQCASISDLVNKANIYTNFEVKKWIDSYYNFSILSLIFEPFGVFLRMYFRQGGYKDGIHGFILALIRGYLYRFLIIVKIWEYNSRNNAGK

SEQ ID NO: 1363 - protein, 661 aa, Ruminococcus sp.
MKVRTTEKKEILLSIGMIVKNEEKVLERCLKSLQPLMNAIPSELIIADTGSTDSTVEIAKKYTDNVFYFEWINDFAAARNSTLKKAKGKWYFFLDADEYLDEDVSEIINFFSIPELYLKYKTLEIMIRNYMDVNKTNYRDACLARFQRINDPKDPVEFIGKIHESIWIRQPLGYFSTILHHTGYCYSSAQQSMNKKNRNMQLMREEYEKNPNDLRLLSHLIDGAGNDNNEKEKYISEALVIAKAERRHLYSNVVYMQAVQNLQNSRPEYCLELCREYYDTLDGVENCVATVAVAMTEAKILSALARYNESYLAFCRYFDLYERYKKDELILTDSSAHPVDGVTESEYIRCICMAALDLKKSKRYDEAFQLLSKFDIVSLDGEDFKNVLGSIREICQDKKQYSTLAEYYGKIINCDDDNKCELSLYMMESTYYSIVGEDNRMAFAKDVVNTGVKGKYSDLMKLVLTQNEKSFADDLLTFIKNVDDWKEGYSEAIYLAVKHGIDISGVVDNMIASEFRSKLEMIAVNHDDFAGYVLCYGVPESFTSNIKRFLWITSMYEKAAYRSFMLDDNRKHEMYLMFTNLLGEYVSNIYNPELLQDEADIQVLPSLHKFGYYMLQANSALLNGDSVGYVRGMKKALQNCESMKEIVEFMLERFKQKMGIK

SEQ ID NO: 1364 - protein, 254 aa, Winogradskyella sp.
MIKLSGVIITYNEERNIKNCLQSLINVVDEIIVVDSYSTDRTKAICESFNVTFIEQEFLGYVEQKNFALNKASNDYIVSLDGDESLSKELQNSIKALKANWVYDGYYCNRFNNFCGQWIKHSDWYPNRKLRVFDRRKATWKGINPHDNVILNDNSSSKTQLKGDILHITYQSYSEFNKKTEYFSTIASKAYFEEGKTSTIWKIFFNPAWAFFKAYFLRLGFLDGLNGFVICYQTANITFLKYLKLLELQKSKEE

SEQ ID NO: 1365 - protein, 442 aa, Carboxydocella thermautotrophica
MLLSLCMIVKNEENCLARCLTSIQELVDEIIIVDTGSTDRTLEIAASFSARLFSCPWTHDFSQARNFALEQARGDWILVLDADEVLIHQGREQLQRFLTAPGSLYEGFYLPVINLHEPDNWLYRSQDLVVRLFRNRPHYRFSGVIHEQVLPSIAAHAGKEAIGQAPLTIYHYGYLPAVIQQKQKCQRNQQVIQLALTQNKQDPFLLYSLGCEYLTAANPRTALHYFEQALAVIPTGAGYLPDLALRAGYCHFLLGNWADAEKYAPLAPQLYLLLALQELEQNNYAAAETLLTLAARGCPEARAQIQQARGDMALARQQPAMAARYYLAALQSQPTYLYPLTRLLELAQTHPRLWQDEWFCLYTPDSCLRLLQFLNWQHDTRLVLYYIMSLAYQKAFLPLKQLEQQALPCYQAVIYLALGAVFSPDPCWSLLSDLFWKEEGWL

SEQ ID NO: 1366 - protein, 357 aa, Bacillus indicus
MVTISLCMIVKNEEEVLARCLDCVKDIVDEINIVDTGSTDKTIEIAKQYTDRIFNHEWTGFAPARNESFRHATKEYIFYLDADDILSEEDQEKLKKLKETLDPAVDSVSMFYNAGTDEFGNVTLRYRRNRLVKTSKNYRWEGDVHNYLNVTGNIINSDIAITHKKTGHAVGRNLNIYKMKIERGDVFGARDYFYYGNELRENGHYQEAIEAYTKNIDLKEGWVEDKVYACINRADCYRFLGDLDQELKSLFASFAFSKTPRSETCSRIGYNFQRKKDYKSAIYWYERAVEEVPDENRWSFSYPAYSTWYPHLQMCVCYDRLGEAEKAYQHNEEARKYRPEDKSVLSNKAYFEKKLGK

SEQ ID NO: 1367 - protein, 275 aa, Unknown
  Description of Unknown: Archaeoglobales archaeon sequence
MPRLDNVGSTDVTQRILQAQQRSSPLSEKPITKPFTLSVVMIVKDEEQYLARCLDSLQPLKYDELILIDTGSTDRTVEIAQEYPNVKVFYFEWIHDFAAARNFSISKATQEWCMWIDADMYFLEEDAEKLHAILHNRLYQHENNAFALMLLNVDTDDAWNLARIWKRSDNLEFDSPVHEVLGPPERMQLRALDITLQHDRDGQVGGLEYHDLLLKWLERDPEDQRALFYMAKHCHLMATQAKTPKEVEDLYDEALKYYEQAAQKGRDSGVYLNAG

SEQ ID NO: 1368 - protein, 653 aa, Paenibacillus ferrarius
MDQLLSLCMIVRDEEKVLRRCLDSVKDYVDEIIIVDTGSIDSTKQIALEYTDQVFDFEWINDFSAAKNAAIQRATSKWILVLDADEYVDSTQMSHLLAMLEQANHDAPMGYILTIYNYTGPIRKGKMVESTALRLFSNHPDIYFERPIHEQVVYRHGHFEQIYYRLSIFHTGYTLEVRQEKNKSTRNLAIFERLKETKQFEEYDYFTLGNEYFAVGDLKKALYYYKRATTKKMENQAFMLHCLNQTVITLIELDRLKEALEVVENGLRRFPAYADYYCFKGLILEKVGLAPLAIEWFETSLKISNSPPNKDGRYWLVSPNYGSIIPLVHLVNLYLKDSDVPKAVSALTKLINLSPGDQKVLYQLFILLSQSEPTSSIIDFFEKIFVNPSQADILQLFQVSLLLGNQELTAHYQHQCEQHKISLSSHYKLLSALIRNSQDEFERIMQLMLPQEQSEHNNKLYILASLVWNRAAYSDQFCETIDGSTLQKEQLYQIVQVAFQLTTEGTCPTLDSEQLNYAVTLLIDLFKYGYFDAYDRFIEKLQPYYFIVANLIGDHFYSQSQIQLALDYYSMLIQHEQLAAVGYENVGKLYMNQGDVEEGLAFVRKSIELNPYRPYLYVFYLAQCSDADLSKDVLDRYKEQYPHYYGLMMNAMR

SEQ ID NO: 1369 - protein, 207 aa, Paenibacillus pinihumi
MSDNIQVSLCMIVKNEEAVIGRTLKQAEKHVDEIIIVDTGSTDRTKEICLEHGARIYEFGWTNNFADARNYGLDKAQGTWIVWLDADEELEVEDAGLWRSSLNRASRCCGRSRLSTISAALLPIPTAPIWLHSTGSFAMEQDYGLRVPFMNSFRSDICRMMLWSCGSFRHVFIIMVIWMPSPYRRISISAMYLCWSGRRSVRITIRG

SEQ ID NO: 1370 - protein, 358 aa, Oscillibacter sp.
MVSVSLCMIVKNEEDVLERCLESAAGLADEIIIVDTGSTDRTREIAARFTDQIFDFPWADDFAAARNESFSHASMDYCLWLDADDILLEADRSAFLALKETLDPAVSVVMAPYHTGFDEGGRVTFSYYRERLIKNRAGMRWEGAVHEAVAPAGQILYGDFAVTHRKTRPGDPDRNLRIYEAQLAAGKTLDPRQQLYYGRELYYHQRYEDALAVLESFLAEGRGWLENNIDACCLCSYCQEALGRDEAALASLFRAFVYDRPRAEVCCEAGRWFFVRERHGQAAYWYALALTCPRDDRRGGFVSPDCYGYLPCIQLCVCYSRLGDQERAESFNELAASYKPDSPAVLHNREWFRSLASA

SEQ ID NO: 1371 - protein, 366 aa, Desulfosporosinus sp.
MMSDPITISLCMIVRNEENTIARCLDSVRGIPDEIVLVDTGSIDSTKVIAKQYTDRVMDFTWIDDFAAARNYSFSLATMEYIFWLDADDVLAETDREQLLKLKNYLDPLMDAVNMPYLLSFDQFGTVTFSLRRNRLVKKSRNYQWIGAVHEYLEVYGHVLNSNICITHKGTGSNHSDRNLKIFEKLKERGDPFSPRDLYYYANELFDRKLNNRAVDAYQEFLKTGQGWVEDILSACGKVADCYQNLGEKGRELEYILKSFEYATPRAEFCCRLGHYFLRAEQYDQGAFWYKLATQLEKPLDSWGPIIEACWTWLPHLQLCVCYDRLGKRELAYEHNEIARKYRLEDPQILHNKKYLEGVLGLSSKE

SEQ ID NO: 1372 - protein, 653 aa, Unknown
  Description of Unknown: uncultured bacterium sequence
MSLKNHLSTELELSDKDTQKKARDAYDKGDYVGAYNLYLSIYQKENNPRGLQLSIALCLLRMNKRRQARLFAFKELLDYPDNDTASRLITEQSSKVVGKTVFRRFDNTVRPEKFPDISLVLIVKNEEKDLPRCLDSFKDIVKEIVIVDTGSTDRTVEIAKSYGARVEFFEWTNDFAEARNVSLSFASCEWILRTDADEYIEEPEKAKLLHCINSGVADIYLCPTVSKLKNGVQTVENVRLIKNNLGIIYHYPIHETVALSAAKLGLVQCLTNVEFLHSGYEFVEEGSSERKTERNISVCSQYLEKHPEDFYVRLVRGLLLLNTPRKTDAISDLERGVKDIPDDASPVKYMGLAYIALCQQYVFQKRDIDLINILLDAQVDFNVYSCMMQFIGQIYLFNRGDWKRANKIFDWTLKRYTTKLTFSDVLFPDKYNQVECLQLMAETCVLLKENDKARKYYLQAKKLKKSISEQSDNQNSEKHYEDVDSFSAEQLRILAKTPKENLKYIETYSNILRAASKSELTAQDYLDLANCQIQLNNLNFAQILIEESRLINSELPFASNLESLMALKEKDNEKALIKAVEAFIKDPGNSSYQNNVEQISKLMLLTPVQGIKKVGLNWLESGKIKDGLFALMLYLKFEPDDTEIGALIAKYLN

SEQ ID NO: 1373 - protein, 359 aa, Clostridium scatologenes
MISISLCMIVKNESDVLQNCLESIKDIADEIVIVDTGSTDNTVEIAKKYTDNVFFFEWIDDFSAARNYSFSKATKDYILWLDADDVMLSEDQKKLIQLKNSLNSSIDSVTMIYNYAFDEFGNVTLSLRRNRLVKRKLMFKWYGPVHEYLAVNGNIFNADIAVSHKRIHSKSGRNLAIFEKRLKKGDEFSPRDRYYYANELLDNGFYEKAAENYSIFLNLKEGWIEDRISSCYKISDIYSHLGNPEKELEYVWKSFELTTPRAEFCCKLGYYFLSKNDIENALFWYKLASELKKPEGNWGFFLDSCWTWLPHIQLCVCYYRLGDYKKSYEHNEIARSFRPADKMILNNKSLLEGILKNGK

SEQ ID NO: 1374 - protein, 629 aa, Bacillus sp.
MGDKMQTISLCIIVKDEERFLDRCLNSAAKHVNEVVLVDTGSSDRTLEIAEHYDANIFHYNWTNDFAAARNISIKHATSDYILVLDADEYLDEDADIQRVLITEKDHYTVRIKNHLSSGGAIYHPAVRLFKNNRGLKYQGRIHEHLNVEDKSLGLSHEFGDVLIHHDGYKDEVVKEKEKHNRNIAILLDEVAKNPSGYNLYNLGTQYRANHQDEEAVNYYKRAFELSKDRLYIQSLLYNMIDSISRLGRHEEALNVVNAAIESFPNHTDFYFLKGRIFEELAFKNDAIRAYENCIRLGEVDLFQTLEGVGSFLAYVRKGAIAVEKGQYVLAFDMALKALEVNKYHMPALRLYLEMMTKTHIPLKAMQEHLSNIFSVEDVKDLKHLIVVLTVIKSPLLQQYIDLYKLQLDPTVSMIAKLYSRHYSEALEIARKLGDINESESNDLFLLAYISNSEQLAVAAKKHLNISNREWKQLKRFFQSKPEELGNVSERVANIIVFIAEQLLILQEEDLFNRCITTIQNGPAMLKMKLCHMLIENRYSHIAMDLLVAEYEQNKQNPQWLELLGDVCVQENQDKDALSVYNRALELRPEYRIYEKVYEIYNKLNDQEAALSIKREIADAFPIVEWAKA

SEQ ID NO: 1375 - protein, 325 aa, Unknown
  Description of Unknown: unclassified Bacteria (miscellaneous) sequence
MISISLCMIVKNEEGVLARCLDSLAPAVDEIIIVDTGSSDSTKEIAQRYTKRVYDFVWTGSFADARNFASAKATKEYIYTADADEYLDRENQEKLLQLKSILLPEVEIVQMLYCTTGEFNTVYNFEKEYRPKLYRRLRPFTWIDPIHETLRTDPIVYDSQIEVIHCPESSHAGRDLQALLQAGMREERFSKKLHHMYAMELYRSGGDRDFINAVPVFEKTLSEDGRSMDEVKEAMCVLAKAYRIAGDLPKFFGFALKDAVTTSCAEICCELGTFYEENNDLEEAAIWYQNAATETESILDIRTSQNIPQEGLRRCSGEAGCKERE

SEQ ID NO: 1376 - protein, 812 aa, Anaerovibrio sp.
MGIKISACTITKNEEKNMPRWLECMQAIADEIIVVDTGSTDNTVAIAQSAGVNVYHFKWINDFAAAKNYALEQATGDWILFLDADESFTPEAQKLMREELERFHRDKTVGCLLCRMLDVDADNDYRVFNTALLPRIFRCSPYIRYKGAIHEQVENRQGNKKMVFAEKLEFIHTGYSSSIVKLKTERNLPILLSELDKATTEKERRRLYPYLMDAYNTLGDHDKVLLYAKKCISTGYRMIGAEGHFYEVMTMSMYNAKKPLSEVFSALDEAEAAFPEEPFFHFVRAMALEEQEDYLGAEKATLKGLKLREAVEEKLRCGIGVSDTSRGFLPYAYERLGKIYAMKGDKQQAADNYILALKNHKYQTDALKGLCLLLLGSDDIELIQLLNSFFDREKDGNFLVRTLKGCVSTGVMAYYGKSVKDYNEGFVYMAGGRFDSGAVKLGQRYKELSQLGVLSAYNMDEFPVDGYIDTLIGNQYREKLLDKSADEGTVLKRLKEYRIRIELDDISFPEDSMPLVSIMIPTYNRPELFERTLMSAINQSYPNVEILVNDNSTNDDTEVLMDKYSGVVNVHFFRNKEAKTKAENFMTFEHLATGKYLQWCMDDDLLAENKLSKMVPVLRDNPNITVVSSVRGIIDANDELIDSSTAIKLPIPANDEYGYFYGEDMARQMLLNCKNLLGEPSAVLFRRNDLTHHYWQAEAKGYKTISDVAMWCELLEKGHAVVFKKPLSYYRRHDNQEGQQEEVILLSRLEWMKLITNYYEQGVFIKNHADYKKALMALYNEYVNKFSNNEYLRQAANFVTYKEAMELIVGLV

SEQ ID NO: 1377 - protein, 214 aa, Bacillus sp.
MITISLCMIVKNEEHHLPRCLESIKGIADEIIMIDTGSTDNTKQVAREYTSHIQDFQWRADFSAARNFSFEQATQEYILWLDADDILLPKDRDALLKLKQTLSSDIDSVYMPYHTAFDANGNVMTSTKRMRLVKRSKPFKWEGIVHETLACKEKYKYLNSDICVTHMKNMEDMSNRNLAIYIKALEQGHHFVTHDLFHYALELMLQKSYNEAIP

SEQ ID NO: 1378 - protein, 773 aa, Paenibacillus sp.
MDFMYFFVLEVFALKNRLLGIHMIVQNEEHHLPRCLDSLKHISTECFITDTGSSDRTPEIARTYGATVLHACWQDDFAHARNISLPLASTEWVLCLDADEYVTQGLEELLNFLPKVHKSISRLRITIENRYGEEVEENVISQPVRLFRAHQGYRYKGRIHEQLVRSGPSELVQEEAGDMDKSETFTGEEHMLIETEPLAPLCLVHDGYLASTISKEHKPRRNLKLIERELADEPAQPFHLYNLGVTYCQLGQIEQAIEVFRESLHLTELLAPYRPTLVRDYAKTLVGSEHYDEAHAILALERQRYPSYADLHLLYGETLEQQGLEERAYQSYARATDCWERTNRVGQSDGGSMLDASYVTEAGSNSYRAYTAMARLAQKRGFLNESAHLYGLALNSMFTYAPAWAGLADVLQQSGETDENIAETLLSRSSGIGELDQGDLIRGKMPHSYAMTNEDHLLQVIYVLTGCGAYEQALKMLDTDARTARIHVVDRIHWMLCANRVSEALQLAEEHWSVGCVNEVNLLAEHRMDWALACWTNGLPLSEAFLATTLPQEKNVWKVMDRLLNQLTKEPRSMKLASHEQKLMQWGPHSEMVAEKVVRQAIKTGQLTLAEQLHELRAMMMCDHWGTAITLRREFASLLYRQGYTMVAANILIQCMTESELDAEGLFWLGETLYAKGHNDQALSLFEQALEREPDMWQARAGVAVCYMQLAMEAIQQELVRSPSSGVLAAQYTALEQRLQTTGGIPWRTLFHAKERRNQLASGTNFPMHDREG

SEQ ID NO: 1379 - protein, 339 aa, Paenibacillus sp.
MMKASLSLCMIVKNEAASLKRCLESAAPYVDEMIIVDTGSTDGTLDVARMFTTSVISCPWNGSFSEARNQGVALATGDWILWLDADEVLECDQDPRLLKELTGGHELLLSVRTIHYTGKEANPAEAYQLAQTRLFRNHSGFKFIYSIHEMLNAEEIMERSGRLILPPIVPVSIHHYGYMDNARKNKAGRNLRMLEQAYASEEKHPWLEYHLANEYYYNGEYDQAVKQVNQSIVRFLLRGQIPPSMLYQLKYASVLALGNEQEFRASIDKAILLYPDYVDLHFYKGVILYRNGDFEEALATFKHCLTLGDDNLNHLTEYGLGSVQAMQYIRLCKEKLNEL

SEQ ID NO: 1380 - protein, 620 aa, Paenibacillus ferrarius
MDKLLSLCMIVKNEEKVLRRCLTSIRDCVDEIIIIDTGSTDGTREIAREYTEQLYEYKWEQDFSAAKNEALRKSRSKWILILDADEYVQTEELAQMRSFLLSLDSTKPISFLLPIYNFTESVQSGKFVESTAIRIFLNHPDIYFVRPIHEQLIYQNGELQTTFYPSLHIFHTGYTEETLREKDKSNRNLAIFEKLKETKEFEEYDYYTLGNEYFAIRDFPKALENYKKAMTNRSKNQVYMLHCFNRTVSVLMTLELFDDAMSLVEEGIQRWPDQVDYFCFKAAIYKDVGLYEKAAEFFELCIQIAENPKDSSGRYWVVSPNYGSFIPYSNLASIYHSLLDIPKTVYALTKLINLDSSNQAVLFQLLKILLPNEPISSIITLLDKIYLEMSRTQVLQLFEIALLLSHKELAEHFYHLCLRENIPLSSLSQMRYALISDDLQTFDTCLSDIHLDNSSDQQGQINKLMTIAEVIWNKPYHSEDHIDIELSVSILIDLFNMGHYSAYDSLIQNASQQDKYVIANRLGDHFIGNGQYQLAIDYYSHLLLDDKLESSGYENLARLYLMQDEIKESLQFLRKAIELETNSLGAYTLLLRYCDEEEKKEVLRVFKERFPECYSVVKNY

SEQ ID NO: 1381 - protein, 381 aa, Bacillus cohnii
MQTQTISLCLMVKNEETFLRKCIESVQATVNEIIILDTGSTDKTIEIATEYTDQVKYKVFNGDFSAMRNEVLKYVQTDWVLFLDADEFFDETEIPKIKEAINKVSSDVGGIRFYRYNFFASGGWYSNKVLKLFRNNLEYKYAKKVNESIDTSIIQSGYLIEDSDIVLNHIGHTRSREDRDAKSKKYIQLMKEQLEETPNDPVLHGYIGLISRTLGDFDYAINKTTHALNINPNSSTLHMFHGHVLRSVNKNLEALDTYKKALELRPNDAGVLNMIGVMYMTLGNLAEAEEYFGKAFESNPALIHSLLNKGIVRFYQKDYLSAYEYFSKVIERNKSFLYKDIFGILECDPYKSFYYETYMEYSGLESYIAICESKMKEVLNY

SEQ ID NO: 1382 - protein, 340 aa, Unknown
  Description of Unknown: Firmicutes bacterium AM59-13 sequence
MQMITISLCMIVKNEERILARCLDSVKDLVDEIIIVDTGSADATRRIAQTYTDRVYDFTWIDDFSAARNFAFSKATCEYIYSADADEVLSEENRVRFQALKETLLPEIEIVQMKYGNQLHNGTVYNFDEEYRPKLFKRLRNFIWEEPIHEMVRLEPVVYDSDIVITHMPEQNHAGRDIANFRKQIAAGRQLSRRLYGMYARELFLGGADRDFLEAENYFQMQVASPDRSGDEITEGCCVAAKAARLRGDAVSFFKYTSKVIAVDGCSEICCELGHFYETSGDLEEAVIWYYNAVYETQPVLALRTSGAEPLEGLVRCYDRLGLSEQAASYREELNSRSEE

SEQ ID NO: 1383 - protein, 662 aa, Desulfosporosinus sp.
MAEKISLCMIVKNEGQDLRRCLNSVQNIVHEIIVVDTGSTDSTSDIARQYGAILHHFLWNDNFSDARNASLELAQGDWILFLDADEELSPDSREILIRLIENETIEGYFVKIMNHLGKEGWIETVPDLVFRLFRNKKEYRFRGAIHEQIADVILEKNSEARFQVAEDLMIIHHGYLDNVIKEKDKKHRNLSLIEKELELKPNNRLLQFHYGVELFRAERYTEAAAVLIQSATDIDPNTIYLPKLLRYIVIAQQSSGQLNEALNSAALGLRLFPDYADLYYYTGLILLDLKHYSQARNAFLQALSMPEQPPQYASFGGVRGFRAYYYLAQIAESFLDEEEALKYYLYSLRDNARFTHALERLVGILKPTKEPDYTKECLEKVCDFCTPEANRLMGDIYYQHGAYGLALYYFDQAEDESPVLPDIKLKKAICLIQELRFFEALRLLTDFTQESPNYPLATLNRLFCFWIQNNPQKVRTLWKELHALGLAQDTDNVISLFLAYDAKHAPSPQMVLGSEGIFLLLDIIQRLVALQEIERAMYFLHALQPKCLIKYNLKIAQIFVNYSEENRAIPFLQTVIENDPLAEAHFQLAEIHSHLGRFSEAEQHYKHALHLDPDTPRSYVRLINLYTAWRQSILKEALAKYPENDVFKKLAEEGASNHERTD

SEQ ID NO: 1384 - protein, 642 aa, Acetoanaerobium sticklandii
MKYKLSICMMVKNEELHLKRCLDSIKEVVKRDDVELIIVDTGSIDDTRAIAEQYTNKVYFKEWFHDFSGMRNVTLSYATGEWIFIIDADETVENIEVFNDFLDNKINESIKTYFVREKNYVNIKNLDAYSMIITPRFFYNDGSFKYEGTVHNQPIYKQPVAYLDIILGHYGYIVLDKKIMDEKFNRTTQLLIKELKKKPDDMYYLFQLATSYNMHGDTEDSYEISKKAYELIMKCTKKQQIEGFAIFSVHLSNCLVLKKYNEVLDVSEKSIKLREDYIDGYFYLLFSYEKLGNLDIAKKYAEIFIDLVKRFDTLPISKDDSIAIYRTDRATVNKIKFFLVKYYINRNEHRNALKYLNENKIDSKNINVFIDIYIETNQYNKLKDLYYKIEDLDLKLILFEKIEEKIDNYKPNKKKQIRSLFTDINEDYSQFCRFSVDININTEDKLIIANKIFANMKKNTTNLYYAEVMSFICENMTLNLSFFNKFNRSTTFYYLNYFYNNKYSEVYLKVFDWIKNIDANQPSFKNEVALKNLLEGIILRMASEYKNTGIETAISSNVFVFDKYIQVGLSVINKLYITKGMSLKYEYIADVESKFLILMNLYYENLNNANTTAALKYYKLAAEAYPELADFLATFLKKEFIN

SEQ ID NO: 1385 - protein, 689 aa, Hydrogenispora ethanolica
MSTVSLCMIVKNEADNLPRCLKSTAGAVDELIVVDTGSTDNSLEIAKSFGARVSSFPWNGNFSAARNASLANASGDWILFLDADEELTPESARILRQITATPAVEGYFVKILNYLGNENWNEVCPDLVFRLFRNRPAYRFRGAIHEQIVDVILEQNQTARYQTAENLIIRHYGYLNQAIEAKDKKNRNLRLIQAELERDPQNRLLRYHYGVELYRAERFDEAAVELHQAANGIDPAAIYLPKLLRYLVLAYQGAGCPEQALETVRIGLSLFPNYADLYYYGGLSHLEQRDYVQAYHAFRQAAAMPEQPCYYASFSGIRGFRAYYQLGQLAEVFLNPEEALKYYIHSLGDNPAFAPALRSIVRLLKPQDDPEYARQCLEKICDFCTPQAQLWLGQILFQESAYALALQYLESGSAGPQVPGEVKLWRAICLCQQRRFLEALHLLKEFPPADPLYPLALLNQLLCFWIQGNRRKTLSLARQLQTLGLSEDTAAVISLLTHVLPQQQKIFELTDSQGQPIFLAWAKRLLKRGQDSGKPAKTAGVRLGPDGISLLLDILLRLIDLNESALAESLLNRLDPEVLSGQAGAIGQLYYRYQRLDEACQYLRFYAETHPESAAALYDLAEVERDRGNAIHAETLYRQALALDPKEPRFYIALIRLYQKLRRELLEEAVAQFPEIPVLQKLLREAQEQ

SEQ ID NO: 1386 - protein, 358 aa, Roseburia sp.
MATISLCMIVKNEEAVLARCLDSVRDLVDEIIIVDTGSTDRTKEIAARYTGQIYDFPWESDFSAARNFSFSKAHMDYIYAADADEMLDETNRTRFLRLKQCLLPEIEIVQMKYVTKTDFNTVLNFKKEYRPKLYKRLRSFTWVDPIHETVRLDPVVFDSDVEILHMPPAPHQNRDFSIFRQAYQKYGILSNKILDMYAKELFISGSDTNFADAAPIFRAYLASPAANEPANATLAKKAALVLLHTARITDDFPSILKFSLDDMLTTPSAEACMEIGEWFFEKKQFDTAILWFYHAAFEAESILNARSSGNLPLARLSDSYRALAELSRGQKTDAEISAYLNAASDYLAQSEAWELPEE

SEQ ID NO: 1387 - protein, 610 aa, Unknown
  Description of Unknown: Acetanaerobacterium elongatum sequence
MPVRLSVCMITKNEEEFLDRCLSSVSAVADEIIIADTGSTDDTVQIAKKHGATVYPIKWRNSFSAARNLSISKASGDWILLLDADEVLEETDIPLLREFMNTTSCDGCNFTIINYIGRTAGGLHTMHNAFRLLRNNGLYRFEGAIHEQIIRRDGKPIPAGAIETSSIRLYHYGYLDDVVRRKQKRKRNLPLLLKELNADPQNPFLMFNLANDYLACGEHEKALKLFDRAYHKMDTTQAYAPHLVYRRAVTLYNLGRYDLAAKAAQDGLNIYPACADLEYLLGTVFSEWGRYTLAIDSFNRCMSMPKPPDSLRFMQGSTTLRPLMALGNLYLRLGDYSRAYDAYAAVIKKDINCCSVLYQIGKVLNHIYADKATVVKKLIGFFLSPDYTPNLILLTDILIQERLYSQAASCCEKAAEDLSYKQDTDFLKANLYFYSRKFGEARRLFEELVSQEAASTNVLQNITCQSAQYLFVISLIEGKTVLDSDLALVERYCDRLTYRVYTQVRNVLNDRDESVFSPDESWPSVLTEVGRLFDRVLRTGEFDLFERLLYLLNWVDSKAVLIELAQVYLDNGYPGMAREQVLRSVKELDYLNPAGLSILAQTAGIPRAST

SEQ ID NO: 1388 - protein, 657 aa, Paenibacillus rubinfantis
MKRLSVCMIVKDEEELLPRCLESVRTIADEIIIVDTGSTDKTKDIAAQYTDQVYEYSWTNDFAAARNESIRHATGKWILILDADEYLSPDDQDKWVAFMEQEKPLEYLAYTLPIINFTGDKGYEDEISTSPVTRLFPNFKGIYFERPIHEQLTRGTAGELFHKKLDLNIYHTGYQNLRVDEKNKHERNMQIFNQMQQNGEMSAYDWFTLGNQYRYAKEEQKALECYELAIKDAGTKTVWYPHCLVGLITLYYKQNKLDKSWEWTESRLAEYSEFADYYAIKGVQYETLGFFDEAIACYLKAIETAELRAVNNQEIWLVDPMYSFDMPVQQLIEVYSHTNDNQKAIYWLSKLLNKNRKNPTVLLKLVEWLCHNDAPESVIQLLNQIYDVNDPSDVSLLFKISLALGQEELVNYYRPYLDIDSQLTSGDRIRLSLVQQDKQDWMKSIQSAIGHEEDRPFYMWLQGLIGAMLWNESDLLHRLTLSIKDEEVQKLHQFVMSTLLTNQPSPKSSDYEVNSEKLFIIARQLFLLKQYELFDIFMKKFQTNNLVNQLANYFYSINVLNLAMDYYSILLSSQALNFNSLENLGLYHANQNYKEDAVEFLSSALREEPQARHLYYFLIKNARQEEKTHYIELFKSEFPEFTTISFIADFLHKQIHG

SEQ ID NO: 1389 - protein, 367 aa, Paenibacillus daejeonensis
MIVRNEEEWLGRCLSSVSSYVDEMVIVDTGSSDRSVEIAASYGANVIHYKWENDFAKARNVSLAHATGDWILWMDADEELAPEDGPALREGISVSEDPLLLIQLINYYGAAPPDSSRAYHIAHHRLIRNGRGFCFSQPIHEQLNTEAVLGTVAAIRTLPVRIFHYGYMDEVKHSKKKTERNLEILLRQKEDESYSPWIDYHLASEWMGLQKYEAALGSVNLAIARFLAAGQLPPSIVYKLKYATLLEAGYAAKICPAIDKAIRIYPDYVDLYFYKGMARFLLGQYDEAAQTFSECIAIGESCNHHLTMRGTGSFFAYYYRGQCREHMGLPNEASADYIAALQLHPQFEQAAQALNTLQVAEEERGCR

SEQ ID NO: 1390 - protein, 653 aa, Desulfotomaculum ferrireducens
MGKGISLCMIVKNEEKNLGRCLKSVKDVVDEIIIVDTGSSDNTVALAKEYGAKVYHYQWNDNFSEARNYSLEQAKADWILFLDADEELTSDSREHLTRYIREEQVEGYFIKIVNFIGKEGWVETCPDLVFRLFRNKPEYRFHGAIHEQIVDVILEKNSNAAYRIAEGVVINHYGYLEQQIEDKNKKIRNLRIIEKELASKPDNNILQYHYGVELFRAEKFEEAARVLVQVANKTNTNTIYFPKLLRYIVLAYYSAKQPAQALEVVQVGVSLFPNYADLYYYGGLCCLDQKSYKKAAEFFLKAVAMPEQPPQFASFAGTRGFRSYYHLGQIAEKFLNYDEALKYYLDSLKDNPNFIHSLERIIQILEPRKNPDYTRKCLEKVIDFDNNQARLALANIFYDQGAYQLCLEFIEEVIANGLVAGDILLRKAFCLIQRKRFLEALRILGELSGDNNLYPLAKFNELFCYWVQGKKKKVRELVTELCSKGLSVDTENVLKLMLKTQDKRIKTQKIYLGVDGVTLLLDIINRLLDLGQLELAWEMLNKVAPPCIEERKWELSRIFYKYGCYEKAIELIEDYLQHKRSGEAHFLLAEAQREIGNYAEAEKHYRYAIEIEPEVPQYYIKQMELYKVWQEVLRSKSLEAIEHPAGKDPGGGI

SEQ ID NO: 1391 - protein, 457 aa, Paenibacillus assamensis
MTTPSFPITLCVIVRDEEDVLRRCLQSAKDLVAQMIVVDTGSTDASAAIAKECGASVYHFEWQDDFSAARNAAIEKAEQPWILMLDADEIIDRESWQEEQLQAVFKQPHVLGCYVRIAHLTHCWNQNFNLNHRPAYSAIDMACRLFRNDPHLRYAGRIHEDITATIEAVSTEESSEAICWSSFTIWHDGYAAERLQNKDKSARNLHLLHLQLEEEPLNPLWWYAYGTEHFQAERYAEALPWLLRTITSLSKQPRLPGYASDVWLKAVFAYYSLNQIDSAVRLAEEAMNRFPRFPDLLLLSSTLYAIRGSLAEAYRCAEKAASCGDRTHLYTSTDGASTWRAHWMAAFLAERTGNYAQAAHHYEQAAAYTIAQHPSAVLKSAAAWHRSDWISSSRWMRSAAAASEQTLPTIAHQLTQALAASVHSSAAAHLLPFVPALHRATRIDWASFTRHFLYDDT

SEQ ID NO: 1392 - protein, 356 aa, Unknown
  Description of Unknown: Lachnospiraceae bacterium Marseille- P3773 sequence
MSAISLCMIVKDEEANLKKTLQSVCDYIDEIIIIDTGSKDKTKEISKQYTDKIYDYAWNNSFSDARNYSISKASNEYILVLDADEVVDEFDMEQIKSLISANPEKVGRLLRVNEYERNGMPYRQMERVNRLFSKKLYCYDGIIHEQVISKEGSEKKYDTYLLPLKIIHSGYEGDLETRKKKTERNIELLKEAQKENPQDPYIIYQLGKSYYMAEDYVQACSYFDKALYFDLDTRLEYVQNMVESYGYALMNCKEHERALQLISVYDEFKGSADFVFMIALALMNNGRFQEAIEEFLKAAEKTSCKMEGVNSYMAFYNIGVIYECMGNFENAYVYYVKCGDYEPAKERLRQMKQVKL

SEQ ID NO: 1393 - protein, 630 aa, Caldicellulosiruptor hydrothermalis
MADVRLSICMMVMDEEKNLKRCLESLKPLLLREDVELIIVDTGSKDKAVEIAKNYATKIYFKEWNHDFSDMRNYTISLASGDWVFILDADEEIENPENVIDEIEKAEKKQAKTICLTVKNLTQEEDKKNYVINISPRIFKKNYIKYWGKVHNQPIYHEPVYYSDIAIYHYGYILLDTKLMEYKYKRTVTLLLKELEKDPTNIYYRYQLGVSYSMYGKLKEASIEFEKAYNLLRTQNSEIKKRFVVLYCLYAKTLLGLGLYDIAREIAEEGINYNSDYVDLYYIAGQSLYMIGRRKEAVEYFKKYLNFFAKNEKPQILNDPSLAFYYVNDYYIDQAISYILQYYFDTKNFGEVKNYIDLFRDNSSRLKHYVLMYLETQEYKKLKEFYVQSEQKEKIAELIEKFIVDLKLDEEERNKLYKEFATVDNLYGKYAELWINPVEAADIINYIFNYGEIKNLSAFYFKALLCHLDKKEFLLKKLKEIDILTLRVKIAEALTAKFIDFEDVISLLEVIKTEKADIDILARYTSLALLVLLNFPRQSDERLYEIFLNYTENGILLMSRLYENEEIKEKYRYFLSEEEKYFALMYLIYLSLQEKRMDKSIKYLREAITTMPKLVKHLKRFSKDILGVDV

SEQ ID NO: 1394 - protein, 542 aa, Bacillus sp.
MSLISFCMICKDEEKRIEACLKSIVDIVDEIIVVDTGSIDRTVEIAERYATKTLHFVWNDDFSAARNYALEHAAGEWILFLDADEELDEQTAPLLRSLAKENKHPAYFLQIVNHISNKGEKVVETCPVLRFFRNDNRIRFTGEVHEQIGGAIAEVYHNESVAYTQIQIHHYGYLEEIVQEKKKKERNMTLVLKQVRREPDNPFHHYNLAGEYIRVGSLEDALLHLQKVKELCDISHMGFGPLTIKKEIFTLYSLNRKKEVLNVCRKENKRFPYFPDLLFLWGRVAAEIGLFAEAIRVYRIIVSITEVPLHYTMDEGILKKKAPFELAKLLERKNRKEALALYKKVLQHDSQQREVLERIMALLESIEEVEDIFQTFHYWDDLPLLQKTCEMFFQQQKNSLIIYIYERGNLSNDLLYDMAAYMEHRTIHQSIITAFHDWVENKQLRMKNKTHVFISFLRTGEWPDDIFPSEEDWLCIQYGFQLALQKENHHKLWQITSLWRYFISIVNGKEEQIYRQYVYSLHIAKIPEVYINKRVSIQPIYK

SEQ ID NO: 1395 - protein, 502 aa, Paenibacillus catalpae
MAELRKRISLCMIVKNEEKHLPGCLDSVQGIVGEIIIVDTGSTDETIAIAESYGAIVIRSGWEHDFAKARNKGVEKASGEWILFLDADEQLDEATKPQLLEYARHADLSALLLQIRNQIGPDHDQGSTIHPVLRMFRSDPAHRFEGRIHEQISFSILRKNPSARFHLTDVIIHHYGYRTQVVAEKNKLQRNMELLELALAEDPDNAFHRYNIGVEYLRNNRAADALEAFRTARRSAGFEQLSYAHLVLKYESLSLQLLGRWEEAAATAREGAAVFPDYTDLWHYIAFCSASTGQYKAAMEAAEKALEMGAAPARYHTEDGMGTFRTAYLQGRIYEAMHDEQGIVHAYITALRFKPSLLPPLFRLCKYMRAAGREGQLAALMARRITCPDEAAMLKLAGVMVASGCPDSAIAYLEWQAELYKEPALRNSLASHANALLEGDFSRLPFAGYSGKDEVEDMLSPAAHWRERAEYYLERVQQQKEQIVEKQAIQSIRLLMPGFEGW

SEQ ID NO: 1396 - protein, 637 aa, Paenibacillus curdlanolyticus
MQPSISLCMIVKNEAPSLKRCLDSVKGLVDEIVVVDTGSTDNTIDIALQYTSNVFSFTWMNNFAAARNESIRHATSDWILVLDADEYIQSEDHDKLKSFLSQFDKSIPAGIVLTINNFMSNETDFSQIMESTGARLFVNHPCIHYVEPIHEQLISTDIPINWVSYSFHIFHTGYTKQTVTTKNKSERNMSILMQLQAEKKNDPYYNFVLGNEYANIHEHHNAHQCYIVSYEGTKTTDTWFNHLLDRLIATELQLELYNEASRHIEQGVKLYPQKADYHCLRGVLLEKLGFRKEAALHFSKCLDIFKQAGNTPYWVIQPSFGTTLPMQALADIYRRQGNFEQAVSYWIQALQQQPANYSLLKVCLEHWGHIATITNIIEDLGLIYPNSIPLNQVMLFKIALQTGNRDIAAYYRKNVSSFPIQWSEEDAILDRVLFPDSSSTLQTSGSKSSIPVSIAVLAAITLNDNQYLNPSYISDDAITWVLELQQLLSNRPIDLTKLPGQEGWYAELLLQLWKMQQYDVYYELLQKTANSPVLNALANLLYNSGHIEHALELLLLLLEEQALDSDALLTLAEWGLHHDNIDDAFDMLSIIIESQSNSGAVGLLLEHCNNSRYHDRINKMPIETFPNISTLYPNKLS

SEQ ID NO: 1397 - protein, 683 aa, Sporomusa silvacetica
MILSICMMVKNEEANLERCLQSLQPIRDGLDAELIIVDTGSTDNTVGIAKNFTNKIYFHQWDNNFSEMRNISIGYATGKWIFIIDADEQLEDCQPLIDFLRLPKRDKYGSVAITVKNMVDLENNEYSSMIAPRFFKNDGYFRFEGVIHNQPVFKGEALAIPQVYLLHFGYLPTDKELMERKFQRTGTILKSELEKDPKNIYYWTQLSVTYGMHKDFPEAIEYAEKAYSLLPKKRTPKHMFLFSHMALTYQHVKNYEKVEQICREAMTIKEGYLDIYFYYAEAHSMLKRNREAIIYYEKYLDLLDKREQTSKHDVTIIEYSLGCQELAYWNLSVLYAKEKEYDRALYYSKQITNSKYIKNNMVNTIECYLKLDQYVNVRKFYDKWVQEDWKSFFFENLDKIVRQYDRKVHIDVARNFCNVNHQYALLCNLIVEDTDNGYISEKMQQAVEKIRMESLPVYCSDIFYYLLKWHYPLEKIVVNFKEIWLTCAFDFVGKHHDDLCTVIYNYLQKYTCNYRVHEYKLAKTLARCAILLNKLSMDQYKELLDRYVQEGIHYLQIVYSPLILEGTMIYEVKNDEEAFLLYMYKAQIYRTSQPAEYVKCLRQALQVFPVLNSGIEMLLVEIQVTRKTEQNEFDTYKQEIKNRIQQLIDRKKMNEARIILEEYKSIVPNDMESILLESRILIS

SEQ ID NO: 1398 - protein, 374 aa, Synechococcus lividus
MAPLLSLCMIVKNEAHQLRRCLTSVQPWVDEIILVDTGSEDDTVAIAGEFTPHVYAVEWQQDFAAARNYSLQWATGEWIFYIDADEELIVTDSHWRSQLLDQGIDCFSVLRQEAGTHHNWSDFANVRFARRQPGLRFVGALHEQLNTAQGKVGALKGIHLLHHNQQTQEQFLKKIRDRNIPILEQMVQRGDRRLMNLVCLGDHYAACGRTEQSRDWYHQALDAIAEDIEQQRLPQETTWLRHLLFWATYTAFEAKDYDTAQYYASYGLRYFNAYPPLLYAAGLIVFELGLPRGALPYFHRCLDLFSRGTYDRSEPFDRQWMTTQPAYSLGFTYMTLQEQERAITYFQKTLEFNPHYQPAQQHLQHLLSATAPSG

SEQ ID NO: 1399 - protein, 629 aa, Paenibacillus sp.
MIVKNEEKVLERCLLSVKTLVDEIIIVDTGSIDQTKAIAARHTDKVYDFSWMNDFSAARNESIRHASGRWILILDADEYVQPADHDKLRKFLLEYKSDRPCGFVLNIMNFGGSGNDESNVTESTGARLFLNAQSIRYIEPIHEQLTSDFGTPLFTPYPFLIFHTGYTVQVVQEKNKSERNLSILEKMNAGEKRNNPYFCFVLGNEYTSAGREDEALDVYRRSLERSSPSDTWYFYLLERLAVLEMKKGNYSKAHVNIRNGIKLLPERTDFLCMEGILLEALGLWNAAENVFHQCIQIAVEAEKKGSPYWIIKPSYGKIVPHQSIAEIKRRKGDITGAIHHWVKTLQHQPKNYAVLQLLMEALLQSEPYDQVADIIEQLYPIDQPMNKVLLHKIALKIGSIELVSKYASDVLELGVQLDKADIVQQNLLLRNWSTSTTSSLRPNSLEDSLAIAAAIVHQEISIADTATGDTTACTALVQEALLAINNKTWNNEVLTNQEDRFTQTLQLLWRYGYTEIYLSLMQIMASETVLNNMADWFYTRGFHEQALDLYSVLLENNLLHAKGLKNVGVWYINCGNMEEALPFLEASFKKEAFVDIIGLYKEHASPEAYRRFKSSYIEQFPNTSQCIFL

SEQ ID NO: 1400 - protein, 638 aa, Unknown
  Description of Unknown: Bacillus sequence
MKPFISLCMIVKNEEKVLNRCLSSVANFVDEIIVVDTGSTDSTKEIASKYTNNLYDFEWTNDFSSARNYAATKASGEWILVLDADEYVDEENFNQFIQEVKNDNGIYDAYTAKILNFTGNFGENLLQNFHDRVYKNNGEISYYRHIHEQFKSTKGKQLNIKNSSLLIFHSGYLSKVVSEKNKGQRNKELLNFELHNGAKNAFDYFNFGNEYYSIGEYEKALESYLQAYKQKSDFRLSWVSTTLVQIIICLIHLKRYNDALNIITDAQNMYMASPEFPYLKGEIYFTRGQLDDAKQTFLQIVNYPQQYHHIIFRPDLKDQKPHTRLGEIYLYEENYQQAIYHYTCVLNINKYNEESIKKVIYILNKFHSVEEISAFLKSNGLISEKNVSSYVKACFDVGNPSLAINLLEDYLDEYKLLNKVALLKRLCIDNIGSIEQFHEIFKPEIIKHLMESNWVNIIDVLLLKDHISTSNDLLTVLNYLKQNESMNKLMDLVDGNESIVNIDEDLIIYALQLFFVYKKFDLCNSILKEIEKVDKHTILIVARVLFSNGFKGEALQLYNLCDWDAFNAQDFINIIHSLLEVNNKDNAIEVSKYALSIFNEDFRFYKYILENTEDPSLFKTTFDQAKKIFVESIYFNQF

SEQ ID NO: 1401 - protein, 373 aa, Paenibacillus sp.
MISISLCLIVRNEEDVLARCLDSVKGIADEIIVVDTGSVDRTKEIASDYTPKIYDFEWIDHFAAARNFAFGKATCEYILWLDADDIFKEEEQVKLLELKASLSTEVDTVSMLYNLTQDETGAVTNRLRRNRLVKRSRQFRWIGAVHEYLEVYGAAFAADIAVTHASTRHDNDRNLRIYEQRLAKGDELSPRDLYYYANELKDHSLNERAVHYYSLFLQSKRGWVEDNIAACGKLADCYASLGNQELALESALQSFSYGSPRADNCCRIGYYHLQVGAYETAAFWYESALRAPRQDEAWSMQNTSCSTWLPHLQLCVCYDKLGEWLKAYEHNEIARAYRPDHPSVQHNKTYLEGLLLPAQTLEPSDLSLTQTAP

SEQ ID NO: 1402 - protein, 651 aa, Sporolactobacillus sp.
MRCKLMSPLLSLCMIVKNEENVLKRCLDSVKDGVDEIVVVDTGSTDKTKEIAGEYTDKLYDYEWTNSFADARNYAQSKATGEWILALDADEFVDYDNLMDLRKELRENVNHFDVGLVKIFNFTGQAGQLIYNNYHVRIYRNDPSINYYRAIHEQLKKTDGSSLKEQVSSLVVYHSGYLTSTVDSKNKHKRNKALIDKEVRENGQTGFDYFNLGNEYLSHGDTEKALDHYVKAYKKRPDVRYSWVGPCVLQIIQCLIQLKRYKDALNVIRDSEAIFSRSPEFKTMRGRIFLLQGRINDAEHELIRLVDNKDDYTDTIISPDYLKYFPYKFLGYIYEKKEDLQKAVFHYSKAFHFNLNDEDLLRRYFRLLLQNTSPEAFYQFLLDEKLLENKNSAKRLMKVIVNLSDSNEFVSEILDHSFFNEDFGAQAKYLLIQKQPKDAFKLISQLSPKQLIYIFNEGIFDFFDFLILCLLLNQQKLLAAYTGMMKQVAGLVDLLSNGKSKDKVNPSIYLIVLKRLIRLEQFDLFEKIVGYKTFFDKSINIRIGHLLYNDGFCDLAVSFYQEAGTSLFDEQTYLNVMEQFKKQNMLEDAFQFALRSLNKGYQHFSLIKDVIEIANQVNDEPIHHAKRDLAKFALKLYPDSKEMREVLFANR

SEQ ID NO: 1403 - protein, 655 aa, Paenibacillus jamilae
MKRLSVCMIVKDEEVLLARCLDSVKGIADEIVIVDTGSTDRTKEIAKEYTELVFDYEWSNDFAAARNESIRHATGKWILVMDADEYLSVDDHVNWNKFLDRERPNEQVAYTLPIINFTGEKEYQDEITTSPVTRLFPNFKGIIFERPIHEQLTKGPSGELFHKKLQLNIYHTGYQDQRVMEKNKHERNMAIFNSMKKSQVMTDYDWFTLGNQYRYAKDEEQALECYERALEGADWNAVWYPHGLIGLISLYYKQGRLHLSWRLTEDKLSLYQDYSEYYTIKGIHYETLGFFEQASAYYLKAISIAEERAANQKEFWLVDPMYSFEIPVQQLITLYFRLNDNQQAIYWLSKLLSKNNKHPGVLLRLIEWLCQNESESSVIGFLNQHFDMDKQADPILLFKVSLALGQNVMTTYYHKYLSNDDFLSISDRLRIAVLEQDKSSWSKTGLAIDKVGKEEQQQVWLQIVLGSLVWNDNELLKESVAIIVDEEFNGVEKLISQFIQEEIIPDQQALEKHADSLFLIAKQLFLIKNYELFDRFVQFTKSTKLINSLANYFYSMNLIDMAMNYYSILLKEQLLDAKSLENLAFYHLNHGYFDEALDFLKELIEIEPKARHLYYFLIRHGERQEKQLYIEKFTSKFPDFENISFIREFFNQNRT

SEQ ID NO: 1404 - protein, 364 aa, Cohnella sp.
MTTISLCMIVRNEEEVLARCLDSVSDLVDEIVIVDTGSTDRTKEIAANYTDRIYDYEWTDHFADARNYSFAFATQDYVMWLDADDYFREKDRLKLKKLKDELDSAVDSVVMEYHLAFDAYGNPLAMSRRNRIVKRSRQFRWYNPVHEYLLVEGNYYLTDIAVSHGRVHENTGRNLRILEQIVQREGEVTGRDIFYYANELSDAGRFAEAAEQYRRFLDQPVEYFEDNLTACARLSACYHQLGLLDQKLTALLQSMVYDVPRADFCCSIGQCFLDREDFVKAIYWFKLALSQERPPDHHFGVLNLICWTWLPHLQLCICYGMTGELELAYEHNEKALSYLPNDANLLQNKAKIEQALGIGGTEPE

SEQ ID NO: 1405 - protein, 595 aa, Cohnella sp.
MGEPLLISLCMIVKDEGATLARCLSSVQGAVDETIVVDTGSTDDSAEIAKRYGAVVVREQWKGDFAAARNAGVCLAQGRWILFLDGDEALESSQHAQLRQLATRDDYEGFFLQVRNYVGNGEQGATVNPILRLFRNRPEYRFQGRIHEQIAASILESRPGASFHLTELVIHHYGYQREYIEAKDKVRRNMDLLEAALQAEPDHAFYRYNLGVEYLRSGRPEEALEHFARASRLVDPERTSYAHLLSKYEIRCKQALGRWEEAYVQTAGAIRLYPGYTDLLQYKALCERALGRQAEAIGTLIEAMKQGVPQPIYHTEEGIGTYQTAYLLGELLEEYGHYEEALLAYKKALGYRSSLTPPLYRMFRLLRVAGREKEIPQWLKTSFRLASPEAWAKVVAILLQCRCGRAAAAILQEKQGRKLPEGFRLLAEAEAELQRGRLDAARRGLRSSGRKGQGARDSALASAAIAEHLRWLDGDVKEPWSDRITIALASSSQGSEQPIKLTGDELSGGVWPQLQRLLEGSYSCGKRQEGLHVLHLWQRTLESPEATPAGADALVHGLSAIADRHLALLTSSDFGKRHKEALTAARLRLPHEDGM

SEQ ID NO: 1406 - protein, 531 aa, Desulfacinum hydrothermale
MKKPRISLCMIVKNEEHNLPRCLDSVQGQVDEIVVVDTGSTDRTVEVASRYGAKMVTFAWNGDFSAARNVSLDHASGDWVLWLDADEELLEGTGGMTLPELAASTDVDAYLVPIQNMKADGSFTAHFAVRFFRKLEGIRFEGKAHESVGDWLLRQNARIAQSPVPIRHWGYAVSDGELQRKLDRNLELLMAQLKQTPNSSYVHYYIGMTLIGKKDFEGSFRHLQKAHELGPETPNMECLVANMIAHHHLHRCQYDEAEKWARRSLAVTTQQHTGRLFLGIALYNQKKFAEALPLLQGAYQFQRQPLMRRRSDISLEHAHGEKELLWAVARSAYEVGRYPLAYQFLERLSRSYSPDGTVALLQGLCALAMESYRSATCHFQQAGALGASWAVLGAPWVQALLRLDRADEALRVLEDAGASFFHNEKAGSIFTTLVERCFESQRIGALSKVLERIVRNGPTHPLVLDALAVCRIKAGDYARAAEALEALLELDPGNPEVRRRLAAVWYGLGDRERAAHLLRHGRSREAVGAMW

SEQ ID NO: 1407 - protein, 655 aa, Paenibacillus macquariensis
MPKLDISLCMIMKDEELHLERCLSSIQHLVSEIIIADTGSHDKSVSIANRFGAQVIQIPWEDDFAKARNTVLKQASCSWILVLDADEEVDNWQLEELRNLLNNPDNQGYFLSLKNYVGETIDHSYVTDAVCRLFRNDKRITFCDRIHESVAPSIWEIPDANIAFSSLRIKHYGYLQHELVRKEKGTRNLNIIQHSLQQRPGHLPLLYALGTEYYQLADYESASTILIPLLHQIPATSGFTSDLYLKSAYALYMCRKLKQSEAILLEGSILFPDFTDLLETYAILLAEQGRFSPAYEYLQKALNAGDVSIKYSSTSGSGTYRTHWVAGTICEQMLLFEEALRHYEHSLEFRSDYMPTWRSIVPLCLLSNQIPRLLLITERYHTSLTSDILMFLTPSALNSRSLPWLSQLRSYLPSEPATIVDAMLFQQTGDRHESAQRLEVLLHTFPNHPMILSYQWAVTHESEVSQSAIRWMNELIHVKPDMNTIQQRLEDHPDTSLNPPNPQMLEYALQLFIQTGSWNTLLTLFRHSSADIRWSALPQSTLAGLLQSPHAVQQQWCHIFLQQQEHHFSDDQSHEETIISYDISEWLYYASIAQACGELPELNEQMEERLCHSGEPIPLVALAYYQLLRVYSLHTSHTPKSSICWPLLFRSYINI

SEQ ID NO: 1408 - protein, 377 aa, Bacillus lonarensis
MITVSLCMIVKNEEDVLARCLDTIKDCVDEINIVDTGSTDRTVEIAKQYTDRVFFFEWTGRFADARNESFKYATKDYILYLDADDVVLEEDREKFKKLKETLDPAVDSVSMFYNAGMDQFGNVTLRYRRNRLVKREKNFQWGGDAHNYLNVFGHIINSDIGITHKSVRHATGRNLSIYKDKIERGDSFSPRDYFYYGNELRENGHPEEAIESYDKCIALKEGWVEDKFYACINKADCYTRLKENQKALESLFQSFVFSRTPRPEACSRIGDKFKVANQFKDASYWYELAVLMKPDENQWSFSYPAFSTWYPHLQLCVCYDKLGDIEKSYENNEKAREYRPQDPAVLHNKHYLEKKMEKLKEEKEKKEQEKEDKVEKE

SEQ ID NO: 1409 - protein, 638 aa, Cohnella lupini
MTKLISVCMIVKNEEAVLNRCLQSISALVDEIIVVDTGSSDATKAIALKFTNHVYDFVWINDFSAARNEALKYATGRFILTLDADEYMDEANLSLLRDSLSKVEPRTDTLYQLKVVNYKGRNQPTTEEPIFRVFANYSNISYVRPIHEQPKTHSSPTTKVVPLPVKIYHSGYTEDVIKSKNKHERNMNIFSEMQKHSQLGPYDHCMIGRQLIMMDLHEEALEHLQKALKLGNKKEVWYKHNLISMLEVYLSTNKAIDAFIFMEKHFTQYLHYPDIRGLYAMVLERLGFWSLAKKEYEEAYKIAENQIKTKKEDVFVSGDLSFRIPTWNLAIMNENEQNYNPTIDYLAKLLIANKSDLESIGKFIEIASLNEKPEIIIQILEKLIQADSEITSNAIVGKLSISLNKLELARHYCDDKLLSGLYNPSEQLRYALIISNVTLFQSVLNKLTSELILQDPMVKRLIALGILIWEVKEWSSLIESDVLLSRFTSQLLNEDVPEHSDEAEEMACMIISELYSLQQWDPYETTLSHYETPKVINYLANFFLASHQSKTALQYYQHLLDHDAMYANSYANLAFYKYSQKETSEALVLWEKAINLDPSRKKLYIQYYEACQDPIKKQMMKKRLLDIEPQYSAIRLLK

SEQ ID NO: 1410 - protein, 364 aa, Paenibacillus sp.
MERCLASAAPFVDEIVIVDTGSADRTLAIAESYGAIIIHHRWQEDFAQARNVGLEHATGDWVLWLDADEELEAADGEAMRESLATEKGPLLLVELINYYGADPPDPLRCHILAHHRLFRNGIGLRFVNPIHEQLNVNEVITSLEPPPTIKARIYHYGYMDDIRLAKDKSGRNIRMLQEQKKLPDYSPWIDYHLASEWLTAAKYDEAIKDINLAITRFLQIGQLPPSLVYKLKYAALLESGHAYLMWPAIDKAIQLYPDYVDLRFYQGIALLLRGNLREAENSFNQCLAMGETCTTHLTMKGAGSFLAYFYRGECRRLSGRLDLAQEDYKETLKQNPQFVEAEQAKLKLETGRKGSEVNVTGSHT

SEQ ID NO: 1411 - protein, 252 aa, Fluviicola taffensis
MKSLSVVIITLNEERNIQRCLKSIRDLADEIIVLDAFSTDKTATICEQYNVQFVQRAWEGYAASKNHLNSLATSKYILSLDADEVISEALYLEIKAEKGNGFKGTYSVNRLTNYMGKWIYHSGWFPDIKPRLFPKEGSYWSGEYVHEELVHPPSEVKIFKGVLEHYSYYSYEDHRARADKYSILTAQKFNAKGKKAGPLKPIISAVGRFVAMYFIKLGFLDGWKGFKIAQISAQSNVLKYKELRRLNREGRN

SEQ ID NO: 1412 - protein, 265 aa, Unknown
  Description of Unknown: Phenylobacterium sp. sequence
MIRLSAVLCVHNEERRLARCLDALGFADEIVLVLDRCTDRTRAIGEAYGAVMVSGVFPLEGPRRAAGMNAASGEWILEVDADEIVSADLAGELLRSLDDDRFAFRKTPVDNYVGDRLIRHGWGGAFGTSLAARFYRRGSKRWGDERVHPGVAFDGPEGPKFTSPLRHQFADDVSDVFRRLDRYTDLKAQDLREHGGKTGVADNAWRGLRRFWKCYVRRRGWKEGGWGLMIAMMAGLYPLVSAMRAELDRPTADTVEPALPLARAA

SEQ ID NO: 1413 - protein, 362 aa, Paraliobacillus ryukyuensis
MISISLCMIVKNEEEVLARCLESVKDIVDEINIVDTGSTDRTVEIASSFTDNVYHYEWTGNFAQARNVAHAYATKEYTLYLDADDVILPKDKEKFLQLKETLDPNVDAVSMYYHAGTDEFGNVTIQYRLNRLLKTAKKFQWQGDCHNYLNVTGHIINSDIAITHKKISHSVGRNLSIYEERKKRNEDFSARDYFYYGNELRENKYYEEAIKSYQQNLEMHSGWIEDKVYAATYQADCYRILKNEKQELNSLFYALQLAKLPRPEICSRLGYHFQQKRDFKPAVYWYELATTIKTDPNKWSFTYPAYATWYPHLQLCVCYYNLQQFEKAYEHNEKARIYRPEDQRVLFNKELLEKRLDLSNEK

SEQ ID NO: 1414 - protein, 350 aa, Herbinix luporum
MISICIIVKNEEKLLNLCLKHLIPLNYEIVVVDTGSTDGTKDVAINYTDKVYDYPWNQDFSAARNFAISKASNDYIFMIDSDEILASCDKKELETYIQRYPDGIGRVMIISEYYRDNEKYSVKNQVSRIFSKKKYCYQGRIHEQVVPIEGEIATIYDAPIRIYHRGYDGDLETRRKKTERNISLLKKELEDKGDDPYILYQLGKSYYMQEDYFASCEVFSKALYFDLDPNLEYVQDMVESYGYALLNSQQYETAMQLLGVYDEFAVNADFLYLMGLIYMNNAMFTEAIGEFIKASQMKVYKMDGVNSYRAYYNIGVVYECLGLVDKAIKYYKKCGNYSLAVKRLNTLVYD

SEQ ID NO: 1415 - protein, 373 aa, Paenibacillus sp.
MIEISLCMIVCNEENSLPRCLSSVGAIADEIIIVDTGSTDNTKEIALSYGAVIYDFTWIDDFSAARNFAFSKATKEYIFWLDADDYLKDVDHARFRELKHCLPDGVESVNMQYNLAFDEEGRVVTSLRRNRLVRRSCNFKWIGPVHEYLEVYGPAYSSDVCITHEKDKVYTDRNLRIYQKRVAEGEVFSPRDQYYFANELRDHGIYEEACRYYELFLDGGLGWIEDSYQACLRLAECRERLGDREGAFQSLCRTLQYDTPRAEFCCRLGAWHVEKGQLLPAVYWYELAIKLPRNNDSMGVKNEAFATWVPNLQLALCYDRLGQREKANLFNEAALLYHPVHPSMLYNRNYFKNVLGDNYVELHSREAAEKEAE

SEQ ID NO: 1416 - protein, 340 aa, Clostridium sp.
MITISACMIVKNEERVLDRCLKSLDGLVDEIILVDTGSTDNTKLIAEKYNCRIFDFQWIDDFAAARNFSFSKAGMDYIYVADADEYIDEINRERFYKLKQCLLPEIDIVQMFYTNQLEFNTTYNFDKEYRPKLYKRLRQFSWVDPIHETVQINPIIYDSEIEIIHMPESNHASRDFSFFNKLINKGVTLSEKLLGMYARELFIAGDNEDFLKAEPYFINVLESNLAPEQLKAIQCVLVRCGRIKNDPALILKHALKNLASGNASAEVCYDLGEFYFSNEDYQEAAIWFMNAAYETEAELNIRYSKDYPVDRLADCYEKGGTIEQALLYRQQAVELRKEFS

SEQ ID NO: 1417 - protein, 544 aa, Paenibacillus ferrarius
MAKNTISLCMIVKNEEAHMHRCLDSIKNTVDEIIIVDTGSTDNTVQIAKSYRAKVITIPWKSDFASARNAGLSLASGSWILILDADEELDEKNRKELKICAEHHEFDGFFLQIYNHSGNTINSPVSTINPILRMFRNHPHHRFRGKIHEQIAYSIVERNPNPALHITNIVIHHYGYEEQLVIQKDKIRRNLDLLIQSLQEEPNDPFHHYNIAVEHMRVNNHESALPYLQTSLSLVNHEVSYTHLLYKYKARCLFALGHNLEAIQACESGIRLFPDYPDLFHIKAVIHSSIGDKTLARDAFLQAIQIGTAPMQYHTDSGIGTFLSTYGLGQVHEEIGEDNNAIHWYAETIRHNSQMSRPLQRIFRILKCTGSESMIPALLSERFSIKAPEAVLKVVNLLIEESCYTAALSLLTRLDDETYRQVRDEKIKICQLLSGQKHKNIWYWIGLDEPVLERSYMEGNDYDQFELAVKSAYYNDHQGKALELLRNWQPPIVTDSKAVQDEGYRRSRIWTALANAKIGVPDKQSPHYKILRLAKQSLPLSRGY

SEQ ID NO: 1418 - protein, 702 aa, Clostridium sporogenes
MKLSIAMIVKNEEKYIENTLKPLKKLQKYIDSEIVIVDTGSTDNTVEIAKQYTDNIYFHEWNNNFGDMRNISINYCTGDWILVVDADEVLYDVEELAKLIRNKKISKSNGAFVKIVNFNKDVKDSISNGAISPLLRIFKKGTVKYEGSVHEQPRFTNPIIDTNIRFIHYGYDNSNYKLMEYKFKRNLSLLMEELKKDADNIYIIFQIAVSYSMHKDLKEALKYIEIAYEKAKGKIQNYIYVIDKYCFILHSLREHRLLLEKVEEALSKEEFIDFYFYKGEACYNLGKYEDSIEAYNKYLNFYQKLKNNNLIFNNTLSVVTRSLRDIVIYNLSISYFKIKKYYEALNTILQIQDKEMLKDKAFIIFKIIVEGKLWSKLSILNGFIDKYNYESILVYVHKDVLLEDIILLSQNEKLLDNELKEIINIVKYFKENEGINKDLLNKSKKRIDENKIPYSIYIYYILKYDITEIEYFMIYGRDKIENILINLCVNYFDFNYSILEGLEKFKLINTNNISIKTIMEKPLLLSGNLPEEDKEKIFLNYIAHKYYCIIKNYNEDLVGNSKWMLTDEERFVLEIKEVLEDKYKDSVKYIRGIKDILNIQKSYIGYMKILTNNVEETVNKDIKALIPKLIESIKVLINTEKYQEAYNTIEEGLALVKFDFDLMVLKYNLLVQFSYDEEARICLRDIILYGDGKKIKELIYNL

SEQ ID NO: 1419 - protein, 256 aa, Unknown
  Description of Unknown: gamma proteobacterium IMCC1989 sequence
MSVSAVLIVKNEQDRLKDCLESLVWATEIIIVDSGSTDNTLNIAKQYTDKVYIHADWEGFGKQRQLAQGYAVCDWVFAIDADEIVTSDLRESIEHVVQANDQRYAYAINRKNWAFGQFIHHSGWSPDWVTRLYPRAKTSYCDSLVHESLLIPEGIKIESLPKTSHLLHYTYDSLYDYNLKVTGYLKAWADQRVGTKKSSVLKGVCHGMFAFFRMYILRLGFLDGRHGFILAFLTAYTTSLKYFDLWLRQQENTNDG

SEQ ID NO: 1420 - protein, 324 aa, Bacillus cereus
MIVKNEEESIERCLNSIKELVDEIIIVDTGSSDRTIDICKQYSQNVYPFLWNYNFSEARNFSIQLAKSKWILCLDADEEFDGNEISNLKDSINKKKEQLFYLPILNYVGNTVAENNIYQIFQPRLFCNGVGFRFQNKIHETLCIPPNFSQYGILNIPIRHYGYLNSRVKSKKKNYRNLEILKSELEIQNHTPWIEYHMASEHYGVKDYEKALYFINQAILKFLAQETLPPAIAYRLKYTIIMESGNIAKDWRGIDFAIQIYPDYVDLYFIKANILFYLKKYQDALEAVNCCLDLGENNYKYLILKGTGSFRAIKLKQKCLEKLK

SEQ ID NO: 1421 - protein, 586 aa, Pelotomaculum thermopropionicum
MEDTITLAMIVKNEAGNLKRCLDSVSGQVDEIVIVDTGSTDETLEIARRYTDKIYHFPWGGDFSAARNFAIEKAGGEWIISLDADEELVSGTGDLKRLVARDKHLEAYLLPLNNPTAGSPGEYNRFLVLRLFRNNGRYRFRGKIHEQVTVSEKGVVGIAEGPVISHKMLPARERNRKRGRNLALLKKAFSDDPQNYFLQYYIGVEWLMLGKPERALPHFQQAYRNLTDENLLFRGPALRYLIICLKELGRLDEAICLCLEADLKYPEYTDVYYLCGVLFEEKKEFQLAIKWLNQAVKCGTPPAIYSHMNGAGSFLAFYHLGYCHEMLGQAEVAENYYQQALDTNPGYIYPIYNLFLIMLAKRGPRLTLEYFKKKGYLGHIDLALAAAGLFFNWGYPELARRCLGHYETSGKRAKEFYFYLGKYNIYSGKLKQGLDYLKQVSEESSFFIQSQILRAVALLLQGRFEKVRSLALELWKNHAARRRALVLLSLARLVEKGGTLSFPQKVRDIDLLETALEILDQCSRYLPDEDRARKDPRLNRLINGLEALIKNNSPRGHLALIEHYRDKSYSARSFFDYKYGFGGNRV

SEQ ID NO: 1422 - protein, 358 aa, Bacillus salacetis
MITISLCLIVKNEEATLWNCLDSAKEIADEIIIVDTGSTDRSKEIAREFTDKVFDFEWVDNFAPARNQSFKHATMDYILWLDADDVLFEEDQKKLLELKRNLDPSIDSVSMIYNYGFDEYGNVTLSFRRNRLVKRSRNFQWAGDCHVYLQVDGNILDSDICVSHKRVHHSTGRNLAIYEKRLENGDEFSARDYYYYYANELNENQFYEKAIENYTAFLEMEDGWREDKIAACSRLADCYGKTGELEKQRNALYKSFEFDVPRPEVCCRLGSILMDEGNYRAAVFWYKAAIDYQQPEENWGFTFKAYSTWVPHQNLCKCYYYLIDFEKAYEHNEIAREFRPEDPGILHNKKILEEKLKG

SEQ ID NO: 1423 - protein, 360 aa, Paenibacillus nanensis
MISISLCLIVKNEQSTLGRCLDSVREAVDEIVIADTGSTDGTKEIAANYTDRIYDYRWSDDFAAARNFCFDQAQTDYILWLDADDVLLDEDREKLLRLKKEIKDTVDAVSMIYHYAFDEFGNVTLSLRRNRLVKRARGFRWHGPVHEYLAVSGSILSSDIVVTHRRTHVQSARNLTIFENRMRRGELFSPRDLYYYANELLDHGMDEKAADKYEQFLATGQGWSEDVISACLKLADIYSRMRQPEKQIAMLWKTFDYGEPRAECCCRLGHFFMERDRPEEASFWYRLATRLEKPKDCWGFLQDAYWTWVPHLQLCVCYCRIGDFGKAYYHNEMAGRYRPDDPHVLHNRRYLEGVLRNEAL

SEQ ID NO: 1424 - protein, 625 aa, Paenibacillus sp.
MMKTIALCMIVKNEQEYLRRCLESVKDKVNQIVIVDTGSTDETISIANEYTNEVYHFDWINDFAAARNESIKYAKADYILVLDADEYLEDSVDILSSIEVEADYYFIKIHNMMSQGRAIDHLAIRIFANNKDLYYRNRLHEHLNTYEDEEKYKAGHAEFTIMHTGYTDDMLEGREKSKRNLSLMLKEVEENPNVYNLFNMGRTYNWTGNHGKAIEYLQRAYSLSGNLSIVPELVATLCRSLGEMKRYEEALYVLQEAVLVFPQEVDLVHLQALFFKEIGYYRDAIAKMNLCLEIGDQGITVTEGNGSYLAHFRLAEWYEERNDLVKSYEHILEAFKLNMNFIPVMGKYFKIVEKANIPLDDVFISIKQLYTISNSAQLERLLEVLYQLRHPLLHRFITEYNVIVQDSVEAIAYQYVGEYEKSRDKWITIDEITDQNGEDILLLSILLKDENLFKISRPLLNLSVSEQKKLQKCIFDISPGNLKLTTHTESLLEKSIIHLIRLHEFETFESVLGCLWNGGIDIKMKICEHLIAYGFNEIAIDLLVKLYEHNSRNESLNLILGDVCYKSNYFEDANLFYSRISPRKYEIHEHLYEVNSKMGNQNEKEIIIEEIKKLFPICQWVKTEL

SEQ ID NO: 1425 - protein, 335 aa, Campylobacter coli
MNLEKISVIIIVKNAQNTLFECLNSLKEFGEIILLNNESTDDTLKIAKEFQKDFTHLYIYESKFIGFGALKNLALSHAKNEWILNIDADEILENEAKEELKKLEFKEQNILALTRKNLYKGEWIKACGWWPDHVLRVFNKKHTKFNENLVHESLILHPNTQKVYLKNGLKHFAFESIDDLLDKLQKYSKLWALQNLHKESGICKALVRGFWTFFRNYVLKKGIFYGYKGFIISVCNGLGAFFKYMKLYELKKQKPKTCALIITTYNQPKRLALVLDSVKNLDPLPNEVLIADDGSKEDTAKLIQEYQKNFPCVLKHIWQEDKGFRLSQIRNKAIQ

SEQ ID NO: 1426 - protein, 361 aa, Bacillus cereus
MIVKNEELCIEKCLQSVKNIVDEIIIVDTGSTDKTVDICNKYNAKVYKYSWNGSFSDARNYGLKFATGDWILWLDADEELETIHKEIFDKLLNECINERLLSIHLINYIGDTVDIDKTFHIAHTRFFRNHQGFKFIYNIHETLNVHQILNSENLKNIKVLPIKVYHYGYMDSFVENKNKVERNLQILEQELLNENHTPWIEYHIASEYYRKKEYIKSFEYTNLSIERFVKNNQLPPSLVYKLKYSNLICANSIDGAWPGIELAISLYPDYVDLYFLKGIILFRKKEYNNALQVFEICIDMKENNLQHLSLKGMGSFMAWYYKGLCFEKTKKMIEAKNAFETSLKISSNYLPAKEALNKLTK

SEQ ID NO: 1427 - protein, 1623 aa, Gottschalkia purinilytica
MRLSLCMIVKDEEENIVECLDRALKVVDEAIIVDTGSIDKTRKLLLEKYSEDDRVKIIDYEWENDFSKARNKSLQYAMGDWILVLDADERIFCNRNSLEKLLLENKEVVYSIPIYNIYGKDNFTVSTSMIRLYKNDNPIYKGAIHEQIFINGKQYLGGTIDKDICKIYHYGYDNGIFEAKNKSKRNMDIIKSEIEKDPKDPFNWYNKAIMEMIDGNFNSALNDFIKAHNLCNGIRKAYHNDLLIRMIQCMMMLKRYKDTISFIKTLLKDECINKMPDIYYYLGMCYKERKKYKKAIENFKKAIEIGDYYEGISKYGTGSFLSLIEWGEVLKINGRLDKAIEKYKEAIFNKNNPTMKGLEELKILLEENNMTCELKELEEEIEEIKETGTKTNNTEVKIELEKYKEEFKNNIQVLLEQGLIKEAKEMVLEFEKIVKNDVSVFSIKGIMSMMEGSLEEAERNFLKGLEIESFNVDILYNLAYLYESQGKITSAYRYYIKIQKSSSDEILLDEVKEKIKEYEKLNKIKDYKNRKKVLFISHIFPPLGGSGVQRSLKFVKYLRDFGWEPIVVTTGKTKFLLRDEEMISEIPEEVEIIRIDEVDKIDGRYSKKLIKLYSNIVNDNDLIKEYVHFISSSQEAYDNLILFPDQYIVWAKEVLEKIHDKVDFNGIDMIYTTSGPNSAHTIGYYLKERYSVPWIADFRDEWTNNPMMNYDKESIIYKMSFAFEQSIIHYADKVVTCTEISSDNYKRIFNLDNKKVDTITNGYDEDDFNNIKIQNYRDKFRIIHNGLLYGVDRKVDNFIKAIYNLIINGSIDKSKIEVTFGPTDDTERYKNILKDMKLEENIMFIDYLSHEESLKLASKSNLLLLVVGKSEKWKGVPTGKIYEYLRLCKPILALSPKESIVEEIIEKQNRGKNIEFDDIKEIERYILQQYNDWLNGKENSLEITDEVKIYERKLLSENLSKVFDEIHNIKNRRKLAFFCVKNGDSFLDDIITNLSREYEIKKIIIEKYEEFNLIDKWMQWSDICWFEWCDSLAEYGSKISIAKEKFIICRLHSYEAFTNNPNNVNWDNIDKIVFVAEHIRRFVIDKFDIREERTCVIPNGIDMKNWTFKSRNDGFNIANVGYIDYKKGPMLLLQAFKSIYDMDCRYKLYLAGKFKDDRDVLYFNQMVKQLGIEKNVFFEGWQNDLDNWLEDKNYILCTSVLESQNMSVMQAMSKGIKPIIHNFVGAKGIYKEEYIWNTIDEASNYIVSNNYDSKDYRDFIKNNYELSKTIKSIRNIINCTEDSVKEERDVEPLVTIGVTTYNCEKYLTVCLDSILKQTYKNIEILIVDDCSTDNTINIINRYKENHKNVISIYHDKNSGGASKGINEIIRNSNGKYFQWIACDDSLQPQAIETFVKFMENNDSIDYVYSNFNIIDKYSKIKEKCRYNELTSNEIIKHIFNTCSTPIPLNCLYRKSFFVDNEVNWIIYKGNDFSCDTINILNFIKNGIKIRKLEDYLVNYRIHDKNLSYNIEKRIYGSTTIIDYIVENFDEDIYLPNIEWSSIKNRKVYKSYIISRVFEEYIKNHLNGDLIPKYINNNKKDIERYMNYFAKRGIYYLEKFISYTNGNDSESERLKEYFSKYCLN

SEQ ID NO: 1428 - protein, 255 aa, Sutterella wadsworthensis
MNPDATLSAVVLTRNSSALLERCLQSLKFADELIVIDDFSTDETAEISARCGAKVVKHAMNGDFAAQRRFGIEQCGCKWVLFIDSDELVSDELAEEIKHVLQGGEKAAYLLKRENSFPHYDITHGSMRSDCVLRLFPKEGLKVEGRVHEKVSSPFPHKKLQGTLLHHPYENWSATIRKLDVYTEYLAVQQVEKRRKTGFFTGVFIKPTWAFIKVYFFNKGFLDGRMGVMFAVHHAYYTFMKYAKYYLLVNSGGKF

SEQ ID NO: 1429 - protein, 371 aa, Marininema halotolerans
MISISLCMIVKNEEKTLDRCLASIFDIVDEINIIDTGSTDATKEIARRYTTRIFDFTWIDHFAAARNFSFSKATKEYILWLDADDFFKEKDREKFRELKKTLDSSVDQVSMYYHLHYDDEGNVFSRIRRERLVKRARNYRWHDPVHEYLEIHGKIMDSDIAVHHGKLQFNKARNLAIYEHRLAKGETFSPRDLYNYGNELMENNRLEEALVQYEKYFAADSPYTEDNVSACGYAAHCCHLLGRGEEERQYLLKSFDYDAPRVEFCCRLGFWYHAHNKLEKAISWYNHATQIKHLHDWGMINEAAHTWLPHLQLTVIYGALGQIEKAYHHNEIVRSYKPNDHEVLNNKKKLEFYLEKGITVATRPETGGGKV

SEQ ID NO: 1430 - protein, 335 aa, Unknown
  Description of Unknown: Lachnospiraceae bacterium XBB2008 sequence
MITVSVCMIVKNESQVLARCLDSLRTIWDELIIVDTGSTDDTMEIARRYTDKVYEFAWTGDFSEARNFAIDHATCDYIYSADADEILEGENVKAFEALKLCLDPAVDVVQMYYGNQLDQGTVYNFDRELRAKLFKRLKPIRFKDPIHEIPDIDPIVIDSDIVITHRPTSMHAGRDLETFRKIISGGNKLSSRLQKFLDRELYLQGSVEDYESFAGYLKGVTCDPERTADEVIEACTLLVRYHRMRGEIPQMFDNVIKVMAHECNSEVCDELGAYYLSLGDYDNAAIWFFNAAYEVTPILGIKAGKETALLGLIDVYKALGNEEMVTEYTNRLKED

SEQ ID NO: 1431 - protein, 545 aa, Desulfosoma caldarium
MDKPVISLCMIVKDEERHLPQCLESVRGQVDEIILVDTGSTDATPRVAARYGAKVFTYPWNNDFAAARNRSLEHATGDWVLYLDADEELVAFPQGVSLRQMAASLKVDAYLVPIQNMKMDGSFTGHFAIRFFKKLEGIRFEGKAHESVGDWLLRHGARVERAPVVIRHWGYAIPEDRLQEKIQRNLELLVAQVEKNPNDSYAHYYIGMSLIGMGDHERAYRHLVKAHELGPTTPNMQSLVLNMLAFYHLHRKEYIKAEDLARQSLAITPLQHTAKVFLGIALYNQQKFREALPFLREAYQFQRLPLESRRSDLSIEHSYGENELLWAVARSAYEVGNFPLAYQFARRLEKVATGDGPVLVLQALCALALGAFHEASAGFIKARSVGASWTWIGAPWMYALLQLEQLDEARSLLENAGLAFFENKDSAKIFALFVDRHWERGCLSELTETLTRLAQLDAVPVEVLDALALSLIKQQRYKDAVSALEKMRHRDPRRPEIIRRLAALYARLGEKTRAAHLLKSMDAARFTAPGPSLSVSKPFERWAAW

SEQ ID NO: 1432 - protein, 349 aa, Paenibacillus rigui
MLVSVCMIVRNEEAHLQRALDSIPQSFETVVVDTGSTDKSVEIASNAGACVSHFEWVNDFSAARNASINHANGKYILIMDADEELEEGTEQRVMEYIDRFPDQAGTVTIENFIKGESHLHRMVRFFPNTKQYTFQGKVHETVYKDGKVALIQDTCIRVKHYGYEQELYNKGAKTERYLKLYHDHLQQFPDDGYMLYQLGKLHYSNSQLQLALDALERCLHLNEQDHLYYPVMLVMLGYVLKEMGHSQLAEELLEPFIYRYKEFPDLFFLLGLLAMDTGKVGNIKTYFLEALRIGDTLKYTSVKGVGTFKAAYNVGLYYELTGHLTNARLYYQKAASLGYLPAINRLQNL

SEQ ID NO: 1433 - protein, 273 aa, Unknown
  Description of Unknown: Flavobacterium sp. Root186 sequence
MNKIPISVIVSVKNEAQNLPSCMDKLKRFSQIIVVDSGSTDDTIIIAKAMGAEVLQFQWNGKFPKKRNWALQNANLLNEWILFLDADEFVTDEFVNEIEHKIQDPVYNGFTIRFENYFMGRKLKYGYGFQKSALFKKSKGAYEKIDEDLWSHLDMEVHEHPIIEGKVGIIKAKVVHKDFKNLEHYIDKHNAYSSWEAQRYLQIKKSENTLLSLNQKIKYGLLNTGLLPAVYFFGAYFLKLGFLDGKEGFYLARFKSHYFFQIQTKIDLIKNKN

SEQ ID NO: 1434 - protein, 657 aa, Desulfotomaculum reducens
MISLCMIVKNEERNLARCLNSAKDCVDEIIIVDTGSVDNTVNIAKKFDAKIYTYQWDEDFAAARNFSLSKAAGDWILYLDADEELEANCCQRLRALSNLPQYEAYYFQIINLTDGNDPLKHLNIRMFKNKPEYRFEGKLHEQIISSISAASPNQPPVVNSGITILHYGYLASEFIAKDKAQRNYRINKALVDKEPNNPFYLYTLGGSCVNLNDLEGATNYYLKALKNVSLQAMYAPSIFISLITCLLKIGKIVEAAEYIEKCKTHYPDYVDIHFIEGELYKRLGHVSRAILCFEKCLQLGEQKISKYTTRTGVGSFMPLFELAQIYIDQGDLKKALDYQIMGLKLKNNDMKQYLTLAKILKTALGNGQIVYKILKANIKHADKTAEKFILARMLYQIEEYELAGKLFDKIPVKSEEVAYYKCLYFIKTARHNEVTQTLKQINNIALYHDVLQELILAHWNSSPPLDASIYLEQQTDPDQELIKILSYINDRLFNCPTTCKFDINSEAFLLIMNKLLATKGFKLANDVLSLAGLDTTESKITYLSNSNLNNEKLELAARLALQELKQGSTHPDYYYVLGLYFLNNEDLESAHNMIHQALAILPEADQYQRLLKTIYRKQALQMVLKALENYPHNPRFNNCLIHLQKDLMTDTRLKGGH

SEQ ID NO: 1435 - protein, 642 aa, Anoxybacillus tepidamans
MKPLLSLCMIVKNEEKVLQRCLDSVYGIVDEIIIVDTGSEDRTKEIALQYVDRVYEFEWTNSFADARNYAQQHANGEWILVLDADEYVDRSNLTEMVKVLRQTNENTDAYDVTIYNFMGTYGERVLQHRNTRLYRNIPNIRYHRAIHEQLRREDGQPLNAIQGLLNVYHSGYMHQTITEKDKHQRNAPLIEKELQARENVAFDYFNLGNEYLSKGEIEKAIQSFLKAYKEKTDFRLSWVSFCIVQIVLCLKYLERFHDALNVIADAEKLYSITADFKYLKGEIYYLQHRYDDALLELNELVQNKDKYTHCVKTFEYLEYDPHMLLGHIYKHKGDIQSAIQHYTSALSVNNKSYEALYHVLLLLSRFHNEEEIIQFLEKRNWFESDQSILLLLRVVISLRLSTVAQFYTGKLKEKTIQKGFQIKINILQKKYGEALEEILKNSVQSLEMYIKTGSLDLYDVLVASLSTNKFEVVRLLFHLVSDEKEKEFLWFIMNEAEQASEPAFYIRLLERTLQLKEYNLFERLIQLKETFDQRIHIELGHLLHRYEFIELALDLYQCVDNVNELDAQSFINIIEGLSVKNQLTNAVQYGLQAISLGYNDFRLYKYVIELMKLCGMWEERKFIIRQALDIYSDSKWLMQQDI

SEQ ID NO: 1436 - protein, 621 aa, Caldicoprobacter oshimai
MKISACVITKNEEKNIARCINSYKDIVDEIILVDTGSTDNTVEVAKNLGAKTYYYEWNNDFAAAKNYALSLAKGDWIIFLDADEFFAEGHCYNVKKYIALLHRDEKYDGICCRMANIEENGEVKNYIVQIRIFRNHPDIRYENSIHESVRKRSEQLKVFFVDKEDILIYHTGYSSNVGTTKAERNLKLLLESKEKGYFPPHFNGYMSDCYFILRDWDKAIAYAQEYINGGVSFFGYNIKPYINIIEAMIQRGDDTELVIERIKEFIKKFPDNPTFYVFMADALYRVKRYTEAFEFYKKAAELNEKYNGIEINLAVNKRYYLYYKMGYICYLCNDYENAFTYFVESLKDKKHFYPAFMPLYMLVKYNSVQEKLTLFNSIYDLQKEEDVSFLTKAFAVLKDRDLLTYYEGIWIKKYDQRDLTIAYTLFSNGFYEKAFSKFMEAYKSGLFNDELRSITLAAYILSGYDYCSGHKIDSFKDEDRRFLELVFDCNHKKVSEEFNSIYLNVLKQMINVADDESLNRYLALAQFFEKPVWKDIFDIMIDNRMYASVLGVCDYLYSIKSEGADVQVEENELIFYMGLCYFKTERYSVAKEMFSLAKDRGYKDNDLKEFMLWTELYLQKV

SEQ ID NO: 1437 - protein, 260 aa, Vibrio breoganii
MATIGILLITKNADKTLRKCLDSVQNWTDEIVILDSGSTDNTLQIAKEYTKLVYKKTDWEGFGVQRQVAQSYLNTDWVFAIDSDEVVTPELKASILHAIKKAELDTCFSINRLTWAFGKYIRHSGWYPDRIVRLYPRTYTEYNDSKVHESVVIPTNTKVKKLNGDLLHFTMDSLSHYTSKTNLYIKSWADQREGKKSSSLGKAISHALFRFFKMYFIKLGFLDGKHGLLLAILSANTVFTRYADLWIRKIKRNGDDINLP

SEQ ID NO: 1438 - protein, 686 aa, Desulfosporosinus fructosivorans
MMVKNEDKNLERCLESLRELRMKLPCELIIVDTGSEDNTVSIAKRYTDKVYHHPWNNNFSEMRNISISYASGEWLFIIDADEELVAAEKLIQFFKKSYPKSIAGGALLVKNLTGNKVNKNVVVLNSSRVFRNDGAFHYEGSVHNMPIINGQILEIQASINHYGYDSTDQELMEQKFVRTSTILKRELAKNPDNIYYRFQLSVTYMMHKENNHALEEIEKAYRLMKKASDKKKHLYVYCQLARSYMKMSQYQKVEETCLEGIAIEEEYIDLYFYMAQAQGTHEKYEQAIENYSQYMKLVENFDNLAIKLNPVINHYTLPHMDEALYNVSVMLFKTDRFEQALNNVEELIKDNDSDVNLIVRAIPILVDACFTTQNFIRLRDILLGDLQARGLTLVEQALQRIEQDRKKLDKIVEKNFFQVFASFGDKYGILNKIRIMNNTGDTELADAISKFSNANDFNSLPDYYGDLIYNLIRLGRPEEVLGNLTELNAVRYLKYLSDEYGATVNDAILLYCGEDLESDFKKLRSKKMLLKYVLFSEECSDESYLSTFQKYLTSGTTYMQKIYTPLVLDQELIHDVKSVEEAFLLYMLNARSYKHGESGYVQYLKKAVTIFPEMNKGIKLLLQEIEEPANNAAKEMTDLRGELIQHIQTLLDTGEYASAKNILEEYEQICGADADSLTLKSQAMLH

SEQ ID NO: 1439 - protein, 371 aa, Paenibacillus peoriae
MTEHPMTISLCMIVKNEEQTLARCLDSVADLMDEIIIVDTGSTDQTKTIAARYTDRLYTFEWKDDFAAARNESFDKATCSYIMWLDADDVLLEPERERLRALKQRLSMDIDAVVMPLHLAEGEQGELLFTSRRIRLVKRERQYRWEGRLHEDLVIPQGQIVHSDVAVTHRRMQDHTLRNQRILARWISESGKLEGRLLYLHANECFDRKEYAEAAEAFNHLLEEPSGYREERITACARSAECYLHLGKPEQQLDSLLRSFRYGVPQSDLCCMIGDWFFTRNEWSTAAYWYEKALEQQHHLPGMRPVPLPCYSWLPHVRLSHCYAHAGKLDASYEHNQTALRYLPDDPHLLDNERKLREAISNSSPSARSSK

SEQ ID NO: 1440 - protein, 257 aa, Campylobacter sp.
MNLKQISVIVIVKNAEQTLLECLNSLKNFDEIILLNNESSDNTLKIANEFKKDFANLRIYHSVFIGFGALKNLALSYAKNDWILSIDADEVFENECINELKNLEFKKEDIIALSRKNLYKGEWIKACGWWPDYVLRIFNKNFTCFNDNLVHESLILSNNAKKIHLKNGLKHYACNGIESMIYKMNLYTSFSAKEKLKQGKKASIFGAISRFWLTFIKDYFFRGGVKYGYKGFIVALLNANGAFFRYMKLYELNHEKN

SEQ ID NO: 1441 - protein, 253 aa, Winogradskyella wandonensis
MIKLSGVIITYNEQRNIRQCLESLTSIVDEIVVLDSFSTDNTKAICTEFGVKFYEQKFLGYVEQKNAALKLASYDYIISLDGDESLSPELQKSIKELKSNWVHDGYYCNRFNNFCGQWIKYSDWYPNKKLRVFDRRKAKWIGINPHDKISLIDNTKAGKLKGDILHKTYQSYSEFNLKTEQFSTLAAQAYFEEGKTANIFKIVFNPTWAFFKAYVLRLGFLDGLNGFIICVQTANITFLKYTKLYELQKKSKV

SEQ ID NO: 1442 - protein, 626 aa, Anaerotruncus sp.
MKARVKAREGQLCLSIGMIVKNEEAILEECLQALEPLRRAVPSELIIADTGSTDRTMEIAEKYADTLFQIPWSGDFGAARNETLDRAQGEWFFYIDADEVLDADCEALIHLLQSEEAKKYQTISMIRYEYADSTRKEFTTTYYMRIHRRIPGNRFARKIHETLIAYSPIVQLPTLVHHSGYQKEVFREKQLRNRPLLEQEPGPMTPRRLRELSDTYAFDIPWEADRKKELLYQAIEMESQDKSLGMYPSVYTSLANLCLALKEYAEAERIAKQYLNGRAGKPPLMSDMEINYILGLSLHNQDAFSRAVAPLKQYQALYEQYHAGKLCTEDAGSVTLASAGKGEWMLTNFLLAFGYAKLGEYQTARAYLDRTDRKLLLPTHWKLSAAVDVIYAAESGDVSRLWETCHWLQQLPSREPLVESLQLFAQNAGQLAPAFDRYFEEFPAPPKDPGVCRAQLQLISTLWDVSDKNLLEELFPLVCRYIRWDAQFCRLLLRREVCTPENRYLLPGEYAFMLDAEQALALYDRQDREGYFCALQALLKQYPERSREISVLLSPIDESREQERKNREEFESLAQAVKTAFYNALQDGKQEEAQEILSRYQQLNGDDPELAMMRIMMVQPQGGALS

SEQ ID NO: 1443 - protein, 576 aa, Unknown
  Description of Unknown: bacterium HR19 sequence
MAKSSKGNTISVCIIARNEEKNIPNVLSSAKKFADEIVVVDTGSTDRTPEIAREFGAKVYFFQWCDDFSAARNESLKHATCDWIMWLDADDVIDDFNIEKIIELKKNLPPTKDSAYYFLIESKIIESKDSSSRNDAWYWYQLRLFPRHEEIKFEGRIHEQVIFSIEKLKIKQKYTTIKITHTGYHDPEKLQQKMQRNIRLLEEEEKSNPSFWIKRYLAFSYAKLGRIEDALRKLDEALSLIPQNAYMWLYDLHMLGVDIRRFIGDWDKVLYHLGEAEKVRPDEGALNLAKSEVFFVKGEFEKALDELEKARKKGFLVSLIPISPDSLKRKYFMGKARVLYHLKRYDESLRNFEQLVNMSPEYIIEVPQALDEFVDCAGKCEKWELIYETLKKIEDKLEPHHISNLAFASERLGKIEDAKNYYEKAYSMMKDENPDILFNYAHFEFMYGNDLSKTIDLFKRYLEVIQPTKENSVYILTALTALANIFLKLGEVKFSVELLSTACEIAGVKVVADSFSDLSYAWVRISEKFSNKFLKTVALQNATLLLNLSPEKETDKEVYDKIVAEIEKITSQVISQ

SEQ ID NO: 1444 - protein, 608 aa, Unknown
  Description of Unknown: Flavobacterium psychrophilum sequence
MGEKIRISALAIVFNEEHNIRQYLDNMSFADEIIVVDSFSTDNTPSIIKEEYPQVKFYQRVFDDFSSQRNYTLEFATNDWVVFFDADERVTQRGIDEIIATVNGNPEEVAFWFKRIFYYKGRPMVNNSFNKDRAIRLFRKSKCKYSEKLVHETLSINGKSGHLTESIHHYSFKSKEDFLEKRLQYSKLKAKELYQKGVTTNLYHLSVRPAFRFFKYYILGLGFLNGRRGMEIAGILGYHVYMRYVYLREMANHKDDPKILVIQQKMIGDVLASSIICANLKALYPESTLDYLIYPFTQPVVENNPTIDNLVLFDQKYRDNKWKFMQFVFGIRKKRYDIVVDAYGILGSNIIVGFSKAKTRIGFYKSYSSFVYTHTVQELKIPLSNAGLALDNRMQLVRVLEPSLPLINRPKIYLTQEEIDFGRRFLDEKGVAQGTKIYMISVLGSLNIKTYPAAYMAQLLDFISQNSEAVLIFNYIPSQQKEAEELYSLCSDATKQRIRMDISPGTIREFLSVLHHCNALIGNEGGAVNMAKALFMPTFTIFSTWIKKEAWNSFEDGTTTISVHLKDFKPELYGQSSPKEMKPKALELYDAFTPDLILPELKKYIEIN

SEQ ID NO: 1445 - protein, 342 aa, Unknown
  Description of Unknown: Lachnospiraceae bacterium 28-4 sequence
MITVSLCMIVKDEEETLGRCLSCLSDLVDEIIIVDTGSTDRTKEIAAEYTGKIYDFQWVDDFSAARNFAFSKASGDYIYSADADEILDEENRERFRVLKANMLPEVEIVQMYYTNQLKFRTVYNYDKEYRPKLFKRLRNFTWIDPVHETVRTAPVVFDSDIEIIHEQTENHAKRDLEALHRAAVRDGVLSQRLFDMYARELYLAGDEEDLNNAEGFFENICNGGTGSSEELKTALCIMVRIERKLGNIPKFFKYAAKAIAVGGVSELCLELGDHYMELEDYEEASIWFYNAAYETESIFDAGSRGGKALRRMAECCRKLGAPEKAEHYEKSAEEWEDKAAMA

SEQ ID NO: 1446 - protein, 355 aa, Ruminiclostridium hungatei
MIVKNEEETLARCLDTVKDIADEINIVDTGSTDKTKEIARQYTDRIFDFPWTNSFADARNESYKYATKDYILYLDADDVILEADQIKFKQLKETLDPSVDSVSMYYDAGTDEFGNVTLRYRNNRLVKRDKNFRWYGDCHNYIDVRGKTINSEISVTHKKIRHSVGRTVSIFEGKKARGDTFSPRDYFYFGNELRENGRYQEAIDNYNKNLELREGWAEDKIFACLYRGDCYRALGDKDNELTSLFQSFNYSAPRGEACSRIGYNFQKRREYKTAIFWYDLATKLVPDPDRWSFVYMAYYTWYPHLQLCVCYYNAGDYQKAFEHNEEAARYRPTDQSVAYNRRLFERIYPQKKDTE

SEQ ID NO: 1447 - protein, 365 aa, Paenibacillus antibioticophila
MITISLCMIVKNEEEVLARCLDSAKDIVDEINIIDTGSTDRTIEIAKQYTDRVFHFPWTGSFSEARNHAFTYATKEYILYLDADDVILEGDRQAFLELKETLDPAVDSVSMFYNAGMDEFGNVTLRYRRNRLVKTAKNFQWRGEVHNYLEVSGYVINSDVAITHKKTEHKVGRNLKIYETKIARGDTFSARDYFYYGNELRENGHYEKAIESYEENLKLREGWVEDKINACINMADCYRFLGNMQQEFASLCRSFDYSKPRAEVASRLGYYFYRKNDYHTAIFWYDLATKLPADTNQWSFSFPAYWTWYPHLHMSVCYYRLGLFKESYLHNEEARKYRPDDKSIVHNKKLLEEKLNITDEQEQLL

SEQ ID NO: 1448 - protein, 703 aa, Clostridium botulinum
MKLSIAMIVKNEEKNLERTLIPLKKLQDYIDAEIIIVDTGSTDNSVDIAKKYTDKIYFHKWNSDFGSMRNLSIRYCTGDWILIVDADEELYDIEELANLINSKILKKYYSAFIKIVDFSQSIQNSVSSGAISPLLRLFKKNTVKYEGIIHEQPICSEPTLDSQIRFIHYGYDNNNYELMEHKFQRNIKLLFKELDEKPNSIYVYFQIATSYLMHKDLQKALKYIEIAYKKASKKGLCNYIYVIDKYCLILYTLKSYDTLIYKAKEGIKYCDKFIDFYFYLGEAYNNLNQYDKAIQPYEMYLDLYKNRNKNDILAEFSISIFTIEYKNAVIYHLGLCYYQNKFYEKALSLILTIDDNNFMHDKITIICKIIEDGGLWNKFYILNNFIDIHNYDEILIFLHNNVFMENLIMINSQEIDGFLKEMLDIVIYFKNNGNINYKHLEKIKRIISRNKKLYSIYVYYVLKFDINEFDFFINYGKKELKNILSKLIFTYYDFGSYLENKLNNFKEYNTISVIKHNIIMEALLNSRKLQIDKRRILFLDFLADKFYSIVKLYKFEYICDNKWILPPKERFIIELKEAISYKYIDSIRYIKKIKDILNIDKSYVDYIKLLIEENEEFISNNKIKAFMPELVKNIEELINTKKYQEAYNTIEEALSLVKFDFDLMVLKYKLLVNFNYEKEAMQCLREIILYGDIERVTKLINNL

SEQ ID NO: 1449 - protein, 357 aa, Unknown
  Description of Unknown: Chryseobacterium caeni sequence
MKISLCLIVKNEEEVLARCLESARDFADEIIIVDTGSTDKTKEIAKRFTDKIYDFEWVNDFSAARNFAFSKATMDYQMWLDADDIVPEKSVQEINELKKTLNNDVEIVTMKYVLSFDQNNKPAFYSTRERLFKRSRNYEWIDPVHECIPLIGQLQYTDIEIWHKKTKLEALSTRNIDIYRNLENSGKEFSPRQLYYYARELRDHGRLQEAIGYYEKFLATELGWFEDIISSSYDLAVCYKNIGQRNKILPTLLKSFEYDIPRASICCELGYYYKDEGNYDLAFRWFDLATRLAHSTSVGFIHDDHTGYIPNIEACVCLCFLGDYQKADEYNERASLSRPDCSSVKQNREYLKTMLGH

SEQ ID NO: 1450 - protein, 662 aa, Unknown
  Description of Unknown: Peptococcaceae bacterium BRH_c23 sequence
MAVKVSLCMIVKNEGQILRRCLNSVSGLVHEIIIVDTGSTDSTCEIARQYGAIIHHFLWNDNFSDARNASLALAQGDWILFLDADEEISPESREILSRLVENETVEGYFVKIMNHLGKEGWIETVPDLVFRLFRNKKEYRFRGAIHEQIADVILEKNPQARYQVAEGLILIHHGYLDEVIREKDKKLRNLTLIEKELAQNPTNRLLQYHYGVELFRAERYAEAAAVLIKSANDLDPNTIYLPKLLRYIVMAQHSSGQLQEALHSATLGLKFFPNYADLYYYTGLILLDLKHYSQARNAFLQALSMPEQPPQYASFAGIRGFRSYYYLAQISESFMDEEEALKYYLYSLRDNPNFTHALESLVGILKPTKEPEYTMECLEKVCDFCTPAANRLMGDIYFRHGAYGLALKYLDQAEDGFPVSADIKLRKAICLIQERRFFEALRLLEDFPPESPEYPIATVNRLFYFWIQDKSQKVRTLWNELHAFGLAQDTENVISLFLAYSGKNAASPQIILGPEGMLLLLDIVQRLIAMREFNRAMYFLHSLHPNCLIEYYLKIAQLFIAYSEESRAILFLQTLIRTNPSAEAHFQLAEIYSQLGQLTEAENHYKHAVDIDPETPRYYIRLINLYTAWRRNILNEALAKYPENYVFKKLSEEVSSSHERAD

SEQ ID NO: 1451 - protein, 379 aa, Planctomyces sp.
MIVRDEETNLAGCLSCVVDLFDEIVVVDTGSVDRTREIAREFGARIYEVPWTDDFSVARNAAIDFAAGDYIFWLDADDRLDECCRRRLRSLFDGLVDTDEAYVASVRSNIPGAPTGFVVDQVRLFPRNDAVRWSGKIHEQILPALERVGVGVRWTDVIITHTGYSDPEVDKRKSERKVSLLLEELQETPDDPFTLLNLGRASIDGRLLDDALGYLDAGLASSKPDMPIRRNLYIAKALAHQLAGSLDDASAACREGLSSFPDDGELIFRDSCIKKLAGDLDGAEAGWRRLLRLERPRLFLCSVDGVYGHLPLRNLALLAEERGRLREAFRLWAEVLRECPRDRQAVEARLRVASRAFGTWKTRLVGMLKFKPSPPRIGL

SEQ ID NO: 1452 - protein, 697 aa, Unknown
  Description of Unknown: Clostridium sequence
MKGRMIMLLSIGMMVKNEEKYLDKCLASLIPILDNLDSELIIVDTGSTDKTVEIAKKYTDKVYFHEWNNNFSEMRNITLEYCSGEWFFCVDGDEVVENCDEIISFFKQKIYKDYKSASIYVKNLSSLDDEKDFSIFPSLRLFKKDKDFKYVNAIHNQPLYKEPIKVLATILKHYGYISTDEELMERKFKRTATMLKSELEKDPENIYFLYQLSVSYGMHKQYDKAVEYIQKAYDKYIYKKEDINKYIYLYPQLCLCYISINDYLNVKKYANECLKYKELIDIYYYLGMATMLLKDNEEADLSFKSYLKLYEDYYVSEKDVSIIDYTIGKVDEVYYCLYKLSREAGEYERAGNYLLKIEDVHQYDICGNIVDLYIETNEYHYLKEYEQRLLAEDDNNTVIKKFYSELEIKKLKLKNEEVGMLTELFVDGNTTYNYLNKIRLDYMKEKYIDIDLIHALLKKIDLQNQPFYFADLIYYLMINGFDISNEIIEFNFMKINEYFEYLKTKYNDFDEIIYKYILKFKENDEFIHVRINKELCRYIILLDKLEESKLIEIYKIYINIGVEYINYVYSKFMLENERWQEVRTEEEMFFVYMNKAKFYKNIDKKIYIKYLRKALSVYPYMNDLIRYLLDEEKRTIQKNDIELSEYKSKIKDEIKMFISNKAFENAELLIKEYEKIINNDLEILLFKSQVTSGKLKR

SEQ ID NO: 1453 - protein, 371 aa, Halobacillus salinus
MVTISLCMIVKNEEEVLARCLDSVKDLVDEINIVDTGSEDRTVEIAKGYTDRVFFFEWTGRFADARNEAFKYATKDYTLYLDADDVILEEDRKKFKELKENLDPSVDSVSMYYNAGTDEFGNVTLQYRRNRLVKTSKNFQWGGDVHNYLNVYGYVINSDVAITHKKTRHAVGRNLSIYDTKIERGDVFSPRDYFYYGNELRENGHHEKAVESYTKNIEHKEGWIEDKVYACINRADCYRFIENTEMELASLFESLRFSKTPRPEMCSRVGYNFQRKGEYKPAIYWYELATKIENDPNKWSFTYPAYSTWYPHLQLCVCYYRIAEFEKAYEHNEKAREYRPQDERVLYNRELLEKKLGLSQETGQQNDEPSE

SEQ ID NO: 1454 - protein, 554 aa, Ruminiclostridium cellobioparum
MKVKITACSIVKNEEKNIGRSIESYKSTVDEIIIVDTGSTDNTVEICEKYGAKVLHFKWNDNFSDAKNLAIEHATGDWIIFLDADEWFVPALKRSNVMNIVRQAGHVAEGFIFTMKQIDHSKKEECFVTDGVTRIFRNLPDIRYKGSIHERIKRGDRELILARCPDLFIYHSGYSSELLEQKAKRNLDLLNNVYKNGEKDTILYYFLLRENYSSHNYKDALKFVELFQQQDDVEHIIKNYSSAICFYEYAYGVMKNVPDEVTREEIMNLLNKAYEKYPEVPTHSYLLGREAMDNNLDEEAKTWLGKALELNKNYTGTFSNSFPSYISDTYFRLGLINQLKGKQEAALEYYVYSLKYAVVKKYAPIIQNTLSIIGKENEKEIIVFLNSILDIGKKEVLEEILSVLRNTRLYKAFLYYAVKYNREFDGQNENTYIAMILTGQAELAVDTAIKGSLNYKPDYNKGDQIYNGCSDSPEKYNWHLDYALMGILYCRDMELFEKYQLFFDDTTKEIIVAYISGNKITNLTNEILELHNKIFLLIFNIIPEKELAAFRGII

SEQ ID NO: 1455 - protein, 2439 aa, Unknown
  Description of Unknown: Desulfobacteraceae bacterium 4484_190.1 sequence
MNKMSGLIIIPKIYTKSYISIGRYLSLFNLIRDEYGFRIIFEDDYDPANITEDIVIVLKSPNKHYPYLMKSIRELPKGKKLITYVTDLHEQPELQKSFKYTEFHISMKKMFERSDKILCPYDYAFNTLWPEFVEKYEFFPHFLPDYEYFKNVQTNRTPIIKCLVSGAISVFPDYYPLRKYIASRNNDNITILKHPGYFRQDEEMLKSGGKIGIEYYNEINKYYCALATSSTLHYVVAKYLEIPATGSLLMANYTYDLDKMGIKKNEHYVEISKDNFFDVLDEVLSNTAKYDKIRENAKTYIFKHFNIRNRFDQFKKILEEMSMELWSRKSINNKTISCNTNQTDKKATRIKQDRNCPSEQDITKNDPMVSVIVPTYNRPDMLPDTINSILDQTYQKFEIIVVNDAGIDVENIVTSLNKYQNITYVKHAKNRGSAAARNTGIKLARGKYIAYIDDDDIFYPNHLEILVNCLTSSDYKVAYADAYRAIQVPKGDSYETVRKEIPYSVDFSRELLLCQNISPVQCLMHERSCLDVVGLFDETLITHNDWDMFIKLSRQYDFNHIKTVTSEYRTRQDGSSTTGRLLTDFLKTMKIIYRRYEGYVGGNLEIIKTQQKHIQDLEKAIKIKASGRLGSRKVSIIIPVFNQIKYTRQCLETLLANTPDDLYELIVVDNASTDGTKEFMKNLKTKVTTITNVENLGFAKACNQGARAASGKYLVFLNNDIIPLPGWLVEMLRVIESDEGIGVVGSKLLFPDGTIQHAGVVISSNGLPYHLYRGCPDKIEGANKQRDFQIVTAACMLIERKCYFDVGGFDERYINGCEDIDLCLKVRKINKRVVYTPRSVLIHFEGQSEGRQDEMNYNRRLLMGKWSKSIVQDDNYYLDQDGMKLIVEQDGSFKYVSLPNRSPIKTSIIIVCYNSLHDINKCIDSIINNTLLSYEIVVVDNVSLDGTQEYLRTLKNAKVIFNSYNKGFSTACNQGIREARGEFIVLLNPDTMVTKGWDAKLQSHFKEGVGAVGPVSNYVAGLQKYEIYKQEDLTGNIDINNLAEKLYQWNRGKVVETKLLIGFCMMIKKDIVDKIGMLDETLFLGSDDLEYSLRLRNNGYKLLVATDTFIYHKGQASFKTESSSKVERLTQESQDALYVKLEKMYGKGQVPSSMELWGMDWFKPNSRCKSDTKLTSIVILTHNQLEYTKKCIGSIFRYTDVPFELIVVDNASTDGTVEYLESKKRRAMADNRGQKTEKGGQKRDGGCQGIRIIRNKENRGFAAGNNQGIAAAAGAYIVLLNNDVVVTPGWLNRMIACVESFPEAGIVGPRTNFAPGRQCVENVPYDIETLEGLNVFSDRYAEQHSRSAERVLRVVGFCMLIKRCVIEKIGGLDDRYGLGNFEDDDFSLRATLCGFQSWIVNDCFVHHFGNRTFVGEGIDYRKTLRKNWELFKEKWDMPRDLPYGAYNLSQIGRSVFDVEKDYIPLKGETRREGGENESFEILPVTSAKGGVEVDQEENESHGVVSIIINLSHHRELAENCIDSIKKHTGLSHEMIFIDTDTAEPVPACVRRIVEENPDCHLMQAENNRGLAGFYNSVLAEACSGRHVVFMHSDLIVSQGWLEGMVECIESHEDSGVVGPMMNEAEGVQKDVLSDYADAEQFEAYSKSFRKRNRHRYVPVKSVSGCCFACRRTLLEKIGGFDEELGSEKGIVDDLCMRAAILGYRNRIASDVVIHHCNSTREEDRDIRSAMTVEDRKILLLKQSNMAKKDALRKRMLVCSAMEKADELWQKDDISGACDALVEVIRQVPDDQTPFYALAEMLMDAKRFMDAREVLDMMPSDGDEIRKLVLFGYCDEGTGRYDDAESCADRVLMIDPEFPEALNLKGMIAYRKGDAGTAEQFFRRAIHKAPHWGEPFGNIGFMKWAAGKKTEGLEYFEKAFVLTPAATDIFSNYHAAVKSVNAYERAESVFREACALYPNNRRIKYLFIDVLIQRKNYADAMEEIEDAIARFDMDEEMISAALEIRNRLDPSCPSELTGRMPGISLCMIVKNEAGQIGRCLRNTKPIVDEIIVVDTGSTDRTKDIATIFGAKVFDFEWGNDFSEARNFAISRASGKWIFVMDADEIISPQDYGILRQVVIDDTSSSEAYSFVTRNYNIRTDIIGLNYNDGSYALEEAGVGWVPSEKVRLFRNDPRIRFEYPVHEMVEPSLKRSGIRIKRCPVPVHHYGQLNEKRRAGKGEAYYRIGRRKLDETGDGDVMAIYELAVQAGMLEKWDEAIELWQMLIAINPKVPLAYVNMATAFQKIGDYENAIRTVSKAMTLDPRMKEAPNDYGLYQLYAGNIKEAVRVLEDTVNRFPGYLSAQFKLAVAYCCDGRKDKAMEVFRDLERTEMGAGLPVSCSTIAKKFLSLKQFENANAVLTAASELRSGDSEMALPRQSGDGGEGVLRVGGPAVPEALSASG

SEQ ID NO: 1456 - protein, 509 aa, Komagataella phaffii
MIMQLGLTSLAFLALKCDAYNIAPKIDTPNVEPFAPSGGLKLLAIVAIIWYVVVLLVAYYGFFEIMQKFSKRKTLPVPPQVEGVTILRPIKGIDPEMELCLQSAFDQDYPKFEIIICVESENDPGIGVAEALIRKYPHVDARILKGDSHNPDHFGPNPKVNNLAKGYSAGKYDIMWILDSNVWVCSGALSRSVDALNRSLDNGRSTFDFQTGKGRKVNLVHHVPMAISINPQTGTNLDEMFLFTSHSKFYISINKAALAPCVNGKSNLYRRSELDLAVKRLGKGSEPSLDGTTGILAKDAAYYGSKPGQGLRFFARYIGEDNMIATALWFQNGGRTGLTGDAAIQPLGGVNSTSLKNYLLRRIRWLRVRKHMVLEATLLEPTTECLLCGTFGTFAISTLFLQSYFNWKFFIFHLLVWMVTDYTQFHILLTNASQDTATCNVPYFAEPNFNAYGSPFESSNLRTFHRWVLYWLLREVLALPIWISAMLGTRIIWRNRPFRINVDLSAEEL

SEQ ID NO: 1457 - protein, 381 aa, Halobacillus massiliensis
MVTISLCMMVKNEEEVLARCLDTVKDLVDEINIVDTGSTDRTVEIAKEYTDRVFFFEWTGKFTDGRNESFKYATKDYILYLDADDVILEEDREKFKKLKETLDPSVDSVSMFYNAGTDEFGNVTLQYRRNRLVKTSKNFKWGGDAHNYLNVYGNIINSDVAITHKKIKHSVGRNLEIYKKKIENGDVFSARDWFYYGNELRENGHHEEAIKSYTKNIAMSDGWVEDKVYACINRADCYRFTNNLEKELESLYESFKFSKTPRAETCSRIGYNFQRKRDFQSAIYWYELATTLKSDPNRWSFQYPAYSTWYPHLQLCVCYYNLQDFENSYYHNEKAREYRPQDERVLLNKDLLEKKLNIKPAEESKKQESEEEQSSASKEDV

SEQ ID NO: 1458 - protein, 359 aa, Clostridium tunisiense
MITLSLCLIVKNEEKVLKNCLQSVYDIVNEIIIVDTGSIDGTINIAKEFTDKIYNFKWIDDFSAARNYSFSKATSDYIFWLDADDILKEEDRMKLKLLKENLDFSCDAVSMIYNYAFNEVGKPTLTFRRNRIVKREKSFRWIGFIHEYIAVEGKIFESDISVSHMRTHSSSDRNINIFRNKIKEGYILNSRDTYYYGKELYYNNLYDDAVDVLNKVINMDGWYEEKIQALICIADIYLYRKLYGKSREVCYKTFEFDTPRAEVLYRMALSYQEEERYLQAISWYEVITHIEKPKSDYGFIYDEYWTWLPHLQLCVCYYKVNQIEKSFKHNELAYKFNPFNKSILDNFEFFKSLGISSNL

SEQ ID NO: 1459 - protein, 488 aa, Clostridium sp.
MKSLSVCMIVKNEEKNIKRCLDSIESIANEIIIVDTGSNDETLNICSNYNAKVINHKWNNDFSEARNVSLEYATKDYILFLDADEKISKENLEKLKALLSSKKLAEGYFFRLTNIINGTEVGEYVVFRFFKNKRKYRFRGKVHEQIANCIQKHNKDKCIENIDIKIYHYGYDPNKVNIESKYKRNMGILNTYTEEEKDAYYFYVLGNEYARITDFKSAIESYEKSLDLMELKYNYVFYPYLILNIVKAYSNEKQFYESIKFIEKIRFSIPNFKDLYFMECLAYIECGKISKALECLNEYINCPVGNTYEYPHNNFEKIYDIKEMKKNLEQASTPNNNLLSALMIIDKYETSIINTIKSFNEIVSNFTIVTSNKCLEVTELKNIGAKIIYYDDKDLNLLIEKCKSKYIFMVDIGEICSTLSQKKIIELLSNTNEKFFTVNIVNIANNTNCKEVRIIKNENSNFINEYKYALIKNKNVVDSNIYIHKSFN

SEQ ID NO: 1460 - protein, 379 aa, Thermosynechococcus elongatus
MAPLLSLCMIVKNEAHQLRRCLQSVQPWVDEIIIVDTGSTDGTIAIACEFTPHVHAVAWQGDFAAARNAALAQATGEWVFYIDADEELVVTDAHWQDQLTAPGAHAINQWSLLRREQSSDRNWSEFWNVRFGRRFPDLHFAGALHEQLCYREREAVVGELQGVYLIHHNQQSQEQFLAKIRDRNIPILETMVQQGDRRLQNLVCLGDHYAACGDSDRSQAWYEQALEEIASAVEQGILPRETTWLRHLLFWVSYRAFEAKDYETAQYYLSYGLRFFDRYPPLLYVAGLFVFELGLPRGALPYFHRCLDLFEAGSYDRTEPFDRQWMTTQPAYSLGYTYMTLQERDRAIAYFQKTLKFNPDYPPAQMYLEQLLRASANQG

SEQ ID NO: 1461 - protein, 278 aa, Gramella sp.
MISIIILTLNEEQDLPICLDALGWCDDIHLLDSGSTDNTLAIAESYSLTLHYNAFSSFGQQRNHALDAIATKYDWILFLDADEVVTPAFVTAIKTQTAAADEAVAGFYCCWKMMLNGRWLKHCDNFPKWQFRLLRRGRVRFTDFGHGQKEGEIDGVLEYIKEPYLHFSFSKGWTEWFARHNKYSSQEAKSRLESNAPFKDIFASNTSQRNPALKAWLVKIPGWPFLRFLQAYFLNLGFLEGKHGYTYCVNMAFYEHLIKIKMKEIKYQSITKEKQTLL

SEQ ID NO: 1462 - protein, 351 aa, Clostridium diolis
MLSLCMIVKNEEENIKNCLSKVDNFIDEIIIVDTGSTDNTKAIVSKFTDKVYEFRWCNDFSKARNFSISKSSNDWILILDADEFITDFSRDKLHEFINDSLNQNKVGRIQRVNIMEDSSGNKKYVERVNRLFNKRYFHYEGIIHEQIVALDGKTYETGDVNITADHVGYTKEVLNRTDKLKRNIYLLKEAIKDKFDDPYLYFQLGKSYYMLKDYRTSIFYFEKALCFKLDFKLEYVEDLVETYGYALINSGRYADALVLENCFEVYSRFADFHFLMGLIYMNNAKFTQAVESFIECTKFKYSKVEGITTYSSYYNIGVIYEVLGFMEKAIEYYRMCDDYEQARNRLRGLLN

SEQ ID NO: 1463 - protein, 582 aa, Sporomusa malonica
MTGLISIAMIVKNEENMLRACLDSVKAVVDEIVIVDTGSVDKTVEIAKSYTDKVYSYSWQGDFSAARNFAIDQCSCEWILYLDADERLAVRPESLRELITSTTKEAFIVPLKNYCGPGCSDYNVIGVLRLFRNLPHYRFIGKIHEQIGIANQEVVGHSDFPVISHSYINTGRRQDKRRRNMSMLAEQLKHEPENEAFIKYYLGCEWLGLGRYLQAYACFRCAYEQLDESHIFFRSSAVRSLVACLRGMGRFEEALAICMKETAVYPEYTDLFFDGGVVLEQLGEYEIALRWFKAAVDLGAPLIVYQHSNGTEDFLSQYHLGHCCQILGKYEEAAEWYEKALEANKNYMYPLYGLFMVLVTKKSCEELLITFTERGYVSSYESRLALAALFFASSRPDLAVKVCSQAESQIIPSSDLAKYLLYSGHFKQALKMIEALQTRQDLNDAVLMKLEIICYIFLRELGAAKAKCLTMWRYGPLRADAMALLALVKRLGGSRLAISKKYEPVLVDSLLRIMADCVRSYGENSSIFIQVAKCCEEIMSDLEQGSKALLDFWQSEIKGIEMLLDVRYKSMRGLYVWQKAGR

SEQ ID NO: 1464 - protein, 364 aa, Unknown
  Description of Unknown: Lachnospiraceae bacterium MD335 sequence
MKFSLCMIVKNEASILRDCLDSLQDIMDEIIIVDTGSTDETKKVAESYTPYVYDYEWHDDFSAARNFAFSKATGDYIYSADADEVLDEENRTKLKALKRVILPEVEIVQMIYVTEQINHPTENFARDMRPKLFKRLRQFTWIEPIHETINTSPVVYDSDIEIIHRPQGSHSSRDFGVFERVIEEKSFLSDRLLGMYLRELYKAGTEKDLENARAFLEKSLTEKREKRNELLCRQIIAVLLKIYRQADDPVSMLKVSLSSEATVPSAEMCMELGYFFMKKGDFGEAAEWFSRAAFHCESEIDIASSGTSALMALAVSYRGLAKSPKLRALPQKEFEREHTRLTEKAAEYELMARSWKPAELELNT

SEQ ID NO: 1465 - protein, 666 aa, Phormidesmis priestleyi
MADPLISAIICTHNREQYLGAAIDSLLNQTLSGQTLSGQMPDAQTSDAQTSDAQMPAGYEVIVVDNASTDSTAQIARAHLAKFSDSSQSTYIQATYIYEPTLGLSVARNTGAAAAKGQILAYLDDDAEASTEWLTELVKIFEGNEKVAIAGGKVTLIWPPNTQPPSWLSKDLSSALGAYDLGDMPVSIQQPALTPRGLNYAVRKHFLQSVGGFDTHLGRVGTNLLSNEEQQMTRMALDRGWQVMYVPTALAAHNVSPARMKPGWFLRRSWWQGISESYREQASSTTGLWQLRSGGERLVRGVYKTIKYCHRPDQRFENLAYAYGQIAYLGSVIGSLTGASTQCPTPPSSPMTITPGSIPISVLIPAKNEEENLPACLASLVQADEVFVVDSQSEDQSVAIAESLGAKVVQFEFNGRWPKKKNWSLDTLPFRNEWVLIVDCDERITPESWAEIAERIKNPDLDGYYINRRVFFLGKWIRHGGKYPDWNLRLFRHAKGRYENLNTEDIRNTGDNEVHEHVMIPHEKVGYLKEDMLHEDFRDLYHWLARHNRYSNWEARVYYNLLTGMGDDGTIGANLFGDAVQRKRFLKKIWVRLPFKPFLRFVLFYILRLGFLDGYAGYVYGRLLSQYEYQIGVKLYELKFGGRLNIQSKPPESLPTQARPAEANLS

SEQ ID NO: 1466 - protein, 644 aa, Paenibacillus barengoltzii
MNNLISLCMIVKDEEKVISRCLDSVQGLVDEIIIIDTGSVDNTKTIARRYTKHVYDFKWGNDFSAARNESLRYATAKWILVLDADEYINSSDIEGLRNALRLTTTDKDSLKSFMLPIHNFTGRTVDPSRIMISQGARIFENHKGMYYSSPIHEQLTSDHYKITFQNLPYPVYHDGYTEIRVKGHNKSERNLSILESMKTEEKLQDPYFCFILGNAYISDNQLEKAGQLYRACLASSTPNHSWYIHLLDNLISTELKLENYVEAYQLIQQAIQQYPGISDYYCHLGLLYDQFGMFQQAIGYFEQALKCAETAVRQNRPYWNVQPSYGSTVPLQMLLKLHNQLGHKTDAVRYGVQLLQIQPRNYTVLQQVWELLIQAEQDNEAIIRLFQTVYPNASAIEYIALFLVALRTGSRSLSSYYYQKLTIQVSPSDALTYHLLQHEEKPFKLSIDMELDASPALIAAVVYNDPNYLSAITDTEGCESARELWTYHCDLQANPNSSPQLTDSASDLLAKTLLILLSYSYNDIYLHWLQSMATADTINKLADLMYEHGYYEPAIELYAILLDNGVLSPKSMINIGQWQLVGNNADDGYLFIDTAFDHEKDLSVIGWVFNYCSKKQYEQFLERYLDAFPHLIELPFLTQPTNKL

SEQ ID NO: 1467 - protein, 365 aa, Unknown
  Description of Unknown: Lachnospiraceae bacterium sequence
MEDVRFSLCMIVKNEEAVLKDCLDSLQALMDEIIIVDTGSTDRTKEIAAQYTDKIYDFQWCNDFSAARNFAFSKATGDYIYSADADEYIDAENRKKFQLLKQAILPEVEIVQMIYVTEQINHPTENFARDLRPKLFKRLRQFTWIEPIHETINTNPVVYDSEIEVRHRPQGDHSGRDFGVFSRIIEEKGTLSDRLLTMYLRELYKAGDEDTLVRARTFLEKMLEEAAARNKELLTRQIIAVLLKIYRLSDDAAAMLKTGLRSEITVPSAEVCMEFGYFFLKKEDYPEAAHWFYTAAFESESEIDIASSGTSPLMALALSYRRYAKSPHIRALPQEEYELEKLRLTQKAAEYEQMARDWKPQENGF

SEQ ID NO: 1468 - protein, 356 aa, Roseburia hominis
MATISLCMIVKNESAVLARCLDSIADLMDEIIIVDTGSTDNTKEIAAQYTSRIYDFKWTSDFSAARNFSFSKATMEYIYTADADEILDDANRERFLRLKDALLPEIEIVQMKYVTQGTFDTVLNAKKEYRPKLFRRLRTFTWIDPIHETVRLTPVTFDSDVEILHCPQSLHSKRDFSIFIKAFEHDGQFSPKIRTMYAKELLKTGDKKDFTDAKPIFQLIFDNDPADDARKEAACVLARIYRMEDNKNEFFKLTMKDMLTTPCAEICYELGTYFVGQRDYAEAVLWFYNAAYETESILDVHTSGDLPLLGLVECYETLLAGEEAKIPSDTALTIQYEMMLDKYREASRDWRMPEET

SEQ ID NO: 1469 - protein, 286 aa, Unknown
  Description of Unknown: Flavobacterium thermophilum sequence
MITISLCMIVKNEEDVLARCLDSVQHLVDEIVIVDTGSTDRTKEIARSYTARVIDFPWSDDFSAARNFSFSHATMDYIFWLDADDILPAEEQTKFLTLKRTLSSDIDSVTMIYSLAQDEYGKTISSVRRNRLVKRSSGFRWHGMVHEYLEVWGTILNSDITIIHQPNRCASDRNLQIYERQLAQGAEFSPRDLFYFANELFDHQQYERAIQYYEQFLQTKKGGWKIASPPAESWQTVFTHLVMKNRHCDMRSDRSNTIPLGLNAAAGWAITSFSASNIVLPPFGTI

SEQ ID NO: 1470 - protein, 605 aa, Paenibacillus sp.
MKYSIVLLVQHAELAEACIARIKQYTGGTYEIIAINDGGGDIVTRVLKRTQVHHLLTNHTRLGVAASYNLGAVIAKGERVVFIRDHIGVSEQWLFHLSDCLDNHPDAALVGPMSNDVSGMQRLPIPCETMMQLDRTARAMILTQSGCSQKVTRLLSHLLLMRKEVLEQLGGFDERFGLETYEDDDLCYRALQAGYSLYIAQDCFVRYTSPPSLFPEEPNWYSSQLTRNQAIAQEKWGIDVTEALMKWTYPVTVSLCMIVKNEEQTLDRCLSSVKGLVDEIIIVDTGSEDRTKEIASSYTDQLYDFTWVQDFAKARNYAFSQATQDYILWLDADDVVQPHDAEKLQRLLSAVQWDTDAVSMNYNIAFNENGQVTVSSRRNRLVKREKGFQWIGPVHEYLNVYGNIVASDISITHDRMHKNLSRNLNIYETRLAAGEAFNARDLYYFANELADHEQWERAIGQYEQFLKHTDGWVEDKIRACGRMADSFHNLGNIQEAKSQALQSFIHGLPRAENCCRLGFYCLSEERYEEAAFWYKLAADTPKPDMTNAIIDHDCWTWLPHLQLCVCYDRLGKKELANQHNEMAMKFIPNNSQVLANKRYFETVLS

SEQ ID NO: 1471 - protein, 358 aa, Natronincola peptidivorans
MITISLCMIVKNEENVIARCLDSIENFVDEIIIVDTGSTDTTKEIAKGYTDKIFDFKWINDFSVARNYSYSKATMDYILWLDADDVILEEDRRKFKELKQTLDPTVDIVMMKYNVGLDQYNKPTLSYYRERLSRRINNYRWHEPVHEYLELNGKIVNSDICITHKNEGTSSYDRNLSIYEQIISRGKKLSVRGLYYYARELYYHQRYDDAIEYFTKFLDTEMGWVEDNIYACYHLSVCYEYKNDRTNMLNALLRSFKYDNPRAEICCQFGQYYMEASNYESAIVWYTLATQLKKPTDNWGFILHDYWGFIPSIQLCVCYARVGNMQKAIEYNDKAAELKPNDPYVVHNRRYFEACLAI

SEQ ID NO: 1472 - protein, 367 aa, Clostridium fimetarium
MISICIITKNEEKNLEQCLRPLAKLNYEIVVVDTGSTDNSVATAKKYTNQVYHFEWCDDFSAARNFSISKASGDIIVVIDSDEFIVEFDKETVEKIFEQNKRVIGRINIKEKFGAKGEFEAVDHINRVFSKRYYHYVGRIHEQVGAIVNDTNTVRQCNRCNAFNNSVVDYEIVNLPITVLHNGYGGEELRLRKAERNIDLLNKELEISEDTYILYQLGKSYYMISNYQKACEYFSKGLEYDINPELEYVIDMVETYGYSLINTKQYKTALQFENIYDQFGNTADFQFLMGLIYMNNEMFEKAIEEFEKAIRCKYSRVIGVNSYLAWYNIGVILECLEYKDDAIMYYKKCGSYEKALERLTFFDSKNK

SEQ ID NO: 1473 - protein, 649 aa, Unknown
  Description of Unknown: Desulfobacteraceae bacterium sequence
MSGRVRKAKRKRESSKSPLLSLCMMVKNEEEMLPRCLESIKGSVDEIIVVDTGSSDRTVEIAKSYGARIYHHAWENDFSKHRNQSISYATGDWILIMDADEEFYSEDVALLREVIQRSNADFIYLQCFDMEKTGKPHGVFNQVRLFRNGAGMHYTRCVHNQLQAVGRGFYSKLRFKHFGYDLDPLKMEAKHHRTTSLLLRRIEKDPGDPFNHFQLASSYSMHREYHKAIEQGEIALLLRKEKDLRNAYFSTVYYTVAQAHFALGMLQEAEGVCLEAIDFFAMDLNAYHLLAAIRFKAEDFQKCKDASLRYLDILQKFEEDPSEMRGVYFNSYGKKHEIYYGLAFINFAERQFDRAEEYFDLAFQLQGRSMEKALEISRFYLDGKMERKAFQWIEKACERGFRDIVVMESFIARCATRMGWIETRKILEQTTGAFSEWPEYWALVASLCREGNDPETAIRYYKKSIDLNPSEHKVFMKSSDCYERRVDLANAVETFEEYLNGSWRDERNLLRMAGLQLRRQDFKTAAQWLKQIEGHDLDGQQEYEKKMMDLTVNWGVGDFDEFLRRLEEMMQALNMATAVTIDSAVQLGRILYEMTEVFCEKGFWQTAELGLRLALLIAPDAFPAERLESLLSSLPRSCGSDRDFLQRSP

SEQ ID NO: 1474 - protein, 360 aa, Ruminiclostridium sp.
MVTISLCMIVKNEEETLARCLDTVKDIVDEINIVDTGSTDRTVEIAKQYTDRVFYYEWTNNFSAARNESFKYATKDYILYLDADDVVLEADQAKLKELKETLDPSVDSVSMYYDAGTDEFGNVTLRYRRNRLLKREKNFQWYGDCHNYINVQGKIINSDISITHKKIRHAVGRTVSVFEQKIARGDTFSPRDYFYYGNELRENGRHEEAIKNYDICTSMKEGWVEDKIFACIYRGDCYRALNDTNNELTSLFESFKYAPPRAEACCRIGYNFQRKRDYKTAAFWYEQASQQVPDPDRWSFIYNAYYTWYPHLQLCVCYYRMGDYKKSYEHNEEAAKYRPTDPSVLYNKKLFDKMFNNNES

SEQ ID NO: 1475 - protein, 637 aa, Ruminiclostridium hungatei
MLQLSLCMIVKNEEQVLERCLDSVKDIVDEIIIADTGSTDNTVNIASKYTGHIYDFEWTDSFSDARNFAQSKASGKWILVLDADEYVDGDNLKEVKGQLCETSESIDAFSTTIYNFAGYSGEHIVQHRSLRIYRNDPNIKYVRTIHEQLIREDKEFKSDKSELIIYHSGYMDNVVKGKNKNSRNVKLIQKQTDVAGQAAFDYFNMGNEFLSAREVEKALEAFQKAYMQKADIRFAWVPLTVVQMVLCLIDLKRYNEALKVIYDAELIWNNAPEFKCLKANAFLAQNRRYEAKAELQELIENKENYKHFIRSIDYLEFHPYMLLGDIYNKEGNVSQAVENYAHVLSVNSRSYEAFYKLVSVLSKYCSQEELLKFINDNNLADEKKRMRLIKILLEISQLELAAAFIGSLKGNPGILVGIILKYKMLKDGYESARDYLMGIPEEDIVRILGEGFIDRIDLGLLYLVKREQEVYSKITCAFDDKSMLLFLKKCKVNTDSNKDLYLKLLERSIRYKWFELFEKLLSEKIGDDAGIELGIGHMLNNHDFRELALEFYERVGDIKRLDEKAFENIVSTLKEEGQNENAVQFALKAIDMGYTNFSVFMNAIQLLGEMGRKEIQKEIQQIAIGHYPDSRLLKDLK

SEQ ID NO: 1476 - protein, 1060 aa, Lysinibacillus timonensis
MTKRLSICMIVKDEEKNLRRCLDSLKPLLETDFVELIVVDTGSKDKTVEIAKEYTNRIYYHQWNNNFSDMRNISISYAKGNWILILDADEKISNINNLILLLEQKNLNQYNTVQFQINNILSMNEDIINTTTSERMFKNDGDFCYFGSVHNQPNLKRPILRSDIHIIHYGYINDDKDLMEKKFQRTATLLKEELKEDPKNIYYRFQLSRSFLMHGDTYEAYEEIKHAYNLVKLEQANKLKMYYYVYVELARVSFIIKRYQETVKICKEALMIKPNYIDFYYYLGYAHFNLKEYDEGIIALKKYFSLIQNYQDSLDEITSVELYTVNTRSKNLTALRLSQHLYNEGFYSESLTYAKIIDDKDLQNELFIKNLLKQKEFEKVVKLYNEVIDNNKFYFINKVEEEKKSLGEEDKKLLEVKFSEIQDSYGKLNLIRATKENRKKLILDFMNTEDVMEFSEQIILEYINYLIESSYLNRFFKKIDSLTIKKIVKVLIDKEDKMDYFMNILHNDFRFNDYQNNRIYLAIANVIMLSKIENRESTSEHIGKIFLEYINRGINYIKYVYNINHIRINYNTIINKEEKFLVLMYLAYEYADKGDYRLFFKYVNEATNNYPYLSKLIPEVLKKVYIKKAQNFVDSGEFLQAVETYEDIININVSGKEECISTIKYLEKKYRAQILEQLSNASVNKKIKGNYLFENVHLMIDSPYSENFIRFVNKHYNNSHHKFILVTNDGKCKFIKKNDKNLQLFSFKDKNTIIEILKNSNKIFVHFLLDYFCELISLPEIEGDIYWSIWGSDLYSTIDYQLYGTNTNEFLLSNSIPHISESVSFSVIRRRAIRKLNVILTNLPYEFDLVNKNFLTVARHERFIYPTLISNLYKNDQYKEKSCKKNKDHYTFLIGNSGDPSNNHFEVFNLLKKFSHHSKFKLIVPLSYGEPKYIEKLIEKGKEMFGDNFIPLTDFLPEQSYIEVLNEVDVAIMNHYRQQALGNIIVLLSLGKKIYLNDKSPVFQMLNERDFNIFEINKLENIQFNDLVKYNFDYKHNREKIIKEHIDSNIIKFNLEILFK

SEQ ID NO: 1477 - protein, 367 aa, Brevibacillus porteri
MSPPLLSLCMIVKDEADQIEACLSSVHMVVDEIIVVDTGSTDGTQDICRKYGAKVLEIPWENSFAKARNAGLQVAKGEWILWLDADEIVQEEKTGVLRQAVSASKGDAFFMKMIHYTGSQKVQASYHSAFRSGQIRLFRNKKGFRFVRDIHEVLQWPTTVSRDLAVPLLPVHIHHLGYMEDAVQRKQKALRNLRLLRHERKQSKQDPWCDYHLANEFFRAKQLEHAFTLVNQAMKGFLTTKQPPPSICYKLKFDILFQHGSMRGAWPGIARAIQIYPNYVDLHFYKGVFLLEHGLYAEAIKAFEYCLEIGDNQWEHFSEQGMGSFYAFHFLGRCMERMGKAHESLVYDYTASSLHASHFAQKREVVL

SEQ ID NO: 1478 - protein, 276 aa, Geobacter pickeringii
MSSRSHKPGLSAVMIARNAERYLSMSLRSLQRVCQEIVLVDTGSDDATIAIAEQYRCRIFHYPWGNDFSAAKNYAIEQAEYSWLLSVDADEVLYDKGSATLLASVVAEDAWPACVVWIDNLRDSGRTESHQALRLFRNDSRIRFANPVHESIGESLLKHWPDTVPPALDLRLRHYGYLAANAAGKHHRNLELMERWVAGEPDNIYARYKLGMTLAEMGESDAAYRQLRATYELFARCGDRQTYPFLKTFVGVFGRMLERRESSEEALRVRAVMARW

SEQ ID NO: 1479 - protein, 650 aa, Paenibacillus polymyxa
MKRLSVCMIVKDEEVLLARCLDSIKSIADEIVIVDTGSTDRTKKVAQEYTHLIFDYKWSNDFAAARNESIRHATGKWILVMDADEYLSLDDYNEWNHFLDREIPVENLAYTLPIINFTGEKEFQDEITTSPVTRLFPNYKGIFFERPIHEQLTRGSSKELFHKKLELNIYHTGYQEQRVVEKNKHERNMSIFNEMKKHQNMSEYDWFTLGNQYRYAKNEVEATDCYERALKGTSSKVAWYPHCLIGLISLYYKQDRLHLSWKWTEDKLSLFEDYSEYYAIKGIHYETLGFFEQAISCYLKAISIAEERAANQKEFWLVDPMYSFETPVQQLISLYFRLNDNQQAIYWLSILLNKNNKHPRVLLRLIEWLCQNESENTIIEFLNQHFNVEKKSDITLIYKVSLALGQDQMASYYLSFLKDDDSLTNSDHIRIAVMKQNKESWEEACSAVKKVTEGDKQQLWIQTVLGSLIWSDIRFLNSNYFGEDEDIQSVNVLISQIIKGEQIDDSQMLIEYSGSLFLVAKQLFLIKNYELFDNFVQAVKSAELINMLANYFYGLNLIEMAMNYYSVLLVERQLDATSLENLAFYHLNHGHYDEAKEFLEELVELQPKARHLYYFLIRSAGQHEKKLYIDKFISEFPDFSSISFVREFIN

SEQ ID NO: 1480 - protein, 254 aa, Bacteriovorax sp.
MMISVIVITLNEERNIERCLQSLDGLVDEIVVVDSFSTDRTQEICESFEGVRFIKNAFEGHIQQKNFAISHASHDYILSLDADEAISNKLRDSILAIKDNLGDYDGYNFNRRNWYIDRWIYHCGWYPDRKLRIFHKDKAKWGGVNPHDIIEVSPNSRTKFLDGDLLHYTYFSIEEHIAQQDKFSTIAAKAYFDMGKKSTMFQVITRPVLVFIRDYILRAGFLDGARGFMVCYINGLYAFLKYAKLRELWLKHNL

SEQ ID NO: 1481 - protein, 529 aa, Bacillus sp.
MRWAGKRNGTACKGGERMEKLRKLISLCMIVRNEEQQLPRCLKSVQGIVDEIIIVDTGSSDRTIEVAEQFGAIVVRAEWEQDFAKARNVGLARAQGEWVLFLDADEMLDAATGSQLREEADHEASGLFLQIWNVVGSSDDERGGTVHPVLRLFRNDQHIRFEGRIHEQIAASILRRWPEAVFRLTDAKIFHYGYRHDIVLEKNKLQRNMELLERAVLEEPNNVFHRYNLGVEFLRAGMPEKALEAFRFVKKQEGFGQLSYAHLVLKYEVRSLLSLHRWAESVDAATKGTAQFADYPDMHHYRSLSLAQNGQLRQAVHAAEKALQLGAAPPQYHTEDGIGTYRTSYMLGRLKEAQLDTQGVIRAYIASLRQHSSLMPPLYRLCRYLRIAGEADRLAAILAAQLACHNEEAVLKVADVIAESGCEQAAIEWVNWHAAQHSDEQRRRLEAWFERIGGVGDEEKGQKTERGLLRDQGQEQEQEPVQTPIGTSGLFSEMCLRADWHLERLQRSNKAVTALRLLLPCEEGWGPRR

SEQ ID NO: 1482 - protein, 339 aa, Mobilisporobacter senegalensis
MITISVCMIVRNEEAILARCLDCIKGIADEIIIVDTGSTDQTKEIAKKYTDKIYDFKWIHDFAAARNFSFSKATKDYIYVADADEMIDKENIERFQGLKQVLLPEIEIVQMLYTNQLEFGTTYNYDSEYRPKLYKRIRTFQWVDQIHETVEINPVIYDSDIEIIHKPSENHAGRDFRTFLTLLEKGERLSKKLVNMYAKELFIAGSDKDFIEAKEFFLNVLEDDERTMDEKKDAQCVVCKCCRIQDDIHNLLKNSIKGIADKNPSSEICYELGEYFYEMKDYKEATIWFYNAAYEAGSSLNIHYGGDYPLKRLSDCYRKIGDEEQAKIYEELAKEWSVK

SEQ ID NO: 1483 - protein, 344 aa, Dickeya aquatica
MIIKNEARHLARTLASLMPYFDDIVIVDTGSDDGSQAIARQYTHSVHDFTWVNDFSAARNASLTYARHDWVLVVDADEEIESIDIEALYALIKQHPKAIGRVERINYIDDESGQSTIRECINRLFHKNLYHYTGIIHEQVTPRKNHTQIQSFTTPITLNHVGYKKEILQQTDKITRNITLLKQALETEPEDPYLLFQLGKSYYLKRDYTAAIQAFQHALRFETNFSYEYMEDLVETYGYALINQGSYAEAMNILDYESYFSSTDFTFLKALILMNNGQLQLAVNTFLLCTSSPPGNKEGVNSYKANYNIGVIFECAGMQSQALEFYQKCGDYPPARDGIKRVTH

SEQ ID NO: 1484 - protein, 363 aa, Anaeromassilibacillus senegalensis
MITVSLCMIVKNEEDVLARCLDSVRDVADEIVIVDTGSADRTREIARRYTQKVYDFTWVDDFSAARNFSFSKAEMDYCLWLDADDVLEEPARAAFLRLKQTLPPSVCAVMMRYDTMFDASGTPVFSYYRERLVRNGKGFTWTGAVHEVIQFEGEMRYADIAVAHRKTRPADPDRNLRIYEKQLAVGKTLEPRECFYYARELYDHRRFEEAARRLEAFLDGGEGWRENEIEACRQLAACYYHLENEQKAVASLFRSFLYDTPRAEVCCDLGKYFLDRQKYQQAAYWYELALGCSRRDCAGGFISVDCYGYIPLMQLCVCYDRMGDRERARQYNERAGQLKPNDAAYRYNQALFEKQQGEQCHAK

SEQ ID NO: 1485 - protein, 342 aa, Unknown
  Description of Unknown: bacterium 0.1xD8-82 sequence
MVTVSLCMIVKNEEKILARCLDSIGDLADEIIIVDTGSRDRTKEIAARYTDKIYDFQWIRDFAAARNFAFSKAACDYIYSADADEVLDESNREKFRALKENLVPEVEIVQMYYANQLSFGTVYNFDKELRPKLFKRLRTFCWIEPVHETVRLSPVVFDSDIEITHLPQGSHAGRDLEIFYQIAAEGKALSCRLKNMYAKELMISGTAENFQKAERYFTQIADSEDTEPEQMKEAVCVLVKAARIRGDYLKMYRYAMKDIASEGVSEVCFELGEYYFGQKEYQEAAIWYYNAAYETQSILNIHSGGDFPLMRLADCYEKMGMYEQAKGYRQQAREWSRSVKEM

SEQ ID NO: 1486 - protein, 721 aa, Paenibacillus sp.
MYWCRSVFSNIHVFPTAPALSAHQAPSMCSSMDKAHNPFFCHIGTWGSLWWTSCTFLYWRWLRLQNRLLGIHMIVQNEEQYLPRCLDSLKHAGTEWFITDTGSSDRTAEIARTYGATVLHARWEEDFAQARNISLPLANTDWILVLDADEYVTQGLEELLNDLPKVHKSISSMRITIENLVGEAAEEKVISHPVRLFRAHQGYRYTGRIHEQLVRSSPRKANRDADTDTDIIIMEPHSCEEDLHAETEPLAPLCLVHDGYLASTIAEGNKPRRNLKMIERELADDPAQPFHLYNLGVTYCQLGQLEPAMDAFHESLRRTDVLAPYRPTLVRDYAKVLVGAEQYNAAYVLLAVERQRYPSYADLHLLYGVTLEQQGLEERAYQAYARASDCQKELGNTGHTEYSTSTPGAPYVTEAGSDGYRAYTPMARLAQKRGFFQEAVHLYGLALDSLFTYGPAWTGLADVLQQSGETDKKIAQILLSRARGIEGLDLSECSGHSGHGNGRHGSDRSDYSTADDPNVMTTDEHLTHMVYVLAGCGAYEQALNLLDTDARRARIHAADRMYWMLCAGKVSDALQLAENDWADVCVEQHTNLPLEHRINWGLACWGNELRLSDSFLVAMPPQEKDVWKVMDRLLNKLSNQLGPREPASEEQQLLQWSPQAQMVTEKIVEQAVKTGQLTLAEQLHELRAMIMRDHRGAPRRFGVSLQVCCIVTGTPWQPPIS

SEQ ID NO: 1487 - protein, 349 aa, Sporomusa malonica
MKISLCMIVKNEEELLRKCLEQIIPHVSEFIIVDTGSTDKTKEIARQFTSQIYDFDWCNDFSKARNFSISKASNDWILVLDADELVIEFDQNISASLAQIGELTVGRIKRINSIEDKWGPAWNTEKISRLFNRRFFHYEGMIHEQIVDKNGCNSYETISVGITVDHVGYAKEVVNKKDKLTRNITMLLQAIAEAPHDPYLHYQLGKSYYMAKDYQQAYDSFQTALSLPLNYAYEYVQDLVESFGYTLINIEKYSLALNIEQYSKHYQNSPDFNFLMGLIYMNNALFSKAVESFLNCTGMKEGKMKGVNSYLANYNIAVIYEILGYKKEATAYYRRCGNYELAKRRLATL

SEQ ID NO: 1488 - protein, 637 aa, Bacillus halosaccharovorans
MDKFISLCMIVKNEEKVIDRCLSSIKNLVDEIIVVDTGSTDNTKELVSKYTTNIYDFEWVHDFSAARNYAASKATGKWILVLDADEYVDEENFEVFIKELKKDNGIYDAYYAKILNFTGNLGEVLVQNFHDRIYKNNGEISYYRKIHEQFRNQTGQEIKYNNSNLLIFHSGYLKQTVNEKDKSNRNKKLLENEMKNKNAFDYFNLGNEYSSGGEINKALECYIEAYKLKSDFRLAWVSTTLVQIIICLIQLKRYNDALNVIHDAEKIYGDSPEFPYLKGEIFYLRGQMKDAKLLFSDLINNYEKYNHILFRPDFRDQKPYSRLGDIFLYEESYQESIFNFISVLNINKYNEDAIKKSIYILNRFHTVNEIADFLKSKNLINNKNITSYVRACYDIGNIELALCLLKQLKEEDGLLYKVGILKKIAIEGKGQFEDLHDILKVSVAKDLIKSNWINVVDLFLLRDILTEDEYFKKLMKELDIEDALKSLIDIKNGNTNLELLDKNLFITSFEILLNYKMYSLCTLLLKNVENIDSEVTTRVASVLFAKGFRVEALQLYDTGEWNNFIEQDFINIINSFLETNNKEYAIEVAQYGISIYENDFRFYAYILENVDTHQYIPTLEKAKSIFKVSYYLESIKH

SEQ ID NO: 1489 - protein, 356 aa, Subdoligranulum sp.
MDMNVKISLCMIVKNEEDVIARCLDSVSRCVDEIIIADTGSSDRTKEICRDFTDKIFDFEWTDDFSAARNFSFSKATGDYLMWLDADDVVSSENIGLLKELKKTLAQKNPDVVMCRYVTSFDENGTPLFSFFRERLLKRTANFKWEGFIHECISPRGNIIYSDFTVHHKKERGAGDRNLRIFQKKISQGVKLDARNTFYYGRELCYNKMYAEGAAVLERALDMDLKNNRNEACLFLYDCYNAMDEKQKAFLSLCRSLEKGPPRADILCRIASVFKARRDFETAAFWYDAATKCGDMSARGEFDRAEFRTFIPFVELSCCYFYLGDKKKALMFHEKAKSLRPSHPSVLFNERFFGAQ

SEQ ID NO: 1490 - protein, 642 aa, Paenibacillus polysaccharolyticus
MKRRVDLMDKTISLCMIVKNEQKYLEKCLESVKQIVSEIIIVDTGSTDETLDIAKKYTPNIYSFNWVNDFSVARNYAIEQAKSDYILVMDADEYFDADVNLQEELKKDYDYYVFNINNHMKFNQSFIHTAVRLFRNNIGLKYENRLHEHLNILDDNSKYRGVMSVSTIQHVGYMDEEILEEKKHKRNLPLMKLEVQENPTAYNLYNMGKTYFGMNDFKKAVTYFQKSYSLGKDKVYIPELLTKLSFALHETGQFEDAVGILVDATRIFPSETEMKYIQGIIYARNGYFKDAETCFHECIKLGDQGTMVTEGSGGYMAHLQLADMYEKTNQLDKSYLERINAMRVKGNTAHVLQDYLQFSLKINQSADECKQIIEEHYKLNTIEDLQNLMNTLYSLRHPLLNHYLSKFNITTEPHIHTIAKIYSKDKNLMRTALEDINNLGNRENIQDVLLMAYIFKDKSVMDKIQFAMNFGVKEMKIIKQLFEDEKLTGSITKPLQNVLFTLCKQLIMIEEFELFQELTQKLIDNDSKNVLNICKILSEYRFDELAIDMLVGVYRESPNHPGIVRLLGDLCFRNNYFEDAELFYTKLLNLDSSYETYERNFRLYENNNDQEAMMKMRKEMMEKFPSAAWVQPGYDTRILSSN

SEQ ID NO: 1491 - protein, 351 aa, Clostridium pasteurianum
MLSLCMIVKNEEKNLKSCLSKVAAFVDEIIIVDTGSIDNTKIIASQFTDEIYDFKWCNDFSKARNFSICKASKDWILVLDADEFVTDFFRDNIDKFIKNSLNKNKVGRIQRINIMEDSNGNKKYTERVNRLFNRNYFHYEGIIHEQLIALDGKTYETEIIDITVDHLGYTEEALNRTDKLKRNIGLLKVAVKNDSEDPYLYFQLGKSYYMLKDYKTSALYFEKALSFQLDFKLEYVEDLVETYGYSLINNGRYSESLILENCLEVYSKLPDFHFLLGLIYMNNAKFTQAIKCFLECTKFPYSKVEGITTYISYYNVGVIYDVLGFGEKAMEYYKMCGDYEPARNRIKAQLN

SEQ ID NO: 1492 - protein, 351 aa, Bacillus solisilvae
MIVKNEENVLERCLSSVSTIVDEIVIIDTGSTDQTKEMAKKFTNCVYDFNWINDFSAARNFAFSKATKDYIMWLDADDVITEVNAEKLLELKKTLTEEVDAVAMKYHLSFDEDGNPTFSSVRNRIVKRKRNFKWIGFVHEYLEVYGNIIHSDAAVIHHKDKDSSTRNLKIYEEAIASGKSLNPRDKYYYANECLDHGKYETAIEWYNKFLDEGKGWSEDNIQACGKMADCYLNLGDMDLATRSCLKSFTYDGPRGENCCRLGYIYLQQNDYHRAISWYKIATFVDIPEQKSPFINTACYTWLPHLQLCLSYSRLGDQETAKKHNDIAASFAPNNPSVKYNQAYFNSLFNEK

SEQ ID NO: 1493 - protein, 335 aa, Unknown
  Description of Unknown: Lachnospiraceae bacterium AD3010 sequence
MTFSLCMIVKNEAEILRRCLDPIRDLMDEIIIVDTGSTDDTKKIAAEYTDKVYDFEWNDDFSAARNYAFSFATCDYIYSADADEVIDEKNVEKFRQLKEALLPEVEIVQMYYTNQLEANTTYNYDRELRPKLYKRLRTPLWEDPLHEAVRVKPVIFDSNVEIRHCPVSLHSGRDFSIFRKIIKKDGDISNHLARMYARELFISGSDEDFLEAKDFFRRRMDKDSEEELVLMAACVVIKCARLLDDTSLMLLASSRALASEHTPSEAVFELGEYYRGRRNYKEACMWYYNAAFETEPLLNLKYHDSYPYLGLHISYVIMGDRENAAKFANYAKDLR

SEQ ID NO: 1494 - protein, 661 aa, Paenibacillus tianmuensis
MCLMTYYNSTVFFTGGTMEKLLSLCMIVKNEEKVLRRCLESVKDLVDEIIIIDSGSTDTTKEIALEYTDHIYDYEWTNDFAAARNEGIRRATGKWILILDADEYIQNEQHQELKDILRKHSHSPEAIGITFSILNYLGATEAESTGFMESHSIRIFLNGRGLLYKGAIHEQIVSPTGAFETYSHSFYIYHIGYTDQINQEKDKATRNITIFNELKKRNQLKTPYDDFTLANEYAKLRDLPKALYSYEKAYRRCKDKNNYWIPHCADRLITVYKILKKYKEAFQLTEECLERWSEYPDFHTIKGMLLDVFGFEKACQNKMEQSIRIAENLESQNEQYWKIHLDHGKFLPYQKLAEIYYKQRNLNKTVFALTKVLNIDRNQFQALYKLAHLLSLQEADKDTIAFFEKLYSSSKASNCLLLFQTFLLLGKGTLTQHYYNLCIEHKLLLSEADILRYYLLLNEPTSFQNKVLEMNFGIASDEACKLLLLAALTWQDPAYLIPLADLPEERARLYNLGQAIFGSQNEDILDHEDLLYTILIDLFTVQSYEAYDLLINQYVKPSLLNKLAHYFYNQNYIEMAINYYSILIENHEMEAMGYYNLSLVHLYEGKPQEGLHFLKQAIEIEPGHLPFYATWLEHCTDPELNAKYREKFNNLVPSCRHINFA

SEQ ID NO: 1495 - protein, 350 aa, Unknown
  Description of Unknown: Ruminococcus sequence
MIVRNEEAVLGRCLDSVADLVDEIILVDTGSTDNTKAVAAEYAAKIYDFPWCDDFSAARNYAVSQAVGDYWLWLDADDVIEGENHEKLRKILEAPEADMVFLPYWLSFDAAGTPQMISRRERIFRRSRGYRFTGAVHEAVVPSGSIRYGDAAVSHRKLHAGDPDRNLHIYQKLLLSGKRFSPREQYYYARELCDHGAYRAALPVLEQFLQEGRGWTPDNIGACLLAGRCYARLEQPDEAMQSLFRSFCYGIPQPEICCEIGGLFLERQQYPQAAFWYHLAIETGHQPHEGFWRQECCDYLPAIQLCVCYDRMGDISTAAAYNALAGSFRRGDAAVAYNRQYFAEKAARRK

SEQ ID NO: 1496 - protein, 618 aa, Paenibacillus flagellatus
MKTSIIIVTHNGLDLTKRCLESIRAHTPEEHEIILVDNASTDGTTAYIRTLPDVTAVFHSDNLGFAKGCNAGIGHSTGDNILFLNNDTVVTENWLGNMLRTLYSDEGIGMVGPVSNFCSGPQQVPAAYTDLDGLERFARERAKHHAGLSRRLNRLVGFCLLVKRSVLDDIGPFDERYGIGTCEDDDLCLRAVRQGYALLVALDSFVHHVGHAAFREAGIDMMGLIRENKRKAAEKWGGDIHELLLAEENGRKSITISLCMIVKNEERTLARCLESVREAVDEIVIVDTGSTDRTKEIASRFTHRVVDFEWIDDFAAARNFAFDQAAMDYILWLDADDVLLPQECAKLIGLKRSFDPTVDAVSMAYSCAVDEAGRGILNVRRIRLVRRSKNYRWHGAVHEDLTVCGTVLDSDIVITHRQEHGRTDRNLRIFEKLAERGAPLTKRDLFHYARELHTNRRYDQAVRAYLQFLDCEGISPEDRIFVCGTLADCYHHLGDCDRELDWAFRSFRYGMPRPPICCRIGYHFLNKDELQQAIFWYKLAVEAPPPANRWAIDNVPSRTWLPHMQLAHCYFRAGDYDQAYRHNQLALDFRPNDEHIRGHMKLCRERLGAQTAVDPTLA

SEQ ID NO: 1497 - protein, 386 aa, Rhodothermus marinus
MPHDEARPLLSLCMIVKNEAEYLETCLKLARPHVDEIVVIDTGSTDGTQDIARRYADVFEEIEWPNSFAAARNYSLDRASGRYILILDGDEYIADPQGWSLIRSILSERHIAALRLKLLNLLPLNSLVKAESVYQERIFPNHPILRYERKVHNQIYQNIVRYKNENGGFIIDVPVEITHFGYAHNYDKIIGKYTRRIPLLEEEYDQAANLTMKYYYAFQLGVVYFMLKDFEKAAFFLESIDFNQMGKDNMMNAFYSQVLLIQSYLELGEYNKALVCCNQLLSYRINEPVLYYLTGISLLLNDKVKEGISFLIESLELNMKKDKTRFLLNDRIVLKNLKIVFEKIGWADVANQISFDDKRYCGAGSKINGILKKIQYCILQTLPESQ

SEQ ID NO: 1498 - protein, 626 aa, Clostridium lundense
MYKLSICMMVKDEEKNLERCLNSLKPLLENNIAELIIIDTGSKDNTIEIAKRYTDKIYIHLWNNNFSNMRNISISYAKGEWILIIDADERLDNTDELIKLLINEKLKDFNTISLIVKNLYYEDNENKFSSLLSPRIFRNDGSFKYEGAVHNQPMCKRPNLSANISITHFGYVLTDKVLIRKKFQRTSSLLIEQLQENPNNLYYIYQLAVTYNMYGKDDKALEEFRKLYSKLRNNKKDFLYALAAYAKTAFNMEQYYEAIEVAKDVIKYRKDYIDMYYLLGMINVKIGNKEDGLKYFKEYLELITNYDNLEIAKDTKLISYFIDDQSISNASFELATYYIENGEVEQCKKYLNFIIDKYELCNINVKYLIAEKNYKSLVEYYNNLKDNNLKEYFAFSVEKILQNINKTDAYDIFYNLSNVNDEYGLLNKLRISNENKNTTIDNIIEKVDFKNCFTFYYDVFQYIDDFDKIIHYFKKMDIDDIRKIFKYLVNEHYNFNGKFEQYLINSNIRNNDIEGNKVYIAIAYEFIIDRIENYEKYYNVFQLYIDRGINYIKQIYQTDKARILYKNLSNNEDKLFILSFIANNYIEKGSFDLAVKYFKEALKCNGNLLSYMNLHMKSIFIDISKE

SEQ ID NO: 1499 - protein, 531 aa, Paenibacillus sp.
MAQASRLVSLCMIVKDEEEQLPRCLASARNIADEIIVVDTGSSDRTAAIARQFGANVIHADWEGDFAKARNIGVEQAVGDWILFLDADEELDSSACAGLRQTLRGTDAQGLFLQIWNVLGDDMRGGTVHPVLRLFRRDPDIRFEGKIHEQIAASVLRKWPHAIFRLTEAKIIHYGYKPDQVASKNKLERNMKLLEQAIREEPEVTFHHYNIGVEHLRVGNARQALGAFRTARRQADFAELSYAHLIVKYEVRCLLVLGLAAEAVQAAAEGAAAYPDYSDMCHYEAVALAEAGRLHAAAKRAERTLELGAAPPQYHTEDGIGTYRTAYLLGRIKEALLDGQGVADAYVLALHHYSGFNPPLYRLCHYMRKTGQQAELAQLLTTRLTCPAVEAVEKVAVILLATECEDAALQWLRQHKRLGGEFAALVGRFERQGAQTTRTTDRKERAAEWEGEPAGNGNGATGQIERDAGMAGGSAGAKGLLSEMCERADLHLERLQSMLGKSRRVGNGVSTAALAALRLAMPCKEGWDVPQ

SEQ ID NO: 1500 - protein, 356 aa, Roseburia intestinalis
MATISLCMIVKNEEAVLARCLDSIADLMDEIIIVDTGSTDHTKEIAAKYTSQVYDFKWTSDFSAARNFSFSKANMDYIYTADADEVLDDFNHERFLRLKNALLPEIEIVQMKYVTDADFDTVLNAKKEYRPKLFKRLRTFTWVDPVHETVRLTPVIFDSDVEILHKPQNFHSKRDFSIFIKNFQSGHELSPKIRTMYAKELLKTGDTKDFQDAKPIFQYILEHDLSDDAMKEASCVLAHVYRLEDNKNEFFKLTMKDMLTTPCSEICYELGTYFLAQKDLNEAVIWFYNAAYETESILDVHTSGDLPLYGLVECYELLLAEAKSNIPSDTMLVSSYEEALEKYRRESQSWTMPAEN

SEQ ID NO: 1501 - protein, 634 aa, Clostridium botulinum
MKISICMMVKDEEKNLRRCLNSVKPLIEKGIAELIIVDTGSSDNTVDIVKEYTDKVYFHLWNNDFSSMRNISISYARGEWIFILDADEEVENVEELRKVLFNEKIKDSNTLILEVKNIDTLKDKDNIVYSPSTRIFKNDGQFKYIGAVHNQPVYKEPTYNTKVSLVHYGYILGDKELMDKKFLRTKTILESELKKDPNNVYYLFQLGVSYDMHGDFREGLEEFKKAYNILKTMSNMEIYDRIYVHGAYARCCYANGKYNEVINICKQGIGYRDDYIDLYFMMAMAEKHQGDLKESKKHFLKYFELINNFHKIKISEDLNIILYNINIESKDNAYYNLSEIYMDEGDYEKAHEFLVLIKDKIKKNSLIPRVIVRLNDISKLKKYYNEIKEDKGLTNYFLSNLEVEINKLTEEEQYKIYRELGKLENEYSLYCKIKILKDEEKVIKAKEFLKTFDFRDKPLFYSQIFTIIFNDREFLFKCFKKIGLNDLKEIIKYLLDNYAESKRIFKELLLNCNIKCYDISGNKAYIGISYIILINEYQENKTIYDIDYEVFKKYIDSGINYVLQLYNMEKVRIIYKEVSSSEERFFMLMYLIKEHSLKNDIKSVVRYIKEALNCNKELIKYIGKYKDEILRDIS

SEQ ID NO: 1502 - protein, 245 aa, Sporomusa sphaeroides
MGVSAAIITCNEEANIKRCLESITWVDEIIIVDSGSTDRTLEIARQYTDKIYHQDWLGFAEQRNVSLTKVTGDWILIIDADEEVTPALRNAILHMTQAATNHAAFTITRKNIFMGKVLNSYVEKKLRLFKGGILTFHGQVHEAAIFNGSTGHLSGGTLIHHQYTDLEAQLAKMNTYSTLAARERYAANKKYGVLALVVRPLLDFLKRYILKGGFRDGMPGFISAVLRAFYTFSRFAKLYELHKKS

SEQ ID NO: 1503 - protein, 654 aa, Paenibacillus contaminans
MTRWFCFRVRPSCAKNGGRSRKRSAGSKRLSRFHAGSASKGCDFMHERPLLSACLIVKNEQRVMKRCLSSLKGVADEVIVVDTGSTDATVQICLENGAIVHHAEWEHDFAKARNTAIDLATGQWVLVLDADESILEPQGAKLRNLLNAETQAEGYFVKVINYYGYGHKVLGASVSSSMRLFRNNPQYRYKGKIHEQIVEPILQANPKAALLFTDLEIEHDGYLTEVVRDKGKSRRNIELLEREVEEHGDPFQRYNIAVEYIRAGEYERALKQLRLCKLADRFLLRSYAHIVMKREIDTLDYMGRYEEALVVCDEAARAFADFPDIFLSKGICSYRLGRWEEAETALTRALEIGEAPPQYSSNRGTGSYQATFYMGKLCERTKRYDDAIRWYLFTLRMKPDSLPPFLRIIRLLVRLAERSQWLAKVEELFTIDSARTWWSVALAFYQLGLYEETLKVLGERAMPEEKKAESDWLTIRCLFLLVDEGEKSEFAAQWTAAKGSPVKCVFYASLLSNDASAARASLPLLENAGEDPLTRALYRHLLADDNQLAVDPVLMTHISQQLWSELAFLHHMSRKHGLPMLAARIQTFWQAAIAFAPDPAKKIEGQFAWVRTLHVRIHQLILSAPQSSVSAEMWNETSDYLMPLIDDLFLGETV

SEQ ID NO: 1504 - protein, 656 aa, Desulfotomaculum hydrothermale
MISLCMIVKNEEHNLARCLNSVKNCVDEIIIVDTGSTDGTLTIARQYGAKIYHYQWDEDFAAARNYSLEQAGGEWILYLDADEELEPNSCERLRALAADPLYEAYFFQIINLTDNNAPLKHINVRMFRNKPRYRFTGKLHEQIISAIPPRSGRPPVVNSGLCIIHYGYLAREFLIKNKAVRNHRINQRLVEEEPDNPFYLYSLGGSCVNLNDLTGAITHYRKALQHVNLRAMYAPSIFISLISCLSKTGRLVEAAEYIEQGKTHYPDYVDIHFVEGEFYHRLGHLQRAVACYEKCLQLGEQLAGKYTSRTGVGSFLPCFKLAEIYQQEGRLKEALAYQIAGLKYQPADINQYIALARLLQQAASSRQQLYEILKENIKHKDQVARRLLLARIFYEIGEYEQALELFNELPDDRQETAYYKALTCIKSGRRAAARQSMAYIRQSHLYESVLAELLPACWTAAPPEDVLPYLEHEAWPAPEHRSIILNINHLLLDRPAASEINLHNYYVNQIVNQLLAQKAFSAVDKILNQGGLTAAADKINYLMQDDSNPCRVEMAARLALAAVKMGSVQPDWLFAWGKYFYHNNRLATAQAALQQALRLHPRNGRYQQLLIFIYGRQTLQMVQTALRHYPANPQFTRRLIELHEFLNLDAGLKGVH

SEQ ID NO: 1505 - protein, 650 aa, Paenibacillus sp.
MKRLSVCLIVKDEEELLPRCLDSVRNIADEIIIVDTGSTDRTKEIASEYTNLIFDYHWTNDFAAARNVSLQHATAKWILVMDADEYLAVDEHNQWIQFLNDEKPLSYLAYTLPVVNFTGDKEYQDEISTSPVTRLFPNHMGIHFERPIHEQLTRGAQEELYHKKIDLIIYHTGYQTQRVNEKNKHERNMLIFNKMKRNSQMSEYDWFTLGNQYRYAQDEVQALECYEKAIQGTSTTLAWYPHCLIGLISLYYKQDRLVDSWRWTECKLSEFPDYAEYYSIKGIHYETLGFYSEAAEQYKKAVEVAESRAAKSQEIWLVDPMYSFEMPVQQLVNVSFKINDNQQAIYWLSKLLNKNTKNPRVLLKLVEWLNHNEQPESIIHFLDQIYDRHNKAEANLLYRVSLGLGRKELVDYYESFIDQEDLSLEDHLRLSIVKYNHDMWVKYSMMLIEEGDIEQLWIQIAVGSLLWKDNKILKMAIDLRKTEDKFKRLLSLIASITSEEEVRDLLLTEYADDIFLIAKQLFILEQYECFDQFIQSTQTPELVNQLANYFYGLNQVETAMSYYSILLSQQQLDETSLENLGFYHANHGYSTETVEFLGEAVRLQPKARHLYRTLIQHTSSGCKTTLIERFLKEFPQFSSISFLKGFLNMK

SEQ ID NO: 1506 - protein, 357 aa, Blautia hydrogenotrophica
MFTISLCMIVRDEEGTLRRCLDSVKEVVDEIIIVDTGSRDHTAEIAREFTEKVYEFQWIDDFSAARNYGLERATQDYCMWLDADDVLKPEEAEKIQRLKEEMPVDVDVVMMKYAIAFDEWDRPTFTYYRERLVRNGDRCRFAGRVHEAITPFGTVKYEEIYVEHRKVKASDSNRNLRIYERMVREGEILGPRETYYYGRELYDHGRWRKAGRMLREFLKMPSGWEEDKKEACRLLAVCYYKQGHREKGLHSLLRGLAYGAPRPELCCDLGGWFLEEQMWETAVYWYEQALQAPRPEKGFCRENSRGYLPCLQLCVCWYRLGNYDKALYYHKEAGRWNPRGKEYLRNVPFFENLAYCK

SEQ ID NO: 1507 - protein, 358 aa, Terribacillus halophilus
MHTISLCMIVKNEEEVLAGCLESVRDLVDEIVIVDTGSTDRTKEIAAQYTPRIFDFEWINDFSAARNYSFSKATSDYIMWLDADDVLLPKDQEAFRKLWKELADEVDVVSMFYHTSLDEKGNPLYLYRRNRIVRRSKNFRWHGAVHEYLEFGGNIVASEIAVTHRKNKKTHTISDRNLRIYESYIASGRSLTPRDMFYYANELKDHGKFDLAKSYYTDFLHSEAGWVEDNIRACQYLADCCKAEGDMEGYRMHLFQSFRYDRPRPEFCCLIGDLLTEDRNYEAAAYWYRQALDYEGKELPGFSVPAYTTWYPYLQLTLCYSRIGLMEEAKLAHDKAVSYHPDHPSILHNTAFFEKFKL

SEQ ID NO: 1508 - protein, 600 aa, Clostridium botulinum
MPLSLCMIVKNEEKNLERCLESIKDIVDEIIIVDTGSIDNTLKIAEKYNAKIFFYKWDNSFANARNYSLSKASKDWILIMDADDELKSEYKDNVIKLINNENNKVDVYYGETLSYVGNYSDNNILSSVNIRLIKNGKGYKFSGDIHEQITPGSEAADKQSFMEIVDIKYYHYGYLDKVVNEKNKRKRNMDIIQKNLKENPDDVFMLYNMSTEYIAKHEYAEALKYLEKAYKNFDPSFVFGFKLILKMIVCNEMLQQFDDCLTLIEDGLKYYPNCTDFEFYRTNIFFTQKQYLPAIESAKKCISMGDSPVLLRECLGAGTYRPYYLLGIIYSNIGDYDASYKCFDEVLKLNPKFSDAIFKISGIMAMKNIAIDEMQKKLESYFDNINQETNLLLSKVFYTQNKFDIAYNYADKAESFDENLLEIYFYKGIYLFYLGNYNESLEYLYKIKEGKYYNDVVYCSILCELFIKNYENVDNLLTITQSFNNSEETMVYETFISIIKENKHIQLADTKENSKKFIKPIFNLLEILLRANCFEQFDKAVQLLNLIHDDSLLLLLGKLYYKYGYSNFAYELFIKSIKMYEIIDADALYMMQTTLLSKKD

SEQ ID NO: 1509 - protein, 260 aa, Halapricum salinum
MTDVSAVILTLNEGDFLRDCLESIVDLVDEIIIVDSGSEDDTVEIASEYADTILHETTERGEGFDILRQYGIDAANNKYILDIDADERVPSPLADRLREIVESERYDVVDIPRKNCFFGKWAKGAGWWPAYNPKLYNKECVEITNELHNFIDVVPDARRGKIPDEEQYCLVHINYRTIEDMIDSMNRYSTIEAKERDFSTKMVLWDPIFEFTVRFVYQGGWRLGYFGLILCLLRLYYNLILGMKCFARHRGWYDTSSRNG

SEQ ID NO: 1510 - protein, 369 aa, Bacillus alcalophilus
MVTISLCMIVKNEEEVLARGLDTVKDIVDEINIVDTGSTDRTVEIAKQYTDRVFFYEWTGNFAAARNESFKYATKDYILYLDADDVLLKEDQKKLKELKKTLNLSVDSVSMFYNAGMDQYGNVTLRYRRNRLVKRENNFKWEGDVHNYLNVYGKIINSDVAITHKKLKHSVSRNLSIYKEKLERGDVFSARDYFYYGNELRENGFPKEAIEAYEKNIAKKDGWSEDKFYACLNKADCHRHLGELDKELESLFQSFAFSKTPRPEVCSRIGYHNQQKGEYEHAVYWYEQAIELKPDLNQWSFSYPAYSTWYPHLQLCVCYDKLGNYNKSYYHNEKAGEYRPEDPSVLHNKAYLESKLGSKKKKVKSKKRK

SEQ ID NO: 1511 - protein, 670 aa, Unknown
  Description of Unknown: candidate division KSB1 bacterium sequence
MKKRKPLKLAKTTSRLSVCMIVKNEEKMLPKCLESIREVADEIIIVDTGSTDNTVAIAESFGAKVYFHPWEKDFSKHRNQSLSYATGDWILQIDADETLEPESKNELKRLLRQAPKDVNGFFVQIHDYRSNGQKNVVFNFARLYRNGVGVHYEGIVHNQVIIPGKVLFCNVRLNHYGYDLEPEKMKWKYKRVLTLLKKQLKQDPKNSFTLYNLANTYSMSGKPEKAIFWGEKTLEVLRRQKRASLLYVGVYYPIITSYIHLKNYQKAREYCQEAIKIFPYYLDGYYQLTRVDFIEQKFTDVLRNAEKYHRVREYLLADLSRIEFLNLYTFSLDFRVNYWMGVGKLGLGAPAEADKFFQKAFDSPLFDKSLALEMIHNISIVERGEILYTWLQKVVDRFKNNQSFVFDLLHDLKLNHGAEVLRPFFERDKVKHQFQTTEFLHATWHYFHDELASAEKLFQAVPSDSPYFLDAQIKLVLIKRNLNQIPQAITICRKLLDSDMEKQTKVSINIELVKLLLDNQELEEASRQWQNVWRLNKKSREVLLFGIEIHWKTGQYELAVNFAAKLLEELGLPCPQQLDSLEEFADLLDRIGKRLLQYKEFDLAERAYQIATLVHPDHLPANLYLARANLKQKNYSQTLQHLQQVLMLEPANRDALNLLREINFSVGSPK

SEQ ID NO: 1512 - protein, 359 aa, Anaerotignum lactatifermentans
MATISLCMIVKDEELTLERCLQCAKGFADEIIVVDTGSVDRTKEIAEKYADVVCDFQWCADFAAARNFSFSKATKDYCMWLDADDVVPESEQKKIVALKEKLEKTKADVVMMPYDVAFDASGKPTFSYFRERIVKNTGRPLWEGRVHEVITPYGNILHEDIHVEHRKEKAYDTDRNLLIYEKMRAEGCVFSPREQFYYARELYYHGRYEEAISEFRMFMGREGAWLENKLEACRQMAVCYGQLQKPQEQLEALFYSFTLDLPRAETCCDLGRYYFDRQAWREAAFWYETALRVEKRKNGGGFIREDCYGYLPCIQLCVCYDRLGRREKAVSYNEMAAVFKPEDRAVTYNRAYFANVSKA

SEQ ID NO: 1513 - protein, 357 aa, Brevibacillus centrosporus
MRISLCMIVKNEEEVLRECLESVSGIVSEIVAVDTGSNDRTLDILKEYGAKIKKLAWNHDFSAARNASLSEATGTHILVLDADERLLSSREELEAILQENPHVPLQVLCKNDLDGEISTHRVVRVFPNDPELCFQGAIHESIHRDGKQVSGCPSSLVIWHVGYQKERYEKRNKKEFYLTLYEKELKTRGEDGYLLYQIGKLLYSTGDYSEAIQYFQKCMEHGEEKSLYFPAMLVLHGYTLKHAGRSVEALELLVDFIDTYPDYPDLFFLMGLLSLEAGLLENTELAFLQCVEIGETQKYSTVDGVGTYRAYHNLGVFYEVYGQKKNAIDWYSRAADAGYRPSAERLIEYGNILKKNM

SEQ ID NO: 1514 - protein, 639 aa, Geobacillus kaustophilus
MKPFLSLCMIVKNEESVLRRCLDSVRGIVDEIIIVDTGSTDRSREIASEYTNWLFDYEWNNDFAGARNYAASKASGEWILVLDADEYVDRYNLKQAIEEIKRHDNQFDIYAVNIVNFTGQNGEITVQHQHSRIYKNDGTIQFYRSIHEQLRKKDRQANIGLSSLIIYHSGYLVHTVKTKSKYERNLPLVQKELNRLTNIGFDYFNLGNELKRLGKTIEALDAYIKAYQNRQEAVYGWVPFCLCNMVDCLMELHRYRDALDIIYDAEYIYANVADFVFLKGEIYLQQHRYDDAKSVFIEIVSNKQNYNQVVRSVDCREYFPHRRLGRIYELEGNYEQSVVHYIKALNFNRFCLESFIRLVQLLDKFHSEKEIYDFLSKQLLIDNKSFLQKVLIFFVNQGWFELSRSLARDYFQEQQIVYRLIDLKQDIMNGNMRKYENVTGIDSSLFLHGIHLGIVDLADLLIMYKHLNDSFVKRCIQVIIASTNIMPIVECLETGDSSLQIEEGVYLYVLEKSLKLQKQSLVRELLDIRHAVDKGLEIKIARIFYEAGHTEEAMSFYRQVNSDCWSAQDYVHIIERLLSQSKYQEAYIMSQEALKRFQDDFRFYKYVILLGDSTSSYLQEVKLNAFQRFPQSEWLRKHI

SEQ ID NO: 1515 - protein, 359 aa, Bacillus megaterium
MKISLAMIVKNEERFIKRCLDSVKSLVDEIIVVDTGSTDNTLYIIQEYSSVKLFHHTWNNNFSTARNFSLSQCSGDYVLVLDADEYVSVGDRQELEIIMKSNVIGRMKICSPFKKEGQTFTSNSYVSRFFPKELKYKGIIHEQLDSDLSRQKMNFEIEHSGYMDVRKDQRNIPLLLKALEQEPKDSYYMFQLGKEYRIVENYERAFHILNESYSLLTGEEEYYTDLVVEFIYSGKEIQNNSISKRILGVIEDNEEHLKKVADFHFAKGLFFLDYSLKLRNRGFAYLPAIEQSFLKCLQLENSSHVESVVGTGSFLAAYNLGVFYEVIGKIDEAEKYYLLSFERGYIPAQKRLNVLKVSK

SEQ ID NO: 1516 - protein, 251 aa, Unknown
  Description of Unknown: Verrucomicrobia bacterium Tous-C9LFEB sequence
MKISACLITHNERDNLDRCLSSLRPVVDEIIVVDSGSTDGSQDICRSYGAHVTEHKWEGYVAQKNLAISLASNKWVLSIDADEELSPGLSSAIEMLRENPPEEDISGYEISRVVYYRGEWIWHGNWFPDRLVRVFQKDRARFAGGSVHERLEIDGTVKRLPGYLHHYTFVSMEERRGRIQNYANLWAANAIAHGRRAWPWSAPLRATWRFLRGYVIRRGYLDGSLGWEIAVSNAEEVYMKYQSLRRLQQRA

SEQ ID NO: 1517 - protein, 351 aa, Caloramator sp.
MISLCVIVRDEEKNLDRCLSSVNNFVNEIIIVDTGSKDNTKYIAKKYTDKIYDFKWENDFSKARNFSIEKANYEWILILDADEIITKFNRQEIDNFIKFKKDVLGRIDIINLISDKNGVKKSKQRVARLFNKNYFRYKGKIHEQLEKKDSDYLCMEDIDIEVEHVGYDKKINNLRYKLNRNIELLLVEIENNDTDPYLYYQLGKSYYMGEFYDMAEKQFEIAIKYVTDYRYEYIEDLIETYGYTLLSLGKYEKALKIIDYESYLCDSADFYFLKGLICMNNGYIYESIKSFEIASNKEKYKVEGVNSYLTFYNLGVIYECLGDINKAIEYYNKSGDYHLSKSRLDKLMTKV

SEQ ID NO: 1518 - protein, 362 aa, Ruminiclostridium papyrosolvens
MISISLCMIVKNEEETLARCLDTVKDIVDEINIVDTGSTDKTKEIASGYTDRVFDFPWTNSFADARNESYKYATKDYILYLDADDVILEADQVKFKELKETLDPSVDSVSMYYDAGTDEFGNVTLRYRRNRLVKREKNFRWYGDCHNYIEVSGKIINSEVAITHKKVRHSVGRTVSIFETKKQRGDAFSARDYFYYGNELRENGRYQEAIESYDQNLALKQGWAEDKIFACLFKGDCYRYLNDKENELTALFQSFNYAPPRAEACCRIGYNFHRSRLYKTAIFWYELATQQVPDPDRWSFIYMAYYTWYPHLQLCVCYYNIKDMQKAYEHNEKAAGYRPSDPSVLYNKELFAKMIEEGTIKP

SEQ ID NO: 1519 - protein, 604 aa, Paenibacillus rigui
MTKPKISLCMIVKNEAEMLPHCLNSVRSAVEEIILVDTGSTDGTKQIAEQFGATICSVEWTGDFAFARNIGLLQAKGTWILFLDADEELEEQHVQELRNAAEHLEYEGFFLQVHNHQGERKHSRTATINPILRMFRNRPEYRFKGKIHEQIAQTILMAKPEAQFHILNVTIHHYGYSEQQVVRKDKIARNVALLQEALCQEPNDPFHHYNMAVEYMRMQDYPSALEHLREALERCMPETSYRHLLVKYEARCLLALQRYEEAAAVCSQAIELYGDYTDLVHLLGVIQFTTGHKRQAQDTLTRAARMGAAPGHYHTEAGIGTYTTCYALGRLLEDTDEAAAAIHWYAEAVKHNAQMTTPLQRIFRLLASAGSESEIPQLITEKFRMRTPEAWGKVIRLLMEEGCWQAVLALLPEWEVTDQAAEWAAVGGWSVFKLEAAITCLAWSGRVEEAKRLLEREKAVGLAEGDAVAVEHRRLLSRLRELLDAARDPAVTLKEAGSSIDMDVDGANDTDEMDTTVEMEFRIRAAYFSERRALAYKLLTAWLKAGHGEANVAANPMAAAEAAYRKSRTLIALAEARLGTIDVANLCFSVYRKARLGLPPGRWN

SEQ ID NO: 1520 - protein, 353 aa, Clostridium sp.
MISICMIVKDESGVLKKCLESIKDYNYEIIIVDTGSTDNTKEIAQKYTKNVYDFDWCNDFSKARNFSISKASNDFILVLDADEIILNLDEENLEKIIIENREDVGRVVRKNEYLRENNKFIYNEYVNRLFSKNKYKYYGTIHEQIVSKDAKTYTTYNLPIVIKHIGYDNEEIRRKDKINRNIELLKESLKTKGDDPYIYYQLGKSFYMNGNFADAKINFEKSLNFNLDTKFEYVQDLIETYGYSLISLGEYKDSMKFLNLYDEFKDSADFIFLIALIYMNNGLFHEAIIEFKRAKSIKACKMEGVNSYLANYNIGVILECLGNEEKAMEYYNMCNNYENALKRINLIIKSQKL

SEQ ID NO: 1521 - protein, 639 aa, Unknown
  Description of Unknown: Candidatus Scalindua sp. SCAELEC01 sequence
MKTNKTNLKPLPNDEVGDSRNSGSTISLCMIVKNEEKFLPMCLDSVRDYVDEIIIVDTGSADRTVEIAKSYNAKVYHHAWENSFSKARNYSLKYATSEWILILDADEEIDKIYAPRLKEVLNDDRTNVILLPVFSKSYKGKSLGVGNSERIFRNHLGFRYEGIVHNILQCSGPFKKSNIKVHHYGYNLDERQMVKKFQRTSTLLQNQIREKPEDPISHHYLASSYLDRDMNDACIQEALEAARLFDLQQGKAQIRFLNYYIVSVAFLREQDTQNAEKFALKAIDLFPDYLDAYCLLSSVYFLRREYKRCLEVTHKYLYLLRSIEENPSQIPAIPLNTIHHDRLAYTRLAIIYFEQEREVDGLNALRKAKQCAENRWEPYLLIGKHFIEQNSLKMAEKFLKYGLYNCNHNRDLLYCIADMYEKSGSPDKALLYLKEILAYHSSEILAQYRIGLIFVKEGQSKEAINSFKAVLDKDSHHVGALFNLARSYERVKDHDKAKKTYNTILTILPENPETLVKLGTLYLRESDYVKARECFIRTIQLNKYLIESYIAMSKISLALRDLEKCVFYCEKSSQELGLAVNVTIKSTYDLSKLFLTIGANLLIRERDDLAKLSYDLAVKLDTLSSHQDCDRQRVKFAVG

SEQ ID NO: 1522 - protein, 720 aa, Paenibacillus sp.
MYSLFCPPLPDNTPIVHHRTVGKLTLQGGTPVKKPTLGVHLIIRNEAALLPQCLDSLSGAADEIVIVDTGSTDDSLSIAEGYGAKVYRMNWNHNFSEARNTGLSHAQTDWILVLDADEILKTPLGEITDMLQNTPALAYTVNIENWLGSSPEERLTHSIIRLFRNGKGFSFDGIIHEGLDASIIDKHGASVIHSSNIEITHLGYLPGLMAQRNKVSRNEQLLRLALGKEPDNPFYSYNLAVTCCQNGQLEEAAELLSHTIHQAPLQVSYRPSMIRDLGKIYLAMNNTKGIDALLARELQRYRDYPDLHFIQGQSWESQGLIERACQSYERAAAGSEAALSQEAALSGKYVSEKGMNSFRPLTRLGENSLQLGHTEDAARWFHRALQHHSMYGPALQGIASAFQRLNVPDPEISTLLIQLAGTEQPAGRSAVIHALESVHAYEAIAGLPRAGFPLEWETLPAIISAWMITGQLQEAGSALREALPLLKQETDRDRDVTRQLWIIHAICRWQEDRQQTESYGFLDAPEPLRSGLLHIGEKLARQVSAPAAPDNAGEHSLVVTELIRQAVKLRSFGLAAELAGLFPEHRAELAGALYEAGQLEAAGELLITLAAGGQTGGKGSFYLAEMLFDQGHYGEAAEWFRHMLDTAPADNPSRIGLSLSYLHLAKQELEGAAASFPEIYTQGPLQEDIAAIHQAIAVLNRTAWHTQWSANQNIQGGAAR

SEQ ID NO: 1523 - protein, 649 aa, Paenibacillus ehimensis
MEKLITLCMIVKNEEAVLSRCLESVKNIVDEIVIVDTGSTDYTKTIARQYTDLIFDFSWSNDFSAAKNEAISKATAPWILVLDADEYLQHEDLDIRSFLKELDPQKPLGVISSIINYVGHPNSGKMVESSAARIFPRNADIVFVRPIHEQLSYRHGELTYINGPLVIYHTGYTQDTVQLKNKTERNLSIFQAMQHSGSLKPYDYYTLGNEYMMTEQYQLALKQYQKAFVKEEFEKYWFPYCGAQMITAYLKLEQYKEACLLIDSCLQYWPQYSDFYWFKGSVLYDLGLYDAAVAELQMAITRSEKPGIQIADHQPWLISPNYGTSLPYQRLAVIHLEHLRIREAVYCLTKLLYSNPNNETVLFRLLQLMSQSESADSIISFLDKVYDAPKEHHLLMLLRVTLNLGNLPLYHYYKEECSKKSIPLPIHLQLLQALVLDRLDLFSSLIESCSLVPDDLELMTTISSASIVWKERRFAALISKSNEASALKFILDYYWGISPDNVLSQKDIAVLTKLLTQLFQLGFFDTYDRLMERFNAYADELANELGHYFYSIQQIELAIDYYSILINKNKLSGKGYENLAKLYILQGEYEEAFYFIKQALQLIAVPPSLYVTFLQHCQVQNLNNQIRELLQMKHSDLLDIPLLKPYLIN

SEQ ID NO: 1524 - protein, 331 aa, Murimonas intestini
MKISVCIIEKNEENVLERCLQGAALFADEIIVLDTGSSDSSREIALRYTDKVFDYVWKDDFAAARNASFEKASGDYIMWLDADDVVDAENAAKLSGLKETLRGSSALLMPYERPEHGCVFYYLRMVKRRTDKKPYWHGIIHEQLIAYGPVQFADILIRHAKMGTLDYERNIRMMEKLSVEDLKNDFYLCCQCFLDCCLAGKKELSDYYYSFCDDSGDFDVKAAQYLPVCNVLAWHRKDKDVLRWTELAWRDFQRHPVHKDIMCRLLSDGLKAAERQGNFQMSETINSRVLELDPENPAALTNRHSLQRVMAQIGAKNIKIFDSIISAFADK

SEQ ID NO: 1525 - protein, 489 aa, Paraclostridium bifermentans
MKSLSVCMIVKNEEKNIKRCLDSIESIADEIIIVDTGSNDETLNICSNYNAKVINHKWKNDFSEARNVSLEYATKDYILFLDADEEISKEDLGKLKALLSSKKLSEGYFFRLTNIINGTEVGEYVVFRFFKNKRKYRFRGKVHEQIANCIQKHNKDKCIENIDIKIYHYGYDPNKVNIESKYKRNMGILNTYTEEEKDAYYFYVLGNEYARITDFKSAIESYKKSLELMELKYNYVFYPYLILNIVKAYSNEKQFYESIKFIEEIRLSIPNFKDLYFMECLAYIECGKISKALECLNKYINCPVGNTYEYPNNNFEKIYDIKEMKNNLEQAANNNTDNLLFALMIIDQYDNSIINTVKSFNEIVSNFVIATNNKYLELVELKNIGAQIIYLNDEDVNLLIKRCKSKYIFIVDRGEICSTLSQKKIIELLSNTNEKTFTVNIVNIGNSTKYKEIRIIKNDSENFINDYKNMLIKNINAIDSNIYIHKAIN

SEQ ID NO: 1526 - protein, 682 aa, Gracilibacillus dipsosauri
MGKLDRVKKLSICMMVKDEEKNLERCFESIKPLIDREDVELIVVDTGSEDNSVDIIKNYTTKLYFHKWNDNFSEMRNITISYATGEWIFILDADEELVDPFELMDLLNSKKMKEFNAISLLIKNFLTKSGTEQSIFPALRIFRYDEDFRYDGVVHNQPVFKQPTLETEILLNHYGYFNDDKVLMEKKFRRTATLLKSELEKDPNNVYYQYQLAKSYIMHGDYEDGLNQIEVAYNVMQKKQTNRSQSYIYNVYARVALHLKQFDKVIEIAEEGIGYRKDYIDLYFLLGKAKYNKKMNNEALNAYRNYLKLYKQGNDLGCLKDLSLEIKYIDEKSKDSVVQDMVYIMIEQEEFETAKKLLNEVDDSSIRNKALGKIYLAARKLEDLCEHYDSLNESSQQELEYLIEDHKSRLSDDEKTDLEISLSHLSSPYSLLNNARNSSDPEVIKNIANDLINKHNLIELPIFYCEIITLCLKNNISLFRYFKNFDSNSIQKMMNFVLNSAADSKWLIINYLNNIKPIRDNDYNNNRIYYSIVLPLLIAENQEATIEKRNITDEFIDLFERYIKSGKNAVRIIYNKDKLKLYYQTINDAEHKLFCLLLIMDDAIAKQNIKASLKYLKETVTTFKSLSKFYDVLFINTYIEFGDIFKKQNKMDDAIEMYEEALLKSINEKQHQFILEQIENCI

SEQ ID NO: 1527 - protein, 640 aa, Paenibacillus naphthalenovorans
MTKKPTLSICMIVKNEENNLKRCLDSVVPLLEALSAELIIVDTGSTDKTVEIAQAYTSKVYYHEWNHHFSDMRNKSIAYATGEWIFILDADEELEDPEKLVALLQSETVNEYNTIRVLGKNFLTEARDKYVVHISERLFRNTGKFRYEGSIHNQPKYENPAMHADIYIRHYGYNNDDPELMEKKFKRTSSLLLKELEKDPDHIYYRFQLARTYFMHKDYREALLQIRKSYALLKKHGKEIVARNYYVIGEHARMSYVCKIFDETVRIAKEGISLTPQYIDLYFYLADALLAQQEIDQAIETFKTFLKLHQEYNQKGLSKLSILELYTVDETSKSVAAYKLARALMENENDAEAVEYIDLIEESTHKVDLVINVMLKLQRYEELYQFYKSIENNSVAAYFIHQLEIAAAALKDAEEKLLIASVFSKEEGPYGQLNQIRLTDDPRLIKDFLVSNMMSKLPVFPYFEIYRYAIKRGLPVISYFKSLENGYIKLYVKMLLDKFDEAQDYFMQYLKGEKIRPNDYQSNRVYCAVANVILLTAIERSKKEKSVIDREYHDIFNLYTERGIQYITYLYQLTPIRLVYKTIDSAEDKFFILMHLAEEAKAKGSIKYASHYYKEAAEAYPYVAEMLKPFMEQRILTVIE

SEQ ID NO: 1528 - protein, 372 aa, Amycolatopsis xylanica
MPDKISIVVLAKNEERCIARCLASITGHDFEILVVDTGSADETTTIAENHPDARLVHFPWSDSFGAARNFAIDHVSTGWIVFLDADEWLSERAAEELKTRLSAWSGASNLARLVLTPTIFDVDRGVAEEGVPRVFHAESSIRYRGPVHEYPVVEGEDDVRVELARLGVEFQHDGYHPEVARAKDKLHRNLRLLDLARAHDPDNPRWWYYTLRDGLPVFDRDQIVSLCETLRDLPSDSRRTGELLSTAELYRLALGTACQGLAALRDWRTLDRYCAELDRLGSPDGTYFRLMAELHNGVLTTRDLLGAVRLRGDEKLVATSAVDPAGRHLDALIVALLARLRGEPEAERYRALCEPWTDVFFDGGRERSPVAR

SEQ ID NO: 1529 - protein, 370 aa, Pantoea ananatis
MDVTAAVIVKNEERCIKRCIDSVLPLFTEIVVVDTGSTDSTLDIVSSYEPSQVKLFHCTWNDDFSEPRNMAISQANCKYIFFIDADEFVISDKNTVCSEIERVERICDNHTYAWSPGIRDTGDNNITCSVRRFFRNTGFFYFAGYVHEELRNKEHNAVTEQKLNIILSHDGYSPEVMCSKEKKERNRHLNIKNTLLEPDNLRWTYFLYRDNFEDFSSEEICYNLSRLLKKNQDEDLSLNNIIFCDYTFPLVDLMVMAKLELMDDEAGFNTLLSVMNSLIPNNSNAVYYEVVFYLLKWKIFANKTMARLIRLRKENKLLHDDMLHSEGMHIDAALAFYLHEAGFSEQGEKLLTSVRKSGFITPLTEKYICS

SEQ ID NO: 1530 - protein, 592 aa, Unknown
  Description of Unknown: Thermoanaerobacterium sp. RBIITD sequence
MQPLISLCMIVKNEEKNIKRCLDSVKDLVDEIVIVDTGSIDKTVEISRSYGANIYSVEWHDDFSEARNKSLDMAHGKWILFMDADDELDKNDLKKVKEILNDDDEAYFFKTINFVGNSPSYETAINMNLRIMRNRPEYRFIYPIHEQIAVVIQNVNPNAKLINTDIKVYHYGYLNYEVQNKNKRKRNMLIINKVLKNNPQDPFMRFNLGNEYFALEDYSKALDEYMISLKNTFAKTGYLSKLYVRIVLCLNELGRYNESIKMIENGISYYQNLTDLYFLKGYILHIKKRYTIAERMFKKCIEMGDAPDDLGFIAGTGSYRAYYALGKLYLELEDYDVAYKNFVDSYNNNRKFKEPLYDMSYILLITKPLDIAMNEIEKYLDPNIYEDKILLIKIFMRFKRYDVCLKYLNELILNNTINDEVLYLTGNCFFNLKNFNNAYKYWSKVGKDSSFYENIVPDLILLNIIKKDNINEELKYIKKIKPKLYDVMLRLMILSKGEMPTTLSDDEKLSSEYEDIIFEILERLLYLEEFEIFEKGLNLLNLINDNKVLLRLGKLYYKYGFYQFACDEILRSMKLFNIYDKEALAILDEKMD

SEQ ID NO: 1531 - protein, 336 aa, Acetatifactor muris
MITISLCMIVKNEEKILARCLDSVAELADEIIIADTGSTDATKEIAGRYTEHVYDFPWVDDFSAARNFAFSKASMEYIYSADADEVLSPENREKFRLLKETLLPEIEIVQMKYANQLQFGTVYNFDEEYRPKLFKRKRDFVWEAPIHETVRLTPVIYDSDIVITHLPAESHAKRDLENFHRHCINGYRLSKRLHGLYARELMLAGDEEDFAQAADIFLESAADNERDGEEMAQACCVVAKAARLAGDTITFFKYTSKVIAEEACSEICCEMGHFYEGNEDWEEAAVWYYNAVYETSPILNLQAGGRESLEGLTRCYEQLGCPEQVQVYREELRRRG

SEQ ID NO: 1532 - protein, 350 aa, Paenibacillus baekrokdamisoli
MLVSVCMIVRNEEGNLERALSSIPGSFEKVVVDTGSTDNTVEIAKKLGAAIGYFEWVNDFAAARNYSISLATGKYVLIMDADEALPSGIDEHIERFLAAYPNQAVAFNIANEIKGEIHRHTSLRLFPNNPAFAYHGKVHEMVHYNGQLSEFVLSDLTMHHYGYEEEQYSDGKKANRYLELYHKHLEANPNDGYMLYQLGKLHYSIGQMNLALEAFERCLELNERGHLYYPVMLVMLGYVLKEIGQSPIAEELLVSVQPDYPQFPDLPFLLGLLAMETGKMADIEIHFLRALEIGETKKFSSVEGVGSYKAKYNLAVYYEITGSIDRAIQYYKAAAEADYLPAKKRIFKLS

SEQ ID NO: 1533 - protein, 335 aa, Unknown
  Description of Unknown: Lachnospiraceae bacterium NK4A144 sequence
MTFSLCMIVKNEAEILERCLDSISDLMDEIIIVDTGSTDQTKEIAKKYTDKVFDFEWDDDFSAARNFAFSKATMDYIYSADADEVLDEENHEKFRMLKEALLPEIEIVQMYYTNQLEFNTTYNFDEELRPKLYKRIRTPVWVDPLHESVRLDPVVFDSDIKIKHCPTSEHQNRDFAIFQKEIAANGKLSEKLQKMYARELFISGSDNDFLTAEPYFKKRLDKDSSDELIMHDVCVLVKCARLRDDSDAMLYAAGRALAADDTPSEVVFELGEFYRGRHNYHEAVMWYYNAAFETMPILNQKYNTLFPFMGLHVTYVILGDREKAAKYGTLMREYQ

SEQ ID NO: 1534 - protein, 361 aa, Unknown
  Description of Unknown: Bacillus sequence
MVEISLCMIVKNEEEVLARCLDTVKDIVDEINIIDTGSTDRTVEIAKQYTDRVYFFEWIGNFAAARNESFKYATKDYILYLDADDILLEEDQKKLKLLKETLDPSVDSVSMYYDAGTDEFGNVTLRYRRNRLVKREKNFKWKGDCHQYLEVFGKIIESDISVTHKKIRHSVGRALNIYQNRIDRGDKFSARDYFYYGNELRENGHYQKAIEAYEQNIGMTDGWIEDKVYACINKADCHRFLGDVENELKSLLKSIEFSKTPRPEACSRIGYYYQLKRDYKTAIFWYNLATQQIPDSGQWSFSYPAYYTWYPHLQMCVCYYNIGDFESAYFHNESARKYRPEDQRILYNKSLLESKFGQKTV

SEQ ID NO: 1535 - protein, 351 aa, Clostridium amazonitimonense
MISLCMIVKNEEKVLDRCLNSLKDTLDEIIIIDTGSHDGTKEIALKYTDKVFDFTWCNDFSKARNFSISKASNDWVLILDADEVIKEFNIGSLKSFCNENNNKVTGRIKIVNEYEDDYGTKRYIERINRLFNRKFFEYKGSIHEQIVCKNGLDYMTQNVDIVVDHTGYSKEVLNRTNKIQRNIDLLRVAIKENNKDPYLYYQLGKSYFMGKNYKEASIFFEKAVTLVDNFGYEYVEDLIESYGYSLINLNEFKKAKIIEKYNKYYLSSPDYYFLMALVYMNNNEFQKAAETFLRCTEFKEGKVEGITTYLPLYNIGIIFECLGLKEEALSYYNKCGDYNPAKKRASVLLED

SEQ ID NO: 1536 - protein, 284 aa, Porphyrobacter sp.
MSHPDPSELPVTVVVPVKNEEANLARCLERLGRFSEIVVIDSGSTDRTCEIARDYGARVVNFRWDGKFPKKRNWFLMNDPPKENWVLFLDADEFVDKAFCDALQAELPDSDLSGYWISYDNFFLGRPLRHGVAQRKMALLRVGRALFERIDEDGWSQLDMEIHEHPIVEGEVGEIKACIEHRDDRGLAHFVTKHRDYAQWEAKRFAKMQGDEAVWAAMTDRQRFKYRHLPKWWFPWFYFAATYFAKLGFLDGGAGFHYAAYKVWYFQTIRLLILEQSAANKTHG

SEQ ID NO: 1537 - protein, 593 aa, Clostridium acetobutylicum
MSNEISLCMIVKNEEKYLFQCLDSVKDIVDEIIIVDTGSTDKTVEIAKKFGAEIHYFMWNNSFSDARNESLKYATKDWIFIMDGDDEFSKDDKEKFKELVKNNLKEDCLYYFETLSYCGEFVDSSNISVNLNPRLFKNNYGYKYEGIVHNQLINTEKEIKNVIYNIRIYHYGYLEDVSKKKNKRGRNIPLLKKQLKENPDDRFAHFNIGNEYYAIGDLQKALTHYCEAYKDFNPSSGFGFVLITRLIVTNFGIGKHEKAIEFADIGLEYYPNATDIYFLKALIYEATRRPTLAIKALKRCIEMGEPPSNLKLYYGTWSFKALYELVNIYMGLKDYEEAYKYCIETIKAKNDFVNPVYVIGHILKERKTPIEEFKVELEKLFSDYPKAYFFIANILYDEGYFNEALEYTDKCEKEGLNSDAILDLKLKAMIRAQKFNECAEANYFAKESVFYFNASMYKVLSLVLIGKFKEALKDLEIFKDGKLKRQDKKELEVYSQFVKLFMNEETKVLSEDKEDKEYTGFILDICDILLSNKLYDEFEKALNLFNLISDENVLLNLSKLYYKHGIESMAKKEAIRSIKEFEVFDNEILDILR

SEQ ID NO: 1538 - protein, 362 aa, Bacillus sp.
MVSISLCMIVKNEEEVLARCLDTVKDIVDEINIVDTGSTDQTVEIAKQYTDRVFFFEWIGNFAAARNESFKHATKEYILYLDADDVLLEEDRRKFKELKETLDTSVDSVSMYYDAGTDEFGNVTLRYRRNRLVKREKNFVWKGDCHQYLEVFGKIINSDISVTHKKIKHSVGRNLNIYQNKIERGDRFSARDYFYYGNELRENGHYEKAIEAYDENIALKEGWIEDKVYACINKADCYRFIGDLENELKSLFQSFGFSKTPRAETCSRIGYNFQTKQEYNAAIYWYDLATQLHPDSAKWSFSYPAYYTWYPHLQMSVCYYNLGKLQKSYYHNEEAAKYRPQDPRILHNKNLLEGKLGIRVGI

SEQ ID NO: 1539 - protein, 368 aa, Synechococcus sp.
MIVKNEAAHLARCLASAQAWVDEIIVVDTGSTDETLAIAESFQAQIFSFTWCDDFAAARNASLEQAQGEWIFVIDADEELIVTDPAWLSQLREQTDLSYQQYSIRRLEAPQAENSPTMTDFWMNRFGRNQGGIHYAGRLHEQLTHSGSYQTGYLTGAYLYHHGCTTRTEMIQKMKTRNIPILEAMRQEGNIGLMWLITLADHYKACGELELAQECFQAAYERILPNLLSGEIPQETGFVRQLLFVLAWDALEAEDYDQAQFLIHNGIRWFPHYAPLIYLAGLLVFYLGFYLGAVPYLEQCLRMGQRQTYDRNEPFDQAFLKAHPAFSLGYCWLKLGRIDQAETFFELTLTHDPNHQPAQEQLQQLREL

SEQ ID NO: 1540 - protein, 353 aa, Lachnospira pectinoschiza
MISITLCMIVKNEQSILERCLISYAGTYDELIIVDTGSTDSTKDIAHKYTDKVYDYKWCDDFAAARNYAFSLASCDYIFSADADEILDERNNQALKDLKSMLLPEIDIVQMYYVNDNDYNSVYNVHRELRPKLFKRLRPFVWTSPIHETVRLTPVVYDSDIEILHRPVSDHSRRDFSTYIKAFARGTQLEDYVITMLCKELYISGSDKDFMDFKDIFADILINENRSDDIRQEVNCVLVKIYRIAGDMGEFFKLALRCVADNPSSEICYELGNYYYDINDYAEAAMWYYNAIYETSSVLDITSGGNKPLYALSRCYDKLSETSEDIEQIAQFRQMAEDYKYQAEQWKLPDEIV

SEQ ID NO: 1541 - protein, 478 aa, Clostridium sporogenes
MKLSIAMIVKNEEKNLERTLIPLKKLQDYIDAEIIIVDTGSTDNSVDIAKKYTDKIYFHKWNSDFGSMRNLSIRYCTGDWILIVDADEELYDIEELANLINSKILKKYYSAFIKIVDFSQSIQNSVSSGAISPLLRLFKKNTVKYEGIIHEQPICSEPTLDSQIRFIHYGYDNNNYELMEHKFQRNIKLLFKELDEKPNSIYVYFQIATSYLMHKDLQKALKYIEIAYKKASKKGLCNYIYVIDKYCLILYTLKSYDTLIYKAKEGIKYCDKFIDFYFYLGEAYNNLNQYDKAIQPYEMYLDLYKNPNKNDILAEFSISIFTIEYKNAVIYHLGLCYYQNKFYEKALSLILTIDDNNFMHDKITIICKIIEDGGLWNKFYILNNFIDIHNYDEILIFLHNNVFMENLIMINSQEIDGFLKEMLDIVIYFKNNGNINYKHLEKIKRIISRNKKLYSIYVYYVLKFDINEFDFFINYGKL

SEQ ID NO: 1542 - protein, 628 aa, Paenibacillus odorifer
MKKTVSLCMIVKNEEKTLARCLDSVVGKVEEIIIVDTGSEDNTIEIAKRYTSNIYSFQWTGSFAEARNFSIRQSSCDYILVMDADEYLDEDSDIHKVCVTGFDYYVLKIKNYLSFDQTFIHYNVRLFVNNENLYFENQLHEHLNIFDERFKFVGDDVDLLLHHTGYSNETIEEKDKLQRNLPIMIREVEENPNGFNLFNMGKLYLSLGQYHKAVNYFKKAYPLSKSTLYFPDLLTLFASTLGKLNRYEDGLSVINEAVRLYSEDSEMSYTQGQLFMEAGYLKDAELSFRKCLLMGDQGQGAMVYEGSGGYKARFMLAEVYERQRKLAESYELVIKVLEEKKTHIPALTKYFEIVSKANIPADDVYRNLELIYNVENINDLRNLIDTLYELRHPLLNEYIAKYKLQTQPYICAVASQYNKKYELARIQWSNISHLPDEVGGDLLLLAIILQDLSLFHRVRPLLNVSKKESETIVNLINREDNSTIRLTSHVEKLLFEVSRHLVILQEFDVFQVVLEFLYRGSVETKYNLCFFLAEYSFVEVAIDMLIKLYDEQPYNIKTITLLGDLCLHSGYIDDAHLFYSKLMDLKPDYNTYERCYDCYKKQGDIKAMNILKNEIKRKFPLVSWVDAS

SEQ ID NO: 1543 - protein, 247 aa, Paenibacillus rubinfantis
MGVSAAMIIKDSSRCIERCLDSILTAVDEIVIVDTGSTDGTVEIVEAYCQQYKHIQLYHFQWINDFSAARNFSLSKVTQEWTFVVDSDDVLPEQDQSKIREYTNQMDAQGKKCVFDIVYDNTVDGKIVETIPVGYVRLFPSSLRFQDKIHEQIVYHPLERIQSDIHLLHDGYDFNQIDLRVKKKRNIDLLIQSLQEDQENARLWMHLGREMIGLDNDKAIRYLNIAESKAKSPEMLDWIRKSKLEMS

SEQ ID NO: 1544 - protein, 356 aa, Bacillus sp.
MVSISLCMIVKNEEKTLSRCLNSVKNIVDEIILVDTGSNDQTIEIAKKFGAKIYHFQWIDDFSAARNHAFSHAHMDYIFTLDADDVLSKADSEKLEQLKKSISPTIDAVTMKCLAGFDESGNVLVSLRQVRMVKRENQFKWQGAVHEYLEVHGNMLHSEIAITHKREHSNSDRNLRIYEQRQKNGALFSPRDLYYFANELYDHQQYERAIQNYQKFLQSGKCWIEDVIQAHGRIAECYAALGKMDNAIHSALYELKFGPPRAESCCRLGFFFLQLSRPEIAVHWFQFATQLPAIDTGGITNHACSSWIPHLQLSVCYSHLGDYQKALEHIEMAKTFNPEHDLILKNETILKNFIKK

SEQ ID NO: 1545 - protein, 358 aa, Pelosinus propionicus
MITISLCLIVKNEEETLARCLESVKPGLDEIIIVDTGSTDSTKKIALQYTDKVYDFVWIDNFGAARNFAFSHATQDYIMWLDADDVLLENDLQKLLLLKHDLDLAVDSVTMNYNLASDENGNIVSSLRRNRLVKRTRNFQWIGAVHEYLAINGKVINSEITVTHKKERCDTADRNLKIYENRLANGEVFSPRDLFYYGNELVDHQMYEKAAQYYQDFLNTQLGWIEDNISACGKLADCFSHIGDEQQKLKYIYKSFEYDTPRPDFCCRLGYHFLNTQKYSNSIFWYNLALDLKESNDHSSLKNYACSTWLPHLQLCVCYSKLGENSLALEHNKKAESYVPNHPSVLYNKEYFKKLFNS

SEQ ID NO: 1546 - protein, 657 aa, Pelotomaculum thermopropionicum
MDARISLCMIVKDEAQNIRRCLESVTGAVDEIIVVDTGSTDESCQIAGEYGALVHLFPWNENFSDARNASLELATGDWILFLDADEELAGESKEALRRLTADDNVEGYFVKIINYLGNEGWIETCPDLVFRLFRNRPEYRFRGAIHEQIADVILEKNGKAAYRMAEEIVIIHYGYLDRQISEKDKKNRNLKIIQKELGENPENRLLRFHYGVELFRAERYAEAADELTRAANGIDPNTIYLPKLLRYIVMSHQSAGQPEKALDVARLGLQVFPNYADLYYYCGLLYLELRRYTLAREYFLKAVSMPEQPAQYASFGGVRGFRSYYHLGQISEIFLDYEDALRHYISCLRDNPDFTPALENIVRILKPRENPDYAKECLEKVFEFSTPRANQMMGNIYFRQGAYSLALEYFNRYTGSEPASPEIQLWKAICLIQLRRYLEALRIIESFNSNSHLYPLAMLNKLLCFWVQGKKQKVCSILAELRALGLAEDTDKVLTLFLNSQDKRKNVYRVTLGQDGVALLLDIVKRLLDMNEADRAIYLLNKVNPESMAEYRLTIARLFYDFGFKEKAELLLREYLTANQDGEAHFLLAEICRETGNYIEAAQHYQYALEINPDEPRYYLRQINLYDNWRKKILQEAIEKYPNLEVFIKLSEEAPVN

SEQ ID NO: 1547 - protein, 625 aa, Paenibacillus polymyxa
MMKTIALCMIVKNEQEHLRRCLDSVKNKVDQIVIVDTGSTDETVNIAREYTNDVHYMDWNNNFAAARNESIKYATTEYILVLDADEYLEESADLQKEIASGADYYFTKIHNIMSFERALNHLAIRIFSNNKDLYYQNRLHEHLNIMDEKRNLISGQAGLVIMHTGYTDEMMEGREKAKRNLPLMLKEVEENPTVYNLFNMGRTYMWVGKYEKAITFLKRAYPMSKNLTIASDLIITLCRSLGEMKRYNEALQILQEAVVVHPTEVDLLHLQALYYMEIDYYIDAIDTMTKCLDIGDQGITVTEGHGSYIAHFRLAEWYELQNDLTKSYEHILEAFKLKNDFAPIMGKYFKIIEKANVPLEEVFVSTNQLYPISNSGQLEKMLEVMYQLRHPLLQRYLTEYNVTVQDNVMATARQYARDYDGAQALWLGIEGVDEQNGEDILLLSMILKDRTLFGRAKTLLNLSQKEQKNLYKIIIDEPSGDTKLTLHLENILERVLMHLIRLQEFDSFEKLLNYLWQGSVDVKIKVCEYLVSYGFNEIAIDLLVKLFEQHPRNISIIKMLGDVCLSNEYYQDAQLFYARLLEFHPEYSSYERCYLLSEKVGDQTSSFNIKESIKLKFPLSSWVVG

SEQ ID NO: 1548 - protein, 645 aa, Sporolactobacillus terrae
MKPFLTLCMIVKNEEKVLKRCLGSVFKVVDEIIIVDTGSTDNTKAIAKKFTKKVYDYKWIGSFSNARNFAQSKATGEWILVLDADEFCQEDNALEFKKYLMNKQDNVEAYDVLTYHFLGNEGASVIQNKQMRVYRNISDIHYIRSVHEQLINKQRALNSGHSTLLVYHSGYMRQTIKEKKKHTRNKKLIDQELLKNADSGFDYFNLGNEYSSIGEDEKALENYIKAYQLKRHFKYSWVSLTIVSIVNCLINLKRYSDALDVIRDSEEIYSRSPEFRVLKSVIYLRQGRLEDAKNELETIAFHENEFPEVIVNVNYLIYIPYKVLSEIYTKQNQIEKAVQCFIKALDSNLNDTELLYRFFRLVITRVNDQEIITYLTKLNFMSDVKNVKRFIKVLTNLPGSLNLINKILRIEEVDKSLIRGIQPKIALIKDESEKAMKIFDSMNLNTTTQVINEGIFDFLDYIILCFILNKKENLLSLSYGDEENKNFVSFLCNGQPDCQQNDGAYLLLLERTINLNKFDLFEKLLSYRTAFDDTINIKIGHLLYEHDFIKLAMSFYQEVDISLFDENTYINIINEFIKKNELEDAYRFALQAINSEFYSFGIVKQLILLTNHSKDNKVKFATRQFALKCFPDSEELKNAMFNGIG

SEQ ID NO: 1549 - protein, 550 aa, Bacillus sinesaloumensis
MKPFLSICMIVKDEEKVLKRCLESICGIADEIIIADTGSIDKSKEIAAKYTDMVFDYKWEGDFSKARNFAASKASGDWILVIDADEFVDRENFMAFKDDLKLNPPDFNILAVQIVNFVGQNGKDTALNFHERLYINDGKISYYRNIHELLKHRDSKESKGYSKFQIYHSGYMKNVVNEKEKSKRNLKLLINNKVKEPIDYYFMGNEYDQLDELDKAIKCYQKAYKLKDDINRDWVKKLLLRFVNTLHRAKRDNEALEIIDSCENIYPGLVDFKFYRGKIYFDNEQFRKSGEVFEKILAEKHHLIADSSPDFLEFLPNKYLGEIYENENRLHLAVKSYSKALSINDTDDYIWIRLIGLLSKHSTLEELSEFLNNNLLNKSNITVKRVISILLSVPNLDVQKLTRSLLEDENLTELENEGLFLRNLLLDGDTDEILTIINQKSESEIFTLLSTGIFNIIDFIILILKTNNEGYKKIIHSIKFNKPINNLLLLLLEEKKSNLSVFEQELFLLIYKQSYILGASLVIEQLETKVPYLSRENRNKLNKIRSGKII

SEQ ID NO: 1550 - protein, 369 aa, Unknown
  Description of Unknown: bacterium 1xD42-87 sequence
MSRVEVRTITMIPISVCIIGKNEEQHMENCLAPLASLPFEVVYVDTGSTDRTKETAAKYGAKIYDFKWIDDFSAARNFALEKAAHEYVLFIDCDEYLTELDTVPLFTALEAHPQDVGLLLRNNYYEANGTQTNYPDRVERLFSKKHFHYKGIIHEQVVRQGSESPFYERYEIPLIVDHAGYSGGMDAMRQKAERNNALLFREIKRTPNDPYLYFQVGQSYNGIRDYENAYTYYKKAFSLPIIFREPWVQIMATAYINAMNHTGRSAEAQAFFEPIYEHFSGDANFYCSMGNIYLNLDPPQPLRAMAEYVKALHCPDAREKGANSFIPYYNIGLVNEMLGSQDSALTFYQKAADLGFAPALERLSDWNGV

SEQ ID NO: 1551 - protein, 621 aa, Paenibacillus odorifer
MIKTVSLCMIVKNEEKYLSRCLESVRNKVDEIIIVDTGSTDSTLEIAKQYTNNIYHFNWINDFAAARNESIKYATSEFILIMDADEYLHPDADLQKDISSSYDYYFIRIINDMSYGRTLKHTAIRLFANHKRLVYHNRLHEHLNVMDNQTKYKGIAGEFIIYHTGYTNEVLQEKEKKNRNLTLMLQEVAENPTGYNLFNMGKTYMWLGEHEKAIPYLQKAYSLSKDMIIIPEVIVSLCSCLEALHRYEEGLEILKDAIPIYPNETDMRHMQGCLFMEAGYTKDALTTFEKCLELGDQGVTVTEGHGGYLARFKMAEIYEGAYQLSKSYDQVLKVLEEKKTFGAGIEKYFRIVSKANIPNEEAYNNLQQIYSITELEDLKLILEVLYKLRHPLLSKYIDLYKVNIQKNVLIVAKQYSRKYEEAHDLWLSMEEQPKENAEDILLLAIILKDQKLLQLAIKNLNLSSKEVKILKAIISQELVKSITPRMERLLCKLSEQLIILQEFNNFQILLEYLLKGSVDGISSLGKLLSEYSFKEVAIDILVEVFKNNPNNVNIIRILGDICLNQNYLEDALLFYSKLLNLCPEYSTYERVYELYEILGDKEEMSKIKITINSKFPLSSLA

SEQ ID NO: 1552 - protein, 350 aa, Clostridium tyrobutyricum
MISLCMIVKNEEKVLNLCLGSIKNFVDEIIVVDTGSTDNTKYTALRYTDKVFDYDWCDDFSKARNFSIARAENDWILVLDADEIVKQFDRNSIFEFCSCVENQSKVGRLKRINEYEDSYGKRRYIERISRLFNKNNFCYSGSIHEQVVYKNKGNYDTHNIGITIDHVGYSKEVLKRTNKIQRNIIMLKKEIIKNEKDPYINYQLGKSYFLEKDYKNAILYFKKSILLVDNFNYEYVEDLVESYGYSLLNLNKFNEAAIIKTYKRYYLNSPDYNFLLALVYMNNSKFQQAAETFLHCTELEGGRIEGITSYLPLYNIGVIFECLDLKKEAVKYYSMCGNYELAQKRISELK

SEQ ID NO: 1553 - protein, 638 aa, Paenibacillus sp.
MKPLLSLCMIVKNEEKVLERCLLSVKTLVDEIIVVDTGSTDQTKTIAARHTDKIYDLSWSNDFSAARNESIRHASGRWILILDADEFVQPADHDRLRKYLLEYKSDRPCGFVLNIMNFGGSGNDESNVTESTGARLFLNGKSIRYIEPIHEQLTSDYGTPSFTPYPFVIFHTGYTVQVVQEKKKSERNLSILEKMNSGEKRNNPYFCFVLGNEYTSAGREDEALEVYGRSLECSSPSDTWYFHLLESLVTLEMKKGNYARAHTNIKSAIKLIPDRTDFRCMEGILFETYGLWNAAEDVFHQCIQYAEEAEKKGVPYWIIKPSYGKIIPHQSIAEIKRRKDDISGAIHHWVKTLQLQPKNYTVLQLLMDALLQFESYDQVASIIEQLYPLHQPLNKMLLYKMALKIGSIELASKYATEVQKLDLRLDDVDTVQQNLLLRNWSALTTSSLQPASLEDSLAIAAAIVQQEISFTDAAVGDITACATIMQQALLAIDNKTWNNEILTNNEERFTQTLQLLWRYGYTEIYLSLMQNMANETILNWMADWFYIRGLFEQALDLYSVLLENNLLHAKGLKNVGVWYINCGNTNEAFPFLKASFKKEASVDIIGLFKEQASPETYQEFHTIYMERFPDISLCIFPR

SEQ ID NO: 1554 - protein, 379 aa, Thermosynechococcus elongatus
MAPLLSLCMIVKNEAHQLRRCLQSVQPWVDEIIIVDTGSTDETIAIGREFTPHVHSIVWQADFAAARNASLAHASGEWVFYIDADEELVVMDPQWRDQLTAESANTINQWSLLRREQAGERNWSEFWNVRFGRRFPDLHFAGALHEQLSYRERPAVVGQLQGVYLIHHNQQSQERFLAKIRDRNIPILEKMVQQGDRRLQNLVCLGDHYAACGDGDRAQAWYEQALEQIAPAVEQGILPRDTTWLRHLLFWVSYRAFEAKDYETAQYYLSYGLRFFDHYPPLLYVTGLLIFELGLHRGALPYFHRCLDLFEQGTYDRAEPFDRQWMTTQPAYSLGFTYMTLQERDPAIAYFQKTLEFNPDYPPAQMYLQQLLTASANQS

SEQ ID NO: 1555 - protein, 331 aa, Oceanobacillus jeddahense
MIVKNEETFLEKCLTSVQGFADEIIMVDTGSTDNSINIAHTFQVKVYHYEWEHHFAKARNEGIKKAQNEWILWLDADECLDIQDPETFKKRLNQIEANILFLPITNFTGDHLESEDLTSYIHYQPRLFRNHQGIQFIHRIHETLDTDPEKMTTDILDLPILHYGYIHEITKKRDKSARNKQILKLEAAKETHSPWIEYHLASEYYRDKAYNQAFEYINQSIYKFLLEGQKPPSILYKLKYDILIQTNSIDQALPGIEKALLLYPDYVDLHFYKGLILFQQADYQAAKRCFEKCLELGEVHPNYLILKGVGSFRAAHYKSMCMEKLNTSDEN

SEQ ID NO: 1556 - protein, 359 aa, Romboutsia ilealis
MITLSLCMIIKDEELVLDRCLKSIYDVADEIIIVDTGSTDNSKDICKNYTKNIYDYVWNDDFSAARNFSFEKATKDYILWLDADEIIDEKNKEKLLNLKQVLSLDIDVVTMHTYMDIDECNNPQITMVRNRIVKREDNFKWVGFVHEYIEASGNVYDSDICIIHDKIKPVSERNLKIYKKKVEEKQIFSERDLYYYGKELYCNRCYNEAIDVLEEFVSKGTWKDEIIDALCKIGECYLCKGEKEVGRKYFYKTFEYGPPQGEVLYKIAYSFQDEEKYDIAISWYEIILRLPIPDDCYQCRNICCLRFNPHLNLCYCYFKCGDLKQAYYHHKHCVKINPNNPCVKYNENCFKLIMNKNKV

SEQ ID NO: 1557 - protein, 345 aa, Clostridium sp.
MISISICLIVKNEEVVLSRCLDSLKGIGDEIIIVDTGSTDNTKKIATKYTDKIYDFKWIDDFAAARNFAFSKATKDYIYSADADEILNNENHKKFIEIKQVLLEEIEIVQMKYTNQLQYGTTYNFNTEYRPKLFKRLRTFTWIDSIHETIRIEPVIYDSDIEIIHMPETNHAERDFKTFLTVIKRGERLSSRLLSMYAKELFISGKAFDFKSGLEYFKGVLYDEERSNDEIKYAICIISKGYRLNNDVYNFLKNCMKGVADKPCSELCYELGEYYYELKDYDEAIIWYYNAAFETESFLNVHYNGDYPLRRLGECYDAIGNKEEAENYMKMSVNWSIPESEDGRI

SEQ ID NO: 1558 - protein, 654 aa, Desulfotomaculum profundi
MGNRISLCMIVKNEEGNIRRCLQSVAGVVDEIIVVDTGSTDATPEIAREMGAKVYSYDWNENFSDARNASIQRATGEWIFFLDADEELARESRDVLARYTAEKNVEGYFIKIINYIGADGWAETCPDVVFRLFRNRPEYRFRGAIHEQIADVILEKNKQASYGMANEIVIMHYGYLDSQIDQKDKKNRNLKIIEKELESQPGNYLLRYHYGVELFRLEKYAEATQVFVETANHTDPQTIYFPKLLRYIVLAYHSAGQPEKALDTIAQGLRVFPDYADLYYYGGLCLLALKQYMKARDLFLHAVSLPEQPPQYASFGGVRGFRAFYFLGDIAETFLNDEEALDYYLKSLRDNPNFQPALEKIIKILNPRSNPEYTRECLEKVLDLSIPQAKLVLANIFFQEGAYRLALDFLEEAIQTGNGTAEILYRKAFCLIQERRFLEALRILSGYSPDSYLYPLAKLNELFCFWVQGKRKKVLSIIEEMRAMGLSEETDNVLKLLMKIQEKRKTVRKMYLGEEGMALLLDLIKRLLNLGEPEKVNELLNRVNPDCLAERKWDVILLYHEAGCREKSVELLEEYLTVSRSGEAHFLLAEAYRELGNPAAADLHYRHAIELDPHQPRYYLKQIELYENWRERLGKELADGDQRNGEITEEVHLE

SEQ ID NO: 1559 - protein, 280 aa, Prosthecobacter debontii
MTAPISVSICIPVKNEAVNLPACLSALKDFDDIVVVDSGSTDETAKIAERAGATVLQFRWNGQFPKKRNWALNHHSFKYPWILFLDADERMNPTFVEELRRVLPTTSHVGFWISFTNWFMGAPLHHGDVFRKLALFRREAGAYERFPEDYWSHLDMEVHEHPLLHGSVGELKSRLDHQDYRGLKNYLARHNEYSSWEANRYLWLDQADVSAWAELNPRQKFKYRNLHRWWLAWLYWFVAVIVKKGFLDGPPGIALGRFKRHYFQEIRLKIQEARRTGKAA

SEQ ID NO: 1560 - protein, 652 aa, Paenibacillus borealis
MKKTPRKPLISLCMIVKNEADTLARCLQSVRGVADEIIVVDTGSTDSTVSIARSFGARIIPFTWNGDFASARNAGLAVAQGTWILVLDADEELEPGSKKELLVCAEHTEYEAFFVRIHNHKGTDRASQTITVNPILRMFKRRVNYRFSGIIHEQIAAVIVQETPAAAMHMSTVVVHHYGYADGVVEKKDKISRNIGLLKEQLKLNPGDAFHHFNMAVEYMRLGDYGHALEHIQTSLDLVEPDTSYIHLLYKYEIRCRAVTGDLPGALEACERGLALFPDYPDLHHIKGALLLQVSAFAEAKAALGRALDIGVSPPAYHTESGLGTYLTRTLLGQVCQQIGEDNEAIACFTRAAQLHPEPLPLVTRLVRLFKCAGRELELKGWLAEHLPAILAEQRQELVRLLVTDGCYAAAADVLGGGVGEGVAGERSAGERVMREFGVGELGEEEQVVREFRAGELAAEEQVVREFGERKLAAGETVARERGEGELAAGETVARERGEGELAAGETVARERGEGELAAGETVARERGEGELAAGETVARERAANKRSSGAHAENGHDYAGEPEAASSDSLFLLLQRAEAIPAAELKHGDIAALLQHPAIARTTPATESAASAVQPWISLADKLLATLEASSVFSPAAARARLALPLPRPAD

SEQ ID NO: 1561 - protein, 418 aa, Anoxybacillus thermarum
MKPFLSLCMIVKNEEKVLQRCLDSVHGIVDEIVIVDTGSTDATKEIALKYTNKVYDFEWTNSFADARNFAQQHATGEWILVLDADEYVERTNLQEMIQQLKQTDGRVEAYDVGIYNFVGAYGERVLQHRHTRIYRNVPYLRYDRAIHEQLRHVSGKYVEAKPGILTVYHTGYMRHVVAEKKKHDRNAQLIEREMEAGESIAFDYFNLGNEHLSKGEVEQALQAFIQAYQHKKDIRLSWVSYCLVQIILCLKYLQRFDDALRVIADVENIYSETADFQFLRGEIYYLQHRYDDALKQLEYLLENKEKYPYTIKTFEYVEYDPHMLLGQIYKHKGNLQKAIYHFSCALSFNRKSYEALYNVLQLLARVHSETEIIQFIESKQLANDLLAISLVARIASALHLENVMKSLAAKLDDAVIQV

SEQ ID NO: 1562 - protein, 622 aa, Paenibacillus sp.
MIVKDEEQWLPQCLDSVQAAVDEIIIVDTGSSDRSVAIVESYGAMVVHLAWSDDFAAARNAGLARASGDWILFLDADEALDQVAQEQIRSWTAVSGCDGLFLNIHNYTGSGQQGATVNPVLRLFRNAPEHRFEGRIHEQIAASICRKNPEAAFHLTDMVIHHYGYQTAVVEHKDKVNRNLRLLEQAVKEEPDQPFHHYNLGVEYLRLGEAERALKTFGVAKAGIDPTVTSYAHLLCKYEIRCLEYLNRWQEALEHIDAALELFPDYTDLLHHRGVCEDALGHVEKAEFWLREAIRLGAPPPMYHTEEGLGTYQTWYTLGRLLEGKADLEGAVDAYVEAVRAQSSLLPPLYRIFRIMRVSGQEQQIPELIRERFALESEEAIYKVLGVMEQSRCYEAAVEWIAELSSSADPVEKRERLSMAEALLQIQRGKWKAARLKLEPIQRKKGLYAEQASSWLDRLHWAQGRSIEGKDELCNWLYRHSQPDGLGGERHEGKAEDSNTPVTKGESANGGYDGWQAFGLLMEGCVQSGQWQELHTLIQMGRQQLATGVSPGGETRQEQAEEPFAGVANTVAGTSWLVRGLVSAADEQLREWSEGINGQRQQCWPLVQRLRLELPGPDGFGS

SEQ ID NO: 1563 - protein, 350 aa, Bacillus lentus
MSTISLCMIVKNEEDCIERCLDSVHALVDEIIIVDTGSTDMTTTLCKKYKAKIYEYSWNQHFAKARNYGLSQATGDWILWLDADEELDKHGKLKIQEALESTDTKVFTLPTINYYGDTLANENEAFIHYQPRLFRNNHGIRFYNRIHENLRLPSGIEGQPIQAQIKHYGYLQGIVNKKQKAKRNMKLLKEELRDQAHEPSTEYHLASEYYRNKEYERAFIYINQSILKFLRKGEKPPSITYKLKYAILIETGSFDGAWPSIEKAILLYPDYVDLYFYKGWILYNLEKYTEAIQTFEQCIELGEEHKDHLILKGVGSFKAWHHKGLCLEKLGEFVEAEKAFQQAKTIERNV

SEQ ID NO: 1564 - protein, 309 aa, Campylobacter jejuni
MPKLSVIVPTFNRQVLLEKAIKSIQNQDFKDLEIIVSDDNSSDDTKSVVQNLQKDDDRIKYFLNQNYKQGPNGNKNNGLDQASGEFVTFLDDDDELLSGALSTLMQKANEGYAHVFGNCLIEKEGNLSKEFSGKGLEKDSEISKKDFLMAKFSGEFFSVFKKSLLENKRFNEEFYGNEATLWVNLYKEKSFYIHKAFRIYRIFRQDSVTLGASKNAYRVYLGYLELAKILENELRMSKDKDYKKTCASYYKMAAYYAKLAKNYKALYKCLFKSLSIKINAPALILLILSIIPNNMIEKLSKIRVALCKN

SEQ ID NO: 1565 - protein, 371 aa, Halobacillus halophilus
MITVSLCMMVKNEEEVLARCLDSVKDLVDEINIVDTGSDDRTVEIAKEYTDRVFFFEWTGRFTDARNESFRHATKDYIFYLDADDVILDEDREKFKRLKEGLDPAVDSVSMYYNAGTDEFGNVTLKYRRNRLVKRSKNFQWGGDVHNYLNVYGHIINSDVAITHKKIQHAVGRNLSIYKEKIERGDVFSPRDYFYYGNELRENGHHEKAIESYTKNIEHKEGWIEDKVYACINRADCYRFIEETEKELASLFESLRFSKTPRPEMCSRVGYNFQRKKEYKFAIYWYELATTIEDDSDKWSFTYPAYSTWYPHLQLCVCYYNLSNFEKSYEHNELARSFRPQDERVLFNKELLEKKLGLNQTAEQPQDESSS

SEQ ID NO: 1566 - protein, 336 aa, Unknown
  Description of Unknown: Lachnospiraceae bacterium KH1T2 sequence
MTSISLCMIVKNEENVLARCLDGIADLMDEIIIVDTGSTDNTKQIASKYTDKIYDFKWTDDFSAARNFAFSKATCDYIYSADADEVIDAENHEKFRMLKAAMLPEIEIVQMYYTNQLEKNTTYNFDEELRPKLYKRIRNFCWQDQVHETVRIAPIIFDSDIRIKHCPEELHSGRDFAIYQKLIRSGSEISPHMQRMYARELFISGTEDDFRQSFEFFKAHIDIDTDEELIKMDACVLAKCARIMDDASVMLLAASRGLAVDEVPSEIVFELGEFYRARRNYSEAVIWYYNAAFETEALLSNSYNSSFPLIGLHICYVIMGDKENAAKYGAKLRELN

SEQ ID NO: 1567 - protein, 359 aa, Oceanobacillus picturae
MVSISLCMIVKNEEKLLGRCLDTVKDIVDEINIVDTGSTDRTLEIAKKYTDRIYFFEWTGSFKDARNESFKYATKDYILYLDADDVVLEEDRKKLKKLKEELDLSVDSVSMYYNAGMDTYGNVTLKYRTHRLLKTERQYRWEGDAHNYLNVHGKIITSDVGVTHKKEHHAVGRTLSIYKKRIENKETFTARDHFYYGNELRENGHYEQAIESYTKNIETEQGWIEDKVYACINRADCYRYLDKPDKEIASLYESFRFSKTPRPESCSRIGYHYQKKREYNQAVYWYKTAIELEDDPNRWSFTYPVYATWYPHLQLCVCYYNLQQFDKAYEHNEKARYYRPDDEKILFNKELLEKKITNN

SEQ ID NO: 1568 - protein, 364 aa, Paenibacillus sp.
MKLPLSLCMIVNNEQKFIKDCLDSVKEFVSEIVIGDTGSTDMTESIAREYGAEVFRVNWKNDFGDARNAVLERASMPYVLVMDADERLNQSSSDQLIKFFEYETTNPGKVVIKNMVRDNDITFGQATRIFPNLPDYRYTGRVHEQLQYQGRTPKSLQTNIIIDHLGYKDGIVTERNKIQRNLSILTEIEKSSPHDLYVIYQIGKTHFVAKNYPEAVKYLEKVIKSIPSNSLTSSTFASSAWLTLCYSLYYMKSFKLLNKYIEEGIEFFNDYTDLYFIYGLSLTSMNHPDAIKMVPLVFNYCLQLGEADSTKYETTMGVGSYKAHYNLGIYWEIIGEIDKAYSHYLFAVQQGYQNAAVRLKLLSK

SEQ ID NO: 1569 - protein, 650 aa, Cohnella sp.
MIWHQEGYMDKLLSLCMIVKNEERVLSRCLDSVRDFVDEIIIIDTGSTDRTKEIAAQYTNHIFDFEWVKDFAAARNEAIRRATSKWILVLDADEYIERSDGVALRPFLSSLNTRKKFALSVPVLSLTGESGNVLEAEVARIFPANKGIYFHRPIHEQLTCDSGKLPLYKYDLRIYHSGYTPEVLQEKNKSKRNLEIFEKLKESGKMKQYDYYTLGNEYKVIKEYQKAIECYEKAFSNLNPELSYYKRCLIGLIDCYIALNMLQEAYNHIEKHLSRWSRYPEYHTIKALVLNELGFYDKGRIESEKAIRIAENGSNGDEEYWLISPDYGGVFPYQNLVEYYYRKQDIHQSVFYLSKILNERPNHFYTLYRLVTLLSQSESTQSIVSLMNKLYPKQTNQDLFLLLCASLKLADHGLSEHYLSAMVSAGHDIGTHSHLRYAILKRDRSLFDQYRVNSPDIVHVDHVMPELLAALLWNDTEYLPANTEVQAVQFLHSFINTSIQGDKSIITPSAAQEILLYDLLVELYRYQIYEVYDILMKRISSANLINMLANYYYDHHHLELATDYYSILLQEGKLNAQGYENLAHFHFNQGEAEEGIGFLQAAIELESGKVQYYSTLSAKCTDEGTTETYWKQGFEYFPQYRQLISRITSE

SEQ ID NO: 1570 - protein, 272 aa, Siphonobacter curvatus
MLVDITIAIPVKNEEQNLPHCLDALGKDFAKAIVLIDSGSTDRTRAIAAEYGVDFIDFTWDGKFPKKRNWFLQSGYLQTQWVLFLDADEYVTPAFKEELRQALHQTEKVGFWLNYSIYFMGKQLKGGYPLRKLALFRADAGQYERIEEDAWSKMDMEVHEHPVLQGKVGMIKSKIDHRDFKGISHYVRKHDEYSSWEASRFAKAFQTQEVRKHWTWKQWMKYKLLHSPLIGPAYFLGSFILMGGFKDGSRGLAFSILKTAYFTQIYCKIQEQ

SEQ ID NO: 1571 - protein, 360 aa, Unknown
  Description of Unknown: Bacillaceae sequence
MVTISLCMIVKNEEEVLARCLDTVKDIVDEINIVDTGSTDRTVEIAKQYTDRVFYFEWIGNFAAARNESFKYATKDYILYLDADDVLLEADQKKLLELKETLDPSVDSVSMYYDAGTDEYGNVTIRYRRNRLVKREKNFVWKGDCHQYLEVYGKIINSDISVTHKKIKHSVGRNLNIYQTKLDRGDVFSARDYFYYGNELRENGHYEKAIESYNENIAIKEGWIEDKVYACINKADCYRYLGDFENELKSLFQSFEFSKTPRAETCSRLGYYFQRKQDFHSAIYWYNLATELIPPEDKWSFSYPAYYTWYPHLQMCVCYYRLGDFKKSYEHNEKALSYRPKDERIIQNKILLEKKLNITH

SEQ ID NO: 1572 - protein, 483 aa, Sporomusa acidovorans
MEKGWSLTVCLIVKNEEHCLGDCLDSIKDWADQIVVVDTGSTDNTLEVARQYHVQIEYFTWENDFAKARNYSLQFAVGDWILILDADERIEGSLATLPDLVTKDYEGYYVTIKSPLGAGAVEAEDHVVRLFRNGRGYKFNGAIHEQIAGSIKEGKGQAAIGFSGIIVRHRGYEPEEILRKQKTVRNSQIIQSRLAECQDDTFMLYSLGTELIQQEQYGEACDLLKKALQHMTGKEGYFREVIVLALMASLKSAYADNEDLFAKALAMMPTDNDLLFLAGLRQALMGNCTFAAEMLVKGGINTVLAPPQLLFAIAGELFYIQKNWQEAYRYFKLSLKAAPSLYSAVRMIEVISQGETKSFTELADAIGGDFVRLVQEAIRQDDYYAAAIFCLAVIDKDSSKNISQWKSLYQSAIKQAGNIPAVIKDYLGILCQQIEICNVVLGGDKNCRIAQNYRAKAVNRSLRIWLTMWPEHVLSKSIWECCL

SEQ ID NO: 1573 - protein, 338 aa, Acetivibrio ethanolgignens
MITISLCMIVKNEENLLKRCLDSIHDLMDEIIIVDTGSTDRTKEIAGQYTDKIYDFTWVYDFSAARNFSFSKATMEYIYAADADEVLDEENRKKFRQLKEAMLPEIELVQMLYCNQLQYNTTYNYDEEYRPKLYKRLREFVWEEPVHESVRLTPVIYDSDIRILHMPENNHAGRDFDTFLRMWSRGQRMSKKLHNMYARELFIAGENEDFLAAEPVFLETLKASDRGLSEVKEAACVVARAARLRGDIAEFFKNALKDTASEGCAEICCELGQFYYDRKEYQEALIWYYNAAFETKSILNIHSSGDLPLKRLEELSTLLGQTEDAKHYHELCEAWEAE

SEQ ID NO: 1574 - protein, 338 aa, Unknown
  Description of Unknown: bacterium 1xD42-87 sequence
MITISVCMIVKNEERILGRCLDSLKGLADEIIIVDTGSTDATKRIAAGYTDRIYDFAWTGDFSEARNFAFSKAKMEYIYSADADEELDEENRAAFLRMKEVLLPEIEIVQMYYVNQLANGTIYNYDKELRPKLFKRNRTFRWQGAIHEQVGITTVIYDSEICIRHLPEENHKDRDLAAFARLTASGGYLDKRLHNIYAKELFISGEEKDFLAARVFFQESCKDERRGEEELMEAACVAARAARLAGDVADFFKHALKAVASEGCAEICCELGAFYMEREDYDEAVVWLYNAAYETESILDIHSGGDRPLRGLAKCYQELGNEEQAAEYTRLAAEWTTG

SEQ ID NO: 1575 - protein, 357 aa, Cohnella sp.
MVSISLCMIVKNEEAVLARCLDSVSDLVDEINIVDTGSTDQTVAIARRYTDRVFFHQWTGNFAEARGASFSHATKDYILYLDADDVILDEDRAKFKQLKAELDPAVDSVSMFYNAGEDSFGNVTLRYRRNRLIKRSRNFQWRGDCHNYLEVAGRIVNSDIAVTHRKIKHSVSRNLNIYKMKLERGDAFTARDYFYYGNELRDNRHYEEAIESYKKNIALKTGWVEDKIYACINMADCYRNLNDQDNELAALFKSFAFDAPRAEALSRVGDHFKRRKAYKTAAYWYELALAVPENNDQWSFSYPAYRTWYPHLQLCVCYYYMGDMDSSYRHNEEARKYRPQDPHVLHNKKLLDSKHAK

SEQ ID NO: 1576 - protein, 361 aa, Bacillus lacisalsi
MVTISLCMIVKNEEEVLARCLDTIKDIVDEINIVDTGSTDRTVEIAKQYTDRVFFFEWIGDFAAARNESFKHATKDYILYLDADDVIYEEDQKKLIDLKNTLDPAVDSVSMYYDAGTDEFGNVTLRYRRNRLVKRSKNFRWKGDCHQYLDVRGNIINSEISITHKKIRHSVGRNLSIYQKKIDRGDTFTPRDYFYHGNELRENGHHERAIESYDKNIAMKEGWIEDKVYACINKADCYRHLGDSEGELKSLLQSLEFAKTPRAEIASRLGYHFQRNREYKPAIFWYELAARSEPDPNQWSFSYPAYSTWYPHLQMCVCYYQLGDMQKSYDHNEKAREYRPKDERVVQNKALLEKKLGLTES

SEQ ID NO: 1577 - protein, 376 aa, Lactobacillus algidus
MNKNISIAIICKDEERVIERCLSAISKDSSMNDEIIVIDTGSTDNTLKILSTIKNIKIYHFTWDDDFSKARNFAISKATKDWVFFIDSDEVLVEESLDNLRNTIEKCMNTANKKDTIVFSPRVINSDDTVVYNAGRIIPNNNTVEYDGCVHEYPVTRDKNYNLVALKLSNTIVEHDGYEKVILKNKKKAIRNTKLIKKILKKNPDSSRYYYFYFRDAKPLLSEKEYENGMVNFFNKFPNDIYANQVAKDLANFYIGISEFQNAEKYITMLFESADKGNVDDRYLGILLTAINEIQKTKVKQKELLKLLIYSKENILKDKEVIFDKGYSFDDLIGILFFQLEEYKTAYKISKSLDTSKYSSNISEIFSKLIGTIDNT

SEQ ID NO: 1578 - protein, 375 aa, Paenibacillus sp.
MITISLCLIVKNEEDVLARCLDSAKAAVDEIVVVDTGSTDATKSIAARYTEAVHDFAWIDDFAAARNFAFGKATCEYILWLDADDVFLAPDLEKLLALKRALPLRTDAVSMEYHLAKDEYGTVTSSLRRNRLVRRSREYRWIGAVHEYLDVRGVSLESDIAVTHASTRHDGDRNLRIYEQRLAKGERFGPRDLFYYANELYDHARYEDAVDQYERFLGTGEGWSEDNIAACGKLSDCHAALGEADRTLEAALRSFRYGSPRPDFCCRIGYWHLQRGGPGIAAYWYEAALSAPKPERAWSLQNKACATWLPHLQLCVCYDKLGDYERAYAHNEIARAYRPSDAAVLHNKTYLEGVLRRSGGEAAPAEAETREEVAR

SEQ ID NO: 1579 - protein, 649 aa, Paenibacillus odorifer
MTTPDITLCMIVKNEAKHLEKCLSSVQGIVSEIIIVDTGSEDNSIDIATKFGAKIIDMTWENDFSKARNLSLKHATSSWILVLDADEAVDHWRREQLQHLLDASHIHGYWLPIIHYIGDAPKADFVTDHVCRLFRNDERIIFRGIIHEETASSIWELPAGEIAYAELRIYHYGYLEDELQHKNKYQRNLALINSGLQLQPNHLILRYALGVEHYQQEQYHAAADVLLPLLADVPTQSGYASDIYLKTAYALQRCNRQQESEEVFHAGSLLFPDFTDLLEGYAALLLEQGQLRQARHFLQQALKSGDTAHPYPSSSGSGTYRTELLAGRVCEKLFLYPNARKHYEAAIQFKPDYTDTWKQLVPLSLLSGERLSLIALTRCHIHALSPITLGYLVPAALNARDFEWLVTLSFASQLPLAVQTIVQAFLACTQQQEGAHTLAPLEQLLHNPSVLSERSSILGYLWALSCRAGDTESAMKWLISISPYRPGMLTIHHIITSRSDIKPVLPDLSYAMQLLLQVGAWDSVLSLYRQSEGSLFQWCKLPQPLYYGLLEAPTPVKKQWCSIYLSQTPHYNASSDCAEWLLYVAIACSCGETPKIAQSDEMALGRIGGTTAAVGLSYYKLILAAKAYPHGISTGQIPWGLLVRSASQT

SEQ ID NO: 1580 - protein, 585 aa, Desulfosporosinus sp.
MKERISLTMIVRNESAHLANCLESVKDKVDEIIIIDTGSTDDTLNIAQRYTSNVFTYPWHNNFSDARNFAIEHASGDWILALDADEEVQCQASFSFHSLIAKENDKEAFLLPLLNPILDSTEEYNSFYVLRLFRNNGNYKYFGKIHEQVTIQDQQKVGLAVEPILKHKLLPLKLRHQKRNRNLHLLKKALQDDPHNPFLHYYFGVEWLMLGKAGYALPYLQKAYSRLSDDQLLFRAPTLKYLLVCLRALGRLDEALSLCLETSLHYPNFTDIFYLGGLLLEEKEEYHVALKWFNHAINCGKPPALFSHLTGSESFLAYYHLGFCYEKVGETFEAREAYETALELNPRFPYPLYNLFLILLSEEGAAYCYQYLEDRDYFDDALFCLTTADLFFLADHVAQAYLCLENHKDCFQGDERFLFFYGKYCIYSGRANTGFESLNQIPTKSSCYPSAQALSIVALILLGDFPKAKSSAIMLWKNQPTRCEAHIFLCLIRLMQKQTIPPCPLRVRGKETLATNTEMLLDCKRYRSHIMSYDPLVEAWNQALETLIKSSEKGFELLFNDYNQRVQGLNDRLIAKFGNSWMDKL

SEQ ID NO: 1581 - protein, 354 aa, Paenibacillus sp.
MIVKNEEKSLARCLDSVREIADEIVIVDTGSTDRTREIAKEYDCRIVDYEWKDHFADARNFAFSQAEGEYILWLDADDVFEEKDRQQLLDWRERLDSSIDGLSMEYHLAFDGSGNVSHKLRRNRLVRRDKGFEWHGAVHEYLAVSGNIVHTNIAVTHKKDKEYTDRNLRIYKRLEEQGEVFTARDQYYYANELRDHGLNEEAVQWYTRFLDSGHGWIEDNLSASLKLAECMGRLGMKEQELAALFRSFTYASPRAEACCKVGTWFAERAEWNTAIHWFETAVALKRPEDPLANIDEPSWTWIPHLQLCVCYDRLGNHKQANYHNELALSYHPTHPSMLYNQQYLKEKLQNGVLR

SEQ ID NO: 1582 - protein, 317 aa, Unknown
  Description of Unknown: Lachnospiraceae bacterium G11 sequence
MVTISVCMIVKNEENTLRKCLDSLKGLYDELIIVDTGSSDKTKDIAAEYTDKVFDFTWVDDFAEARNFAFAQATMDYIYSADADETLDEANRKQFAILKEVLMPEVEVVQMRYGNQLENGSVYNYDEELRPKLFKRLRTWTWIEPVHETVRIDPVVFDSDIVITHKQEEMHAERDLRILRKELEKRGALSVRLTDMYARELYMAGTKEDFEGAAAYFEAIAKNNEVISEMILDACAVMVRYHNILGQPISSCTYVGIAEDLGGCSEVYLELAKYYKEAGEYDKAREFCEKAKESEPVLDIRAWKEIPDELLTSMVKM

SEQ ID NO: 1583 - protein, 363 aa, Bacillus sp.
MITISLCMIVKNEEEVLARCLDSIKDLVDEINIVDTGSTDKTVEIAKKYTDRVFFFEWTGRFKDARNESFKYATKDYILYLDADDVLMEEDRKKFKLLKETLEPEVDSVSMYYNAGVDEYGNVTLRYRRNRLLKRSRHFQWQGDVHNYIAVSGNIVNSDIAITHLKNKHAVGRNLSIYKEKIANGDPFTPRDYFYYGNELRENQFYKEAIESYSKVIEMDKGWVEDKVYACMFRADCHRFLGNAKEELSSLLLSIAFSKTPRPEVCSRIGYHFQQQRDYQSAIFWYELATSLHDDPNKWSFTYPAYSTWYPHLQLCVCYYHLNEIEKSYEHNEKAREYRPKDERILFNKKMLESKLRTVSQER

SEQ ID NO: 1584 - protein, 256 aa, Unknown
  Description of Unknown: Nitrospirales bacterium sequence
MEKFSTPCKISAVVIAYNDAPNMRRCLDSLHWVDEIVVIDSHSTDGTTEICLDYTDNVFHYPFQGFGALRNQAITHAAHDWIFSLDTDEWATPEIQQEIQTLLTQDPPARAYFVPRRNYFLGRWIKHCGWYPDYRQPQLFHKAHMRYREDLVHEGYDVLGQTGILQSHVEQIPFRTLDQYLGKMDRYSSLRAQVMHSEGRRFRAHQLFSHPLFTFLKMFVFRGGMLDRKPGLILSILYAYYTFVKYAKLWEFQKHG

SEQ ID NO: 1585 - protein, 340 aa, Roseburia sp.
MIVKNEERVLARCLDSVADLVDEIIIVDTGSTDATKEIAARYTEQIYDFVWQDDFAAARNFSFSKASMDYIYAPDADEVLDEENRQAFLKLKAALLPEVEIVQMKYHTVTDYNTVLNAKMEYRPKLFKRLRTFTWIDPVHETVRLDPVIFDSDIVISHMPENLHSKRDFSIFTKAIAGDGGLSDKLQRMYAMELYKTGDILDLMDACPYFLRIYETESQTDKRSRAAAILLRTYRRLGGERDFFKIAIKEMTDKPSSEICAELGDYYSDAGDAKEAALWYYNAAYESEAILDVHAGSDRALEGLVASYEEVLAQELSEEERDYFMESLLQAKRALEEIEE

SEQ ID NO: 1586 - protein, 338 aa, Unknown
  Description of Unknown: Firmicutes bacterium CAG:534 sequence
MISISLCMIVKNEERVLERCLKSICDLVDEIVIVDTGSTDQTREIAARFTQRIYDYKWKDDFADARNFAFSKAGCEYIYTADADEVLDEENRRKFKILKETLMPEIEIVQMYYGNQLSCGTVYNYNRELRPKLFRRSRSFVWVDPVHETVRLLPLVFDSEIEITHLPEENHASRDLAIFEKEVRTGRRLSDRLMTMYAKELLLSGSREELLRAEDYFTEAADHKAAAPEQMQEALCVVVRAARLRGDDLKMYRYAMKGITDEGIGEVCFELGEYYFGKQEYEEASIWYYNGVYETRSILNVHCSGDTALMRLADCYQALGQEEMAAQYRQAAESWSAE

SEQ ID NO: 1587 - protein, 623 aa, Chlamydia abortus
MSRPSISLCMIVKNEESCLESCLESVQGHVDEIIIVDTGSTDRTVEIAESFNARVIYHDWKQDFASARNESIKYATKEYILQLDADEYLDDRTDFVKALASELDFYYVNIRNYKTDGLSVAHKSVRLFKRRPDFIFVGRIHEQIDVNQPNVRGGSADVLIHHTGYTEDVYKEKNKHKRNMDILIQEVQQNRTGFNLYNLGNQYAQEGSYGKALSAFQEAFGLGKDRTYIPDLLSQMVICLTHLKRYAEGIRLANDAIAVYPSHADLYAVQGNLYKQMEHYEDALICYKHFLEIDESQPSAYTKRVESFLVEYLAAQVHMELGEEEEAYQAILRSLSLNRNYLPSKMMLVKWLQCRHKSGIEIISTINSSNSSDYNTVFSLLYNTRHPDLLQIIKSGSFNLEPYVKAVACLYAGEYEEARKLWNQIGEVNKDNGKDVLLLGVLTQDLRLLQMSRDVINLSDKEFKAVKSIMYKEPLQGLVPSSSLQAYLLELGRGFILVQEYDWFEYLSTQLSGISIRYRYLFSKLMHEYGFSEAAVDLILPGLRTEPHNPDLLQLLGDICRKYGNDEDALDCYKDLVRARPDMGSYTRLIRLLKRRGDKENVHKYKREMKMMYPLSNWAAMGD

SEQ ID NO: 1588 - protein, 454 aa, Yersinia mollaretii
MNDIICYDSNYLGLVKEEGVTFNLGHKEFDLLNNWIENISFILEIDKRLTKLIKNNDLSTDDILSYISVLSEKIEQTLNPTLSAIILVKNEERCIKRCIDSIVNSVDEIIIVDTGSTDNTLDIIKEIDNEKIIIHCICWIDDFSHARNFAKSKASKDWLMFIDADEYLEAIDNNEIKRKLRILQAMSIKDEIVACPFIANHNGYNIKTVRRIFLNHTDINYFGLVHEEPRIDGLLPYYISIDIKFFHDGYMDEVVKSKGKTERNLSLLRRMILLEPSNLRWKFFYYRDGIDNMNLLDAEVGIKSAVLLNQKDGFVLSNIIIDEFSFALLDVLANNLFRQGKFDDAYVIAEIMNDLNPENSNSFYYKCLIEIVRLKWGIKKLLTETIMYREKNISPQYGMIHSEGYHIDLLISILLFENDYIKQAVKYFDFFDELNFNSNILNNYKEKIMLIKLI

SEQ ID NO: 1589 - protein, 625 aa, Unknown
  Description of Unknown: unclassified Paenibacillus sequence
MNKTISLCMIVKNEEKVLDRCLSSVENKVDEIIIIDTGSTDSTMEIARKYTEKVYSYHWADDFAAARNRSLEYAESDYILVLDADEYLESNADLKTVVGSGKDYYLIRIRNLLSFGWAHTHTAIRLFVNKPQLKYKNRLHEHLDTMNENYEYSNEMADFVILHTGYMNETLAEKDKLSRNLPIMLKEVAENPNGYNLFNTGNVYYSLGNYKKAIEYYQRSYPLSKDKSYTPELLTRIATCLSYLDKHEEGLRVLEDAVEIFPNTVDLRYAQGKIYFEAGYFKDAELTFRKCIVMGDKGITVTEGAGGYGAHYYLSLLYYKKGELAKSYDEIIKVIQEKKLFVPGLNHYFEIILKGNIPFEDVKQNINNIYNISNVEELRWLMESMYSLRHPLLNEYLNSYNLTVEDKIRAVALLFDKKYEESKHCWEQISVGEENALDVLVLATIQNDQKLFQLIQPLLNLSSKEQKTLCTFLMDGENGKKPVITTRIEDIIMKVITHLISLQEFDVFERVSTMILKSDIDINIRLGEVLVNYGFNEVAIDVLSKCFERQPRNSLLVRLLGDVCLKSGYLQDAQLFYSRLLELKPEYSSYERCFNLYEALNDSEGMGVIKAEIKKKFRFSDWVNP

SEQ ID NO: 1590 - protein, 693 aa, Paenibacillus polysaccharolyticus
MQKKGGIIMQAHQHQRQRSQAERISLCMIVKDEEEMLPRCLESVRDVVDEIIVVDTGSSDRSVAIAREYGASVVEFAWCDDFAAARNAGLEQASGDWILFLDADEALEATAREQIRSWTEVSGCDGLFLNIHNYTGSGQQGATVNPVLRLFRSHPEHRFKGRIHEQIAAAICERNPEAAFHITDMVIHHYGYQTVVVERKDKVNRNVRLLQQAVEEEPDQPFHHYNLGVEYLRVGEAEQALESFGKARKMIDPAVTSYAHLLLKYEVRCLEHLERWQEALECVDAALELFPEYTDLMHHRAICADAVGDTDAAEMWLRKAVQQGPPPAIFHTEEGMGTYQTWYTLGRLLEGKADLEGAVDAYVETVRAKSSLVPPLYRLFRIMRVSGQEGQIPAVMESRFAMSSEEALSKVLGILEQCHCYDAALELLGELPSASSGEQREKRSIAEAVLHVQRGDWSSARLKLETVKRKKGSFAPMAARWLERLQWLSGKEGKEMKFQDAFTRWLMNGSQVGEGRESASEEESGSTGWGKLAVEMGNRSNLENAATLEGVADADHAELYDGWQALGLMLEGCVQSGRWQALHGLIQRGRQLLDEVHDATEKRLAKERSQGEQVKREIIDAGKLIREPFTGASDTLSGTSWLVKGLIRAADHHLAQLTSDKEQVEPGKRQRLAYWPVIQHIRLELPGADGFEG

SEQ ID NO: 1591 - protein, 351 aa, Unknown
  Description of Unknown: Anaerolineaceae bacterium sequence
MLSICMIVKNEENILENCLEKLSHLGYEIVIADTGSTDKSKEIALRYTDKVYDYAWDQDFAAARNYVISKASNEYIMMIDADEIVVSCDKDKLEDMIHKYPDGLGRLLIINDYSRKDESYRTNSRISRLFSKELYHYEGRIHEQLIPRKGIAPGEIYDLPVHIYHGGYEGDLDTRTKKTERNINLLLKELADKGDDPYILYQLGKSFYMREEYSTSCEWFGKALNFDLDPRLEYVQDMVESYGYALLNSKQYETAMGLLGVYDEFAVSADFVYLMGLIYMNNARFKEAIAEFIKATKMIRYKMDGVNSYRAYYNIGVIYECLGQTEKANTYYSKCGDYKPALQRLKNVSIE

SEQ ID NO: 1592 - protein, 599 aa, Paenibacillus riograndensis
MKPRNRISLCMIVKNEADNLPQCLKSVRGVADEIVVVDTGSTDSSVQIARSYGARIVNFPWSGDFAAARNAGLKAARGQWILVLDADEELDQGSAGELLLCAEHMEYEAFFLRIHNHRGTSRSSETITVNPILRMFRNRPAYRFSGIIHEQIASVIVREKPAAAMHLSTVVIHHYGYADGVVAKKDKIRRNVDLLKEQLKRSPGDAFHHFNMAVEYMRLGEYDHALEHIHVSLEHVEPDTSYVHLLHKYEIRCLAVKGDVQGALAACERGITLFPDYPDLHHIKGVLLLQTAAWKEAKEALRQALDIGVSPPGYHTEAGCGTYATLSLLGQLCQETGEDYEAAAFYTKAARLHPEPWPLIARLVRTMKCSGRESELNGWLELHLPPAAAEHRKLAVLLLNEGCYGAAAELLEKSGFNDALGPMGQRGASAAETGSVGAEQCKLPSVGCGESLVQQGAGRMADSEGAGNCDGAETRDGADSSDSAGKGEPVTGSDAPAAQGSAGSPGTVIEDSGSFVMALQKTAAAPAASLRQEDIAVLLEHSCSIPGQGTGLISTPAYQHSRSWMLLADFVLASLPASAASSPAAGKARQLLPLPRMTD

SEQ ID NO: 1593 - protein, 625 aa, Paenibacillus sp.
MDTTITLCMIVKDEERHLKRCLDSVKDKVTEIVIVDTGSKDKTLAIAEEYTTKIHYFKWVDDFAAARNESLKYATSDYILVLDADEYLESDADLQKDIKSDCDYVLLKIYNDVSYGRAFTHTAVRLFANHRGLHYHNRLHEHLNVLGENTNYKSQHGKVIIHHTGYTDEIMQEKDKTNRNLPLMLQEVEENPDAYNLYNMGKTYLSINEHAKAIEYFQRAYPLSAGRMFLPELITKMCYCLGELKQYEDSLRILNDAVKVYPNETDMHYMQGRIFMDAGYIKDAEMVLKGCLDLGGDLGITVTEGTGGYMTRFVLAELYESRNQLDESYKYIVEVLQEKKTFAPGLSKYFEIVTKSNIPIDDVYRNIEQLYNISNINDLQLLLDVLYGLRHPLLNKFLTVYSITAQPNVAAAAMQYDKKYAEAKDIWMNMECVTEENGKDLLLLSFLLNDDELFNLAKPLLNLSRKEEKIIRKIIKKEIISSNKMTSYVEKILGDIVSHLLKLQEYECLQIILEYLAYTSLKSKVYSYSLLISYGFTEVAIDLLVKLFEEHPNNVEVIRLLGDVCLSCNYTQDAQLLYSKLLELIPDYGSYERCYKLYEKIDDRAGMSRIVESIKNKFPRSLLAI

SEQ ID NO: 1594 - protein, 358 aa, Paenibacillus sp.
MIMISLCMIVKDEEDSLGRCLDSVQTLVDEIIIVDTGSTDKTKEIAAQYNAKIYDFVWINDFAAARNYSFSLATMDYIWWLDADDVLLEGDQQKLLQLKSTFDTSIDSLAMNYHLNSGPDGQATFSMKRNRIVRRSCGFQWHGFVHEYLVVHGKVVPTDIAITHKKNKVHTTRNLDIYEEHRAKQTAFSPRETYYYANELKDHGQFDNAVTYYQAFLDTKQGWIEDILAASCKIADCYEGLGKIDEAMTAAMKSLEYAVPRPDSVYRIGRYFMLKNAIEQAIFWLSLAAKLEAPENWGMQHKDYSTWLPHLQLCVCYYRQGDMEKSYFHNEIALSYRPDDQSMLNNRKLLLPLQPGNQ

SEQ ID NO: 1595 - protein, 623 aa, Paenibacillus odorifer
MIKTVSLCMIVKNEEKYLSRCLESVRNKVDEIIIIDTGSTDSTLEIAKQYTNKIYHFTWVNDFAAARNESLKYATSQYVLILDADEYLDPAADLQKDISSNFDYYYVKIINDMSYGTILKHTAIRLFANHKKLIYHNRLHEHLNVMDNQGDYKGSAGELIIHHSGYTNEVIQDKDKQRRNLSLMLQEVKESPTGYNFFNMGKTYMWLGEHEKAIPYLQKAYSLSKEMIIIPEIIVSLCSCLKDLHRYEEGLMILKDAIPIYPNETDMKYMQGCLFMEAGYTKDAMKAFEKCIELGDQGITVTEGNGGYWARYKLAEIHEGAYQLFEGYDQITQVLKEKKTLGVGLEKYFQIVSKANIPHDEVYENFKQIYTISDEEDLKLILEVLYKLRHPLLYKYVDLYNVSLQDNIIAVAKQYNKMYEEARANWMVMDEIPKQNVEDVLLLALIFKDMKLLLLVRDELNLSIKESKVLNAIINQDALVSMKITTPIEGLLYRMLEHLIILKEFDHFQLLSEYFLQGSVENSYKLGELLSGYSFKELAIDILIQSFRKSPNNVNVVRLLGDICFDLNYLEDSQLFYTKLLDICPEYSSYERIYNLYEKLDDKNGMSETKKTMRNKFKLSISG

SEQ ID NO: 1596 - protein, 641 aa, Paenibacillus sp.
MENLISLCMIVKDEEEVISRCLDSVQGLVDEIIIIDTGSVDNTKTVARRYTNHVYDFEWINDFSAARNESLRNATGKWILVLDADEYMNSSDIEGLITDLRATPTDKDSLKSFMLPIHNFTGQTVDPSRVMISQGARIFENQKGIYYSNPIHEQLTSDHRKITFNNLPYPIFHDGYTEIRVENHNKTERNLSILESMKTEEKLRDPYFCFILGNACTSDNQLERAIQLYRTSIASSAPSHSWYVHLLDSLISTEIKLNNYVEAYHLILQAMTEYPEISDYYCHLGILYEQFGMFQQAIHNFEQALTLAEMAVRQNRPYWNVQPSYGSSVPLQMLFNLHVQLGNKTDAVRYGVQLLQIQPKNYTILQQIWELLIQAEQDEEAIIRLFQMVYPNPTAIEYAALFLVALRTGSRSLSSYYHKKLVIDVSPNDALAYHLLQHEEKPFKLTIEMKLDASIALMAAVLYNDPQYLTAITEYRESALELWSHHNALLASPDIPPQLTDAASELLAKTLFILLRYSYNDIYFHWLQSMATADTINILANLMYEYGYYEPAVELYAILLDNEALSNKSMVNIGQWHFISNNSDDGYLFVNTAFDHEEDLSIIGWVFNYCSKNQYEQFLKRYLETFPNFNLPFLIQPAKNL

SEQ ID NO: 1597 - protein, 661 aa, Paenibacillus sp.
MGKEWVGKKMKLLSVCMIVRDEEALLPRCLDSVRNIADEIIIVDTGSSDRTKEIAQEYTDLIFDYEWSNDFAAARNESIRFATGKWVLVLDADEYLSADDGPKWLNFITQQTPKPGVGYTLTVVNYSGSSERMDQISTAPVTRLFPNFMGIQFYRPIHEQLCVGEQNGKVYTQMTELCIYHTGYQEETIVKKNKHNRNMEIFERMQHQKDMSAYDWFTLGNQYRFTNDIVNAMEAYEKSFEGADETSAWYPYCLIALISLYIENDKLKDSWFLTEEKLSNFRSYPEYFTIKGAHYESFGFYEKAIECYKKAIEKADRKARFAATAWLVNPAYGYDVPVNQLIKLSFRLCRNEEAVYWLGKKLLRDKKNVNVLFSLLEWLSLNDNEQSIKRFLDANYDTQEMSHCLILFKVFLALGNHRMVNYYYDLLSDEVTLTDRDQLRYALINKNKKLWAESVRKLSSEIKKDSFLQRQLIIGCMIFNQKDKLLELFKSSDCSGDNELLNALYNFMEKKEIVSDDVAENYSTELFLLAKDLFLLGYYEEFDNLVNYTNHPKLINDVGNYFFSVNQMQDAMNYYSLLLSRQQLDDRSYENLAFYHEAQGYREDALEFFAESLKLSPEKKHLYYPIICISEPEGKKSYFNKLVDNYPYVSDISFLMEMCNN

SEQ ID NO: 1598 - protein, 1158 aa, Desulfocucumis palustris
MKLSIAMMVKNESKYLKKCLEALKPLMKKVDSELIIVDTGSEDNTVEIAREYTDNVYFHPWNNNFSEMRNITIGYSRGEWLFIVDGDEILQEHEQLVNFLNGKESNKFNTAVIQIKNITNETNEEEGFSIITAPRLFRNDEDFHYEGAVHNQAIYKAPVRKLQALLVHYGYLHTDKELMERKFQRTSSILKSELEKNPDNVYYLFQLSTTYSMHQEYQTALECILKAVDVVSKHNLDLKQNYYVFNECAIVYNNLGMYKEAEEACLKCFNIKKGHLDVHYIAGIAQFNLNKYSEAIENFKNYLKIIESMHMGEEEADLTTTLYTVGKVEDAYVLLFKLFILVDKLEDALSYAIKITKIDYIRNNLENIVKVFVYLARFDELRKYFVDNVENQLPDSIPGFYLALENNRKNMTPEQFIAFCRAFENTPGNYGLLCEARLEYKRDASADADIIDRIKCFDFYGQYDYYADIILLWMKNQHPLSKLIGILWEQDIDIYFEYLRKHYPGLTKIVYRYLIDVPHEATLDDMRIGKIMARYIILIGGIEENEYIGAFKFYLEIGFKYVRNVYSDQVVLEEHIFSMKNKEEAFLLFVMKAFEAKEVKSRAKYLDKAKKTYNDMVKPLEKYIEKLKNIEFEKQCAELRQKRDYILNSVRKLIQEDNFINAEELLNHYIASLPDDPAAVALLSLVYILMDSEKDIEQFLPLKDYEEYKSEFKKDIKTLINEGSFYKAQKVINKYEHINGDDLDIYSMKAVIAIMNNNLHEAEEIIRKGLLIDKNNYDLLFNLAYLYEQKKDYTFAIDIYEKLINNTMKSEDKLELIQIISNIEQEQYRNSSIVQVSKSFLCSDNDCYNNFALIIPTYNRPRYLSRLLYYINNQYSRVAPRILVLDSSCQENKIINQKIIDNFQGLDLDCLSFNSDISVFEKIFQGIEDIDTDYICLCADDDFIKEEGLFRSLIALERDSSLFSVKGRNLFYVKDISNLKEYDFFAGLYDSDPIKRLELINHGFFPSLFYQVFRTKELKEIYRFLVRNKELLPYNNTFQEYLFYYMVVLTGKIGKIDVDFNIRDKGVAREQAFTNFPHAVLDKTFNEDYIRFKRSFLQYCKIVGVFGEKLDKKIDTIFSNFLVFFLGIPKEYVIQTNSQFDLKELEKGMKKSSLWPKS

SEQ ID NO: 1599 - protein, 301 aa, Unknown
  Description of Unknown: Candidatus Andersenbacteria bacterium CG10_big_fil_rev_8_21_ 14_0_10_54_11 sequence
MPGNISRIRRLHAIDNTNILILYITMQGIMLTAIVTTYNNEATIRPCLESLSFADEIVLVDSGSTDNTLAIATEYSARIVSQPWLGYGAQKNVGAAAARGTWVLFVDSDEEIPPLLGKRMKAICNGDPEKAAFNIYWLRTLNIFFHRPLRHLYGHNARLFKRGAAQWNNATVHEQVSRCINSRVIKLGDPDTGIILPPLFHHSYNTVGAYLKKMHRYTTLDAKQMAAHNRHRSGRLVRPVWHTPYRLAARQLVKMVVYRHGILDGWRGMLWCVLSSYYEFELGQKYLRNAQGEHVHNRLPK

SEQ ID NO: 1600 - protein, 346 aa, Unknown
  Description of Unknown: bacterium 1XD42-8 sequence
MIQISLCMIVKNEEKILKRCLDSIVDLMDEIIIVDTGSLDRTKEIAKKYTNNVYDYQWKDDFADARNFSFSKATKDYIYCADADEVLDEENKRRFAVLKEAMIPEIDIVQMYYCNQLNNNTIYNFDRELRPKLYKRNRSFVWHSPIHEIVRLDPVIYDSDIEIMHMSQGNHGKRDLKAFASFLKRGEKLDKRLHNMYAKELLIAGDEDDLKEALPFFLKSQTEEERSVEEIREACCIGARAGRIVSDKEVFFKSVIKSLAQGGSAEICYELGEYYFEAGDYKEASLWFYNAAFETEPFLDISLGNEKALDKLADCYGRLGRREAEEELRKAAKERKDTRLRERMGD

SEQ ID NO: 1601 - protein, 1052 aa, Syntrophus aciditrophicus
MPEKIMGISICMIVKNEEKNIERCLKSIRGVADEIIIVDTGSTDRTVLLANKYTDKIFHHPWENDFSKARNQSLKYAGGDWIFYIDADEELVRQDTQVLLEGVRNEEIDAIQVQIISEFQKKHSESINSQTRIFRNNGSIGFEGRVHNRVIGFKNAKIYPVRIKHKGYDLSPDQLKAKFDRTVPLLKKDIQDSPSNPLPYHYLSCSYLSMEMYQDALDASLTAVRLADKDRNPDLIFLWSRFNAARSYYELNELKKAEKLALRTLELYHGHIDSHFILIRIYYDQSQWSSLIYHGGKYQNLITLYKEHPENFSTVVVNTMNEIWNIHILLGIAYYELGSREQARCCFKKAADTAPKPYMAWKAAGIYCHEKKYFQDALFFLEKARRHNPHDQTTKSLLNKINKTDEKERALPTICCCMIVKNEEIFLEKCLNSVKDFVDEIVIVDTGSTDNTVEIANKFTDKIFFHPWENSFSKARNQALSYVSCDWVFSIDADEELLDGCGSLLRQTVREAGGADAFFVNIISTYDKGRKKARHNLERLYKNNGIIHYEGIVHNRLVGASNPKPSKIELMHYGYDLEEKKANEKFLRTTNLLKKDIAENPDDPRPHHYLGTSYLSRGMHEEALKESILAIKLADQQNNQHPLYLWTHHNAAISSYLFGNLESAEFYSRKSIKKYPDHLDSHYTLTLVYGEKNQWDKVERHGNKFLKLADYFENNPDKTDVVIHTTLKNIPDMHLLLGHAAHRNQNFTKMDKHYQAALKISDFKWQVLWNIATFHIDHTGDIQRAEHYLKMAVAEAPNESSIWYAFAKLNHKTGNYTEEKNCLEKLYRLGRKDVVALNRLAELSLTAGDFSLALSASSVALEADSENYQAFCYLGIACKEESLFEKAVEAFMKSIEINDRFALSWFHLAETCLSMNRFDEARTFFNQVLSLSSSLSVETLICQCEIELRCNRIDSFLAVCSRLLNILKLDIQREIGCFEDIAIILTDIAYSVRENRKAVNRLTEMISLLSIDSQKLIENLLLIESEPDTEKIEFVSKMFQINPEQRPATRSS

SEQ ID NO: 1602 - protein, 367 aa, Thermobacillus sp.
MIAISLCMIVRDEEAVLGRCLDSVAPHVDEIVIVDTGSTDRTKAIAREYGAAVYDFVWIDDFAAARNFAFSKATRDYILWLDADDMLLPEDGRRLAELKRTLDPVYNTVTMPYILAVDESGKPTFSLRRNRLVKRACNFKWIGPVHEYLEVSGPVFHSDVCVTHAKQKAYTDRNLRIYRARQAKGEAFSPRDLYYFANELRDHGHYEEACEYYERFLDTGRGWVEDNIQACLKLADCYRQRKDDRKEFQALCRSFLHDRPRGECCYRLGEYFLDRGKVDQAIFWFQMATRLPVPEDAMGMRNPAMTTWMPHLQLAVCYSRLGKHELGLLHNEKAASYVPNHPSVLHNRKFYARVLRENTNGRAGQPS

SEQ ID NO: 1603 - protein, 356 aa, Unknown
  Description of Unknown: Firmicutes bacterium HGW-Firmicutes-7 sequence
MISISLCMIVKNEEDLLARCLDTVKDIVDEINIVDTGSTDRTKEIAIQYTNRIFDFEWINSFGAARNESFKYATKDYILYLDADDVLLEKDRIKLKELKETLDPSVDSVSMYYDAGTDEYGNVTLRYRRNRLLKREKNFTWQGDCHQYINVSGKIINSDIAVTHKKLRHAVGRTISIYAKKIERGDTFSARDYFYYGNELRENSHYQKAIESYDNNISLKEGWIEDKIFACIFKGDCYRYLGDLKNELCSLLQSFQFSSPRAEACSRIGYNFQLQKDYKTAVFWYEFATQQVPDPDRWSFIYLSCYTWYPHLQLCVCYYNLGDYQKAYEHNNEAEKYRPEDKSVLHNKKLLEGLLK

SEQ ID NO: 1604 - protein, 700 aa, Clostridium autoethanogenum
MLLSICMMVKNEEKNLDRSLKSMLPILDGIDSELIIVDTGSSDNTVQIAKNYTDKVYFHEWNNDFSGMRNKSISYAKGEWIFIIDADESVEDAKEILVFLKSKYTKGYNCCNLTVKNITNKDEYVLLSSPRIFKNDGYFHYEGKIHNDPIFKGPVLTLDTVLVHTGYISTDKELMERKFKRTSSILKEELRKDPENVYYGFQLSVSYSMHKDHKKALEQIEKTYDIFSRKKLDKAQHIYLYYQLAVCNLRFDDIKNYKKVEKYCIEGIEVESEHIDLYFCLAKAYMLMDKYEEAVEYYSKYFELIDNYSNLNIRYNILIQVYSENKKDEAYYDCAGACFELHDYKNCMDYIEKISSEKYIKKIAKIAVAVFVSETKFDRLKKFYDKVTQTSDEDFIRSFLNILEGNVIKLKKEKYINYLEHFSKDNDTYCYLNKIRKMYEDGNNDYGIMITQFVNEFPLSNQPGYFGDLVYFKMKLEEDIYDMLSKVSASKIEDFIKYIANKYDDFNDTICNYVSENVNSNFYTERVKIILERFILVLDKIDEKTYKNVFNDYVQCGTDYINTIYNREVLDERIIYDVKNDEEVFFIFMNKANEVKDYDEKEYIRYLRKALAVYPFMKKGIEMLLNELKNEMNATSDEFEDDKVKVKNTIKALIENNKLNEANKVIQEYENIVKDDMEIVFLKSQISLKKLKNPSTVYKM

SEQ ID NO: 1605 - protein, 253 aa, Winogradskyella sp.
MLKLSGVVITYNEERKIRACLSSLVNVVDEIVIVDSFSTDNTKAICKEFNVKFIEQEFLGYIEQKNFALKQASNDYIISLDGDESLSETLQKSIKYLKNNWTFDGYYCNRFNNFCGQWIKYSDWYPNRKLRVFDRRKGHWAGINPHDNFQLVPNTKTSRLKGDILHNTYQSYSEFNQKTEYFSTIAAKAYYDKGQTASFLKVIWNPTWAFFKAYFLRLGFLDGFNGFVICAQTANITFLKYAKLRELYRNNKN

SEQ ID NO: 1606 - protein, 322 aa, Unknown
  Description of Unknown: Clostridiales bacterium sequence
MITISLCMIVKNEEKVLARCLDSIADLMDEIIIVDTGSSDNTKEIAKKYTDKIYDFAWIDDFSAARNYSFSKATKEYIYVADADEVIDADNHRKLAELKEVLIPEIEIVQMRYCNQLTNGTAYNFDEEYRPKLYKRQREFTWIEPVHEMVRLDPVVYDSEIDILHMPESVHSSRDFAVFQKQIQKGQRLSKRLHHMYAMELYISGSDEDVIQAEPYFAATACEPERSLDEVKEAACIVVRAARLRGDSGVILKMCLKDLLSEGSSEMCYELGEYFYEKKDYEEAAMWYYNAMNETNSILNIHTSTDWPKVRYAEIEKIIAGK

SEQ ID NO: 1607 - protein, 647 aa, Cohnella phaseoli
MNKLMSLCMIVKNEEQFLERCLKSVQEWVDEIIIVDTGSTDRTKEIAQAFTNNIFDFKWINDFAAARNEALKHATGKWILILDADEYMEEKDIRGLRDFLDGEKPSTEFVYRVTVRNFMDSSNHTGISESPILRIFPNRVGFEYYRPIHEQIRLTTGAPYQIIALPFQILHSGYLDHVVASQNKHDRNMSIFEQMMNHTKLNAYDHSMIGQQLSMMRKSEEALHHLEIAFAHGDKSSPWFLNNLWTMLDVYLQSQQYIKAWDLIDQHMAEYIDYPDIRCVRGLILISLGMREQAKQELMLAHQEAENRARLQKDITLVSPNLGMRMPLWLLAIMFENENNFQPCIHYLTLLLRADDQDIEAWVKMVEILSLNESSENIAVFLNRLLHVDAYPKKVVAMAKISISLGNQQLAKYYVDRLPSIDRLSLNEQLRYTLLSKDPITFEQFLKNRAVEELTESAAVKMIILGSIVWSRPEWIELCNQGLTDESVGIQFAKDLLQPALTKELDSSFEPVAIDILSQLYFLKAWDTFDSLIDQFSSAAVINQLANVFLSKHFVQPAMQFYQHLLDHNELDATSCENLALLHIIDGKTEEALEFWEQAILLQPKAPIRLFIQYCFFCKDASAKAKMKAKLTEQYPDDAKSLLIKGL

SEQ ID NO: 1608 - protein, 593 aa, Clostridium sp.
MADQISLCMIVKNEEKDLPRCLESIKNLVDEIIIVDTGSTDSTIDIAKNYGAKVYYFKWCDDFSRARNESLKYATKDWILIMDADDEFAQDDKQKFNELKDKLDVSKTYFFETVCYFGMAKGNNISINLNPRLFKNNYGYSYKGVIHNQLINSDHPINGICESIRIYHYGYLDNEILNKKKNERNIKILKKEIEKDPQNKFNYFNIGTEYSSINDEKKALENYYKAYDKFNPSTGFAPKLIEKIVISNYNLKRFDTSIEFIETGIKYYPEFTDLYYLKGLVLEMQHKPTMAIEVFEKCLKLGEAPFMLKCMYGTGTFKASYELSKIYLYLKDYDMAYKYSVDTLRFKSDYLVPLYNITHILKKKNTPIDKFKQIIENFFHDIKNQYQIIADLFYMEGYYDIALEYIDRYSSENTPEDLAFFKIKCLIRSKKFEECIKYTEGVSEENLYYFQISMYRIICFLVLGKYDFAHGTIRQFYLERNDHNKKIINVYNELISIFEGKETSILSEDENEKEYTSAIFEVFEILLANMEFDKFEKSLELLNLISDKSVLLQLGKLYYKYGYRDMAKKEILRSIKMFDLIDSESLDILKSCI

SEQ ID NO: 1609 - protein, 596 aa, Paenibacillus sp.
MTTKPQQPLISLCMIVKNEADNLARCLRSVRGTVDEIIIVDTGSTDATRSIARSFGARIIGFPWNGDFAAARNAGLALARGTWILVLDADEELEQGSREELLVCAKHTEYEAFFVRIHNHQGTERASQTLTVNPILRMFRNRPGYRFSGIIHEQIAAVIVQETPAAAMHMSTVVVHHYGYAAGVVERKDKISRNLGLLKQQLEESPGDAFQHFNLAVEYMRLGDYRQALKHIGTSLNLAEPGTSYIHLLYKYKVRCLAVTGDYPGALEACGQGSLLFPDYPDLHHLKGALLLQVSALAEAKTALCRALEIGASPPLYHTESGLGTFLTHTLLGQVCQQIGEAQEAAACFTRAAQLQPDPWPLIPRLTRLFKCTGREPELHGWLAGQLPGILAEQRQKLLRLLVRDGCYTAAVDMLGDGAGAGVAAGKMGGTAQSAGVMEAAVRDAGEMDGMAQSAGVMEAAARDAGEIDGKAQSAGVMEAVVRDAGEIDGKARDAGAVDDVGPEVPPTADLLELLQRAKAASAAELSYDDITEMLSHPAVVPADRNTSLPIPAIVAAVQPWILLADKVLAALVTSAMYSPAAAAARLTLPLPRSAD

SEQ ID NO: 1610 - protein, 623 aa, Bacillus timonensis
MVKKTLSVCMIVKNEEKFLPKCLESLRNEVNEIIIVDTGSSDKTIKIAEEYGAKVYNYEWKNDFADARNFSINKASSEYILVLDADEFLDHNTKIEEVILSGKDYYVLKIKNNMSNGYVSYHQAIRLFKNNIGLSYYGKIHEHLNIEEFTNLTSEFGDVLIHHDGYTQEMYKERDKYNRNLEILLKETKEFPTGYNLFNLGVQLKVGGKPKEALEAFKKSYFLSKEKVYVPYLLYLMGDSLLTMGKLEDGISLIKDATKIYPKYTGFYFMLGNLYSQNNFLLDAEFAYKKCLELGEVEYFQTIEGVGSYLASIKLSEVLQRQGKLLGALNHAISAITEKKNFAPAISQYINVLTQSGIDKNAINENIKKVFPMNNSKEMLLLLGVLLAKRSNLLLELITEFNLKVDEQLLFIALLYGNKYDEAYLYLKDISVFKGEYLTDILSLAILRNDRKLRDEIVLQLDLVEEEKEILLEILDDGNVDYTKLTDNVSKIIVKSISNFINMNEKEIFIKMANGLSRYGKVTFELSKQAYLLGLSEYMINILNSIESKVVNDNLFSLQGDIYLASGNLSKAIQVYNELYNKTPNYQHLNNLYNFYEKINDTDGMNIILKEMSLNDLSMLQGF

SEQ ID NO: 1611 - protein, 655 aa, Cohnella panacarvi
MKYPLSGGSMNNLVSLCMIVKNEEAFLDRCLKSMEKYVDEIVIVDTGSTDRTKEIARRFTDKIYDFAWINDFSAARNESLKHATGKWILVMDADEYMEENDIRGLRDSLATIEPTTRTLYQLPVRNFMGDQSNAAIVEAPVLRVFGNRMNIRFHRPIHEQPVPANGKAPDIVALPYRILHSGYLDTVIDAKDKHERNLSIFNEMKKTAALNAYDHCMIGQQLALMKKDDEAIQHLQIALDSGNNKAEWFRIVLFALLEIYMRQGKLLEAWHLIERYLQSYVQYPDIRCIRGIILQNLGFHELGKQEFIAAHMEAEKRAANNQVLSIANPEFGTRMPLWQLALTYERDQDLNQCMTYLTRLLMANNKDMSAWIKMVEILSLKEAASNIVRFLDKLLSVSESDAKMKTMGKIAISLGNKELAQHYFNRSPLSYSIADRLKYALLTDNLADFESIINTNTQEELEDTTVAKSVIWGAIAWARPDWLVRYRNRDSTDDIHRYLTFVDCVLFDQAVPSANEDFDRTVFETLTQLYLLKRWDVFDRLIERYATPSVINQLADFFLTKHYKEPALQFYQHLLDNGQLTEASCDRLAQLQHIEGDPEDALGFWAHAIELNPANPKLYIQYLAHCPDSERRAPIKTKLIERFPEYAELSLLKTL

SEQ ID NO: 1612 - protein, 361 aa, Bacillus sp.
MVTISLCMIVKNEEAVLARGLDTVKDIVDEINIVDTGSTDKTVEIAKQYTDRIFYYEWTGNFAAARNESFKYATKDYILYLDADDVLLEEDQRKLKELKESLDPSVDSVSMFYNAGMDSFGNVTLRYRRNRLVKREKNFKWGGDVHNYLNVYGKIINSDVAVTHKKIKHAVSRNLSIYKKKIERGDSFSARDYFYYGNELRENGHPEEAIKAYDQNIELKEGWIEDKFYACINKADCYRNLENPEKELESLFQSFLFSKTPRPEACSRIGYHFQQKSEYHHAIYWYEAAIELKPDTNQWSFSYPAYSTWYPHLQLCVCYDRIKKYVKAYEHNEKAREYRPEDPSVLHNKSYLEKTYGFGEE

SEQ ID NO: 1613 - protein, 691 aa, Clostridium ljungdahlii
MQISICMMVKDEEKNIRRCLNSIRPILESIDSELIIVDTGSTDNTVKIAGEYTNKIYFHKWENDFSGMRNKSISYAKGKWILIIDADEEMTDCKNMIELLKSPQFKMFNTGFMDVKNMQNLHDDCGYAMLKSPRLFRNDGYFYYEGIVHNNPVFKEPTIDLKTTIVHYGYIEENKDVLDKKFIRTSSLLKKALEDKPDDIYYIFQLSVTYSSHKDYLKAYEIVKKAYNLLTQCKDKKKYKYVYYQVALCCLYLEYDQEAKKACKEGLEIDNEYVDLVFYLAKAQGLTSEYEEALENYKRYMYLCDNYNNMSINFDVSLGMYTLGQKDEALQDIVKICYRLGKFDDIFDFAPKLKKYKYIKNVLELVIDGAIKSQKIKYIKTFYEDKFIGDKLREKDFFNTLEKYCNNDICRLFSNYDNDYSRLYLFRYKYNMKDSSFKNVVDELSFENDFNNLEDYFGDIIYCKIKYLSSISHLLFNVWDKNIDRYLSYISKKYDDFSDAAAGYIVHFKDSTSHGDLRINKILCRYILLIDKISSFKYEKMFNYYVDIGVKWIKYVYSNDLISDDYIDIFKNSEEKFLVYMIIANKNQSNTKMYLRYLEKALEAYPYMKKGIEILLQDVKSKINQSNSEFEKYKVQVKNTIKTLIENNKLDEADKIIQEYEEIVKNDMEIVFLKSEMALRKLKNPSTIYKM

SEQ ID NO: 1614 - protein, 626 aa, Paenibacillus ihbetae
MGKQSISLCMIVKNEERCLERCLNSVQGIVDEIIIVDTGSTDKTLEIAKRYTDKIYFFEWINDFAQARNFALEHATGDYILHLDADEYLYKGSELLKHDLDKAYYFLRIRNDLGFGQAEIHQFVRLFQNSPTLKYEGALHEQINLEKNAHLPFGFLNCLIYHDGYLEQIVKDKNKDQRNMDIAKAALKANPTPFNYYNLGMQYAFEGEHVKAIENFKQSYSLANNQTYTPRLLILLMKSLFELKQYKEALDIGFDSVLIFPGNTDIWYLMGSIYDNLDYFEDAKYCYNKCLEIGEGASINEFNHNEGSGSYLAYGKLSRLYLQQGNKEKAQEYFILAAKEAPDLLYLVKLFTDLHPSLSGKEFLAAMLKVWPFTDGKWIQNMMTLLYEFRHPAAYEIIKCYHVELPLEVEAWVDIIEGNYDLAIEKWNQMDKLQDYFKRDPLLLAFITQNFNVLSPFKHDFGFREREWKWWRDLIQNRTDSGLELSKESEECWINLCADLMKLQKYENLEELINSTRSPKLRLFIAEELKRNGFTELALQIVVESNSHKVNERIYSLVSDILKEENEMDDAIYYANMARSLNKNFINSYRLYNLLKLSGLVREADQLIKEMKIDSIRSPWLDSFNV

SEQ ID NO: 1615 - protein, 756 aa, Alicyclobacillus sacchari
MLLSACLITKDEEFTLSRCLESLTGVVDEIIVVDTGSKDKTVDIARDHGAKVYFHEWDGDFATARNAALERASGEYVLVIDADEFLDPMDKRHIRSKLLESRADGYLVGVVNYTGTSARYQTSSPVQVLRVFKNGYRYSGSIHEQVLPAVIDSGGRIETLNLRIHHLGYLYEFVVYKAKPARNMELLQRELDKDPDSLFHISNMMAEYMRVQRYDEVVKLGKHGFEVFQKNPNHATHLLARLLRMLVVALSMTGETAEAIKYAERGENIFPYLPDIRMDHAHALIQVGRVADAIPLLLQCRQLGDVKDPLIDTVPGLGSFLAAAELGRAWLLLGDTACAAEWYLTSFRENTRQENIVWFLANLLPLEHASIRAQLYNVCKQDPLCFAYFVQACAVRGGKDWQRWISEISRGPLTDTLIERLHWIEALRASEQSMDVYTKSNPCAEIQILLGLYYLEHGDIQAAQEWLVDADSRGQMILEWISDGHTEVQIADVLMELMLLHATKLLTAWLPRATDKHTVLPTILASPLRDVLVEVEWVGENGWECEFRANRAFRRGDMRESISWLEKAMQYPPSVRRVVIEADIALAHGNVELARHVVEQGGMIFSSSELLKRIASELDVRQRRVKQIDELLQWNEGDEGMNPHRAYQSSALTMPLQVKLVKLHERAVECVEQIRILNEQGEIMEARKYIQYVQDIITFLRSSTDSSTEAGKAADASYAFYYSMLVKWFLQPSLIAEQYQNMKEFWESWTETWKRL

SEQ ID NO: 1616 - protein, 359 aa, Mordavella sp.
MAAISLCMIVKDEEAVLERCLGCFGELAEEIVIVDTGSSDRTTEIAGKYTSRVYEFPWCGDFSAARNYGFERATKEYCMWVDADDVMRREDRRRFLEMKKTLPADTDVVLLPYETGFDSEGRPVFSYYRERIVRNSPEFRFMGRVHETIPLKGTLRYEEIPVVHRKEGPGDPDRNLRIYEEMERAGESFDSRALYYYGRELLTHGRYEKGAQILQAFLARPDGWVENRIDASRQLAHCFRGLGQEEKELDALLGALRYDVPRGETCCQLGRYFLERSRYAQAAFWYEQALRARKDPASGAFIEEDCYGFLPAISLCVCHDRMGDLEQARRYNELAGRYKPESEYVIRNREYFEKIGVRG

SEQ ID NO: 1617 - protein, 247 aa, Paenibacillus massiliensis
MSVSAAMIVRDSERCIARCLDSIVDAVDEIVIVDTGSTDRTLDIIEQYIKNYHHIKLYHFKWIDDFAAARNYSLGKVTHDWVFVVDSDDVLPATEQAKVRSYVQRQLETAQEAVFDIVYDNTVAGDIVEVIEVGYVRLFPAHLRYEDRIHEQISFGDLPRLRSDIHLLHDGYDVNIVDLKAKKKRNVDLLIASLQANQDNARLWLHLAREMSVLDQAKARRYLDIAESKTSNVDLLRLINNERSAIS

SEQ ID NO: 1618 - protein, 640 aa, Acidibacillus sulfuroxidans
MLLSACMIVKNEELTIRRCLESLQGIADEIIVVDTGSTDKTMEIVQSFGCTIIQHEWQNDFSSARNAGITQAKGDWILVIDADEFVERLDREKFFQFLKATDAEGVFITVNSLMGPLAHPSNIFAIRVMRLFRKGHLYSGAIHEQVADSVFRTKRPIAKYDLILTHLGYTNEFVAMRAKTKRNTQLIEQMIEENPNDLFQITNLMAEYSISGQHTQCATLSEKTWNRVKKMPTSEWPNFAPRMVSILVASLWELGKREEALSYMQEGIRLFPWFTDFKKRYADMLILNSQFRAAIETLMECRKQGDTQLGLIEFLEGAGTYLAAYSLGVAWAHVGDEMNARKWFLQSFFENPAQDNTLLPIIGLLPKDPKLLREFIEPRLYDPTAFATYVEIYSGWNYEDADRLIDQLEKKYGESEASHRAHMSLLRLEGTEALHKRAQTVNYDIDWLLLGIHYLELGDKEQANYALSRAKVRGEYLLKVMTSLENSPDSTWGLHGVIRDLIAMNPTTLLQKWLPRAMDIETFWITLKCSPLKSMLETITWPGKTAHECEQNALNHFNQKNYREASKWLTRAQQFEKTVTQFLLECDLALAENDLPKARKTIFDGKKLYPDSEMLKIASDQIHPKLNPLEITQKLGSGMQ

SEQ ID NO: 1619 - protein, 341 aa, Unknown
  Description of Unknown: bacterium 0.1xD8-71 sequence
MITVSLCMIVKNEEQILQRCLDSLAGLMDEIIIVDTGSTDATKEISARYTDQVYDFVWVNDFSAARNFAFSKAKMEYIYSADADEVLDEKNRAAFAQLKQTLLPEIEIVQMYYANQLSHGTIYNYDRELRPKLFKRNRTFQWQGAIHEQVGITPVIYDSEIEICHMPQTNHKDRDLAAFARLAAAGESLDKRLHNIYAKELFISGEDKDFLAARAFFQASCMDSVRGDEELKEAACVAARAARIAGDIEDFFKYAMKVIASDGCAEICCELGEFYRQKKDYDEAVVWYYNAAYETESIVDIRSGREIPLRALADCYRALGNEEQAAEYERLARESVQEQDV

SEQ ID NO: 1620 - protein, 648 aa, Paenibacillus sp.
MLLSLCMIVKNEERTLARCLDSVKGLVDEIIIVDTGSTDTTKEIALSYTSNLYDYTWTKDFSAARNESLRKATGKWILVLDADEFVEQGNHDKLRSHIEQADPSLPQGYLLTIMNMTGQNEENMSGMLQSSAARLFPNTPDLYYTRPIHEQLTYKYGEVECTPMEFTIFHSGYTDETVIRKDKSKRNMEIFDAIQSRGDKLDPYYDFTLGNEYANAGQVSKALECYERAYKHSDHSLNWIPHCSDFMVTNYLLIHEYSKAYQMIQTGLKRWGGYSDYHYYSGFLYDALGFDDLAKTSFMKAIEIEEKANKSGRSATIIRSQFANVFPSRSLAQIYYNEQNLGRSVYYLSKVLNHTPDDAATLFKLIKILAQSESESEIVPFLEKLYPAGKPANLLLLFRVSIMAAAAGLAQHYFARLTELQIEPGKAELLDYSLLINDLSLFNHVNATIEQTEASKPLFVKLRLLALLIWRDPVHIAQFQLDENHALNNVWSSIIAVLRGEEPAPIAEQDDTFFNELVMQLFNLQAYDSYDLMINQLSGPNTINYIGDYFYSIHQIELSLDYYSLLLKENTLQATGYVNLGKLYLEQGELDQGLEWLAQAISLNPDKPALYLLYCKHTRNHSDKKRYKKAFFEKFPKLQGLSFVNAIL

SEQ ID NO: 1621 - protein, 587 aa, Pelotomaculum propionicicum
MRGAISLAMIVRNEAENLKSCLDSVSGQVDEIIIVDTGSTDGTVEIARLYTDKVYSYHWADDFSAARNYAIEKAKGEWILCLDADETLDLATGDLKSLLAGENQLEAYLLPLNNPTTESTGEYNRFLVLRLFKNNGRYRFQGKIHEQICISENGVVGIADKPVIRHKLITARERNRKRGRNLALLKNVFSEDPQNYFIQYYIGVEWLMLGKPGKALPYFQQAYENLTDEHLLFRSPALRYLIICLKDLGRTNEAIDLCREAVLRYPAFTDVYYLCGVLHEEKKDYRTAIEWLNQAVGRGTPPALYSHMNGAGGFLAYSHLGFCHGMLGQSEEARKSYERALEANPSYIFPVYNYFLIVMAKHGPYSAWERFKAKGYLNRIDLALAAANLFFVSGYPELACRCLGNCAISRARDEEYRYYWGKYNIYAGRLRQGLKCLRTISGESGFYIPAQIHQAIALLLLGSCQEVKALALMLWKNHAARCHAFVLLVLTGLMERRGDVKYPQKVHGIELPKIAAEILEECGHYHPVNKRIKDNTRFHRLIGSLESIIKNTSPGGCLILMDYYRGKALGTKRFYEYKFEPAGVSYE

SEQ ID NO: 1622 - protein, 313 aa, Paenibacillus gorillae
MIVKNEEQVLARCLDSVKTLVDEVIIVDTGSTDRTKEIAAKYTSRIFSFVWTEDFSAARNYSFQHATQDYILWLDADDWVQEEDLHKLVALKADLAADIDAICMNYVLAFHTLGQPTAVAKRNRIVKRSRQFQWHDPVHEYLDVSGHIVFADITITHDRRHSHSQRNLRIFEKAIKEGAVLNHRQLLHYAMELTANGHYEKAIAIYQCQLDDPSGYFEEKLDACDRMAHCYHELGCKDEQLLALLKTFHYDVPRADYVCRIAYYFQENEDFEKAVNWYELALKLEKPDNRLYGVNHAAWTWLPHEQLAVCYGS

SEQ ID NO: 1623 - protein, 634 aa, Bacillus coahuilensis
MIVKNEEALLERALSSIIEHVDETIIVDTGSEDNTKDIAKRYTEQVYDYEWNNNFSDARNFAASFAKSDWILVLDADEYVEQENINKALTELEYLEEKYSVLAVNIINFSGHYGESIAQHRHARLYKNNGFIKFYRSVHEQLMHVEDETISIGISSLILYHSGYITKEIQDKDKSNRNRSLIENELEIEQSKGFDYFNFGNEYRIKGETQKALDCYVKAYKYKVSFQQDWIPFCLCNMVECLIMLERFDAALQIVQDAEKIYSETVDFLYLRGHIYLVQNQFNDAKNIFLEIADNQDRFKSVIKSKDFLEYLPNKKLGYIYAEKEDYQRAVHFFVTAYNYNNFSLESIYQLVMILKKFHTESEIYEFITSKILQETNNKLIHELLQLSANEGLFEFCRKIVNHYFINHKNIQEGLNYKLGVAESTIDLRDKSTSELLEIVSTKLLDILDLFIINYDLKNPKHDNVERVLKGSELSDMYSLIHSPLDIKLTQLVSSKKVTLLIERIIAFNRLDLVDQFTDFILKNREHFEENVLAKIGNTLYNKNFKGAAFSFYTEAEMKELDAESYLNIIHGLLEIQEYADAKKYLLSAIKYGVKDYRIFEIALKYRNELGIKEKLIKKALDLYPYSQNLNSIL

SEQ ID NO: 1624 - protein, 632 aa, Paenibacillus lautus
MNSRTISLCMIVKNEESCLERCLQSVQGSVDEIIIVDTGSSDKTKEIAKRYTNQLYDFKWIDDFAAARNFALSFASSDYILQLDADEILADHQKELQQYLDKDFYYIQIKNDLGSGQYLSHQFIRLFKNSPDIRYRGALHEQVPSDFEIERYGSLSSVKIFHEGYKTHVVKSKQKIQRNFNILLKEIKEKPTAFGYYNLGMQYVLEKKYHDALKALKKSFSLGNQYAFTPKVVLDIMKCLQALGQYQEAIEIGDDAVVLYEGVPDFWYQMGLVYMEWGLIKDAQQCFEQCLEIGEENTSKLVQHYDGTGSYLAQGKLAEIQLIMGHHEEALQCILKAVRDSPDTLALFDIFLSIYPSANNEELFQTISSIWPFSSQRYIELIGYLYQRRNPLLGEFIKYFEMEVVYPVSVFNFIIAGNYERALSEVISNKDRSIEKDPHFTSNLLFLAMVNNNSALLDQFGSDTSLSSKELKWLKKLVVNQAVEEISISRAIQTVWKQLVKDIIQMQRYEYIDILINATNQPELRLLVAECLQSFGFDDLAIQVLVETSNRQLNRKIYMTAAKSLRKLGAVDDALFYLEKAEQIKKDFDVMFEQWRIYHESDKNFEHEVLKKMNSLYPDSKWAKQTLKTTYH

SEQ ID NO: 1625 - protein, 351 aa, Clostridium beijerinckii
MLSLCMIVKDEEKNLKNCLSKAANFVDEIIIVDTGSNDDTKVIAKEFTDKIYDFQWCDDFSKARNFSISKASGDWILVLDADEFISEVPKCSIGKFIMDSLNKDKVGRIRRVNVIEDSTGIRKYGERVNRLFNRKYFKYEGIIHEQIVSIDGRDYKAESVDISIEHVGYTKEVLRRTNKIRRNIDLLKKALKNNSEDPYIYFQLGKSYYMLKDYEISNLYFEKALTFELNFNLEYVEDLVETYGYSLINSGRYSEALVLENCFEVYEKFSDFHFLMGLIYMNNAMFERAINCFLKCTEFLDSNVEGVTTYSSYYNIGVIYEMLGFSEKSIEYYNMCGDYEPAINRIKARSN

SEQ ID NO: 1626 - protein, 381 aa, Unknown
  Description of Unknown: Clostridiales sequence
MATISLCMIVKNEEEVLGRCLDSAVSFADEIIIVDTGSTDRTKEIASEYTDQVYDFKWTDDFSAARNESFAHATMDYCMWLDADDIVTEEQQEKLIKLKDTISSDTAVVMMKYVMGFGSDGRPTFSYYRERLLRNGCGFRWQGRVHEAIAPAGKVVYSEIEIEHRKKRTGEGHSRRNLDIYRKMKAEQAPFTPRDLFYYGRELYYFAAQDPQCLQEARAVLSSFLDRTDGWVENKIEACRFLSLCWRLEGNEEEALKALLFSFFYDRPRAEICCDVGDWFFRREEYRTAAFWYSAALNTEKDEKSGGFVSGECYDYIPALQLTVCFYRLGETDKAEACNELAGRVKPDSEAYLYNCRFFREERDKAQKQPKADKNNEEHEK

SEQ ID NO: 1627 - protein, 372 aa, Clostridium sp.
MEKNILISLCMIVKDEENFIDSCLKSAKDLADEIIIVDTGSTDKTRKICEKYKAKIFYLPWKDNFAEARNYGISKANGKWILWLDADEEIIIKNKNKFYQTLMDEKGYIYLVPIINYYGDFPIDINRSYLFSSYRLFRNHRDIKFTGKIHEHLTMNYSGEIYSEKALPYIEINHYGYLDSIIRKKEKITRNLKILENEKTEPNYSPWIDYHIASEYYSLKKYTKALYEINLSIIGFLKNYKLPPSLLYKLKYDILINTENYNEAKFGIEKAIKLYPDYVDLYFYKGIILFKENSFKEAILVFNQCIKLGEGNSKYLILSGAGSYLSWYFIGCCYKEINDYKKADDAFKNVLAIYPNCIKAQRELSRITKKSN

SEQ ID NO: 1628 - protein, 662 aa, Desulfosporosinus sp.
MAEKISLCMIVKNEEQNLPRCLNSVSGIVDEIIIIDTGSTDSTCQIAQQYGATLNHFLWNNSFSAARNASLEIAQGDWILFLDADEELAPDSQQILKRLVKDEAVEGYFVKIINYLGKEGWIEAVPDLVFRLFRNKKEYRFRGSIHEQIADVILENNSRARYQLAEDLTIIHYGYLDTVIQDKDKKNRNLALIEQELKLYPNNRLLQYHYGVELFRAERYSEAAAVLIQSATDIDPNTIFLPKLIRYIVIAQQSSGQLQAALDTAILGLKLFPNYADLYFYRGLILFEMKQFAQAQKVFTQALSMPEQPPQYASFGGVRGFRAYYYLAQIAESFLDYEEALKYYLYSLRDNPHFTHALEHLVLILRPTIEPLYTKECLEKVCDFCTPAANRLMADIYFRHGAYGLALHYFDQVEEGFPTSSDIKLRKAICLIQERRFFEALRLLDDFSEDSPEYPIAAVNKLFCVWIQEKPQKVRTLWRDLHALGLEIDTENVISLFPAFLERTKPSSQFLLGSDGLLLLLDIVQRLVAMGEIDRAFYFLNSLHPECLIENSDKIAKIFLNYGEDIKAIPFFITAIERDSLPDAHFQLAEIYAHLGKVSEAEQHYKQALQQNPEDPRCYVRLIGLYSAWRQAILKEALERFPENELLKKLVEEVPSSYEAAD

SEQ ID NO: 1629 - protein, 236 aa, Campylobacter jejuni
MNISIVILTFNSQKYLQEVLQSVNFANEIILIDSGSTDDSLIIAKAFKNVKIFHQDWLGFGKQKQFGVEKANNDWIFVLDSDEVFTEELKEEVLQIIKNPSFKAYKVARLNFFFGEAITKMGLYPDYNIRLFHKKYAKFDEREVHESIICQEKIGKLKHHFLHYAYENIEQFIDKQNKYSSLNPKKNNLLKALINPYWTFFKLYFIKLGFLEGKRGFIIAKLYAQYTFWKYIKSEF

SEQ ID NO: 1630 - protein, 247 aa, Unknown
  Description of Unknown: Bacteroidetes bacterium sequence
MLSVVIITKNEERNIGRCLESLQKIADEIIVIDGFSIDQTQKICEKYGVKFVQNTWLGYSETKNFGNSLAKHDYILSLDADEALSEELQKSLILLKKNGFSADSYQMNRLTSYCGQWIKHCGWHPDRKLRLWNKNKGFWQGIIHEKVEMQSPKIEFLQGNILHWSYYNISEHIQKANVYSSLGAENNFKNGKKGSIFKILFSPLIKFLKSYVLQTGFLDGFYGFVICSIASYETFLKYLKTRELEKK

SEQ ID NO: 1631 - protein, 357 aa, Paucisalibacillus globulus
MVSISLCMIVKNEEEVLARCLDTVKDIVDEINIVDTGSSDTTVDIAKKYTDRVFYFEWIGDFAAARNESFRHATKDYILYLDADDVLLEEEQEKIKRLKESLDPSVDSVSMYYNAGLDEFGNVTLQYRRNRLVKRSRNFIWKGDCHQYLEVYGKIINSDIAVTHKKIRHSVGRNLAIYQKKVERGDVFTPRDYFYYGNELRENERYEEAIESYNKNIQMKEGWIEDKVYACINKADCFRFLGKEEEELYSLFESFQFSKTPRPETCSRIGYYFQRKRDFHSAIFWYKLATELDHDFNKWSFTYPAYSTWYPHLQMCVCYYNLQDFEKSYYHNEKAREHRPDDERILFNKELLEVKVG

SEQ ID NO: 1632 - protein, 648 aa, Paenibacillus sp.
MDKLISLCMIVKDEERVLARCLDSVKGLVDEIIIVDTGSTDRTKEIASKYTDHVYDYTWSNDFAAARNESIRRATSEWILVLDADEYVQQAGIESLRTYLINKTPSPYTVLMVPIINYLGSANVDDSIVEATVARVFKAGLGTHYTKPIHEQITNHDHRLQFVQYPLRLYHTGYTEQTRKAKNKSERNLQILERLTETSASKPVDYFSLGNEYASILNHTKAIEYYRRAFKGAQRTIAWYDTCLVNFINSLIYVQEYHEAWELIENYLIEWDNSPDYLSAKGTVLYCLGFYDVSKDYFHAAVQAAETAAKSKDRFWLVSPDYAYKIPYQMLEHYYDHKQDTQQIVLMLIKILQGNPYQYQSLSKLISLLIQREDTQSIINLLERIYSNDVPKDILYLFQATFRSGDTQLSTYYMNKLEATKLVLPVQNNLLYAVLLQDQQRFDRYRELLPEHTMGDLNQSDVMPYLLAALLWKQPMYIPMLSQDHSLFFIRELIIQTLEGESVVITPSKAEVTLLFDLLTSLFTYKLYDAYDQLLQRISSAWLINLLADYYYQSNRLELALDYYSLLLDAGELRAQGYVNLAFLHYNQGAMDEGLAFMQQAIELQPNEIALYTVLCTNTQDHNVIETYKQKLFDQFPGYKDMELFRSL

SEQ ID NO: 1633 - protein, 361 aa, Bacillus sporothermodurans
MVTISLCMIVKNEEDVLARGLDTVKDIVDEINIVDTGSTDRTVEIAKEYTDRVYFFEWTGNFADARNESFKYATKEYILYLDADDVLLEEDQKKLKELKQSLDPSVDSVSMFYNAGTDEYGNVTLRYRRNRLIKTEKNFIWKGDCHNYLEVYGKVINSDISVTHKKISHSTGRNLNIYQTKIDRGDIFSARDYFYYGNELRENGHYEKAIESYNKNIALKSGWIEDKVYACINKADCYRFLGDLDNELKSLFQSFEYSKTPRPETCSRIGYNFQRKKEYIPAVFWYDIATKSEPDSNQWSFSYPAYYTWYPHLQMCVCYYNLGDFQKSYEHNEKAYDFRPKDERILHNKKLLEKKLGINQK

SEQ ID NO: 1634 - protein, 360 aa, Unknown
  Description of Unknown: bacterium 0.1xD8-71 sequence
MIPLSVCIIGKNEEKNIERCLAPLVPYGFEIIYVDTGSTDRTKELAAKYTDNIYDFEWVNDFSAARNFSLQKASHNYVLVIDCDEFLTDIDLDGIEHAVNEHPRGIGMVLRINQCESNGKMTTSPDRVERLFHKRYYHYNYTIHEQVCDINTNSTYCERYDIPLTLDHVGYVGGEEDKRRKAERNNELLFKEIEKHPDDPYFYFQVGQSYNLINDYENSYIYYKKAFELPLNTEELWVQFMAVTFINSMTHTGRSDEALELFEPVYSCFANTADFYCSMGNIYLNLTNPQPLKAMMEYVKASQCPEAREEGSNTFIPYYNMGIINEMLGNVPAAINFYQKSAAYHYPLAEERLSVLNRQC

SEQ ID NO: 1635 - protein, 234 aa, Clostridioides difficile
MITISLCMIVKNEEEVIGRCLECVKDIVDEIIIVDTGSTDSTKEIVSKYTDMVYDFEWIDDFSAARNFSFSKASKDYTMWLDADDIILEADREKLLKIKESLDTSIDIVMAKYNVSFDENGNPTLSYYRERLFKRSSNHKWVDPIHEVVPLFGEVFYSDIAISHKKLHRQDPLRNLRIFEKMISEGKTLEPRHQFYYSRELYYNARYKEAIEGFTKFLDSSRGWIEDCIVLAEI

SEQ ID NO: 1636 - protein, 371 aa, Paenibacillus sp.
MTGQPTTISLCMIVKNEEQTLARCLDSVADLMDEIIIVDTGSTDQTKTIAARYTDRLYTFDWDDDFAAARNASFDQATCSYIMWLDADDVLLGPDRKRLRSLKQRLSADIDAVVMPLHLAEGEQGELLFTSRRIRLVKRERQYRWEGRLHEDLVIPEGRIIHADVAVTHRRMDDHTLRNQRILARWISESGKLEGRLLYFHANECFDRKEYAEAAEAFSRLLEEPSGYREDRITACARLAECYLHLGKPEQQLDSLLRSFRYGVPQADLCCMIGDWFFTRNEWSTAVYWYEKALEQQHHATDLRPVPRPCYSWLPHVRLSHCYAHLGQLDASYEHNRAALRYLPDDPHLLANEGKLREAIPDLSSAAPPSK

SEQ ID NO: 1637 - protein, 629 aa, Paenibacillus polymyxa
MMKTIALCMIVKNEQEHLRRCLDSVKNKVDQIVIVDTGSTDETIKIAKEYTDDVHHMEWNNNFAAARNESIKYATTDYILVLDADEYLEESADLQKEIASGADYYFTKIHNIMSFDRALNHLAIRIFLNNKDLYYQNRLHEHLNIMDEGLNFKSGQAELVIMHTGYTDEMMEGREKAKRNLPLMLKEVEENPTVYNLFNMGRTYMWVGKYEKAITFLKRAYPMSKNLTIASDLIITLCRSLGEMKRYNEALQILQEAVVVHPKEVDLLHLQALYYMEIEYYRDAIATMTKCLDIGDQGITVTEGHGSYIAHFRLADWYELRNDLVKGYEHILEAFKLKNDFAPIMGKYFKILEKANVPLEEVFVSTNQLYPISNSGQLEKLLEVMYQLRHPLLQRYLTEYNVNVQDNVMAAARQYARDYDGAQALWLEMEDIEEQNREDLLVLSMILKDEALFGRTKTLLNLSHKDQKNLYKIIMGDPSGDVKLTQHLENILEKALMHLIRLQEFETFEKILNYLWQGSISVKIKVCEHLVSYGFSEIAIDLLVKLFEQYPKDVGVIRMLGGVCLDLNYLQDAQLFYTKLLEVSGDYVAYEKSYELYEKVDDEVAMNSVLSQINRKFPLCAWSKQNFNR

SEQ ID NO: 1638 - protein, 318 aa, Unknown
  Description of Unknown: Bacteria sequence
MITVSLCMIVKNEEKILDRCLSSLAPMVDEIIIADTGSTDRTKEIASRYTDQIYDYVWDNDFSKARNFVFSKASMEYIYSADADEVLDLENQQRFLYLKEAMLPEIDIVQMYYVNQLSFNTVYNYDKEYRPKLFRRIRTFQWMDPIHETVRTEPVIFDSDIEILHCPTGNHAGRDLDALFSLWEKGVTLSRRLREMYARELMIAGKKEDFFKAAPAFREFLKNSSISLEETKEACCILAFDAFYRNDIHTFFTNALKIIAADGCSEICCLLGDYYYNRKEWADAVLWYQNAAYETSPILNLQYKESFPVKKLTELTKS

SEQ ID NO: 1639 - protein, 367 aa, Ruminococcus sp.
MPLVSLCMIVRNEEAVLERCLDSVAELVDEIILVDTGSTDDTKKIASKFSAKIYDFPWRDDFSAARNYAVAQAVGDYWFWLDADDVVEGENQEKLRRILAHPDADVVFLPYQLSFDEDGKPQMISCRERIFRRSVKFQWEGAVHEAIVPRGKVRYGDAAISHRKIGAGSPDRNLHIYQQKLMCGENFSPREQYYYARELYDHRAYRAALPVLEQFLQDGKGWAPDCMGACLLCGNCYRKLKQPAQALKSLLRALEYGAPTPELCCELGAVFLDQEQYPTAIFWYQLAMEVGEDSREGFRVQACCDYIPAMQLCVCYDRMGDTFSAAAYNELAGSVRPKDAAVAFNRRYFAEKGIQFHDAENHKRKEL

SEQ ID NO: 1640 - protein, 361 aa, Clostridium drakei
MITISLCMIVKNESINLKNCLDSIKNLADEIIIVDTGSTDNTVEIAKDYSDKVFFFEWIDNFAAARNFSFSKASMDYILWLDADDILLPESSEKLYHLKHSLSPSIDAVSMQYNCDFDDYGNVALTVRRTRLVKRSKNYQWDGVVHEDLLIKSSVFYDSDIVVTHRKIKGTTNPDRNLKIYEKLLLSGKEFTLRDALHYAIELHHHKSYQKATEYYLKFLEMNDITADDCVYVCSKLADCYYQLGDRKKEREYIFRSFDYDSPRPEFCCRLGYAFLEKSQFSQAAFWYNLAIQLPKLNNNWVIQNQISSTWLPHIQLGLCYYEMGEYEKSYYHNKTALSYRPNDQDIINNMKLLEELLAKK

SEQ ID NO: 1641 - protein, 256 aa, Prevotella sp.
MDANKISVVINTYNAEKFLKRVLDSVKDFDEIVVCDMESTDNTVAIAKEYGCKVVVFPKGDCVSAEPARTFAIQSATMKWVLVLDADELVTLELKEYLYEHISHKDAAEGLWIPRKNYFMGRFMHSTYPDYLLRFFIKEDTTWPPYVHTFPIVKGRQEKIPAKRKELAFIHLANENVRTMVGKTNQYTESEVEKKKNKNYGIAALIYRPMFRFFKSYILKGGIRDGKAGFICACYDGFYQFIAVCKILEKKYRKEI

SEQ ID NO: 1642 - protein, 361 aa, Romboutsia hominis
MITISLCMIVKNEENILKRCLDSIYDIVDEIIIVDTGSVDKTKEVCRNYTNNIYDFKWIDDFSKARNFSFDKATKDYILWLDADEYLDEKNRKRLINLKENLNESISVISTETHMCIDENNNPKIVARRNRIIKRNEGFKWVGYVHEYISIEGINESNVYDSNICIIHDKVKNIDDRNLKIYEKKLKDGKILSNRDLYYYGRELYCNLKYEKSIEILKEFIKVSKFKEETVDALCKIGECYIKQKEYKLARIYLYKAFEEDIPRADIMYNIAYSFEEEEKYLQAISWYKIILNTDISCDTNQCINMSYLRFKPHLNLCCCYYELKDLPRAYYHHQKCMELNPNDECVKCNEKYFNSIIKER

SEQ ID NO: 1643 - protein, 341 aa, Lachnoclostridium phytofermentans
MITVSACLIVKNEEEVLARCLDCVQRVADEIIIVDTGSTDRTKEIASRYTDLIYDFKWVDDFSAARNFSFSKASMEYLYVADADEIIEEEQIHNFLRLKETLFPEIEIVQMYYCNQLEFNTTYNFDKEYRPKLYKRVREFRFYDPLHEAVRLEPVIYDSEIEIVHKPLSNHAPRDFTTYQKIIARGENLSDKLRSMYARELFIAGEDSDFIDAYSYFYETVLHTTLGLTELKQCQCVLARGARLQQKDQDFFKVCLKNVACSVTSSEICFELGEYYLQNGDELEAILWYYNAAFETEAELNLHYQGDYPLNKLALCYQALGNDEEALKYVNLRDEWKAEER

SEQ ID NO: 1644 - protein, 381 aa, Unknown
  Description of Unknown: Anaerolineae bacterium sequence
MLEEPLLSLCMIVKNEEVYLPQCLESVKDVVDEMIIVDTGSTDNTPKIAASYGASIHEYQWQDDFAAARNFGLEKASGKYILFLDADEELSPQARSQLRSFLLNSDAEGIYLIVRSLSSANALAPYYDSEQVRLFRNRPQYRFENAIHEMIYPAILAHGGRLYKSRFVIHHYGYLKNVVQGTETRIERDRRLLERMYRENPDSLYTKAKLGFIYLLERQYPNALQLLQEVAQGIDPKIVEPDFLHTVLVALAQTAQATGNFKLSKECAKAGILLNTQPSLTRSSMFYYATSSAAWVIDQIEQFAHDGNLRLSRAKLSKAFESLKDELRESQSILEQLRSDCSENPQANENLAIWQQKIARAEQLIENISSLFSHQRENEGS

SEQ ID NO: 1645 - protein, 362 aa, Aneurinibacillus migulanus
MITISLCMIVKNEEETLERCLNSVKDIVDEINIVDTGSTDRTVEIAKRFTDRVFHYTWTGDFAAARNHSFTFATMDYILYLDADDVLLEEDRIKLMELKENLDPSVDSVSMYYNAGMDEYGNVTLRYRRNRLLKRTKNFQWRGDCHNYLEVHGHIINSDIAVTHKKIKHSVRRNLGIYEQKIARGDTFTARDYFYYGNELRENGHYEKAIESYQNNLSLKEGWVEDKIHACIFMGDCYRSLGDYPNELTSLLKSFQYAKPKAEAVCRIGYHFLRKKDYKTAAPWFEFATQLTNDSEQWSFSYPAYHTWYPHLQLCICYYYLGDYQKAYEHNEEARKYRPEDNSVLHNKHLLESKHGILATNK

SEQ ID NO: 1646 - protein, 361 aa, Paenibacillus amylolyticus
MIVKNEERTLARCLDSVADLMDEIIILDTGSSDRTMDIAAKYTDRVYTYTWNEDFAAARNESFARATQEYILWLDADDVLLPGERAKLAMLKEQLPSGGKTAGVIMGYTLAEGPEGSPLVADRRLRLVKRDAGCRWHGRLHEQLRFPQGEVITADIAVTHRREAGNHSARNVRILRKWIAEEGIAQGRLLFYYAGECYDRQRYAAAARGYAKLLEQPSGYREDRLIACARLAECYERLGEPGRKLGALLQSFQYDLPHADFCCAIAACFHERQEIVTAIYWYMQAVDVSSRDPGLRPVPAACRTWLPHARLSLCYAHLGNWEQALLHNTKARKYLPDDPGLVGNREKLEAVIRKQRKEREG

SEQ ID NO: 1647 - protein, 635 aa, Paenibacillus taichungensis
MSKTVSLCMIVKNEEQVLNRCLDSVKDLVDEIIIVDTGSTDNTLKIARNYTEKIYFFEWIDDFSAARNESLKYATSDYILVLDADEYLEVKGDLQKELKTNYDYYLLKIRNEISLGRNFTFTAIRLFKNDISLKYENRLHEHLNILNGARDYTMGESEFSINHDGYTDDKMLEKDKQKRNLPLMELEVEENPTAYNLYNMGKTYFGMQKYDRAVDFFKRAYPLSRDRLFLPELLTKLAYALAENNNKEDSLSILTDAVVLFPKETEMRFILGMIYHKFQYYREAESCFIKCIELGDQGSLVTEGSGGYMAHMRLSELYAEIGQIDNSFREVGMVLELKKNFTPAIQQYLNLMARLNKSLEETEKGVHQYYTIKSVDDLQRLLDIMYGSRSPLLHYYLTTYNIQVQPNVLGTSKIYAKNYMEADLIWGEIVNIENENAQDLLLLSFLMKNTKYLTVIKKLLNLSNKEQRTLERLINVDNDRYVLTSSLEELLVEVCRQMIVLQEFEHFQILVEKLIKTTSNFQPKICKVLSDYGFDELAIDMLIETMKQKPNSIEVLCLLGDLCLRNNYLEDAQLLYSKLLNLGSEYSYYERNRRYFEKVNDFVGLETLEREISQRFPFADVLKINKPNIQEGVKG

SEQ ID NO: 1648 - protein, 337 aa, Unknown
  Description of Unknown: Lachnospiraceae bacterium MA2020 sequence
MATISLCMIVKNEEDILSRCLNSIADLMDEIIIVDTGSTDNTKEIARKYTDKIYDFEWKDDFAAARNYAFSKATMEYIYSADADEVIDEENHERFRLLKEAMLPEIEIVQMYYTNQLEYNTTYNFDEELRPKLYKRIREFTWTDAVHENVRLDPIVFDSDIRIKHCPTGEHQSRDFSIYQKLIEEKKPISRHMQQMYARELFISGSDNDFLAAEEYFKKCMANDEDLDLLYMDTCVVAKAARLRDEPEGLLFASSRALAAGDAPSELLFELAEYYRNHKNYKEAAKWYYSSAFESEAILNASYNSSYPLVGLHICYVIMGDTEKAAKYAAMLRETRI

SEQ ID NO: 1649 - protein, 255 aa, Rhodanobacter sp.
MSQREPLSVVVTTMNNAGTLDACLRSVAWADEIVVLDSGSTDATLAIAAHYGAHIHSQPFAGYSAQKQAAIDLASQRWVLLLDSDESLTPAGAAILQQALQAPVHAGYQLWRREWQFWRWQSLHSRLNHYVRLFDRQRARMSDHQVHESVLVDGPIGVLDVVIDHAGEPDIAGRVAKANRYSTMQLADLAPRKLSWLRLRMVLYPAVAFLRYYVLRGHYRSGWAGFIAARIHAFYAFLKYAKLYELRRSAQRVDR

SEQ ID NO: 1650 - protein, 339 aa, Clostridium oryzae
MISISICLIVKNEEAVLARCLDSLKGIGEEIIIVDTGSTDNTKKIAEKYTDKIFDFKWIDDFSAARNFAFSKATKDYIYSADADEIIDKENYRKFMNIKKVLLNEVEIVQMKYTNQLVYGTTYNFNTEYRPKLFKRLRDFKWIEPIHETIRLEPVIYDSDIEIIHLPECNHSGRDFNTFLSVIKKGDRLSERLVSMYAKELFISGNSTDFKAALDYFKEVIEDAERSADEIKYALCVLAKGFRLNHDIHNFFKNCIKGVADKPCSEICYELGEYYYELNDFYEAAIWYYNAAFESEPYLNIHYKGDYPLKRLMQCYDALGNKEQAEIYRKALSEWSMPE

SEQ ID NO: 1651 - protein, 260 aa, Unknown
  Description of Unknown: Photobacterium sanguinicancri sequence
MTTKRATISVVLIAKNSSMTLAKCLQSVQWADEIVLLDSGSDDNTTEIAREYGAKIHTHLDWQGYGKQRQFAQQYASCEYTFMIDTDEEVTDELRANIEAVLASPQQPNIIYSCARRNWFLGRYMYHCGWYPDRVMRLYRTQERTYNDNLVHESINTIGATIAPLDGDLLHQTCTDFSSFQQKQLTYAKNWAQERFQSGKKVGFSSAFSHSIGAFLKTYLLRKGFLDGAHGLLLSIIIAQYTFNKYITLWSLHQSSTNKS

SEQ ID NO: 1652 - protein, 625 aa, Paenibacillus terrae
MSKTIALCMIVKNEEQFLRRCLDSVKDIVNQIVIVDTGSTDNTIYIAREYTSEVYSFEWINDFSAARNESIKYATTDYILIMDADEYLDTNSNLQKDIATERDWYFLKIHNVLSQGRQIAHIAVRLFANGKGLSFQNRLHEHLNILAEGKTYSNGLGESVLHHTGYTDEIMEGRDKKNRNLPLMLQEVEENPNAYNLFNMGRTYKWIEEYEKAIQYLQRAYPLSKNLTIMPDLLTNLAHCLSSLKREPEALKILNDAIILFPNETDLWHMQALLFLELGYFKDAINSFETCLKIGDQGITITEGNGGYMAHYRLAEVYEKTYRASESYEQIIETVRAKKSFMAGVSKYFQIVTMANIPLEEVYENFNQIYGISTVEELERLLEVLYVLRHPLLNRYLNEYEIKVEEKVSVIAVQYAKQYEKAKLLWIKMGYYAEENSEDILLLSLILKDMKLFGFAQPFLNLSIKEAKLLQNIILSEEIKNQKFSSHLESILMKMIEHLLVLQEYEIFQHVLNYVWVGSLDFKYDVIQKMVNFGFDEVAIDLLVELFETNPNNLKVIQLLGDVCFKLNYFEDTQLFYTKLLDLCPEYSSYERCYILSEKIDDHISASNIKQSIKQKFPLALWVLE

SEQ ID NO: 1653 - protein, 320 aa, Alkaliphilus metalliredigens
MITISLCMIVKNEEELLSRCLDTIKDIVDEINIVDTGSTDRTKEIAAQYTDRIFYFEWIDNFAAARNESFKYATKDYILYLDADDVISEENRVKLKKLKETLDPSVDSVSMYYDAGTDAYGNVTLRYRRNRLVKREKNYKWKGDCHQYLDVHGKIINSDVAITHKKIRHAVGRTVSIYEKKIERGDTFTPRDYFYYGNELRENKHYQKAIESYSKNISLKEGWIEDKIFACIFRADCYRYLGDMNNELSSLFDSFKFAPPRAEACARIGYHFHRQKSYKTAAFWYELVPNKFQILIGGALFIWHIIPGTLICNYAFVTII

SEQ ID NO: 1654 - protein, 342 aa, Amphibacillus xylanus
MTSPNLSVCLIVKDEEIFLDNCLKSISNLADEIIIIDTGSSDQTLSICEKYNANVHFYKWHNDFSAARNYAISKATGDWILWIDADEEFEKSKSLLIKDTISNSSSPMIYLPIINYYGEKFPVNKEQAYLYHQPRIFRNHLGIKFKNKVHEIPLLPHQDDIGYPTEFVDAPIYHYGYIKEVLNKKDKSDRNFNILTEEAKVPGHSPWIEYHLANELYRKQDYLLAFAYVNESIKGFLLHGKIPPSILYRLKYAILLDTNNIKEAWPGINYALYLYPDYVDLNFIKGLILYDQQDYSSALECFNYCLELRENNHKYLILKGVGSFKALHYKNLCLEKLRNEND

SEQ ID NO: 1655 - protein, 364 aa, Paenibacillus sp.
MPTISLCMIVKNEEDHIGRCLASVADLADEIVIVDTGSTDRTVSIVREYTDRIYHFRWIDDFAAARNYSFSLAEKEYILWLDADDVFEEPDRIKFAALKRTLDSSVDAVNMNYNLAFDEFGQVSASIRRNRLVKKSRGFLWHGPVHEYLEVRGNVRTADIAVTHRALHHDSGRNLRIYENRLAQGETFSPRDLFYFANELKDHRLYNRAIHYYEEFLGTGNGWIEDNISACGRLADCFHALGDEKQELDSVFRSFLYASPRAEFCCRLGYVFLRKRDYRTAAYWYEAALQAGKHTDSWALTHVACSTWLPHLQLCVCYDRLGEHELAHRHNETVLEYRPGDRQALANKAYLEGVLAENTETPAD

SEQ ID NO: 1656 - protein, 501 aa, Melioribacter roseus
MIVKNEEKYLKDCLESVKNLVNEIVIVDTGSTDNTVSIAKEYNAKVYNFEWINDFSAARNYALSKSTGDWILYLDADERLEPGSIHELKKILNTVTKAGYFCTVKSIDSENERDHSIRYVRLFKNSPDIKFRGKVHEQITDSLVENGYQIQHSKIVINHIGYDVSKEEKEKKAKRNLELLLEDYNQSKSSYSLFQLGQTYYILENNDKAKEIFSELIKKDDLDNALKAEAYAYLAQIEHSKFNSSDAEKLIDKAIELNPKQTYYYLFMSKVYLRQQNLYKAKIYAKKAMEANKSINNNELLNKQTIYVDNREIIYFGLFLSFRSQDSDSTEYFIKELYRIIKDEEANHKLQLIKLMECVLNGREINEEIADIIEKHLNKYNLDLLITVLEAQKNTDIKLRLFNYIHELYPKNTDAIKNIAQIYDQKGATAEAIQLMEANKDIMLNDPAALFYLASFYIKGGRFNEAIDIFEYMEKSFAQMGEIIQKVKLIKEKLKGFAVAN

SEQ ID NO: 1657 - protein, 349 aa, Unknown
  Description of Unknown: Lachnospiraceae bacterium MD2004 sequence
MITISLCMIVKNEEAVLQRCLDSVADLMDEIIIVDTGSTDRTKEIASNYTDKIYDFTWCDDFAAARNAALSHATMDYIYSCDADEVLDEENRERFKQLKEVLLPEIDIVQMQYLEDGIQTVLNTNRELRPKLFKRLRQFYYVDPIHETLRLDPIVFDSEIEIQHKPVGLHSRRDFRIFERAYERDRKFSRNVLSMYIKELYKWGRPDDLERAAKILEDVEYRGTLPDDLVQESFTILVRNARLHQDLVNMMRYAVRSASIEKMCSELCYEVGAYYYDIEDYPEAIIWLHNVLFETECYIDVNVQGEKTFQMLIHACEEAAKVTIDPPAKAYYERCVTQYSEKLQEYLQK

SEQ ID NO: 1658 - protein, 778 aa, Paenibacillus sp.
MEFLWWTSCTFLHWRWLHLKNRLLGIHMIVQNEEHHLPRCLDSLKHIGTECFITDTGSSDRTPEIGRTYGATVLHARWQDDFAHARNISLPLASTEWVLSLDADEYVAQGLEELLNYLPKVHKSISRLRITIENRYGEGVEERVISQPVRLFRAHQGYRYAGRVHEQLVRHSPCKLAQDEVADTNKSESNTDEESVLIETEPLAPLCLIHDGYLASTIAQEHKPRRNLKLIERELADEPAQPFHLYNLGVTYCQLGQIEQAIEVFRESLHLTELLAPYRPTLVRDYAKTLVGSARYDEAHAILAVERQRYPSYADLHLLYGETLEQQGLEERAYQSYARATDCRKGMDRVGQSDGGGKFDAQYVTEAGSDSYRAYTAMARLAQKRGFLNESAHLYGLALDSMFTYAPAWVGLADVMQQSGETDENIAEALLARCRGFEESGHGDSIRGEMPHSYAVMNEDHLVHVIYVLAGCGAYEQALKMLDADVRTARIHVADRIHWMLCANKVSEALQLAEEHWNVGGAHEVNLLGEHRMDWALACWANGLRLSEAFLATTLPQEKNVWKVMDRLLDQLTKEPRSRKSASQEQKLMQWGPQAEMVAEKVVQQAIKTGQLILAEQLHELRAMMMRDHWDTAVTLRREFASLLYRQGYTMVAANILIQCMTESELDAEGLFWLGETLYAKGHNDQALSLFEQALEQKPDMRQARAGAAVCYMRLAMEAIRQEMVRSSSSGVLDAQYTALEQRLRTTEGIPWRTLFQAKERRNQLASGTNFPMHDREG

SEQ ID NO: 1659 - protein, 256 aa, Helicobacter typhlonius
MKNAQDTIKECLESLKNFDEIILLDNGSTDKTLEIARNFSNVRIFESEFIGFGALKNLAISYAKHDWILSIDSDEVLELSTLALIESLELNSHTIYALPRKNLYNGEWIKACGWYPDYVWRLFNKTFTRFNDNFVHESVIIPKNAHTLKLSSGIKHYAYDNIAHLLEKLQRYSSLWAEQNKHKKSSPLKAITHGIWTFFRDYFFKKGIFYGYKGFVIATCNGLGTFFKYMKLYELQNTTPPEYVRLSSLLIIKKKD

SEQ ID NO: 1660 - protein, 644 aa, Bacillus onubensis
MRPFISLCMIVKNEEKVIERCLSSIVNLVDEIIVVDTGSTDNTIELVAQYTKSIYEFEWINDFSAARNYAASKASGEWILVLDADEYIDEENFKEFILELKKDNGQYESYYAKILNFTGDYGEHLVQNFHDRIYKNNGDIEYHRKIHEQFRSATGGPLRNNKSNLLIFHSGYLKHTVSEKDKNQRNRELLDQEMKSGNNNAFDFFNLGNEYSSLGDYGKALDSYLEAYKLKRDFRLAWVSTTLVQIVLCLINLKRYTDAINVAKDAENIYINSPEFPYLKGEVFFQRGQLEDAKVIFQGIINDKEEYSHIIFRPDLKDQRPHLRLGEIYLFQEEYNSAIYHYTSVLNINKYNNEAISKVVEILSEVHTIEEIASFLISKELINEKNITSYVKACFEIGNPSLAIEILEDYSDEYQLLKKVAQLKNLIIYEQGEIKQFHEVFKPEIIKKLIESNWINIIDILLLRNYATSYENILQVFDSLKQNEQLNKLIDLVDGNESVINVDEGLVIYALQAFFAYKQYDLCNVILDEIETTDNNTVLKIARVLFNNGFKGEALQLYNLCDWNKFDEQDFVNIINCLMKSNSLNNALDVSNYAIMNKNNFRFYQFAIEILNALGDDENKEKYITNALMEYPDSLWLRNQYLQS

SEQ ID NO: 1661 - protein, 734 aa, Anaerotruncus sp.
MKAQVKKPAQKPLISIGMIVKNEEKTLEDCLKAMSPIREAVPSELIVVDTGSTDRTVEIAERYADKVLHFEWCNDFAAARNVSLEAASGKWYLYLDGDEVLEENCTPLIEFLKTPNNPYKSASLLCRNYGDEARTVYSDFRMIRLHRRTPQTRFEGAIHERIAAYNVPTKDLPIIVHHTGYIEGIHESKRRRNRKLLLLDLEKDPDDLRTLRHLLDTYGMETLPDIVEQNRIARKIIRISEESDGINTEWLYAYYALVLSAVNRREYAAAQQLLQEYYDKKGEEEFAADINMSFFKGMVSFDNHDYSAAKKAYLDYQRLCALYWDGKLNTPDVYSMTLPQLHPYPHALSCYATAICWQNEGNYPEMKGSLERAGALTEKTLERADASLMTEFLYAYEAEDFSRLAGLLGEASFLQNGEGWKVFAEWFEKRFEQFEERKKDACLTIAQTDLQNPFAQLCRLRTAQTREQAQELLEQLLDDPDAVKTPLFADLLYATVFYQFDLQHTLSALDSSLVERYWETLAKQRPDWPELLDTYLMEHPLQESDPPVCWFWQTRLMLSLLLSPEPDTKVLFQQPWLDEERFASLAQRYLDAMTHYCRMVYQPAMLLPENRVALPAEYRFVIGWQEAEALQKEQGDSACLQRLGEMLQEFPLMNRLIGLFTARTRQRLEAQKQQREEFEALAENVKQQFYRLASDGQIAHAAQILESYRALCPDDPELLLMQSQLDGPRYTLES

SEQ ID NO: 1662 - protein, 425 aa, Unknown
  Description of Unknown: Candidatus Kuenenia stuttgartiensis sequence
MDQSERLIHPGVRQRRYVHIMVKLSACLIVKNESGILPRCLESIQSFADEIIIVDTGSTDNTVEIALRYKAKVHHFQWRNDFSAARNESLQHANGDWILYIDADEIIDKANALKIRSLINSKDIMALTVRQCIPQQCDNIATSFYSEYCRVFRRHPEIRFEGTIHEQILPSIKRLGGKILRTDIIIHHWAYAFSKEKKRQRAERNLNYLLKEFEKNPDDSFTLFNLGMTYQELGNNDSAIQAYLHMLEKPTDIKNELTGQSHINLSKIYLENDNTTKAAYHAQQALLLDTNNPLSAYMLATIAVTKKQFQKAIEHLETAIKISEGETGIAPSVELNMAQIYLELGSCRYSLHDFVGAENDFLRSLAYDASATNPYILIGNSRLIRGDKRGAKDMFEQALTINPQLTEAKSGLTLCSNEKSALANE

SEQ ID NO: 1663 - protein, 637 aa, Paenibacillus sp.
MKPLLSLCMIVKNEEKVLERCLLSVKTLVDEIIIVDTGSTDQTKAIAARHTDKIYDFSWMNDFSAARNESIRHASGRWILILDADEYIQPADHDKLRKYLLEYKSDRPCGFVLNIMNFGGSGNDEANVTESMGARLFLNGKSIRYSEPIHEQLTSDFGTPSFTPYPFVIFHTGYTVQVVQEKNKSERNLSILEKMNVGEKRYNPYFCFVLGNEYVGVNREDEALKVYRRSLERSSPSDTWYFYLLESLALLEMKKGNYSNAHVNIRNGIKLLPDRTDFLCMEGILLETLGLWNAAENVFQQCIQIAEEAEKKGSPYWVIKPLYGKIVPHQSIAEIKRRKGDITGAIHHWVKTLQVQPKNYTVLQLLMDALLQSESYDQVASIIEQLYPLHQPMNKMLLHKMALKIGSIELASKYAAEVQQLDLRLDDADTVRQNLLLRNWSRSTSSSLQPASLEDSLAMAAAIVHQEISIADSATGDTAACAALVQGALLAINNKTWNNEVLTNQENKLTQTLQLLWRYGYTEIYLSLMQNMASEIVLNNMADWFYTRGLHEQALDLYSVLLENNLLHANGLKNVGVWYINCANTVEAFPFLEASFKMEASYNIIGLFKEHASPEAYRNFKSFYMKKFPVISQCIFL

SEQ ID NO: 1664 - protein, 635 aa, Sediminibacillus massiliensis
MINPGLSVCMIIYNEEVNLKRCLSSIKNIADEIVIVDTGSTDNSIEVAKSFQALVISHEWGEDFSAARNLALEKATKEWILVMDADEVLQDDQITTYMENNDVDGYFVRFINFYGQYEENSFFIDYACRLFRNHPSIRFQGLIHEEVTTSLKAYGWQIGNSDITLHHYGYLHTNEEKQKKHERNLSIIKKALTENTKDSRLNYALGVEYMQAEKYEDAYRIFTKLLTTLPPSTDFAPDIVLKTAHLLRFFQKSEEALTLVKQGLLHYPDFADLHDAKAEILLELHQYLAAIQSLQQSCSCPVRSTYSSQAGAGSFRTLYHLGQAHEKLLDIESAVHYYQESLNKAPTYKPAWKKYTLWSTSPYVSPQFSNDLKRWKESLKVDQWLLLMRTLLASRKWDRWDLAKQQMPERVHAELSLLTCPLAEALTLSTKGQKQMAVRHLLNQKKAFNLEQILFIWCVYYEENLNHKQWLKSHMNNFSLLADLYKCLMEGYQEKYKEAVTLATWMFLESRMIKGYIRFAKSLDMCCPLPMTHLYLFSSIPIQSLQEITEHLKVDTQKLSVEECLAITLLQIKSGTNINTQETLRYLIKKSPSSPLPRLVTLLNYQSKTDPSIIKEIDKVLVHLTYPNSEILLLD

SEQ ID NO: 1665 - protein, 346 aa, Campylobacter jejuni
MNLKQISVIIIVKNAKQTLLECLNSLKDFDEIILLNNESSDNTLNIANEFKKDFANLHIYHSAFIGFGALKNLALSYAKNDWILSIDADEVLENECIKELKNLELQEDNIIALSRKNLYKGEWIKACGWWPDYVLRIFNKNFTRFNDNLVHESLVLPSNVKKIHLKNGLKHHAFRDISHLINKMQHYSSLWAKQNIHKKSGVLKANLRAFWTFFRNFFLKNGFLYSYKGFIISVCNALGTFFKYMKLYELQKQKPKTCALIITTYNQKERLKLVLDSVKNLTFLPNEVLIADDGSKEDTARLIEEYQKNFPCPLKHIWQEDEGFRLSKSRNKTIKNADSEYIITVS

SEQ ID NO: 1666 - protein, 645 aa, Paenibacillus sp.
MNNLLSVCMIVKDEEDTLDRCLKSIKDFADEIIIVDTGSTDATKDIAKKYTEHIYDFKWVNNFSTARNESIKYASGKWILVLDADEYISTEDIRQFRLFLEEEDARASIIYTISVISYVGESIRQANITEAPIPRLFPNHMGIQYHRPIHEQPIGGNGELLTSIPSPITVFHTGYTRDVIEKKDKLKRNELIFTELKKKNGFTAYDHFTIGNECAAKNDQKRALYYYERAFQKATESNPWRFTCAYEMWNIYLKLDRIQDAWDLNERFFGKYKNHPEYYCFQGVMFEQFSFINKAKQSFLTAFQLAEELSAKQERFFLVNPSFGSTIPLSRLAHLASLEHNNQDMIYYYTMILKGNPLEQATLIKLIERLSQHETTEQIISFLSKLYPEPTQRDLILLVNICTSLGVKELAVHYYNQLTDPEALRLESRLKFSILTHQPEVFMKLLNLVEQPVSASTLRLIAVGAIAWNSSEIMNYQDQLESDDPRLASVLQHVVQQNLTVDETKNHAFDFFHLLTDLFLLQQYEQFDQYVSTLKSPLLLNLLANFFYSKQLIDLSVGYYQTLLEEQELHAGSLLNLAYMHINDHLYDDGISFLEEAIRIEPGTKQSYLLLLLNCPDDIKKHRYRKQFFEQFSHYGKLPFLQELQ

SEQ ID NO: 1667 - protein, 634 aa, Cohnella sp.
MKPLLSLCMIVKNEEAVLDRCLQSVSRFVDEIVIVDTGSTDSSKEIAKKYTNKIYDFEWINDFAAARNESLKHATGQFILVMDADEFVDEPNISDLRNFLTKQKPSNDTLYRVTVVSYKEANKPATEEPILRVFANHMNIQYVRPIHEQPTPQAGRSVKIVPIPIKIFHSGYTEETIQSKNKHERNLHIFSEMEKRQQLSPYDQCMLGRQLLFMGKHAEALTHLQAAHISGDKSEEWYKHNLVSILELHLNTNDLFQAYTFAQDNLVPYFHYADVRSLYASILYKLGFWKTAKREFEEAHRIVEIASSGQKSSLVSSDLGFRGPLWHLVQINENEQNYIQAIPYLAKLLMNNKHDIEAINKFIQLSSLNHSFEDVVKILEELLQTDTNRKTYAIVGKVAIRSCHKDFSLHYCRNNITSGLYNLSEKLQYAMLHNDEPLFGACLEILHEDQLPYRIAQQIAMGILIWNRTDWLQYIEQHSQVANFVQDLLNGNVQDFAAEDLPFESLVELYNLQQWNAYEFVLSHYETPQIVNRLASYFLEIHHIPTALQYYNFLTEQDALTASSMAKLAWYYSHQGSLTEAYSLWERALAMEPSQHSHYIHYYEMCEDPLTKQTLKNRLIALNPEYNRLDLLFR

SEQ ID NO: 1668 - protein, 394 aa, Unknown
  Description of Unknown: Bacteroidetes bacterium sequence
MDTSPKPSAAAPSRRPRLSLCMIVRNEARTLERCLRLARPHVDEIVVIDTGSTDGTQAIARPYADVFEEIEWPNSFAVARNYSFDRASGDFIMVLDGDEYLPEPLHWSRIRAALTRPHLAAILLPIKNLMRSTQIVAADRFWQERIFVNDPSVRYEGRVHNQIREAVVAYARRTGAQILKLDAEVVHTGYALDPGDMKKKYAARIELLRAEFEHPRSPQYQAYYGYQLGLVYFVLERYPEAAAIFNQLDYGQLSPENAFYTRLLATQTALKLEEASMALFHANAMLSIDRTEPIGFFTTGLALLLARQIGDGMLMLLEAYNMNEAHQHAARFALNPEVLLGLLARLCERLNLPRHAAAFHNLKAQPACEARTIKALIASLQTSIVSAELEGARA

SEQ ID NO: 1669 - protein, 356 aa, Paenibacillus polysaccharolyticus
MIVKNEETSLARCLDSVKGIADEIVIVDTGSTDRTRQIAAQYTDCIFDFEWVDDFAAARNFAFDQASCEYIMWLDADDVFEPQDRAKLIALKQSLDPAVDSVTMDYNLSFTPEGKVSYSLRRNRLVRRDRQFRWIGAVHEYLAVAGNLLHSDVAVTHKKDKVYTDRNLRIYRKREQAGEDFSPRDLYYFGNELKDHAFHEEAITYYEKFLDTGLGWVEDRIAACQKIADCEAVLKRPERESAALFRSFAYDLPRAEVCCRLGGYFADREDYRQAIFWYEQAVQANRPGDPMVVLNEAAWTWMPHLQLCVCYDRMGNRAKAKEHNDIALTYHPTHPSMLYNDRYFKDLAKESVMENA

SEQ ID NO: 1670 - protein, 357 aa, Anaerotruncus colihominis
MITISLCMIVKNESEVLARCLDSVRDAVDEIIIIDTGSDDNTREIARRYTDHVYDFEWIDDFSAARNYSFSKASMDYCMWLDADDMLAPEARAALCALKATLDPSVAVVMMKYDTAFDASGRAALSYYRERLIRRGAGMFWTGAIHEAIAPAGKVLHTDIAVSHCKLRAGDPDRNLRIFEKLIARGQPLCPREQFYYARELFWHGQYEKAAQVLRAFLDGGQGWIENNIEACRQLAACLHQLGDKSGALRALLRSLEYDAPRAELCCDIGAHFLERQAYHQAIFWYRTAASCKRCDATGAFVCADCYDYIPFLQLCVCFDHLGDHSRAKGYNNLAAVVRPDSEAVLHNRSYFARIGV

SEQ ID NO: 1671 - protein, 260 aa, Methylobacter luteus
MLTVAILTKNEEANLPRCLEAIPDRYPIVIVDSGSTDNTLAIAESRGCRIYTNPWPGFAEQRNFAINQCGIDTPWILFVDADEIYPEKFYDWFESGMSGIDSIDVLMVPSILYLREKRLNHAPGYPIYHPRLVRRETVRFVRNHTGHGEAVIDTCRIGYSDIPYEHYFYHGEIIEWMHKHVGKAAQEVRLKPTAGAVMTTRGRLSVLLGRSWLRVVARFLYHFVLRGGFLDGFAGLEFALMFTWYEATIYVQAKAATQSR

SEQ ID NO: 1672 - protein, 625 aa, Paenibacillus sp.
MNKTICLCMIVKNEEKYLRRCLDSVKDKVDQIVIVDTGSIDATLDIAAEYTKNIFHFTWIDDFAAARNESIKHATSDYILVLDADEYLIASGDLQKEISSSSDYYFVKIHNLLSQGRAINHISIRLFANHKGLIYRNRLHEHLNTMDENAGYKGTFGELLIYHTGYTDQMMKDRQKEKRNLPLMLKEVNENPNAYNLFNMGRTYMWTGEHEKAISYFQRAYPLSTNLIIIPELLTTLCYCLGELNRYEDALQVINDAVNIYPNETDLRHMQGILFIESGYTKDAVVALEECLKLGDQGITVTEGNGSYTARFRLAELYESQNRILKSYEQIVKALQDKKSFAPGLKKYFEIVTKANIPLEDVYENIEQLYNVSSVDDLELLLEVLYALRHPLLNKYLTMYKVNVQANVIASAQQYDKQYMEAKSTWLHADEIESENGKDILLLSLLLQDDQLLQLSKPLLNVSEKECKVLQKIICNVDIKATKLTPYLENMLVEMSVHLLVLQEYEVFQRILDYVWLGSLETKYNVSCNLISYGFNEIAIDLLVKLYEKHPNNVKIIRLLGDTCMNCNYLQDAQLFYTKLLQICPEYSSYERCYELYEKLEDNDGGNIIIERIKDKFQLSMWVKG

SEQ ID NO: 1673 - protein, 286 aa, Escherichia coli
MSEKNVSIIIPSYNRAHILKEVIPSYFQDETLEVIVINDGSTDNTNSVLAELKEKYSQLVILENETNKKQMYSKNRGIEIAKGKYIFFGDDDSYLLPGVISRLLATKYETGADVIGARILYMNNNEKTIEDCINRHKKEGRFVSDLNRLDFSYTCDLDHPIECFYAQPFVLAERELISKYRFDISYTGNCYREETDFMLSLFIKNKKFIYDSKALLINLPPRKATGGARTANRLKYHYESCINNYRFLKKYNDNLNLLSGQKHAIFYRQCQFVLLKMKSFIGKFLK

SEQ ID NO: 1674 - protein, 374 aa, Streptococcus pluranimalium
MIQKINTLDYLNHPTTISCVYIVRNEEKHIISSIKSVNSLVDEIIIVDTGSTDDTLTKIQELKNSKIKVFHFTWCDDFSKARNYAISKATSTWLLILDADEIIEENTILKFLLTYLISIDDFNDTVFNLNVIRGEDSYKTGKVVKNSSNLKYKGRVHETFYSENQEVSYANIKLNIFGIKRVSQKKIEYYNSLLLETMKDYPYDSRWGYLFLRDNFKNLSFQQMLSYSKQAIINDENDISESNYIWNYYSVKILLLLMYKTLETDDDETFLYLLKIIESKCYSLEDVIYLKYCYEIKKYLEYGSFKLAQFLNDFVNSDDSDNIFSKNAKHSLLATFLFLGGFPEKSKNIFNELNKKDNDITYFLNKNFIDDWLK

SEQ ID NO: 1675 - protein, 363 aa, Unknown
  Description of Unknown: Eubacterium rectale sequence
MITISLCMIVKNEEEVLERCLNSLKGLMDEIIIVDTGSTDSTKEIAARYTDKIYDFSWCDDFAAARNFSFSKATQEYIYAPDADEVLDDTNRRRFMMLKAALLPEIEIVQMKYITPSKFNTVQNSSSEYRPKLFKRLRTFTWINPVHETVRLEPVVYDSDICIQHLPQGTHGKRDFTIFKRSFEKNGTLPKSIATMYAKELLKCGSPEDFTNALPYFQGEYRNSPDIESTCVLSRYYRMNGDYDKFFSVALKNVAVDGCSEVCCELGAYYFDKADYEEASLWYYNAAFETKPVLDVECGGGKALHALSECYSRWADEKQKKLDSLPPKSRNVFKGDKELIESLRSQAVDYQKQAEEWMLPEGD

SEQ ID NO: 1676 - protein, 255 aa, Prevotella oris
MNGKERITVIINTYNAERHLKVVLESVKGFDEVLVCDMESKDHTIEIARSYGWRVITFPKGTHHIVEPARQFAIDRASNPWVLIVDADEVVSEALRNYLYEAIGEKDCPDAIAIPRKNYFMGKMMHSCYPDYVLRFLKRENCHWPPVIHASPKVNGRVLKIPSARHDLAFEHLANDTVADIIAKNNTYSDYEVPRRRSKNYATVALFYRPAFRFFKSYFLKRGFMDGLPGLIHAMLEADYQFTIVAKLIEERRAK

SEQ ID NO: 1677 - protein, 250 aa, Unknown
  Description of Unknown: Rhodospirillaceae bacterium TMED23 sequence
  MOD_RES (92)..(92): Any amino acid
  MOD_RES (99)..(99): Any amino acid
MTRLSAVISVHNEEHRLRECLKRLNFADEIVVILDRCTDRSEFIAEEFTDRIIKGSWNTEGERRNAAINECKGDWIFEIDADEHVPEVLGKXILRTISXSRFDWHEIPVDNYIGDKLVRYGWGASFGKAAYPGLFKNGVKVWSNQRVHPKLIWTGQKGFMLENRIDHYVDKNISDMMRRLDSYSTARAKDLVEDDNVGTTINNIRRFFSRFIKCYFFRKGYKEGKYGLLIAIFAGLYPLISHIKAKVEIN

SEQ ID NO: 1678 - protein, 352 aa, Lachnospira pectinoschiza
MDISVCIITKNEADKLEKCLLSLKKYNLQIVVVDTGSTDNTSVIIDKYADISGSYKWCDDFSKARNYSISLAGNDWILVLDSDEWIEKMNIDEVAAIISNQSVNCTGKIELINNINYDNELTRGVERITRLFNRKRCHYEGRIHEQVVSIDKNVVTAVDVPITVGHSGYMGSVDNKKKKAERNIRLLELELKENGPDAYIYYQLGKSYYMQGDYKNASGNFEKGLSFDLDPKLEYVQDMIETYGYSLLNEKRIPEMMFLQNIYSEFAVSADYVFLMGLAYMNNGLFDKAIEEFNKAKSYKLCKIDGCNSYKADYNIGVIYECLGDTAKAVLSYKKCQSYEPALKGLKRLGCN

SEQ ID NO: 1679 - protein, 585 aa, Unknown
  Description of Unknown: Clostridiales bacterium PH28_bin88 sequence
MKDTITLAMIVKDEAKNLKACLDSVKGQVDEIVIVDTGSTDNTLEIARNYTGKVFSYPWDGDFSAARNFAIAKAAGEWIFYLDADEKLLAGTGDLKQLIDQDNTADAYLLPLNNPTADATGEYNRFYVLRLFVNNERYRFFGKIHEQVAIPDSKAVRMSEGPVISHQMLPRKERNRKRKRNLALLKQASREDPENPFLRYYLGVEWMMLGKPGLALPYLRETYQKLPANNTLFRSPALRYLIVCLQALKRLDEAICLCLAADLKYPEYTDIYYLGGILFEEKQEYQLAIKWFNQAVRCGTPPMLYSHMHGAGSFLALYHLGYCHERLGQMENAITCYEQALESNPKYVYPVYSLFRALMIKYNPRHLLDYFKKNGYWGNVDAAMVAAQLFYAWGYPGLACQCLDNSEENGQQTEESLFLQGKYRLYSGGLEWGLACLDQIQGGSGFYIPAQILKVMGLFLQGRFSEGQGVARQLWKNREARCDAWVLLILGRYLEQGKLGGGQKRIREKSPLTSAREMYEDLKHYLPGSQAGQKTYYVRMVNGLETIMKSLSPEAYLNLLEHYRQKAGDIQSLAGYRFGNIGVTP

SEQ ID NO: 1680 - protein, 598 aa, Clostridium oryzae
MRNEVSLCMIVKNEEEYLPQCLESVKDVVDEIIIIDTGSTDRTIDIAKSYRAKVYPYKWNNNFSEARNESLKYATKDWILILDADDELKGQYKDNFKALVNMELDEKAVYIFETLNYYGDKADNNCITVNLNPRMFRNNRGIHYEGEIHNQLMYKNNQYDAICNDVKIYHYGYLNKTIKAKDKRNRNISILNEKIKKEPDEGFNYFNLGNEYMALGDTRKALECYYKAYENFNPLTGFGPILLLRIIVANYNIREYNTALKFVDIATNNYDKFSDAYFFKALIYKDLGKITLQIKALEKCIEIGEPPAKLKFFYGSGGYKAYYELANVYMLFKDYDMAYKYYSKAIDDNPDYIDSIYGIGHLLKEKAVPVKEFKETIETFCSTAAKDYSIAAETFYNEGFYKTALDYVESLQQAGNKSEKLIILKAKCLIRSGEYEKCINMSTLDEKSDFYMEFVMYKILSNISLGKYDDLSALLVSVDQKTLSDRDNKIFEVCSELIKLFTNGKSSMLSEDENEKNYIFIILEICEIMLINEDFDELKVAVNLLNLINNKYVLLYLGKLYNAYGYFDFAKKEIIRSIKEFEVYDNESLDILKSYSYI

SEQ ID NO: 1681 - protein, 278 aa, Pedobacter metabolipauper
MLLDLTIAIPVKNEENSLKGCLDAIGPDLAKKIIVIDSGSTDRTRAIAETYGAEVVDFKWDGRYPKKRNWFLQNHAPLTKWILFLDADEHLTLDFKQELRDALTNGSDGIAGYWLKYTIFFMGKNLKGGYPLYKLALFKVGAGEYERIDEDQWSKLDMEIHEHPVLNGETGKFKNKIDHMDFRGISHYVIKHNEYASWEAKRYMTAVNDPVVRESWTWKQKIKYRLMRSVFIGPVYFFGSYILLGGFRDGKRGLSFAIMKMSYFNQVYCMIQELKINK

SEQ ID NO: 1682 - protein, 339 aa, Ureibacillus thermophilus
MSSSSISLCMIVKNEEDFIERCLKSVYGIVQEIIIVDTGSTDRTSEICKKYGADVYSYSWNNQFADARNFGIAKAKGDWILWLDADEKLDRSHEDLLIKAIQNPTATMYYLPVINYYGKSFPVDKEKSFIYYQPRLFQNHKGIQFYNRIHETPLFPDVNDSNYTTDYLEIPIHHYGYIEELIAKRKKADRNLQLIEEEYKNPEHSPWIEYHLAYEYYRRGDYQKAFDYLNESIFRFLLNSIKPPSILYRLKYGILIDTNSLDNALEGIEKAIVLYPDYVDLHFIKGYILFQKKKVEEALDSFEKCLELGEHNPKYLILRGTGSFMAEKYKKLCLENIQK

SEQ ID NO: 1683 - protein, 358 aa, Bacillus aryabhattai
MSASISLCMIVRDEEETLERCLLSVHHLVDEIIIVDTGSVDNTVKIAEKYTSNIFFLEWKDNFSFARNFSFSNATKNYILWLDADDYLTKRDQTELKQLKDQLDDSIDSVTMNYHLAFDENNQPTYSLKRNRLVKRTRQFKWIGAVHEYLEVYGKIIDSNVAITHGKEKNTSNRNLLIYLNKRKNEEVFSTRDLFYFANELKDHHRYSEALTYYEEFLNKQDGWIEDKIQACLNKSFCFEKMGEKEEAIRSCLETFTYNTPRAEACCAIGRLFMEKHNWENAIFWFEVALQQPKPSSMAILHEPSWTWIPHLQLTVCYEKINTMEKAYAHHLKCMELIPQHASTLHNESYFQQRKPLV

SEQ ID NO: 1684 - protein, 583 aa, Unknown
  Description of Unknown: Clostridia bacterium k32 sequence
MKERITLILIVKDEEKKLPKCLQSVQGHVDEIIIVDTGSTDNTVEIASRFTDKIYRYPWEGDFSAARNFALAQASGEWILSLDADEELVSGEGDLQRLINTGQNVEAYLLSLHYPTADSSGAYNIFHVLRLFRNNGRYFFQGKIHEQVVVQERGVVGVADRPSIRHKLLSTKERNRKRERNLALLKKACSREPDNLFLQYYLGVEWLMLGKPQKALPYLKQSYEQLTDEHLLFRAPALRYLIMCLQALGRLEEAICLCLEADIKYPDYTDIYYLGGVLFEEKKEYQLAVKWLKQAVLCGSPPALYSHLHGTESFLAYYHLGYCTEMLGQKEEAKENYEKALQANPHYVYPLYNLFMLFCTAHGPKATLAYLREKGLLADAQMAKEAANLFFISGYANLAYSCLADFKASAEVARELKLDLAKYAVLSGRARQGLELLNTVSEDKVLRAEASIYCLLAHLLLGEFTQARTLALALWKQSDSRCLGHAFLCLIQVLDKGTMPICPLKIREEDVLEQLIKIFDLCSYYLPERSSEADSFYFKLKSGLEALCTNISAEGCLSLAECYGQRAGNWRSFCANKFGLKGK

SEQ ID NO: 1685 - protein, 335 aa, Unknown
  Description of Unknown: Lachnospiraceae bacterium AC2028 sequence
MTISCVMIVKNEEKILARCLDSIRDLMDEIIIVDTGSSDKTKEIAAKYTDKIYDFAWTGDFSDARNFAFSKATMDYIYSADADEVLDEANHIKFMALKTMLPEEVEIVQMRYGNQLMHSTVYNFNEELRPKMFKRLRQFVWQDPVHEMIRLDPVVFDSEIVITHMPEENHGHRDLEIFSKATIGGGQLSKRLFDMYVRELFIVGTEDDFRNSLPYFVSCAADVNLDADSVNKACLVISHTARIHGDIVMFFKYITKLMASDPSSEVCLELGLFYERIQDFEEAAIWFYNAAFETIPAVVLTSSGKDAAEGLKRVYDAMGMPEVGMQFAKDIEAKG

SEQ ID NO: 1686 - protein, 624 aa, Paenibacillus amylolyticus
MSKTIALCMIVKNEEQFLRRCLDSVKDKVDQIVIVDTGSTDNTLSIAKEYTTDIVQMEWTNDFSAARNESIRHANTDYTLVLDADEYLEQTTNLAEVLQSGADYYFTKIFNFMSGDRGMTHLAIRIFKNKIGLCYQNRLHEHLNTREQEDQLVAGYSNLMIMHTGYTDEIMESRGKAQRNLALMLVEVKGNPSVYNLFNMGRTYMWLGEHEKAIQYLQKAYPLSKNLTIAPELIASLCRSLGELKRYDEALTILEQAVDLYPLEVDLFHLQALYYMEIGYHRDAMACMNRCLEIGDQGISFTEGNGTYIAHLRLAEWHSTRNEYNKAYEHITEAIRFKADFLPVIGKYFEIVEKAGLSLEEMFTNANDIFSITNSKILGKILEALYQLRHPLLQRYLTLYEVTVQEHVMAVASQYAKDYSQAREQWLGLSEQEEQNGVDILLLAILLKDEVLFEKAGPLFNLSDKEKKFLTIVVRDESIDKLSLTTYTESILERVLVHLIRLQEFEVMETILGYIWNGRIEIKIKVCEHLADYGFGEIAIDLLVELFKLHPRNKNIIRLLGDVCYRSNYLQDAQLFYTKLLELSDNYSSHERMYNVYLKSKDEKGKNALLNVISEKFKLCLWLR

SEQ ID NO: 1687 - protein, 701 aa, Clostridium botulinum
MKLSIAMIVKNEEKNLERTLIPLKKLKEYIDVEIVIVDTGSTDNTIKIAKKYTDKVYLHIWNNDFAAMRNISIDYCTGDWILVLDADEALYDIKDLGELFNRNIIHKYNSAFIKIVNFNKNIENSINNENIAPLLRIFKRNTVKYEGIVHEQPDFKAPVLNTNIRFIHYGYDNDDYELMECKFKRNIELLFKQLRDNPEDIYVNFQIATSYAMHKDLKEALKYITKAYELCKSELTKYIYVVDKYCYILYSLKKYELLREKAIEGINNYKDFLDFYFYLGEACFNLKQYDQSIDAYCNYLNIYTKLQKNEIEFTNILSESTRGFKDNILYNLAMGYYNLKKYNCAIDAIENINDKNIIKDKIYGVFKIIDKGDLWGKLYIIDGIIDKHNFEDALVYVHEELSLNKLQNIEVEQLKQLKVIINIVSYFKINNNINEEIFNEIKEIILRNKVPYIVFVYYTLKYNINEIKNFICFGKDKIESILIHLCKNYYEFNEVLYKGLNVLKSSTFSDLLMRTTVLKSFILGGKIPKELREKIFLSYIAEKYYTIIKCYDNEIIKHNLWILSSEERFIIQLKETLSYKYNDTLKCIQCMKNLLNLDNGYIGYIKLLVGKFEEVTINKKVKAFLPELVQNIRTLINNKKYQDAYNTIEKGLDLVYFDFDLMVLKYNLLLNFNYTEEAMECLNNIILYGDIDRVNNFIYNH

SEQ ID NO: 1688 - protein, 357 aa, Propionispora vibrioides
MIVKNEEKVLGRCLESVAGIADEIIVVDTGSTDRTQEIAGQFTASVHHFQWIHDFSAARNFAFSLATKDYILWLDADDIFLPEDRSKFLQLKYAPLDPAIDTITMLYNLSHDQYGKVTSQLRRNRLVKRSNNFQWVGAVHEYLAVAGQAFHSDIAVTHSPLEHDADRNLLIYEERQKKGEIFSPRDLYYFANELLDHQLYNRAIEYYQRFLATKQGWVEDNIGACGKLADSFYHLSDPENQLKYIFTSFTYDTPRADFCCRLGFHFLQANQLLQAIFWYKTATQLEQPSETWGLVNYSCRTWLPHLQLCVCYSRIGKYQLAHEHNEQAAKYMPDDPRIAHNRKFLRSFIEPQPETVD

SEQ ID NO: 1689 - protein, 633 aa, Bacillus cytotoxicus
MKPFISACLIVKNEEDMLRKCLESLQGGVDEIVVVDTGSTDTTKEIAKEFTDKVYDFEWTNDFAEARNFAASKASGEWILAIDADECVDPKNLAAAIEEIKSHDNKFDVYAVEINSFSDKYGENLSMNHMQRIYKNNGEFHFSGAIHEQIVEKGEGRQELVFSALKLYHYGYLPNVVKKKNKRKRNMDILKKALKSNNNDGFTYFNYGQELRSLGKTKEALESFIKAYQNKEDVYKEWVSRCLYFIVEMLVELKRYEEAIVIINDAEEVFSTAPDFPFWKGEIYFKQKRFDDAKEVYTHIISNNMIYQNAVFNAGAKTFLPHVRLGEIYTQERQHQQALQHYVEALNENDSSVKIIVNIISLLSKYHTPEEIYDFISTRQIIKSDYIRTEVLKLLLDLGLGKVALLLMNDFINQQQLLIHSLQLKANMIIAEEPLQFTIDNLMYGIQMEVFDIADLIVLYAMTKDAHVQNILENSKFKHVFYNLFNKTKNAKKLKQDEYLPILEKAICFQKAEFVEKLISYTSLFPKQIHAKIADLFYNNAYEEIAMDFYQLSDENHVTKQGYVNIIEYLLMHENQEEAYRIALEALQKFKADFRFYKYSIEIEQGDTEGIISKAIQEFSDSNWLKGKLLMSI

SEQ ID NO: 1690 - protein, 651 aa, Paenibacillus baekrokdamisoli
MTTLISLCMIVKNEERTLARCLESVQGLVDEIIIVDTGSTDTTKEIAKKYEAKLYDFTWVNDFSVARNESLQKATGKWILILDADEYMQKEEHTRLKESLLRADPSVPQGFIFNVLNIVGESESNMSGFLPSPSVRLISNSRDIYYSRPIHEQLITSAGHLACTSLDITVFHSGYTEDAKQDKGKSQRNLEIIAQSQTYINQPLDPYNNYTLGNEYFNLGDYKKAVSYYEQAYNQADAQVAWMPKCVDSLVSSYLLMGGFNHAFNYIQVGLQRWGTYSDHHAYLGFLYQNLGFNDLAKESFLMAIQLGEEASHSDKHGAIVKSNLANVFPSQKLVEIYGGQRDTIQTVHYLSKVLNHAPQDTASLHKLISILAQAESDSSIIAFLDRIYPIAKPGNLLLLFRMSLISAAASLAQYYYQKLKEINVQLGEHELLHFALLNQNQALFQQTVNKHRIATDPTSPPPYKFLLIGTLLWGAPEVPANSIAPEGNPLFRIGQSIHALIIGAAPAVIVEEDMSIYIDFLITLFNLHAFEAFDLLMNHLTGIEALNAIADYFFANNQLELSLNYYSILLEDHSLYASGYENLANLHLNQGEIEQGLLFLEQAVALNPNKAALYISFCRYSEDAAKKEFYKKSLLHKIPHLNDLPFIASM

SEQ ID NO: 1691 - protein, 595 aa, Clostridium sp.
MKNEVSLCMIVKNEEEYLPKCLSSIKDIIDEIIIVDTGSTDKTVEIAKTFGAKIYYFKWNNNFSEARNESLKYATKDWILILDADDELFEEDRKTFKALLNSKLDEKAIYYFETLSYYGSNIEKGDIAININPRLFKNNRGIHYKGEVHNQLVFYQGEYNAICDSIKIHHYGYLDKRITSKDKRNRNISILKEQIKVNPNDGFAYFNLGNEYASLDDMNAALEYYYKSYEDFDSGRGYSFILILRIIVSNYNLGNYDEALKFIDVGVQHYPKCTDLYYYQALIFKATDRPTLQIKALEKCIEIGEAPSELKFLYGTGSFRAYYELGNIYMKYKDYDTAYNLYIESMSSKPDYIEPLYNIANILKEQNVPIEKFKAIIEEFFSKNKESCYAIIADLFYHVEYYKTALEYMKKYEDTGTSAEDTIMLKLRCLIRNGDFEEYLSINEMDKKSSCYMFFSMYRVLSAILLKKYDYASSIVNNFKYDELSIYDKKLLDVYSELIKLFTKESTRILSQDKNNKEYMNIILEILEVLLINNKFDELKIAVNLLNLIDNKYALFYLGKLYFKNGYIDLAKKEILRSIKEFDVYDSESLDILKY

SEQ ID NO: 1692 - protein, 629 aa, Paenibacillus polymyxa
MYKTVALCMIVKNEEQYLRRCLDSVKDKVDQIIIVDTGSTDATVDIAKEYTNEVYNFKWINDFSAARNEAIKYATSDYILIMDADEYLDESSDLKADVSSECDYYFLKVHNFVSQGQKIEHTSIRIFANFRGLFYRNRLHEHLNNLDEDKKAFTSGFGKSYLYHTGYTDEMMQDRDKQKRNLPLMLQEVKENPNAYNLFNMGRTYKWVGEYEKAIQYFKKAYPLSTNLIIVSDLLTNLSHCLVSLKREFEALQILNDATALYSNETDLRHTQALVFSDVHYYKDAIAALKICLQLGDQGITITEGNGGFMAYYRLAELHEKNYRLLLSYEHIIECVRIKKDFIAGIAKYFEIVTMASIPLTEVYQNFNQIYRISSVKELKVLLEVLYALRHPLLNRYLSDYKINPEDNVLVVATQYDKQYDKARLMWLGMENIDAENGEDILLLALILKDSELFELSRSYLNLSVKEAKMLRSIIMNHEIDTPKLTTYLENILEKSVDCLLVLQEYEIFQSILEYIWLGSLELKYNTLEKMMRYGFNEVAIDLLVKLFEVNPTDKKIIRLLGDACLNSGYLEDAQLLYTKLLDLSPEYSSYERCYRLYEQLEDKEMMKNIIDSIKNKFPLCLWVHEIAD

SEQ ID NO: 1693 - protein, 718 aa, Anaerotruncus colihominis
MKAKQTGILLTIGMIVKNEEQYLPRCLEALRPLREALPCELIITDTGSTDRTLEIAAQYADEVRHFQWCDDYAAARNTTLEDISGEWYMYLDADEIFDPDISGVVDFFKGPLCKKFQAAALRFINYDSQNKPAGSFYPTRIIKRAPGLHFEGAVHEHLVSDVKDGYALQTVVRHYGYMGELARVKMLRYRPMMLAELEKNPDDPRMLRQLVDGYDPHYPDEAAQRKKLLERLIAICLADKTVNQRPFAFLSLVRTQWTQSDFEGVLDTIRRYFKEKLIKGDSAADIDMYAMRGFALFNLKQFAPALDALDEYRRLYRAFYERKLDLSDMGTVGLHGINDEYLMRSLYVSTQCCLALNDKERAKTYIGQVDISSLAAAYPDLPFLADEFGYMRASGDFARMGALCTQIMAVNGESVRLRFFQLVEKEFPVFDSQKLEAARALAAVKGEHKFLTLHRMRAALADGDSSQAAALAQALLVKQDAGADPYFADVLYCVMLCGQPLAPALDVFGAALEETLNVLAGQRPDFDTAVCAAFGREPFPQSGTPGELFRRTRVMLLALLRGTGAEQARRDQLADLYTREIISFCEQVYNLAALPEQERFILPAEHRFALGMREVNAVLGQGDAAACLQKLQALLDSCPTMHRLIKRRLDSIARQIQEKSEAVNEFERLAMSVKQQFYGFLKAGQRDACAEVLKAYAAVNPDDPEIDVMRRDFEQSFR

SEQ ID NO: 1694 - protein, 362 aa, Anaerovirgula multivorans
MPTISLCMIVKNEEETLARCLDTVKDIVDEINIVDTGSTDRTVEIAEQYTDRIFYFEWIDNFAAARNESFKYATKDYILYLDADDVILEESRVKLKELKATLDTTVDSVSMYYDAGTDAYDNVTLRYRRNRLVKRAKNYRWKGDCHQYLEVQGKIINSDIAITHRKIRHAVGRTVSIYEKKIARGDIFTPRDYFYYGNELRENSRYEEAIESYNKNISIKEGWIEDKIYACIFKADCYRYLGDLDNELSSLFQSFQFFPPRAEACSRIGYNFQRQKNYKTAAFWYELATQQVPNPEQWSFIYPAYYTWYPHLQLCVCYYNLGDYQKSYEHNEQARKYRPEDNRILSNKNLLEEKLNFTKKVQ

SEQ ID NO: 1695 - protein, 367 aa, Sediminibacillus halophilus
MISISLCMIVKNEEAVLARCLDSIKDIVDEINIVDTGSNDNTVNIARQYTDRVFYFEWIGDFAAARNESFKHATKDYILYLDADDVILEEDRKKLKKLKETLNPEVDSVSMYYNAGMDEYGNVTLQYRRNRLVKRSRNFKWKGDCHQYLEVYGNIINSDVAVTHKKIRHSVGRNLSIYQKKLDRGDTFSPRDYFYYGNELRENGHYEKAIESYEKNIAMEDGWIEDKVYACINKADCHRHLGDTVKELESLFRSFQFSKLPRPETCSRIGFNFQRQQDYKTAVYWYDLATKLETDPNKWSFTYPAYATWYPHLQMCVCYYNLQDFEKSYEHNEKAREYRPKDKKIIFNKELLEKKLGINQHETAELN

SEQ ID NO: 1696 - protein, 362 aa, Paenibacillus sp.
MITISLCMIVKNEEQVLARCLDSVKELVDEIIIVDTGSTDRTRDIAANYTNRIFHFEWIDDFSAARNYSFEHAESDYILWLDADDWVQEKDLEAFKTLKQSLDPAVDAVCMDYYVAFDPLGQPTAVIKRNRLVKRSAHFEWHDPVHEQLAVSGKVVFSDIAVSHGRVHAKSDRNLRIYESRLAKGISLSNHQQLQYAMELTAHGYFDKAIGIYQIIIADPYRYFEDKLLACDRMAHCHHELGYKEQELQSLLQTFNYDIPRADYVCRIAYYFQENLDFEKAVNWYQLALRLEKPKDRLRGINHMAWTWFPHLQLVKCYGKLGQLEKAYEHNEIALSYSPNDQAILDNKQVLVKHLSRRGYFK

SEQ ID NO: 1697 - protein, 373 aa, Clostridium sp.
MLSICIITKNEEQNIKRCLSCLSDTELEIIVVDTGSTDRTKEIAREYTDFVYDFAWKDDFAAAKNYVISKASNEYVMVIDSDEFLEKTDLVQLEELIEAHPDDVGRIRRINVFSRDGVGQENREWLNRIFSKKKFHYEGRIHEQVAPYEGDTYDTYQTPVTILHTGYDLPMEERRKKAERNALLLQKELENWEEKYPGITYEAEKYQISSRQAEQISYILYQLGKSAYMAQDYEKACDYFGRGLSFDLNPRLEYVIDMVETYGYALINSNRAEEALFFEGIYDEFGDSADFQFLMGLIYMNNGRFEEAVAQFEKATEQKDCKMTGVNSYLAYYNIGVIYECLGQKDKALAYYGKCPEYEPAKKRMQEMNASNL

SEQ ID NO: 1698 - protein, 365 aa, Natranaerovirga hydrolytica
MITISLCMIVKNEEALLARCLDTIKDIVDEINIVDTGSTDRTVEIAKQYTDRVFFFEWIGNFAAARNESFKYATKEYILYLDADDVVLEEDRAKLKELKETLDPSVDSVSMYYDAGTDEFGNVTLRYRRNRLVKREKNFLWCGDCHQYLAVNGKIINADIAITHKKIKHAVGRTVSIYEKKIERGDDFSPRDYFYYGNELRENGHYEKAIESYDKNIALKEGWIEDKIFACIFKADCYRFLGDLNNELNSLFQSFQLSAPRAEACSRIGYNFQQKTDYKTAAFWYELAIQQVPDPDRWSFVYTAYHTWYPHLQLCVCYYNLGDYQKAYEHNEEAMQYRPEDQRMRHNKALLKEKLNKPATVKEDN

SEQ ID NO: 1699 - protein, 636 aa, Bacillus cereus
MKNFLSACLIVKNEEDMLRRCLESLQGSVDEIIVVDTGSTDNTKKIAEEFTNKVYDFKWENDFAAARNFATSKASGEWIFAIDADECVEKDNIEEVIKKIKLNGNKYNIYIVEIISFLGRGGQSTTVNKMARIFKNDRTIQFKGPIHEQLVAVSGSQNVAFSTLTLYHYGYLEHVIEKQDKKNRNLEIVKQDLKSGKNKGFSYFNYGQELRRLRKTSEALNNFVKAYAHKESIEEEWVRTCLFFIIECLTELKRYEEALKIIKDTETLWPSAPDFTFAKGDIYLLQKRFDDAKEIYQDILANGDSYNNIVYHHDRKSFLPYERLGRIYQIEKNVEAALQAYIKALNENSTSIHIIIKIVEILSEYNEAQEVYDFLNNHNIIKADAIRLEIIKCLLGIGYADLAVKLAGDLEKGNENLIRVINLKATMIQYPFRDNISLTFEEKDILLGIEIGMFDLADLCILYDLTQNQFIEIMLTGSKFKHVFEGLFTELNHSTKIKSEEYLSILKRAFCYKHIDFVEKLIVLKKLVPKDINAKIADLFYENGYEDIAMSFYEISDDNHVTKQGYANVIEYLLEIGNKEEAHRISVEALNKFKKDFRFYKYSLETSEEDAEDLMSKAVKLFPDSNWLKRILLLTF

SEQ ID NO: 1700 - protein, 363 aa, Paenibacillus sp.
MNTISLCLIVKNEEEVIGRCLKSVHQVVDEIIIVDTGSTDRTKEICLEYTNKIFDFEWINDFAAARNFAFSYATMDYIFWLDSDDVLLLEDCQKLKTLKELLDPAVDSVTMVYCLAQDKHGNMTSSNRRNRLVKRLNKFQWRGFVHEYLDVAGNILNSDIVVFHKPLKHHNSDRNITIYKQRLEKGEEFSPRDLYYFANEWLDHGLYEQAVEYYEKFLDTKQGWIEDKIAACGKLADCFHHLDNTEREMYYTLKAFEYDTPRADSCCRMGYGFMQHSEWEKAVFWYRLATELKIPKDNWGFLNHACWTWLPHLQLCVCFYQLGEYEYAYKHNGIAGRFIPDDEKVLYNQRLLEALLGRNKTVE

SEQ ID NO: 1701 - protein, 350 aa, Herbinix hemicellulosilytica
MISVCIIVKNEEKLIEKCLKHLLPLEYEIVVVDTGSTDNTKAVAAKYTDMVFDYEWQQDFAAARNFAISKATNDYILMIDSDEILLSYDRKELEELIKLYPDRIGRIGIISEYVRGNEKYKVKSQVSRLFSKKLFCYRGSIHEQIVPINNNNGVPVTYNAPLLVNHSGYDGELEVRRKKTERNINLLLKELKDKGDDPYILYQLGKSYYMQEDYPAACEAFWKALYFDLDPKLEYVQDMVESYGYALLNSNQYETALQLLGVYDEFAVNADFVFLIGLIYMNNAMFTEAISEFLKAAKMTEYKMEGVNSYLAFFNIGVIHECLGNTEKAIKYYKKCGNYEKAQERLRNIR

SEQ ID NO: 1702 - protein, 353 aa, Unknown
  Description of Unknown: Eubacterium sp. CAG:38 sequence
MISISLCMIVKNEEKLLKRCLDSYRPVCDEIVIVDTGSTDRTKEIAAGYTDLIYDYPWNNDFAAARNFAFSKANCDYIFSADADEVLDEENRRQFLNLKQVLVPEIDIVQMIYVNSKSHNTVYNFEEEYRPKLFKRLRTFEWISPIHETVRLEPVVFDSDIKILHLPEQSHTKRDFGVFADAVRRGVRLENYVVIMFCKELFISGTDEDFLSVREIFENVLAKEDRPEDCRKNIACVLARIYRLTNAYNEFFKICLKDMAQNPCAEICMELGHYFYGLKDYEEAVLWYLNAASETPSIIDIHSSGDAPLACLSKCYSTLAAQAKQDKNAELSAAFLAQAEDYQAQAEHWQAAI

SEQ ID NO: 1703 - protein, 354 aa, Unknown
  Description of Unknown: Eubacterium sp. CAG:86 sequence
MISISMCMIAKNEESVLKRCLDSYSGLFDEIIIVDTGSTDNTKNIAAGYTDKIYDFEWTGDFSEARNFAFSKASCDYIFSADADEVLDDYNRNLFMRLKSVLLPEIDIVQMKYVNCSHNTVYNSKKELRPKLYKRLRTFTWISPIHETVRLQPVIFDSDIEILHMPQSSHSKRDFSIFKKSIDNGTHLENYVLRMFCKELLISGSDDDFEEFYDIFTRRLIYEYTDNDCLEAISCVLARMYRLKNLSDDFFKIALKNVAVSPCSEICLEIGDYFFNKNDISEAVLWYINASSETESVLDIRTSGDIPLRRLAQCYTTLASEAVAHGDDVLADTYNNNASEYEKQADNWKMPEEL

SEQ ID NO: 1704 - protein, 324 aa, Vibrio sp.
MVSDIKFSAVIITKDEEKNIYDCISSIIESIDELIIYDTGSTDSTISLARNYPSDKVLIYQGSWNNSFSEARNAAIDYCSNEWIIFIDADERLIDDPNNSIRNSIHRYLVNGEDYSLGCPRIISESRITHSLIRILPNNGKHRFHGRVHEYIEARSATVKKLPITFTHSGYDKSTTHFQYKSERNLKLLTMQHREEPSNARWLYYYLLYDNNCTPVSERIQLSKRLASSALTPDIYSHSAYSLLISLLLNNNEIDRVLTESLECLNRHKCHFDAQFFNILQRFEGNLEREFETELEDFLAKNEPEETSFLTKKICKEIARSIEM

SEQ ID NO: 1705 - protein, 702 aa, Clostridium sporogenes
MKLSIAMIVKDEERNLEKTLIPLKKLQDYIDTEIVIVDTGSTDNTVEIAKSYTNKVYFHNWNNNFAAMRNISINYCAGDWILILDADEVLYDIDGLINLLNSNSLNDFNAVLLKRIEFLKSVEYSVSNGYISPILRLFKKNTIYYEGAIHEQPKFNYPVMESSVRFIHYGYDNNDYEVMEYKFKRNLSLLLGELKDDPDSVYINFQIAVSYTMHNQLKEALEYIEIAYEKGEKNINKYLYVIDKYCFILYNMGNYKALIDKAIEGIKYCNDFLDFYFYLGEAYFNLKQYNSAIEIYSKYLKFHEGFNDTLVMPNNTLAVMTRRYKENIIYNLSLSYYKNKCFKESLDTIKTIEDSNLIRQKIVFLIKIIVEGNLYNEINIVEKYIDKYNYENLLLFVYKEISVENLKKLNNIKLYEKLHEIFFLVKYFKENDSMDEKIAEDIKKIIDKAQQPYSIYVYHILKYNIHEIKNLINFGKDKIENILINLCITYFDFNGVILQGLNKIRPNNISNILIRTVMEKSLIVASNLPVNERKNIFLNYIADKYFVILKLYNESSMERYWWILPSEERGIIKLKEGLSYKYKDSLRYIQYMKSIINEERIYIDYVKVLIEEDYDFVLNNELKVFIPELVSNIQLLINNEKYQEAYNTIEEGLSLVKFDFELMLLKYNLLLKFNYEEEALKCLRNIILYGDKEEVSKLIKNI

SEQ ID NO: 1706 - protein, 368 aa, Jeotgalibacillus campisalis
MPTISLCMMVKNEEEVLGRCLESVKDLVDEINIVDTGSTDRTVEIAKEFTDRVFFFEWTGRFTDARNESFKYATKEYTFYLDADDVLLEEDREKFKKLKETLDPAVDSVSMFYNAGTDEFGNVTLQYRRNRLVKTSRNYKWEGDCHNYLNVFGHIINSDIAVTHKKIRHSVGRNLSIYDTKIENGDVFSPRDYFYYGNELRENGHHQKAIESYSKNIELKEGWIEDKVYACINRADCYRFEGDTDKELASLFESLRFSKTPRPEMCSRVGYNFQRKKEYKAAIYWYELATTIENDPNRWSFSYPAYSTWYPHLQLCVCYYNLPDFEKSYKHNELARKYRPDDERVLLNKELLEKKLGLKKETNADTPS

SEQ ID NO: 1707 - protein, 645 aa, Cohnella thermotolerans
MTWPNLEDDMTKLLSLCMIVKNEEKVLDRCLTSVQGLVDEIVIVDTGSTDRTREIARKYTDQVIDYAWKNDFADARNVSLRHASGRWILVLDADEYVQPHGHEELRRLLSERSASSNICYLLKIMNMMGKESSGQVHFMESQGARLFINSLGIHYEEPIHEQLRSRDGPIAFEALSFSIFHSGYTNEVVSEKQKTKRNLDILEKLKTPQRLKQPYYCYVLGNEYANGQNDAEALRYYRMSYARSKPGDAWYVHLLDRFLTVLIKLNMHGEAYRLATEARSRRPDVVDYHCLSGIILEHYGLFREAAACFEECLNIADRCETANKPYWLVQTNYGRIIPHQMLAEIARKRGDLHQMVHHLTKTIQVQRNHYGVLRQLMLYLTLFDSPQSVSAFVEKLFPLNEPIHALLLLKVSMSVGNRELAIRYRAKCEEAAVPLSNTDRLIYDLLLHQPSQVMPSEEDGFPADLALMATVVYQDDRYLQSLSAEAELLALGRELMRIVRDNDDSEVAQAPPPALQDLLLRLLMNGYDELYDRILQRWLQPDFLNSFAVKLADSGRGDLAMNYFSLALDNQVLSGEGYKFVGHYLLLQNELEQGMQFLRTALELAPTEDLIGIAKTSTGVLLPSYREFLAEYLKRFPEAKSLPLS

SEQ ID NO: 1708 - protein, 507 aa, Dethiosulfatarculus sandiegensis
MPKSKRRKKGNKKRRQTGRAKPGLSLVVIAKNEEKDLPRALDSARAYVDEIILVDTGSTDRTVEIAEAYGSRVYHHPWQNDFSLHRNQALAYATCDWVLQLDADEALDQATAIELPALMADKRYNGYMVEIQNLFTNGEKTIFQWPRLFRNRINARYYRKVHNQVEIPGRIGQSRLVLFHYGYSGDNSTLKAKQARRVPMMQAWVQESPEDYEARYYLAQTLVAQPDTLEEAIEQAAKGLELAYSQKIDQHSLSRLYLPLLQGLSQLERHEKVVQKGIEWSQLVPNHPDPHMFLARAFLGLSQWQKVDVAARNFFVLHKKLEQAPQSLGPLEVNSLGLKYVVSACWCAALANLNQKDQALTLYSHLISPKEAQATAQMTAELTLEKGSPKTAFEMAQMAAKEHPDWDWPREFISSRNLSSGCPDPKQICDQAFELATAGDTCRAVNLYEKALSLDPNLTGAGFNLAVIHLRNGEVYRASQLLKDCLTREPSMTPARDLLNRIQETQT

SEQ ID NO: 1709 - protein, 339 aa, Unknown
  Description of Unknown: Eubacterium oxidoreducens sequence
MATISLCMIVKNEEKVLARCLDSIADLMDEIIIVDTGSTDRTKEIAARYTDHIYDFKWTCDFAAARNFSFSKATMEYIYCADADEIIDEENHTRFAHLKQALLPEIEIVQMYYKGQLHHGTVYNYDRELRPKLYRRLRSFRWIEPIHECVSLDPLVFDSDIEILHIPQSVHANRDLAIFESMLSNGQPLSKRLRTFYAKELLLHGTQEHFMFAKDYFADLLNNSEMDNEDSKEAFIILARAYRLLGDAPSFFKYILKNIGLELDCSEIFFELGMFYENLSQYEEAQIWYYNAAFESSAYLNIHFSGDYSLQGLARCYDAVGLTDQAEHYRTLAKQWTPD

SEQ ID NO: 1710 - protein, 611 aa, Paenibacillus sp.
MKKTPRKPLISLCMIVKNEADTLARCLQSVRGVADEIIIVDTGSTDSTVSIARSFGARIIPFPWNGDFASARNAGLAGARGTWILVLDADEELEPGSKKELLVCAEHTEYEAFFVRIHNHKGTDRASQTITVNPILRMFKSRASYRFSGIIHEQIAAVIVQETPAAAMHMSTVVVHHYGYADGVVEKKDKISRNIGLLKEQLKLNPGDAFHHFNMAVEYMRLGDYGHALEHIQTSLDHVEPDTSYIHLLYKYEIRCLAVTGDLPGALEACERGLALFPDYPDLHHIKGALLLQVSAFAEAKVALIRALDIGVSPPAYHTESGLGTYLTRTLLGQACQQIGEDNEAIACFTSAAQLHPEPLPLVTRLVRLFKCAGRELEIKGWLAEHLPVILAEQRPELVRLLVRDGCYAAAADVLGGGVNKGAAGKRAAGEQVVWEFGERELTAGEQVVREFGEGELAAAGEQVVREFGAGEWAAGEQVVREFGAGELAAGGTVAQERFANEHSSGAHAEERQDYAGEPEPSSADSLLRLLQRAEAIPAAELTYGDIAALHQYPAFARTTGGTTPASESAAAVQPWISLADKVLATLEASSVFSPAAARARLALPLPRPAD

SEQ ID NO: 1711 - protein, 374 aa, Bacillus thuringiensis
MSQSFSIVIICKNEERVIERCIEAIHEDLREDDEIIVVDTGSTDNTLSILATMENIKIFHFDWNDDFAEARNFGISKSSKDWIFFIDSDEILVKGSIDHLDDAIKNTLKHANNRERIVFAPKIINTDDSVFYNAGRILPNDNTVKFEGVIHEYPIVIEESLNLVSIKISKVVVKHDGYEDVVIKNKNKALRNTTLIEKILKQNPNNSRYYYFYYRDAKPMLTDQEYEQGMLNFFKKFPDDSYSNQVAKDLGFYYLSKNKNDEAEKYITMLFESAERGTVEDRSVAIYLTGIKEIQKLKSQQKELLRLLIYTRDNVLNQEESLFENGYAFDDLIGLLFFELEDYKTAYEIAHKLNLNNFSSNLSKMLKKLDQIYK

SEQ ID NO: 1712 - protein, 371 aa, Roseburia inulinivorans
MIKHWIILILKGKTLMIKISLCMIVKNEAAILSRCLDSVCDLMDEIIIVDTGSTDDTKAVAAKYTDRIYDFAWNNDFSAARNFSFSLANMDYIYAPDADEILDEENRKRFLLLKEALLPEIEIVQMKYRTVSEFNTVLNARTEYRPKLFKRVREFEWIDPIHETIRLTPVVFDSDIEILHMPQSMHHKRDFSIFVDAFNREGTFSAKLRSMYAKELLKTGDEKDFAEALPIFRLIYDSGTDTDTQKEAACVLAHAYRIAGDTNRFFQMTLRDMLSTPCAEICLELGAYFEEAEDYEEASLWYYNAAHETSSILDVHTGGDLPLQGLIRCYEIMLAALPEDDPFAALTANQYEEALADAREALANWDVPEEL

SEQ ID NO: 1713 - protein, 362 aa, Alicyclobacillus contaminans
MITISLCMIVKNEEDTLGRCLDTVQDLVDEINIVDTGSTDNTIEVARKYTDRVYQFDWTGNFADARNESFRHATKEYILFLDADDVLLERDRQLFKQLKETLDPAVDSVSMYYNAGMDEFGNVTLRYRRNRLVKRERNYRWYGDCHNYLSVSGHIINSDIAVTHQSPPNKTSRIGRNLSIYAAKIERGERFSPRDYFYYGNELRESGKYQDAIESYKKNLAMAEGWVDDKIYACINMADCYRYLGEFANELSSLLKSFEYGTPRPEALSRIGYNFQRAKQFQTATFWYEAAIRTQPDFNQWSFSYPAYSTWYPHLQLCVCYYYLGDLQKAWEHNEAARRYRPEDKSVLFNKKLLESKGIPFV

SEQ ID NO: 1714 - protein, 557 aa, Unknown
  Description of Unknown: Candidatus Melainabacteria bacterium HGW-Melainabacteria-1 sequence
MLQVFLLLNGLPQDPPAFAASLAALQQSIRFSLTVINNGQPFGPKRMFHQLGLTCRLLELPLRFHPAQILAARLAERPKADQFLWLEDRLIWHPAHLSAWLQELENWTWISPRLLPGQTLPQTRRSYQAEALLKPLQPARLQSLTPESFPPCFCFARSAIPVLREWLRPEGQLPLLMMAACDMATPAWHPQPALEPGQTEYALSLDEALARWQRIVEQRDTPERIQALLESLQRALPDSPAVYLRLAPMLPADAAVALLETALCRDLIYPELLALMAQALIACHQPELAAIYLRHLQQRFPGFTGQPSPWPQRGGTSVRLHPQALPQTARLSICLIVRDEAEALGRCLDSLRELAAEVILVDTGSVDQTQAVASQRGIQVLPFAWRGDFAAARNFALEQASGDWVLMLNADETLDPKGLPTLRRLLADPPPGLPAFQVPLLSHDASGRVLHLRHPVRLFPRHPLLRFRGRLFETLDCDGPVQIAVSALPGLPLIQHGEQRPQGLQRRLALLQELLALEPEQALWHYGLGECLAELNQPESALEAYQVALNSWLDAAD

SEQ ID NO: 1715 - protein, 349 aa, Unknown
  Description of Unknown: Lachnospiraceae bacterium XPB1003 sequence
MATVSLCMIVKNEEHVLKRCLDSFKAVADEIVIVDTGSTDSTKEIAAAYTDKVYDFKWVDDFSEARNFAFSKTSMEYIYSADADEVLDEENAKKFLALKEALMPEVEIVQMLYVNRHAYRTTENFEKDLRPKLYKRVRSFTWIDPVHETVRLDPVVFDSDIEILHLPEEHHHKRDFGIFRKMIAASEEGKSLSKKMHHMYAQELMLSGDKMDFADAAPYFERAFCESDPDPDQDMRTECCCILARNAANAGRTDEFFKWCLKNVSIEPCSEICMELGHHYFDLGDYEEASVWFLNAAQETKPALKADAGGKDAYDMLAHVYEKIAGEHPDIKEQALQMAIEYKRLTCMS

SEQ ID NO: 1716 - protein, 255 aa, Unknown
  Description of Unknown: Cytophagales bacterium sequence
MPKISAVIICYNEERNIGRCIDSLQTVADEIVVVDSFSTDKTAEICREKGIKFIEHAFDGHIEQKNFAITQASFPHVLSLDADEALDETLQQEIRKIKENWQKDGYSMNRLNRYCGKWIHYGAWYPEKKLRLWDSRKGQWGGTNPHDQFIMEKNATKGHLKGNLLHHRFESIEEHIRKLNYFTDIAAKAYLQKGKKCRWWHLIINPIYAFVSAYFFKRGFLSGFEGLVISSIDAHFTFVKYAKLWQLDKQKNNGK

SEQ ID NO: 1717 - protein, 356 aa, Clostridium sp.
MITISLCMIVKNEESFIGRCLDTVNDIVDEINIIDTGSTDNTKDIALKYTNRVFDFEWVDNFSLARNFSFNKATKDYILWLDADDIFLEIDRTKLKNLKYTLDNSVDSVTFMYNYSSDEEGKPLLIFPRERLVKRERNFKWVGYVHEYINTYGNQVNSDITVTHKRIHNSSYRNLNIYKKNLEYGNKLTNRDMYYYGKELYYHRFWDEAIKILELFLDTDSWFEDKIDASCAIADCYGYKGDTLKERSTLFKALEYTVPRGEIMYRIGYSFQKDGKIDEAIFWYKTILNTEIPKTISGFIYPEYWTWKPNLQLCVCYYELGDVDKSYYYHKKSYEANPIHESIIANQDFFNSIECI

SEQ ID NO: 1718 - protein, 622 aa, Bacillus sp.
MNKKTISLCMIVKDEEVFLGRCLDSVKNQVDEIIIVDTGSTDASVNIAKEYGAKIYTHKWNHDFAEARNFSIEQASSEYILILDADEFLDISFNIQESLNTNKDYYVLTIKNHMSNGYISYHQAIRLFRKTDGLHYYGKIHEHLNIEQFNNLSHEFSDIVIEHDGYKQEIYKEKNKENRNLKILLKEVNESPTGYNLFNLGVQYKVSGNFENAINMFKKSYFLSKDKVYLPYLLYLMGDCLLSTQKYEEGINLMKDAIQLYPTYTGYHFVLGNLYGESGYLLDSEFSYKKALELGEVKGFQTIDGVGSYLSNIKLSEVLQKQGKLVDALNYAFNAIQQKKDFAPAISQYINVLIQSGIEKSHSFNNIKQVYRITSLDEVILLSGVLLAKRSGILLEFINEYNLNVDKGLMMIANLYGNRYNEALDCWQEVLEISEEYLIDVINLAVVRNDENLINEVVSKLSLSDKDKKYLIEFIVNGKVPTQDLSEEFSSVIIKFITNFISMNEKEIFHLLASKLTKLEKIFLSIVRQSDLYGYSNYVLNCSLDFSPKYQEQFLEIISDIYLRNGNYKETIEIINNLYNRKPSYQNLNRFYNFYEKTKDQEGLNLVLNEISKYEISNIRNL

SEQ ID NO: 1719 - protein, 250 aa, Rhodanobacter sp.
MGREALSVVVTTFNSAGTLDACLRGVAWADEIVVLDSGSTDATAAIAAHYGARLHAQPFAGYSAQKQAAIDLASHRWVLLLDSDESLEADATAPLQRALLAPDCAGYQLWRREWQFWRWQSRRGRLNHYVRLFDRQRARMSDHEVHEEVQVDGPVGVLDVVIDHHGEPDVAGRVAKANRYSSLQQADLAKRRVGWLRLRMVAYPTVAFLRYYVLRGHWRSGWAGFIAARIHAFYAFLKYAKLYERRRPRD

SEQ ID NO: 1720 - protein, 367 aa, Ornithinibacillus contaminans
MITISLCMIVKNEEEVLARCLDSVKDYVDEINIVDTGSTDTTVEIAKQYTDRVFFFEWTGNFAQARNESFKYATQDYILYLDADDVILEEDQQKLAQLKETLDPAVDSVSMYYNAGVDAFGNITLRYRRNRLIKRTRNFRWVGDVHNYLQVYGNVINSDVAITHKSTEHAVGRNLAIYQRKKERGDTFSTRDYFYYGNELRENNHLEDAIEAYNQAVAQETGWVEDKFYACIFRADCYRSLDKSDQELASLLESIRFTKSPRPEASSRIGDYFKRKKEFRHAIVWYELAIAAKPDANQWSFSYPAYSTWYPHLQLCVCYDMLGDSQKAYYHNEEARSYRPEDPSVIHNQKYLTKKLGLDSLTTSATD

SEQ ID NO: 1721 - protein, 353 aa, Unknown
  Description of Unknown: unclassified Roseburia sequence
MRKISVCIITKNESEKLKKCLKQLMGYGFEIIVVDTGSTDDTVVMAKKYADKVCYFSWCNDFSAARNYALTQASNDIVMMIDSDEYLQEIDTGELEKLLKQHPSMVGRIKRINRVSVGEQETEYIERINRIFSRQQYEYSGSIHEQVTAKNKEEYETYLAPVVILHDGYEGTEEERRKKAERNLKLLLKELENHPDDTYFMYQIGKSYYMAEDYEEAIRYFEKALGYDLNPKLEYVIDMVESYGYALLNTGRVETALQFQGIYEEFGDCADFKFLMGLIYMNNERYEEAVAEFLKATEYKSARMTGTNSYLAYYNAGVIRECLGDIGQALEYYRKCGDYAKAQERIRACSKGE

SEQ ID NO: 1722 - protein, 360 aa, Unknown
  Description of Unknown: Clostridia bacterium UC5.1-1D1 sequence
MVSISLCMIVKDEETVLARCLDSVQGIADEIIIVDTGSSDQTRAIASQYGRVLDFAWCNDFSAARNYSFAQAGCDYILWLDADDVIPPESRAGFAALKQQLAEAAADVVMLPYHVAFDPQGKPTFVYFRERLLRRAAGFTWQGAVHECITPQGRILYADAAVEHRKERKTDSRRNLDIYEKQRAEKGTLTAREQFYYARELMAHQQWDAAVAAFRDFLSRPDGWPENRIEACRNLSDCLCTLGQRDEAKAALLLSFSMDEPRGETCCALAALELQEEHYALARFWYETALRAPRRTERGGFVQVSCYGYIPCLGLCVCCDHLGQHDEAAAWNEHAAAFWPDSPAVAYNRRYFAQRASGAE

SEQ ID NO: 1723 - protein, 652 aa, Cohnella candidum
MEKLLSLCMIVKNEEKVLARCLDSVQGYVDEIIVVDTGSSDSTKEIASRYTEHVYDFTWINDFAIAKNEAVRRATSKWILVLDADEYLDPDKKDELRGMLSELDASQPLGFVLPIFNLVESVNSGKFIESTAVRLFTNLPTVYFDRPIHEQVVYRDGELPLRNYPLSIFHTGYLEQTRKEKEKSSRNLSIFKDLKGMEEYDYFTLGNEYSSLKDYKQALYYYERALTKKTETMTIFPFVRYQIVLVLIELKRYRDAISYIDENLRRWPQYPDYYSIKASVLELLGFEEEAAALYQTALAKAEVPSAKDGRFWLIAPSLGSHIPLSNLASLSQKKHDYQQAVYYLSKLVNVNLHDHLVLFKLLNILIPSEPTESILAYLGKIFDFGRSDHLMKLLHVSLLLGHKELAGYFHDECSKRNVELLPAQQLFYAVLFNEHERFEAHLPAIDRESNPGQVNKLLFLASIIWNKPEYESYLSPSTDESEPPYELLKAMFAGIFDSGDNENEKPCDVNYIATLLIDLFKMGYYEQYDGLIQRFPAYYFILANILGDYFYNHNQLQLAIDYYSLLLDKKQLSGPGHYFLSMLYLAQGETVEGLEFLREAIRINPDQGPWYIRYLKASPKTPERATVAKEYEDRFYQNLNIDVVRQLIKGQA

SEQ ID NO: 1724 - protein, 598 aa, Clostridium tepidum
MPNHDISLCMIVKNEEANLERCLNSVHDLVDEIIVVDTGSTDKTVEIAKKYNAKVHYFPWCNDFSAARNESLKYASKNWILIMDGDDEFCKEDKEKFRNLIEKGLNEDIIYFFQTLNYSGYSVNSNDISINLNPRLFKNNYGFHYEGKIHNQLVNHEKDVQGKAYDIRIYHYGYLNKSIISKDKRNRNITLLKEQIQKGEDIKFAYFNLGNEYFALNDKKSALENYYKSYEDFDPNTGYASRLIERIIISNYMLKNYDKALDFVDIGIKYYPNFTDLYYLKGIILEEKNSPILAIKAFERCLELGEPPLALKSIYGVGGFRPKYELSTIYMDLKDYDTAYKYSVETIKSKPDFLVPLYNICHILKEKKFSVKDMKKILENFFTDFPREYPIIADLFYMEGYYNTALEYINKSEEAGTFSDDLKIFKVKSLLYSCKIDECIEYIDTIEEKNLYYFQIMMYKALCFIMKDKYDLAIVSINQFNKSNLSEHNNTTLKVYKEFLNMFTNKNTNILSEDKTMLDYTPVIFQICEVMLVNKEFAKFEKALNLLNLISDESVLLNLGKLYFKHGYNKMAKKEIIRSIKIFEIIDKEGIDILKALL

SEQ ID NO: 1725 - protein, 335 aa, Unknown
  Description of Unknown: Clostridiales sequence
MPTISLCMIVKNEEKHLARCLDTVRDLMDEIIIVDTGSADRTKEIAARYTDRIYDFAWIDDFSAARNFAFSMAGCDYIYSADADEVLDEENHEKFRLLKENLLPEIEIVQMYYGNQLAFGTVYNFDRELRPKLFKRLRTFQYEDPIHEIVRTMPVIYDSDIEITHKPNESHAERDLAAFRRLTEKGTISDRLLSMYARELYLSGTEEDLLLSEDYFTERADSGELELYHLKEAVCVIVRAARLRGDYLKMYRYAMKDIASEGVSEVCCELGNYYEQAGLLTEAVIWYYNACHETGAILDIRMQKQFPLEKLAECYERLGNQELADQYRKEAQEEE

SEQ ID NO: 1726 - protein, 624 aa, Paenibacillus sp.
MSKTIALCMIVKNEEQFLRRCLDSVKDKVDQIVIVDTGSTDNTLEIAKEYTKDIVQIEWTNDFSAARNESIRHANTDYILVLDADEYLEQATNLAEELQSDADYYFTKIFNFMSGDRGMTHLAIRIFRNRIGLCYQNRLHEHLNTREKEDQLTAGYSNLTIMHTGYTDEIMESRGKALRNLALMVVEVKENPSVYNLFNMGRTYMWLSEHEKAIQYLQKAYPLCKNLTIAPELIASLCRSLGELKRYEEALAVLEQAVDIYPLEVDLSHLQALFYMEIGYYKDAMACMNRCLKIGDQGISFTEGNGTYIAHLRIAEWQTTRNEYNKAYEHITEAIKIKEDFLPVIGKYFEIVEKAGLSLEETFTNANHLFSITNSRMLEKILEALYQLRNPLLQKYLDLYEITVQEHVMAVAKQYAKDYSQAREKWLSLPDYEEQNGVDILLLAILLKDEMLYKKAVPLLNLSEKEKKILAIVVRNESLDKLSLTTHLESILETMLVQLIRLQEFEVMETILDYIWHGRVEIKIKVCEHLADYGFGEISIDLLLKLFQRYPINVNIIKLLGDICLKTNYIQDAQLFYNKLLTISGEYSSYERIYDLYDKSNNQFEKISISKVIREKFDLCHWLK

SEQ ID NO: 1727 - protein, 366 aa, Unknown
  Description of Unknown: Clostridiales bacterium sequence
MATISLCMIVKNEEKVLARCLDSVKPAVDEIVILDTGSTDATKDVAARYTDRIYDFPWVDDFSAARNASFAKASMTFTMWLDADDVLLPEDLEALIQLKSQLDTLDADVIMLPYHTGVDETGAPSCRFFRERLLRTGIPLTWKGRVHEAIQHQGRFLRLEKPAITHRSIKTVYTDRNLRIYQAQAAAGEPFSPRDSFYYGRELYYHKRYQEAIKVLEDFLRSGRGWVENNVEACKILSYCYEGLEDDMGAFGALTSSFFFTPPRAELCCELGRLFMKLRLYPNAIFWYELALTCSPADREGAFMNRDCYGYLPCIQLCVCYDALGDHKTAEAYNRRAGGYKSTAAYQHNLAYFAELARHQAKSPCI

SEQ ID NO: 1728 - protein, 353 aa, Fictibacillus sp.
MIVKDEEQCIARCLDSIHDLVDEIIIVDTGSVDQTKNIARHYTNKIYDFKWVDDFSYARNYSFSLATKQYIMWLDADDVINDFNRKLLKQLKDHLDPAVNSVTMKYHVNRDQFGNSSFIIKRHRLVRSRCQFKWNGAVHEYLEVNGPIYHSDISIQHIKNKTDNSKRNLMIYEKQLNKGAAFSPRDLFYYANELRCHNELHKAIKFYTLFLNHKEAWKEDKIASCGRLADCYHLLENLEKERESLYKSFEFDSPRADFCCRLGNLLLGRDQVDEAIYWYEYASRLTWDECCMGFYHVPSWTWLPHIKLSFCYYKKGDYKKAFKHNKLALDYLPYDSGLINNQKLIKNKLKNLT

SEQ ID NO: 1729 - protein, 358 aa, Staphylococcus sp.
MVTISLCMIVKNEEDTLARCLDCIKDIVDEIIIVDTGSTDHTKEIAKNYTNLVYDFKWIDDFSAARNFSFSKATKDYCLWLDADDVISKKNQEKLKKLKETLTIDVDFVMMQYQIAWDEFNNPTFLYYRERLIRNNKLYLWEGEIHEVITTMGKIIYSDVIITHKKIHETDPNRNINIFEKIINSGKELSLRHQFYYARELFYHERYEEAIKYLENFIKNPNAWLENRLDAIKLLSHCYNKLNLKDKILPTLLYSLELDTPRAEICCEIGQYFINKKQYKLAIFWYELALTRPQQTESGGFILSDCYGYIPNMQLCICHYHLGEYHIANECNEKAGKLKPNDKNYKINKKFFQNLLNI

SEQ ID NO: 1730 - protein, 659 aa, Paenibacillus macquariensis
MKRLSVCMIVKNEEELLSRCLDSVMRLADEIIIVDTGSTDRTKEIAGEYAAKLFDYTWCNDFAAARNESIRHASGKWILVLDADEYLAENEYDKWNEFLNNAQSMDYLAYTMSVINFTGDKKTQEEISTMPVTRLFPNFKGIYFERPIHEQLTRGQHGELYHKQIALNIYHTGYQTQRVTEKNKHERNMSIFNEMKKHDSMSDYDWYTIGNEYRNAGEVEEAIRCYEQAFKEKYSKLAWYPFCLVGLISLYSQESRWQRVEELTNNQLSEFSDYADYHTIKGIQYETMGWVDQAIACFIDAINVAEQRASNDQEIWLVEPAYSFEKPVLQLVELYFQLNDNQQAIYWLSKLLHKNNKNPQVLLKLVEWLCQNESPDSVIILLNKIYDVTDKSNCNLLFIVSLVLGQAELVKYYVKYIDSLDHLSLLDQIRFAVILDYKEEGLALSSSDQQLDVDDQLQLWVQTAVGAIRWNDYSGIIQIKDEFKTDEISKLTELIVSMITKEHLPDEQDLKSHSSSLFLVAKQLFLIKDFEKFDEFINFMRSSELVNQLANYFYKLNLTEMAMNYYSILLSEQQLDFTSLINLGRYHVNHHYYDEAVEFFSEAVKLEPTTKSLYYSLIRHAKNEQKAEYINKFIADFPDFVGITFVDDFLHQEKELILY

SEQ ID NO: 1731 - protein, 359 aa, Paenibacillus bouchesdurhonensis
MIVKNEEKQLQKCLDSVCDIVDEIIIVDTGSTDRTKEIARSYTTKIYDFQWNDDFAAARNDSFGHATKEFIMWLDADDLLLPTDRDKLKRLKRTLSKQQEVIMMDYHLAFCAAGEPLILSRRHRLVRRDKGFKWKGIVHEDIEVSGARIAYSDIAVTHSRQGVHTERNLRILEKWIASGGSLEGRLLLHYGSELADLKRYEEAVVQLNHFLKQPNKYKDDCILACIKLADCCGELGLREKKLEALLQSFQYDLPQSEICCAIGSCFEERGQWAAATYWYLQALHIGAASSLAIMENRSLRTWVPHSRLCICYAQQGDLNSAYNHNEKALEYLPQDRGLLENRSKLQHALGMLLSDDDSP

SEQ ID NO: 1732 - protein, 626 aa, Paenibacillus dauci
MNLTISLCMIVKNEDKVLNRCLNSVKDQVDEIILVDTGSTDNTLEIAKHYTDKIYHFDWVDDFAAARNYSISKATGDYILILDADEYFESNANLKKDITEQKDYYIVTIKNLLSNNHAYSHMTVRLFARDAGLLYKNRLHEHLNIEEKEAELVRGELASVLLHTGYNNETMEEKDKKERNFPLMLREVKDNPTGYNLFNMGKIYIGRAEYEEALKYFQRAYPKSSNRMYQPELLNRLAETLEYMNRPKEALKILTDAVELYEEDTDLLNSLAKSYMQQGYYIDAEAILHKCFEIGDKGVAVTEGSGSYLAHFLLSELYEKQGRIMDSYEAILKSIQINNKISATLTKYLNTVSRTGIPENEIQQNIDVIYNINNVEDLKLLIEVLYTIRHPLLQSNIKQYDLNLEENVKSIALQYIGHYEEAKHSWMNIESIKKENAMDVLVLSIILQDMELYKKVKDFMNLSTKEQKIIQSLIDDSIIIKKVGYSTDLEKILLTSAQLLIKVQEYVSFQKVTAHLMQGSVKAKLKLGQLLIDYNFFDAATDVLLNVHNVEPTNAIATGLLGDISYRNNQLDDALFLYQKSIDLSNEYIYFEKLYRVLSKLDEIDQKKQLKNIIENQFPLAKWVRK

SEQ ID NO: 1733 - protein, 648 aa, Paenibacillus pasadenensis
MLISLCMIVKNEELVIERCLDSLKEVVDEIIVIDTGSIDRTKQLALSYTDHVHDFVWVNDFSRARNEAIRRANGRWILFLDADEYFAPGDAAKLRSFLEQAEPSPTVVYAINVINFVGKSKEKSVLTSGEIPRLFPNGFGIQYERPIHEQLYSPHGELLSALAPVSIFHTGYLQEVVKEKDKLQRNAGLFKELKQQSGFSAYDYYTLGNEAAVAKNFVKAIYYYERSLKKQKNALNSSWYPHCVISLVHAYLQMERLTDAWALLEERLSLWKEYPEYMFFKAAIFHHLGFIEDAADSYKEAISTASAKSEQSHRFYLESAEYASTIPMRKLYSIYEWKKSWPDAIYYLTQLLVQDIHDYNALRSLLIILAREEKPVQIAAFLAKLYDPNHAKHQYILFRASLSNKQTELCRYFFEHLSDPLMLSSEDQLDYCFLIEDEEGYRNVIDRLNGVLPNERTAMLHLLASISWEFEIPWKLNQATDEDSLDKLSFLESMLNGRLAPEELAPEHGHLALAVLSLCYEYHRYECFDALIQRYAHDFVLSEIADFMFAQHQTGIALDYYSLMLDQGAALSAKNLEHLALYHLQKGFLAEGLAFLEAAIEKSPDSIYLYVQYLQASAKDEKYREIQQKLLRQMPAARKMPPFQKILA

SEQ ID NO: 1734 - protein, 363 aa, Bacillus sp.
MKALVTISLCMIVKNEEEVLARCLDTVKDIVDEINIVDTGSTDKTVEIAKRYTDRVFFFEWIGDFAAARNESFKHATKDYILYLDADDVLLEEDQKKLKELKETLDPSVDSVSMYYDAGTDEFGNVTLRYRRNRLVKREKNFKWKGDCHQYLEVFGNIINADISVTHKKIRHSVGRNLNIYQKKIDRGDTFTPRDYFYYGNELRENRHYEKAIESYNKNIEMNEGWIEDKVYACINKADCHRFLGDMDNELRSLFQSFEFSKTPRAETCSRIGYNFQRRREYKAAIYWYELATTLVPDSNKWSFTYPAYYTWYPHLQMCVCYYNLGDFEKSYHHNEEARKYRPEDKSVLHNKQLLEGKLGINN

SEQ ID NO: 1735 - protein, 362 aa, Cohnella abietis
MITISLCMIVKNEEEGLAKCLSSVKGIADEIVIVDTGSTDRTKEIAAQFTDRIFDFEWINDFSAARNYSFSKATKKYILWLDADDQIQEKDRLLFIKLKKKLTLDVDSVTMSYNLAFDESGNVTSSLRRNRLVRRDRSFQWIGPVHEYLAVWGNIQNSDVSITHGKNKAYTDRNLQIYLKREQAGEQFTPRDLYYFANELRDHAQYRKAILYYEMFLKGKQGWIEDNIQACTKMADCFGKLGDKEKYFESMCMTLSYDKPRAEVCYAIGIHFLEDNKYDIAIFWFTAAVDCGIDKNNMAMVNPAHSTWLPHLQLCLCYDRLGQLEKANEHNEKALAYHPTHPSMLYNQKYFQNMFKDRIKEG

SEQ ID NO: 1736 - protein, 431 aa, Unknown
  Description of Unknown: Chloroflexi bacterium HGW-Chloroflexi-5 sequence
MSLKNHLSTDLDLSDKDTQKKARDAYDKGDYVGAYNLYLSIYQNENNPRGLQLSIALCLLRMNKRRQARLFAFKELLDYPDNETATRLITEQSSIVVGKTIFRRFDNPVRPEKYPDISLVLIVKNEEKDLPRCLESFKDIVKEIVVVDTGSTDRTVEIAKSYGARVEFFEWTNDFAEARNVSLSYASCEWILRTDADEYIEEPEKAKLLHCVNSGVADIYLCPTVSKLKAGEQTVENVRLIRNHLGVVYHYPIHETVALSAAKLGLLQCLTNIEFLHSGYEFLEEGSSERKTERNISVCSQYLEKYPEDFYVRLVRGLLLLNTQRKADAISDLERGVKDIPDDASPVKYMGLAYIALCQQYVFEKRDIDLINILLDAQVDFNVYSCMMQFIGQVYCFNRGDWKRANKIFDWTLKRYTTKLTFSDVLFADKF

SEQ ID NO: 1737 - protein, 339 aa, Butyrivibrio sp.
MITVSLCMIVKNEEKNLKKCLESLKGIVDEMIVVDTGSTDKTVEIAKEFGAKVEYFKWVDDFSKARNYAFSLASCDYIYSADADEELDEENRLRFIQLKKDIEELDIDIVQMYYTNQLSFRTVYNFDRELRPKLFKRVRNFVWEDPIHEQVILDPVVVNSDIEIIHRPSENHGKRDLEAFRKTVKEGRRLSKRLHGMYARELFMAGDDEDFIKAKDFFAGAVLDTERSLDEIKEASCVLAHIAILEKDVAALLKYTLKDAITEMSAEMCYELGDYYFAVDDLDEAIVWYYNAAYECGSILDARRSGVMPRLALAKCYRKLGNEEQAADYEREAGEIEDA

SEQ ID NO: 1738 - protein, 466 aa, Unknown
  Description of Unknown: Candidatus Brocadia sp. sequence
MQNIRIPKISACMIVKNEEELLPNCLQSIKNAVDEIIVVDTGSTDNTITIAKNFGAKVYNHLWNDSFSEARNHCLHYASGDWILQIDADEELEQADIPKLQHAIKNPEYNAIIIAIHSIIKDNVHKFYNTRVFRRGKGFYKDIIHEQIITEGVRLPTEIRLYHHGYNLDEKKMQIKWQRTTRLLKKQIEQNKFDSFSWFNLVRNYRTQDLFYDGINAGEKALAIITPDPCLKPTGTSVNLHHYAMIMYETANCYLHNEDFAKAKELCHTALSRLEELGITPENIDIIFTLACIYLKEGCYRKAINYFNRFLSLREWYLENMHTNPLMIDTLGYDYAAYHGMGYCYGNLGQWETAISHLQKAISYNPKYLTAYKNLVSCYSNVNNRVEATETLLRTVSEGIADDDVILKLGELYIQQEAYEKATPYLEEYLKKHPEDRSALLKLAQSYEQLGHLGAALVGYRSALGK

SEQ ID NO: 1739 - protein, 490 aa, Unknown
  Description of Unknown: Paenibacillaceae bacterium JTherm sequence
MSERISLCMIVRNEADTIERCLRSAAPAVDELIVVDTGSTDDTVRIARRYGAVVFSAEWEDDFAAARNVGLERATGDWILVLDADEELAEDAPERLRACVRDRSCSGYYVTIYNYFHSFSEDAAVHSSIRLFRNDPRHRFEGAIHEQIAPSILRRDPRAVFGGSDIVVRHYGYVGDVVADRRKVERNMRILRRQLRKTPGDPFHLYNMGVEWARAGRPERAVRYFRAARSRATCDAPFVALAYKYEAFCWRKMGDVEKAVFSCLEGIKRFPSYTDLFHYAGLWEMEAGRWENAESFLTSAYRLGPPPAPFQTETGIGAHKTCFSLGILAECRRDDIGVLRWHLEAVRLDTSAEPPLCRLFRYMHCADREKQLAAALLKHFRPDQAGKQRVLNLLEACGCFRTARLLSRIWGIGRSKSVPRLRRDNPAGEEASRVLNDWHVSANRDTSSRRRWVRAASRMVDARLLDVRSPELRAIVRTVRLLLPWVDGFV

SEQ ID NO: 1740 - protein, 344 aa, Bacillus sp.
MTSQTISLCMIVKNEEDFIEQCLQSVQKLVNEIIIVDTGSSDQTINICKNYNASIFSYEWNDHFAEARNYGLSKASGNWILWLDADEKLEVQKSKLIQDAIQQTNALMIYMPIVNYYGQSLPIQEEDAFIYYQPRLFRNHVGIRFTNRIHETLQLPQSLESSHDIVSIDTEIYHYGYFKKITDQRNKSRRNLQVLFKEFQDSSHSPWIEYHLASEFYRLKEYQTAFNYINKSILGFLQQGYTPPALLYRLKYDILFETKSYEVASFSIDKALLLYPDYVDLHFLKGLFLFQIKNYPAAIASFDKCLELGEHHTDYLITRGAGSFKAEHYKQLCLKAMIVPESDL

SEQ ID NO: 1741 - protein, 257 aa, Campylobacter coli
MNLEKISVIIIVKNAQNTLFECLNSLKEFGEIILLNNESTDDTLKIAKEFQKDFTHLYIYESKFIGFGALKNLALSYAKNEWILNIDADEILENEAKEELKKLEFKEQNILALTRKNLYKGEWIKACGWWPDHVLRVFNKKHTKFNENLVHESLILHPNTQKVYLKNGLKHFACNGIESMIHKMNLYTSFSAKEKFKKDKKASIFGAIMRFCLTFTKDYFFRGGIKYGYKGFIIAFLNANGAFFRYMKLYELQNEKN

SEQ ID NO: 1742 - protein, 355 aa, Paenibacillus herberti
MIVKNEEKLLEQCLLSVRGVADEIIIADTGSTDRTKEIARKYTDHVLDFAWVDDFSAARNYAFSQASQDYIFWLDADDVLLEEDRNKLLALKAELAPTTDACSMFYHYSFDDYGKVNLKFRRNRLVKRSLQFKWYGAVHEYLDVSGNVIDTDIAVTHKRVHDAKGRNLAIYENKLRSGAELSPRDHYYFANELRDNGDLARAAQQYERFLEMEQGWVADKVTACDKLSDCYYRLGEHDKECKAALKALEYATPTAEICCRLGYHFLQKEQFSIAVFWYKLATDLEEPKEDWGFRNEQCWTWLPHVQLSVCYYRLGQERLAWEHNEQALRFRPQDQRMLGNKLFFEARFKKRGESV

SEQ ID NO: 1743 - protein, 364 aa, Brevibacillus laterosporus
MITISLCMIVKNEEDSLSRCLDSVKDLVDEINIIDTGSTDGTVELAKKYTDRIFHFEWIDDFSAARNFAFTKATQEYILHLDADDFLLEIDRERLRTLKETLDPAVDSVTMKYHTAFDEYDNPIVSFRRNRMVKRSNNFQWYGAVHEYLSVWGKIIDSDVAVTHKKIHQNEGYSTRNLRIYEKKLERGEEFTIRDLYYYANELRDHSFHEKAIEYYIKMLDSKQGWIEDEINACYKIADCYLALGNKEKELEYAIKAFTYDTPRAEACCRIGHIFFTRKEYLKAIFWYDLATKVKKPDTWGFFTEACWTWLPHIQLCVCYNRIGQNEKAYEHNEEVGKYRPKDPKYLFNKELLEGLMNKEDLGN

SEQ ID NO: 1744 - protein, 378 aa, Paenibacillus thiaminolyticus
MPKVSLCMIVKNEEENIERCLASVQPFVDEMIVVDTGSTDQTISICKAAGAKVYPFQWNNHFAEARNYSLDQASGEWILWMDGDEVLEVSAESCWKEKLAEETEHILNVHLVNYMGESPDPNETYHIAHPRLFRNGIGLRFLYHIHEALNVEEIFAGERALKKIKQHDGLTIHHYGYLQSHTIAKQKSERNLHMLLHELTLDNNNPWTEYHLASEYYRLEKYKQAYEFVNLSIARFLRKDKLPPSLLYKLKYSCLISLGSIDGIPAAIDKAIIMYPDYVDLYFYKGVALYLSNLHSLALDVFEQCLLLGEDNIQHLTLKGAGSFHAWYYKGLCLEKLGKFEAAVEAYKEALRLYPNYFHAAEALTRLEKSGQHSGTKE

SEQ ID NO: 1745 - protein, 355 aa, Unknown
  Description of Unknown: Chryseobacterium sp. 52 sequence
MKISLCLIVKNEEKVLRRCLESVTKFADEIIIVDTGSTDRTKEIAKQFTDKVFDFEWINDFSAARNFAFSKAVMDYQMWLDADDVVPEKSVTEIIELKKTLKDHVEMVTMKYALSFDQNNNPTFHSTRERLFKRSKNYQWIDPVHECIPLIGNLHYTDIEIWHKKTKPEELSTRNIDIYRALEKKGEAFSARQWYYYARELKDHNETAKAIACYEKFLNLGSGWVEDIITSCHQLAIEYKKMGTKEKILPILFKSFEYDVPRPDICCELGYYYKDEQNYNQAFKWFDLATRLPKSNPVGFVFSDYSGYVPNIEACVCLSLLGEYKKANEYNEKASLSRPDCPSVKQNREYLRDLM

SEQ ID NO: 1746 - protein, 751 aa, Acidibacillus ferrooxidans
MLLTACLIIKNEELLLDRCLRSLKGIADEIIIADTGSTDRSLEIAKNHEAHIIHYTWDGNFSNARNKAIEAAQGTYILTIDADEYFKEEDQIEIRTFLEANSADGYLVQIVNYLGSVNKLTKTSPIQSVRIFKQKHRYTGSIHEQIDLGTNHEFHNIMFSPITIHHVGYISEFVAHKRKPERNMAMLKEQLDQTRSDPFHLVNMIVEYARIGDFKNVLPLYEETYDLVKDLSADALPLYLPRLFNISSLAASELKDWDRAIMIAEQGVTRFPYIAELYRKMAIAYMGKGNYQKAIQVLKECKRVGEPKLSFVDTLEGMSTFYSSFDMGLCYMHLGDPVTAQKWYLQSFLENPSFDTVIPYLLSLMPANEDFLKTNIESRIQDALCLSIYAESYALFRLPGAENVIERIAARVGKTEWIQRGMWFTDCEDKYTLLRSAYANSDDEMTRVINGIIHVMEGREEVGYSLLDHTNRGRNLAAWIRTPSQGGLLSGVIKDLIAARAYPLIALLFPYAEDADHFYGWFRHTSRKDIFKGCRPLQEHSLWLEWDALSSFQKGHFPLVEALIEKSLETPVTISKIALECDLLLQKNQTKKALKHVEDGLTLFPDSQLLQNISKQLGQMIQTKKGELFMNRIASYQTQSVMTTPLHVQLSQLHEKAAILVRGIHTDALNHQVMEARAKIEQLQEIISFLRSSLDLTLEAAQKTDQTYAYFYRLSINWYMQPNIIDEQSEERASAIEFWESWAKTWAQVKE

SEQ ID NO: 1747 - protein, 656 aa, Unknown
  Description of Unknown: Firmicutes bacterium HGW- Firmicutes-15 sequence
MLLQVTLSICLIIKNEGKYLSRCLYSIKDIASEIIVVDTGSTDNSMLIACEYTDQIYSYKWKDDFSSARNFCLDKAEGDWILVLDGDEEVDRKCLDLLKEIIQVQDIDVYFVTINNNPDNTQEIMAISDLKPRLFRNNKQYRYKGIIYEQIMDSILGSNARIEIARDIRIMHYGYVKEDSGNRHRLMRNTDLISKAWCREEAVKHFYLGREYYLHHKFADALVHFLVVYDQADLQADYFPELLRSISVSLYMLDRNADALTFIDNAITFFADMGDLYYIKAVIYKNSYEYAKAYEAYKICLTLPDQSLNYYSVYCLHQDKIYFYLGGLAEYFMDKDQALHFFLESLKQNPYMLDSLRRIIAILNPRVNPEYTTLSLNRVFDLSDQALQIDMALMFYEEGAYQLALNNINKLENSAPISEYIRAIKGACLLRNKQYTEAEEELQNISSNKNLYISARKYLLVYYWLVQDCRKAAGCLKRIKNAGAEPAINYVLNLLISGYSGKTNTGQDQAYNLAKQIMEMVVEFDDIDRVDEAFQNLAPILGERPSRLLAEIFYKYEKYELAEKEFNYLLEKDNTDAQAFYYLGKTFWVRGDLHGAENYLCQAINKGLETPKIRWEVARLYQELAIESLREGLKDCPDSEEMQKLLQELKDKMLEV

SEQ ID NO: 1748 - protein, 638 aa, Brevibacillus panacihumi
MDKKIKLSICMIVKDEEKNLERCLSSLQLLNQRHDVELIIVDTGSTDKTIEIAQAYTENVFYHEWNGNFSDMRNISISYAKGEWLFIIDADEELQDPEKLSLLMDKKSLSDFNTVVIRVKNFVSSDQNIFIINKSERLFRNDGFCYQGSVHNQPRFKMPILFVTDIFLKHYGYNSEDKELMEKKFQRTSKLLLEELKKNPENIYYHFQLSRTYSMHGDYKEAYKEAKQAYELLSGNEINKKIQYLYVYHEYVRMSILLGRYEEAKKACTEGLEINPNYIDLQYYMGVIYEECGDKQSAFEARLIYLKLHKKFTEDRFDDKGLIELYKLDDNSKYEILFKVAHFYYDNKNFTKAEEFLKPVIDNEPKILLYTKILLDGKQFTGLREYYDSLTEGDKDKLVNLLEVHRKELDEQEKYELARAFIEGEGCYHQLNKIRTTPDEKVLFEAKSFLAEHDINNLPLFYAEVFSRIMEYPIFWQELKKLKSAIVRKVIKELVLLNHNHKVSLETLVSKMKIRHDDYQGNRIFICIIYVLLVMDLEKHGKENIEMEPELLRLFDKYLEYGIQYIKCFYQMDKFRLIYTTVENSEEQFFMLMYLYNQAMTSRNFKVALNYMREIVSVYPVMSPFLKNTANNLNGDII

SEQ ID NO: 1749 - protein, 335 aa, Lysinibacillus endophyticus
MIVKNEEDLIEQCLQSVQKLVNEIIIVDTGSTDQTINICKKYNASVFSYEWNDHFADARNYGLSKANGDWILWLDADEKLEDKKTKLIQEAIQQTNELMIFMPIVNYYGDSLPIQEEDAFIYYQPRLFRNHAGIQFTNRIHETPQLPQPLEPSNDIVSIDTEIYHYGYIKKITDQRNKSQRNLQALFKEYQDSSHSPWIEYHLASEFYRLKEYQTAFNYLNKSILGFLRQGYTPPALLYRLKYDILFETGSFEVASSSIEKALLLYPDYVDLHFLKGLFLFQIKNYPAAIASFDKCLELGEHHKDYLITKGAGSFKAKHYKQLCYIAMKVPESDL

SEQ ID NO: 1750 - protein, 282 aa, Ruminiclostridium cellobioparum
MVYLSLCMIVKNEEKVLRRCLDSVKDIVDEIVIADTGSIDNTIKIASEYTDRIYNFEWTDSFSDARNFVQSKAKGKWILVLDADEYVDKTNLEAVKREIKQYDNDMDALGVTIYNFTGTGDQMVQNKNLRIYKNSREIRYERAIHEALVRVNGHLKTVMCALNIYHTGYLAEVAKSKDKRSRNTRLLEKQTQKSGNSSYDQFNLGNEFFSAKDMKKALESYQKSYASDKNSSWASFAVVQIIICLIELARYKEAISVIEDADKIWQDVPEFKYLRGQVYYLQ

SEQ ID NO: 1751 - protein, 305 aa, Paeniclostridium sordellii
MLLSIVMMVKNEERYLDKTLESLKPLMKEIDSELIILDTGSDDSTVEIAKKHTDKVFFANWSNDFGQMRNISISHASGEWILILDADEQLTNYDKLKEFFNSNLCKKYNSATITLKNIFSEDEDRYSIDPLLRLFKNYDGFRYEGAIHEQPIFKSPTYNDIARFNHYGYLFEDEEVRQLKESRNKAILLKEIEKNPNNPYINYQLGKQYIISKNYEDALFYIEKGYEIYEKNKYIPLFVTLDLANLYVDLSEFDKCENLCIKYIKKDDRNIDIYYYLATSQKQLNKNKKSIESYKRYLYLTENFI

SEQ ID NO: 1752 - protein, 364 aa, Christensenella sp.
MITISLCMIVRDEQAVIGRCLESVQDIVDEIIILDTGSKDRTKQIVKAYTPHCYDFTWIDDFAAARNASFDKATMTHIMWLDADDVLEQRDREGLRRLKQTLSPDIDVVMAPYNVSFDQNGHPTFTYYRERILKRAQHFQWVGAIHEVIAPQGNIVYSDDFSVNHKKLQQNDPDRNLRIFERMRTNGQPLDARQTFYYARELYYHARYEEAIKQFINFLEDTQGWVENKITACQDLARCYACIQDQEKALDALLRSLVYDVPRAEVCCDIGQYFMHRQAYKQAIFWYTLATSCTKGNVGFIQPDCYDYIPWMQLCVCYDRMGDAARASAYNEKAGTVKPDDTAVAYNRAYFQKKLLTQEEKRVE

SEQ ID NO: 1753 - protein, 454 aa, Unknown
  Description of Unknown: Verrucomicrobia bacterium sequence
MLALSIAMIVKNEEKNLPRCLTSVQGLFEELVVVDTGSTDRTVEIARQFGAKVVPFKWQDNFAAARNAGIAHCTGDWILAIDADEAIDPVDHTAVRSLLTEGGPQAFRIRVRNYLLNASQTILNTVPVRNTSAYALGREFTHYVDYVTNARIFRRFPDVCFSGRIHEVVDPYFEARGLPVGMTTAVLHHFGKVDAPRETYKREFYLRLCEEEARNAPQNYRALFNLMIQSRTAERWEACLAAAENFMRLQKTVPVMVFVTAGICHLQLGNPNTALEWLERALAIEPEDVGALTEKGSALMEMGKFEDACVCLERAAELRPGYTLPYLKLFEIKTSLDLKDAARATLLKAIRANPTEEVLYNKLLQLSPDINHLPTAGADAALALASLPSGGNGLWHRFVAMSQLQAHKHEEARSTVEIGLQAFPDDAGLSRLKRLCDTAVTPPPVISLPGQARF

SEQ ID NO: 1754 - protein, 358 aa, Clostridium amazonitimonense
MITISLCMIVKDEEDVIDRCLDCVKDIVDEIIIVDTGSTDNTKEIIKEYTDKVFDFQWIDDFSAARNYAFSKATKDYILWLDADDVIFEKDRERFKELKQNLDNKIDAVMMKYNVGFDEDGNVTLSYFRERLSKRIKNYQWMEPVHEYLKVDGNIINSDICITHKKERIPIKGRNLSIYQKTISKGEDLSPRGIYYYARELYYNGNYDEAIKYFEEFLNTGKGWIEDNINACYILSTCYNNKNDQKKMLEILLKSFEYDTPRAEICCQLGAYYFNNKDYKRAIFWYKLVLDLEKPIDGWGFISHDYWGYIPCIQLCVCYDKLGNTEEAIKYNNKAEEYKPKDPSVAYNKNYFKSISER

SEQ ID NO: 1755 - protein, 387 aa, Labrys okinawensis
MSHRRLCFIQDVGLVMMHGRVTISAAMIVKNEARFLPGCLDSLAGRVDEIVVVDTGSTDGTIEIAEQAGVHLLHQAWRGDFAGPRNFGLDHVRTGWVLYIDADERLGLPRGGRLADYIDPVAVAGFVRFRPKTNFTRYREWRLFRADRRIRFAGMIHETAVPAIKAVGRLEGWPVVQTDVEIDHLGYDGDISHKHPRNLALLEQALPGDPDRLFYWHHLAETYAGLGRWEEAEKAARQGLERTEGQDDDNRSATASLLHQFLVRSELRQGRDPTGLIASALAREPDDYALHFLKGHALLAIGQAEEALEVAQLLRGIDPDRLPDGWLAFDRALFADKACELAALACLDLGRHTEAGGYFAEASRLAPGVLAYRVKAAAFGGIVPVDQ

SEQ ID NO: 1756 - protein, 550 aa, Paenibacillus sp.
MTTKPQQLLISLCMIVKNEADNLARCLRSVRGTVDEIIIVDTGSTDATRQIARSFGARIINYPWNGDFAAARNAGLALAQGTWILVLDADEELEPGSREELLVCAKHTEYEAFFVRIHNHQGTERASQTLTVNPILRMFKNRPNYRFSGIIHEQIAAVIVQETPDAAMHMGTVIVHHYGYADGVVERKDKISRNLGLLKQQLEESPGDAFQHFNLAVEYMRLGDYGQALEHIGTSLNLAKPGTSYVHLLYKYKVRCLAVTGDYPGALEACGQGSTLFPDYSDLHHLKGALLLQVSALAEAKTALCRALEIGASPPLYHTESGLGTYLTHTLLGQVCQQIGEAHEAAACFTRAAQLQPDPWPLIPRLTRLFKCTGREPELHGWLAGQLPGILTEQRQDLLRLLVTDGCYTAAADMLGGGIAGAGEMDGTAQSAGVMEAAVRDAGEIDGKAQSAGVMEAAVRDAGEIDGKAQSAGVMDAAELSYDDITELLSHPAVVPADRNTSLPIPAIAAAVQPWILLADKVLAALVTSAMYSPAAAAARLTLPLPRSAD

SEQ ID NO: 1757 - protein, 569 aa, Paenibacillus taihuensis
MSSKHKKKASGGLISLCMIVKDEAASLPRCLQSVQGIVDQIVVVDTGSSDNSVAIAKRYGAEVVHARWTNDFAAARNTGLARAAGEWVLFLDADEELDAGTGGQLRMLARERAITGYFLNIWNYMGDSGSDGATINPVLRMFRNDRRYRFEGRIHEQIAGPITRHTPDARFHLSDVIIHHYGYKREVVIAKNKLERNRELLERAVVEEPENRFHWYNLGVEYFRGRALEDALRAFRQARDGIDYASISYAHLLVKHEVQCLQALRRWQDSLALAEEGLAWYADYPDLWHAKGIGLAALGKRRKAAEAFAAAIHIGKAPAIYHTEDGMGSYQSAYWLGSMHEAELDFETAAHWYAEAVRFRSSLLAPLYRLCHMMRIGGDEERLAEFVEQRFTLDSPQASLKLADVMRRSGCYKALRIWLTRRLADAEATERAMLQPWLSVAEDCEALACGSSDDDGGLSTGAAGSLGQALAWLGMAEQSPFPDVALEWLPLLIRSGIAEGPVRDVAGALLDLRPDGEGPSSGAAGVRYAAHALCALADGHLAEVQKTADYTRAAQEMRLLLPAQGEGDR

SEQ ID NO: 1758 - protein, 367 aa, Paenibacillus ginsengarvi
MITISLCMIVKNEAEVLARCLDSVRGIADEIVIVDTGSTDETKNIAAAYTDRIYDFEWIDDFAAARNFAFSKANELFIMWLDADDVLEETDREKLKRLKETLDPDTDSVMMHYHLGFNAKGEVTSSLRRNRLVRRERGFRWVGPVHELLEVSGKTVYSDIAVTHKKERKHTDRNLRIYRKRAERGESFNPRDLYYFANEWKDNGYYAEAVDYYERFLATKLGWSEDNYAACLKLADCYVRLNDRRMQGRSLLRSFGYGRMRAESCCRMGAYFMEKGRLEQAVFWYKAATRLGSPDGITSAVEHEAWTWLPHLQLCVCYDRLGQLSAAQEHNEIASSYVPDHPSVLRNRAYFDGLAKRDIVMGKGEST

SEQ ID NO: 1759 - protein, 376 aa, Clostridium clostridioforme
MRISLVMIVKNEERSLEKCLRSAASLVDEMIIADTGSTDGTKAIAERMGARVWDYKWTNDFSAARNYALSHSSGDWNLILDADEILRPFQRDELEQAMGRYVKHHGASWMGAITRYDVYPDGEGTSVSVSSIPRLLPAGMRYTGIIHEQPDTEYPCYKLPLEADHDGYLRGDKGERNLSYLEEAVKRCPEDLYFKFQLAATLRNMKRLGDSLYWFRDFYAGYIRQRKEGRNNGKEAGMYLTEGVLLYLYTLLDIGNSACLEEAYAVVKNESHILGERADFWFVCGLFYMKLVLSDVAKYVHLLPEIEASYLRCLSIGERRNQDRVIGTGSFKAAYNLGTWYEVSGQKDKAAYYYMEAAKEGYEPAEKRLELMGKCR

SEQ ID NO: 1760 - protein, 355 aa, Unknown
  Description of Unknown: Lachnospiraceae bacterium MD335 sequence
MPTISLCMIVKNEEIHIARCLDSVAELVDEIIIVDTGSTDSTVEIVSDYTSNIYLYTWKDDFSDARNYSFSKASMDYCMWMDADDILEEEEKEKFLLLKQSLSLDTDIVMMKYNTSFDESGRPSFSYFRERWIRNCPQYRWVGAVHEVIVPNGKILYSDIAICHRKMGVGDPDRNLKIYQKMIADGIFLEPRHQYYYGRELYYHKQYEEAVSVLEPFLRSADGWVENKIEACSICANCYLQLGKEQDALITLLRSMSFDLPRAELCCEIGKYFLEHGNFHNAIYWYEIALNTPKSEYSSGFILPDCYDYIPLLQLCVCYDRLGDQQKAKEYNEKAGAYKPYSQAYLYNKQYFDSL

SEQ ID NO: 1761 - protein, 804 aa, Desulfohalotomaculum alkaliphilum
MKKLSISLCMIVKNEEFSIIRCLNSIKNIADEIIIVDTGSVDNTIEIAKDFGAKVIEHPWQNNFSDARNVSLEHAHGDWILFLDADEEVMAEDLHRFEILESTDRDGFFLVILNLDEKGGHTRQQSLRLFKNQCEYRFQGAIHEQIMQSIINHNPSARFGSLNIRIKHYGYLNEQVSRHNKVYRNISMLQHELIKEKNNGFLYFSLGNEYMRMGDYAKALQYYNMAENFTAAEVSYAPLLGKKKSQALINRKLYQEALGVLKNYLKIYPDYTDLLFLKAGVYYKTGQHQQSLSLFKRCLLLGEAPACYVSESGVGTYKAEQAIRKVSASMNKSGISLCMIVFNEENNLPRCLNSAKDVVDEIIIVDTGSTDSTVQIANNFGAKVYHFDWSGDFAEARNYSLKFATCPWVLVLDADEMLRPCEHQRLREAVGVTGTTMGYYLKIINYFGRGDAEQYVVDAVCRLFRNSKEFSFSGRIHEEISQSIISRHGLKSISPLDVHIDHRGYIEQPGLNNKNQRNIGILKKQLKQDPEDAYALYALGTEYFQQGDYNNALVQYYKALRLIDGKDVMSDLFFKIAVCHLELKEYQKGLQIIEQGQQLFAHFTPLWYLQGLIEYKQNQLTQACRTWEKTLSMGDPPWHRYTFPHGIGGFITAAALGGCYEKMGLLDKAESLLEKYLIKGKGVRAVTPIYCRILLKKYQANECLAKLERLNYPRCFKESIILARVFSQLDNVELEHIYFRKSLDLLRNQPNQGDYLQLIALKLKSIDKYCGYGMKLGDQSPLLSRLKSKLISLRKEDNKNICPK

SEQ ID NO: 1762 - protein, 704 aa, Paenibacillus riograndensis
MKKPTLGVHLIIRNEAALLPQCLDSLHGAADEIVIVDTGSTDNSAAIAASYGAKVYHRNWNYDFSAARNTGLSYAETDWILVLDADEILKTPVGAITEMLRNTEAMAFTVNIENWLGSLPEDRLTHNAIRLFRNGAGYSFQGIIHEGLDASIIGKHGASVIRSSGIEIIHLGYLPGIMAQKDKISRNEHLLRRALANDPGNDFYSYNLAVTCCQNGQLEEAAELLTRTISRAPFQASYRPSMIRDLAKIQLSLNHTQAVNALLARELPRYSDYPDLHFIQGQSWESQGLTERAFQSYQRAAAGSEKPAAPVNASSTGAPQEAAAVALSGKYVSEKGMNSFRPLARMGEISLQLGHCEEAARWFHRALQHHVLYAPALQGIAAAFQRLDVPDQDIATLLIQLVGTREAAGRSAVIHALDAVCAYEAIAGLPQADFPLEQETLPARASAWIITGRLAEAGTALREALSQLRDTATMDGDMDTIHRLWRIAAICRWQDNSPQAEPLEFADAPEPLRSALLLVDEQLTQHNTAPALPGEAGNLSQVIAELIRQAVKLRCCGLAAELAGLFPEHRADWAEALYESGQLKEAGELLIALAADQQVRGKVSFYLAELLFDKGHYREAAEWFQLMLDGTPGHEPSRIGLALSYLHLARLELEGAAAGFPDIYANGPLQEDMKAAEQAIAVLNRTAWHTQRNPHRTLQKGATP

SEQ ID NO: 1763 - protein, 655 aa, Bacillus acidiproducens
MRPFISLCMIVKNEEKVLNRCLDSVKDSVDEIVIVDTGSTDRTKEIAAAYTSKVYDFEWTDSFADARNFAQSKALGQWIFVLDADEYVEPENLKQAVRDLKESTSEIDAVEIKLFNFTGIHGESIIQHHSIRLYKNDPFIGYKRTIHEQLVKTKGQLKTKGSSLIIYHSGYIASVVKEKDKNKRNKKLLEKELGISRNKAFDYFNLGNEYLSTKEVEKALKSYIKAYQGKADIRYSWVSFCLVQIINCLIQLNRYQDALNVIQDSMTIYSQSPDLKFFKGYVFAQQKRFDDAIEELEDLLSNKEQYSYFLTSIDYLEYRPHQLLGTLYEKKGNKEKAITHFAQALNINHHCDRSFVGLLEILIQHESDHALSLFLDQHEFMTDSNHLNKLIAVLVANSKFELAEKYINLIENNELLKAGFKMKSEFVQGNDLLINKFIESNTFENLNQLIVYGCFDIYDLILFCIRNNDKKIAQLLYMLIQEPEKKHLMDVFFSNNKPKTINHDEYLTLIKKTLKYKMFDLFAVLAEKADLYPSIYLPTGHLLYQFGFKKEAMNIYENLETVQYENETFVDIISYYKEHGDYLRVAQWIIQALTEDRMDFRIFESALQADYHYEGLIDWDIHQIWEISCQYYPNSSCLTKRNHMVEEKRYIQAHI

SEQ ID NO: 1764 - protein, 345 aa, Bacillus psychrosaccharolyticus
MIVKNEAKMIDRCLNSVNGIVNEIIIVDTGSTDSTKEIGENHGARIYPYQWSNNFSEARNYGLSYATGDWILWLDADEELDETDKNNLPKILGDTKANILALPVLNYHGLTEPVDKNHLFLIYQPRLFRNHLSIKFINRIHENVHLPENIDQFIENISVSIHHYGYLKQITDEKHKGRRNLRLLEIELSEPSHSPWIEYHIASEYYRNNQYEKAFMYVNQAIVAFIQKGLMPPSLLYKLKYAILIETNSLDGAWPSIEKAILLYPDYVDLHFYKGYILYEKKEYVESLESFEKCLELGENNTKYLILKGVGTFKAWHYKGLCLEHLGRTAEAQAAFECEENSLLY

SEQ ID NO: 1765 - protein, 633 aa, Tumebacillus algifaecis
MTCTRVLIVSPVRQTPEILQEHLRSLERLDSTGLELEYLFWDDNSVEESSVLLCNFSQRYPDRTCLICALRPSQQSTAHSWSDQNVWHVAQMKDIALQKAVEGRYDAVFLIDSDLVLHPNTLQQLLSTEKEIVANLFWTRWQDDGPALPQVWLSDSYTLYEQNVGEQLSEQERTQRINRFLQQLRKPGLYQVGGLGACTLIRRSALLAGVKFEKIGNLSLWGEDRHFCVRAAALGIPLFVDTHYPAYHIYRPSDLAGGQAFNRGEGEQAGITISLCMIVKNEEETLSRCLACVQDLVDEIIVVDTGSTDNTRGDAELYDARWYEYEWQDDFASARNFAFSKATKEYILWLDADDVIEEPDRMRFRELKKNLTSEVHYVSMPYQLAFDGAGRPTFSVRRNRLVRRDRNFRWIGVVHEYLEVGGVGQSSDVAVKHRKARSSSDRNLNIYRRLEQQGVEMTARELYYFGNELRDHGHHAEAIEKYQAFLATGNGWIEDNISACLSSADCYSALGDREKQLRMLLRSLEYDMPRAECCCRLGSYYLSEQQYEKAIFWYKSATQVSSPTEQVGFVDLSCWTWLPHLQLCVCYDRLGQLEIAHFHNEQAYLYNNSHPSILQNRKYLQARLEERKTGSEV

SEQ ID NO: 1766 - protein, 403 aa, Lentzea albidocapillata
MREKTMSPGPNPWIRRVLPPLADLSFTGQETSARASVVVLARDEERCIARCLDSVVNSGFDDVLVVDTGSVDGTLGIVATYADRGVRLLQVPWGDSFAEARNVAVDAIGDGWVVFVDADEWVESAEELRDCLDSLTGAGGLPRLVFAPRIFDVDRETYDDSIPRIFLADGGVRFKGAIHEYPVVAGEVDEPIGLVELDVVFLHDGYRPDVVDAKGKRQRNMELLRSALKSDPANPRWFYFMVRDALPVLGGDQIVGLCDALRDLVGRDTGSGDLLGAAEYWKLALAFSCQGLVALGDWDSVHRFCRDLEQVDAHYFSTMAELVGGVVTKRDLLRAVEIRKNDDLMARSAIDRAGRHTDALICALLGRLRGEGEADRYRELCDPWDDVFFEKSVPRRASGVSPA

SEQ ID NO: 1767 - protein, 355 aa, Unknown
  Description of Unknown: Chryseobacterium jejuense sequence
MKISLCLIVKNEEKFLSRCLESAVKFADEIIVVDTGSMDKTKEIAEKFTDKIFDFEWINDFSAARNFAFSKATMDYQMWLDADDVIPEKSINEINELKKKLSDDVEIVTMKYGLSFDENNNPTFHSTRERLFKKSKNYQWIEPVHECIPLVGNIYYTDIEIWHKKEVSEVVSTRNIEIYRALEESGKEFSARQLYYYARELKDHHETVKAITFFEKFLASGSGWIEDVIACCQELAIEYKKNGTEEKILPTLLKSFEYDIPRPEICCELGYYYKDKQDYNQALKWFDLATRLPQFHSVGFVSSDYTGYIPNIEACVCLSFLGEYKKANEYNEIAALSRPNCPSVRQNRDYLRELI

SEQ ID NO: 1768 - protein, 657 aa, Desulfotomaculum sp.
MDSRVSLCMIVKNEAQNIKRCLDSAAGAVDEIIVIDTGSTDNTGQIAAEYGALVQSFLWNENFSDARNASLDLATGNWVLFLDADEELTQSSREALRRVIDDNAVEGYFVKIINYLGNDGWSESCPDLVFRLFRNRRDYRFRGAIHEQIAGVILEKNNQASYRIAEEIEIIHYGYLDKQIGEKDKKNRNINIIQKELLQDPENRLLRYHYGVELFRAEKYEEAAVELIQAANGIDPNTIYLPKLFRYIVMSCQSAKQPEKALDTALLGLRFFPDYADLYYYAGLLFLELKQYNKAREFFQNAVSMPAQPSLYASFGGVRGFRSYYHLGQIAETFLDYEDALKNYISSLRDNPNFTPALESMVKILKPRENPEYTKESLEKVFEFCTPEANQIMGGIYFRHGAYQLALEYFESAAANGASSPEIQLCKAICLIQERRRLEALRTINKFSRESHLYPLAKINELLCFWLQDKKKKVRSLFAELQALGLVADTEKVLSLFLAIPGKQKKHCAVTLGQDGMSLLLDVITRLLDMEEINKVEQLLSEISAENLAEYSLAIARRLYDFGYKEMAEALLREHISGNQNAEPHFLLAEICQEAGKNIEAEQYYRRALELDPDVPQYYIRLLNLYESSRKRILQEAMAKYPGADIFKKLSGEAPAD

SEQ ID NO: 1769 - protein, 361 aa, Paenibacillus ihuae
MIEISLCMIVRNEENSLSRCLASVKAIADEIIIVDTGSTDETKAIAASFGAVIYDFTWIDDFSAARNFAFSKATREYIFWLDADDYLKEEDQQRFMELKRCLPEGIDTVNMQYNLAFDKAGNVTASLRRNRLVRRSCNFKWIGPVHEYLEVYGPSLTSDVCIFHEKDKAFTDRNLRIYQKRAAEGEHFSPRDQFYYANELRDHGLYGEAGDYYEQFLSGGKGWIEDNYQACLRLSECRERLGDKEAAFAALCRTLQYDRPRPEFCCLLGAWHLEKGQLLTAVYWYELAAGLPPDKAPMGVRNEAYSTWLPILQLALCYDRLGQHEKANLYNETALRYHPSHPSMLFNRNYFQNLLGERYTT

SEQ ID NO: 1770 - protein, 359 aa, Sporosarcina koreensis
MFSDHQEISLCMIVRDEEKVLERCLRSVSEFMDEIIIVDTGSVDGTREIAEKYADKVLDFAWVDDFAAARNYSFANATKDYIMWLDADDVLQELDRHGFRELKEQLDGKVNRVSMPYHLGVDSNGNVTHSLRRNRIVRREAGFRWVGKVHEYLEVFGDVIESDVAITHQKEKAHTPRNLEIYLRMHENQEPFSLRDTLYFANELMDNDRKEEAIIYFEKFLSLEGGWLEDNITACLHLSHCYKNSDDRKSLRYLFKTFEYDKPRAEACSEIGRYFIGHGEMGLAVFWLEMIFTLDRPHSMGIANEAVWTWMPHIDLCYCYDQLGQFEKAYEYHMKALSLVPDHPSVLFNEKYFEHRFNQ

SEQ ID NO: 1771 - protein, 253 aa, Escherichia coli
MDDYLVSIIMPSYNAEHTISASISSVLKQTYANWELLVCDDDSSDNTRFKVLEFSDSRIKLLTNEYAKGAAGARNTALKYASGRFIAFLDSDDIWIANKLEMQISMMLKNNISFMYGNYEIINNNSIVGKFVAPQKITYNKLLKNCGIGCLTVVLDRTLLNPFSFPFVHKEDYYLWLSILKDNNISAINCGFICSKYRLSQSSISSNKFKELKRQWDVLGDFVENPLARIYYLLNYIVIGIKKHAFDYKNGKK

SEQ ID NO: 1772 - protein, 479 aa, Acidibacillus sulfuroxidans
MVTHDEVRQNLILHRYDEARNGALELVSINPLDAQGWVFLGEACLRSGNGTVARRCFDRAWLLDPEAKWVSAMQKACEDAPSGTVTDHEVEKVLAYPSKTVSALILFKNNKRTLSACLAALQRAVDEIIAVDTGSSDGSREIAEMYGAKVYDFPWIGDFSAARNFGLKYVSSDWVIAIDSDEILELGDQDNIRITAGLFHELQVPAIVRIVQMNKLGRIIVPALSQSRMFPMNKGLHWDGKIHEVITFQEFVRDRRVVRPAVRIRVFHDGYDPESVDIQSKYDRNITLLLQQLQQEPDNPSLHFFIGRESLFLKRYDVAIKHLEEAERLGQKITGYGMVPDIMRRLVQAYAESGNVKKAEQKAEEMISLFPTYPDGLFLRAEIRIRKIDQEIQKAYSEMLSAQKAANSYRGITETDSTIGTWKSEVYLADIARWLGRWDEARARYVSAISIAPELMEIRKRIDEMDRQIHLLSEATTQN

SEQ ID NO: 1773 - protein, 697 aa, Paenibacillus sp.
MCSSFSSRVHLQGGYDMPTPTLGILLIVKNEADLLPRCLESVSAADELIVVDTGSTDHSAEIAASCGAKILHHAWAEDFSKARNAGLELASTDWVLVLDADEILVTPVAEIKDILAATPLLACTVRIENHFGPNREDRIIHTAVRLFRTGYGFRYSGRIHESVEPSIIGSHGIGAIGFSAVHLVHTGYLPERMEHTQKLARNERLLRLALAENPDDPFTRYNLAVHCCQTGHLEDAEQLLTDTLARAPMQASYRPTMVRDLGKIELATGKIPQLRNLLADELPRYPDYPDLHVMEGQALESQGLLERAFESYGRAADCGSSNNPGEKYALELGMATFRPLHRMGVLARRLGRHEEAARLFHRSLLGHPLYVPALTGIADVFIHLHAADTAIAGLLTSLVGTDSAAGWASMLEALDSIGAYEAISALPQPPMDLEPQAWARIIAARIGTNKYAEADGMLGKMLTSRTADFANHAHRLVWLELYALSRWDRGLAMEPVPAGELPGLEKTFLHIEQTLLHGPTLPEDHHSGSPPAEFVAGLIRRSVKLRRYTLAAALADRFPGHLAGLAEALYEAGRRAEAGELIITLAREDQLSCRLCHYLGEMLLDKGHYAEAAGWFQRASRDRPEAEGDASRMALAFCYLQQAEQDLREAVQRLGNDGGGSALTEEIESTRQAILLLNRIPWHTEWSSCQRREGSTP

SEQ ID NO: 1774 - protein, 790 aa, Unknown
  Description of Unknown: Desulfobacteraceae bacterium sequence
MLSLVRALGDEFIVVCQEFFSRDIKPPMPVIFIPAEADLAAAAGKAVKKATGDWILMLTSNENISSSDCEAVKRLSRNHAVEAYYLIAQNKLEPGALGKYERIANKGKYSNRKVQIAGYIPAMEIRFFQKSVFKKIFSVCDDSIHINLIDNHRGIAHSGIRLITQKDAEAYTGGAREEENHRKDFMRFTHQDEEIPGGNNASEMNIFGTVGFSLISEKDLPSLEAGLEMGFGSINLFNWAVHQLIKKGRYNLAVSLAEKVISRFPGNYEIWHLRGIAFFYTLNLVDAEKSMKKALEQNGKDKTTLSDLARVLIASGRLNEAIVVLEKVRDIHGLTPENEYILKAIKNKSGKTAGISLLMLCRDEEEYLERALKSVKDLVDEIIAVDTGSTDKSLEILEKNGAKIIRHPWNDDFSEARNAGLDHVTHDYVFWMDADEFLEDKTRLSFYVFKHLLPINEKQAVIFDVKCFFGSLEATNLGIPPTDIIKRTSIFPNLKTVRFQGNIFETVEQSLAAAKIPVIFAENIFIKHHNDNNEFRNRRKISAMFKSGTASHRPEDFFRNTIFWLDAGNVLEAADWFEGAVIKADGDRKYLDIICRLFSSFALNGKICPDSRIFRELLSRYGNSYRIASLCADCLYRFKEYSQAAELLKKLASPEYQPPHNARDHDLMRNNWLMLSMASLELDDYETSDSMLDLLSMDNKTADTARAVSFYKAIRVKDLDAAIAVLDKWIRERNIPIRSTIDDFAGFIRLIGDIAEVAAKYGQTDAGKVLLRSAEYFTSTITPMAQITPA

SEQ ID NO: 1775 - protein, 342 aa, Unknown
  Description of Unknown: bacterium D16-50 sequence
MITVSLCMIVKNEEKVLERCLDSIADLVDEIIIVDTGSWDRTKEIAARYTEHVLDFRWTEDFSAARNYVFSMATMEYIYSADADEVLSEENRERFRLLKETLLPEIEIVQMKYSNQLRFGTVYNFDEEYRPKLFKRKRDFVWEDPVHETVRLMPVIYDSDIVIEHMPQESHGKRDLACFYKHCRQGLRLSKRLHELYARELMLVGDEEDFRQAREFFTASAGDAYRDGEELAQACCVVARAARLAGDTVAFFKHTSKVIAEEACSEICCEMGHFYEEEGDWEEAAVWYYNAVYETRPILSIQAGGREGLEGLIRCYEKMGCKEQVEIYKEELSSRDGDINKR

SEQ ID NO: 1776 - protein, 508 aa, Anaerospora hongkongensis
MNTACLISLCLITKNEEHCLAACLASASPVVDEIILVDTGSEDNTLSIAAEYGARIFHFTWIDDFSAARNYAISQACGKWVLVLDADEKLTVTRSEILHFIALNPAEGYYFNILSYIGRDRQVARDQVVRLFKNAPQYRFTGAIHEQIAGSILSQQPPGSLRVTPFTVEHYGYLPEVLINKSKFSRNTELLVKSLLNHPKDPFLHYALAIEYLQNRNFVQAEQTLQEALPLLTGTEGYLPQVLGALLLVKLTQPSDQQAQTLFINAIQVLPDNGDYYCLYGLWLMQRSRYSEAVSILEQALQKPRELTASVSLPALLGDACCLAGQQQHAVDYFTTAVAEAPQLLYPWLRLLTVSCSENSPQLWDYVYNGLTAAMPLSSLLTLQPPIHFETASARMLLEAQYALRTNDARKLAAACSLLGQLPHAAYPVLIAPAEVPALVTLGTELLLFESHLILLGSNLAAQHSLEDSIFHQLRLLTAVISQSFPTSPLHFWEEVFIGEACFNRQPG

SEQ ID NO: 1777 - protein, 626 aa, Paenibacillus polymyxa
MMKTIALCMIVKNEQEHLRRCLDSVKNKVDQIVIVDTGSTDETVNIAKEYTNDVHHMEWDNNFAAARNESIKYATTDYILVLDADEYLEGSADLQKEIASGADYYFTKIHNIMSFERALNHLAIRIFSNSKDLYYQNRLHEHLNIMDEKRNLISGQAGLVIMHTGYTDEMMEGREKAKRNLPLMLKEVEENPTVYNLFNMGRTYMWVGKYEKAITFLKRAYPMSKNLTISSDLIITLCRSLGETKRYNEALQILQEAVVVHPKEVDLLHLQALYFMEIGYYRDAIATMTKCLDIGDQGITVTEGHGSYIAHFRLAEWYELRNDLTKSYKHILEAFKLKNDFAPIMGKYFKIIEKANVPLEEVFVSTNQLYPISNSGQLEKLLEVMYQLRHPLLQRYLTEYNVTVQDNVMATARQYARDYEGAQALWLEMADIDEQNGEDILLLSILLKDETLLRRAITLLNLSQKEQKNIYKIIMNDLSEDNVKLTPHLEKMLEKTLLHLIRLQEFETFEIILNYLWQGSADVKVKVCEHLVAYGFNEIAIDLLVKLFEKYPRNVRIIEILGDVCLRSEYYQDAQLFYAKLLEFRPDYSSYESCYFLSEKVGDQEGSFNIKESIKLKFPLSSWVVD

SEQ ID NO: 1778 - protein, 359 aa, Clostridioides difficile
MITISLCMIVKNEEEVIGRCLECVKDIVDEIIVVDTGSTDSTKEIVSKYTDMVYDFEWIDDFSAARNFSFSKASKDYIMWLDADDIILEDDREKLLKIKETLDTSIDIVMAKYNVSFDENGKPTLSYYRERLFKRSSNHKWVDPIHEVIPLVGEIFYSDIAISHKKLHRQDPLRNLRIFEKMISEGRVLEPRHQFYYSRELYYNAKYKEAIEGFTKFLDSARGWIEDCISACRDLATCYYLINDEKSALYSLFRSFEFDEPRAEICCDIGKHMFDRQKYKEAIFWYKVALTRDKNDTNGGFKSNDCYGYIPYIQLSVCYDRLGEIDKAIYCHEKAKEIKPKDSSILYNENYFSKFKNNL

SEQ ID NO: 1779 - protein, 372 aa, Paenibacillus terrae
MTKPPVTISLCMIVKNEEQTLARCLDSVADLMDEMIIVDTGSTDQTKTIAARYTDRLYTFDWNDDFASARNESFDKATCSYILWLDADDVLLEPDRERLCSLKRHLSTATDIDAVMMPLHLAEGEQGEPLFTSRRIRLVKRERQYRWAGRLHEYLVIPEGRIVHSDVAVTHRRMEDHTLRNQRILARWISETDKLEGRLLYFHANECFDRKEYAEAAEAFNRLLGEPSGYREDRITACVRLAECYLHLGEPEQQLDILLRSFRYDVPQADVCCMIGDWFFTRKEWSIAAYWYEKALEQQDVSGLRAVPLPCYSWLPHVRLSHCCANLGKLDASYEHNQKALRYLPEDPYLLDNERKLRSAIQKPSSSVRPSK

SEQ ID NO: 1780 - protein, 1311 aa, Centipeda periodontii
MMRISACYIVKDEVAELRRSLASLRDAVDEIVIVSTAADVGVAELASNFHAQLWDFPWQNDFSAARNYALGKVSGEIVIFLDADEYFFHPEHVRNALDDVIRAAPDFDIIMLRRCNFMTANVVQNAMYDNSPRILRMPGLHYEGMIHEQAVRDDGKERVLAYGDERLAVGHTGYLKIRGEAKIRRNIAMLAQDAALHGRTEMHALYLMDCFFGLKDYEKVIALSKEVLQGNIRVIGSESTIYHQVIESMRALHYPDEEMLALADEALAKFPELPDFYAQRGMILCGLVRYREAAESFEEALRRYDHDFLSIHNSSFFNDAVAALVSERLARIYRVLGVPAAAQLWEERQRAYLGGDTGAEVKEKMQITACYIVRDDAVHLKQSIESLCTAVDEIIVLDTGSQDDSVRTAEECGASVYHAAWQDDFAAARNAVLAHASGAWIVFIDADEYFSPETREHLRAVIEEADRTEGEVLLVPWHNIDEATGETLLDSYAPRIFRRREGRHYVGRIHEELREADGSAPLSRIIAPELLTLVHTGYSAVLTREKGERNLRLLLEELEHTDTPERCWRYLAETYDNLGNERMAERYALLDIGTGRRSVLYASCSYRILLRIYGANPVLRDKHLAVAEQAVREFPELPEMHAELAEALAAFHRYEDATAAAEQALQTGPPTAGTEQSVFTAEMRDALCRRMKIWQRIASRAEEIRIAACVFVRDDARDMETWLGNAAVYADERVVADTGSTDGTRALSERAGAKVFDFPWRDDFAAARNAVIAEAHADWVTVLDADESFVDPAELRPYLAMMDVVLPHVDAVLLPIVHVDEDAGNREIGRAPHVRLLRMGRGLFYEGRVHEALRKEDGEPVLYHEPVALVIRHVGYSSGRIRAKHERNLALMERRIGEHGLQIGDCRYLADTYYGLGKYAAALIYVRAALEENVTSFGAQSHLHHLLLDVMEKENIPLPEQIAAAHAACRAFSQLPDFYGRLGLLLAADGDAGALDALTKALMLYEHPTDAEGEASVFPAWAGAVSAARARILMEMGQRDAAEEELTRAFTFNTAREEALDVSMELHGSEDVAQILAGMRELLGEGVETLAYLTRFADSYGWLALGAAARAELSRMTGHVVPTPEIYERIRVLAPKELGEHVVGALVEYVREMPEILLRLERERRAKSLHLYHRLRSLLPDAMLAFWRHYDEPDAVALPEAMDGYESVRAAFIHHADAEQSARFLRVAAGYGRDVLRAAAEDFADAQRWEGAFLGWSLLSAVEGESLDSCYGMALAALYLGARTEAQECLTRACTLDPSHRKAMELLELIK

SEQ ID NO: 1781 - protein, 355 aa, Unknown
  Description of Unknown: Candidatus Stoquefichus sp. SB1 sequence
MITISVCMIVKNEEDVLERALSSIQDIADEIIIVDTGSTDNTKSIAKKYTQKIYDFEWCDDFSKARNYSFSKATQDYCMWLDADDVLLEDDQNELRKLKATLSPDTSVVMMRYNTNFNENGQPTFTYYRERLLRRIDCFQWVGFVHEVISPSGKIVYSEIAITHLKMKSNPHRNLKIFQKKQAEGVLFSPREMFYYARELYNHEYFDEAIAEFKRFLNSQKGWKENAISACQFLGYCYYHKREMQEAIRWLLTSLCYDLPRAEICCDLGKYFFELKCYEQAIFWYITALSCQRNDQSGAFILPECYDYIPYIQLCLCYDAIGDHETARFYNEMAGQCKPNDKAYLYNKQYFNKIL

SEQ ID NO: 1782 - protein, 381 aa, Oscillatoria acuminata
MNPTFLSFCTIVKNEKYNLSRCLTSVKPYVNEIIVVDTGSDDGTPDIALEQGAKVFYFQWCDDFSAARNYAVSQASGEWILTLDADEELIIQSENFREILAANSKVLVYSLDLINVGQEENQIGGKLQRIFRNIPEIRYQGRLHEQLIYENQKISGSRRVYLNSLKILHYGYSDPDLTAQKATKRNIPLLERMKKEEGLSLGNLFSLAQMCDYFGQTEKAQVYYEELFGVLLHYVMNNERPNELVWLATMLHFFADKCLKQEQYETAQIFCQFGLKWFSDFPPLNALAGDLLIALGFTLGAVPYFEKCLQLGQEGNYYARDPFDVSFINTYPAYRLGCAYLNLHRWQEAKIACEMALSFDGNYSPAQQLLEQILQFFPDKK

SEQ ID NO: 1783 - protein, 592 aa, Unknown
  Description of Unknown: Chloroflexi bacterium HGW- Chloroflexi-4 sequence
MNKRRQARLFAFKELLDYPDNDTATRLIVEQSAKVVGKTIYRRFDNSVRPEKFPDISLVLIVKNEEKDLPRCLESFKDIVKEIVVVDTGSTDRTVEIAKSYGARVEFYEWTNDFAEARNVSLSYASCEWVLRTDADEWIEEPEKAKLLHCVNSGVADIYLCPTVSKLRNGVQTVENVRLIRNHLGVIYHYPIHETVALSAAKLGLVQCLTNVDFLHSGYEFLEAGSSEKKTERNISVCTQYLEKHPEDFYVRLVRGLLLLNTTRKGDAISDLERGVKDIPDDASPVKYMGLAYIALCQQYVFEKRDIDLINILLDAQVDFNVYSCMMQFIGQIYLFNRADWKRANKIFDWTLKKYSTKLTFSDVLFPDKYNEVECSKLMAETCVLLKENEKARKYYLQAKKIQKSQSEKSEHQSYDKHYEDVDSFSAEQLRILAKTPKENLKYIETYSNILRAASKSELTAQDYLDLANCQIQLNNLKFAQKLIDESRLINSEIPFAYNLESLIALKEKENDKALEKAVQAYIKEPGNSSYQNNVEQISNLLRLSPVQGIKKVGLNWLSTGQTKEGLFALMLYLKFVPEDLEVNAVVAKYLN

SEQ ID NO: 1784 - protein, 362 aa, Bacillus koreensis
MISISLCMIVKDEEALLARCLDTVKDIVDEINIVDTGSTDRTVEIAKEYTDRIFFFEWIGNFGAARNESFKYATCDYILFLDADDVLLEEDQRKLKELKETLDPSVDSVSMYYDAGTDEFGNVTLRYRRNRLIKRSRNFVWKGDAHQYLEVYGNVINAGISVTHKKEKHSVGRTLGIYQKKIDRGDEFSPRDHFYYGNELRENGHYEKAIESYDKNISMAEGWIEDKVYACINKADCYRFLGDTDNELKSLFQTLQFSKTPRAEAASRIGYNFQVKEDYESAVYWYDIATKQKADPNQWSFSYPAYYTWYPHLQMCLCYYRLGNFAKSYYHNEQARTYRPEDQRIVNNKVLLEEKLGIEKEQ

SEQ ID NO: 1785 - protein, 356 aa, Bacillus marmarensis
MITISLCMIVKNEEKLLKRCLESVVDLVDEINIIDTGSTDATIKIAKEYTDRVYSYKWNGHFADARNESFKYATKEYILYLDADDVIKEEDRTKFKKLKNELPQEIDSVSMFYHAGLDAYGNVTLKYRRNRLVKRSKQYRWVGDVHNYLDVHGKVYNSTIAITHLKEKHTVSRNLNIYKEKLNRGDQFSARDFFYYGNELRENNLYLEAIQAYDKSIEHENGWVEDKFYSCIFKADCLAQIGKTLKQRNSLLQSLRFAKTPRPEMCCRLGDVYLKETDYISAKYWYELSLIVPEDSNKWSFTYPAYSTWYPHLQLCICNFKLGKFKAFKVHNEKAAAYVPRHPAIEHNRKLLKNIA

SEQ ID NO: 1786 - protein, 365 aa, Oceanobacillus chungangensis
MNTISLCMIVKNEEEVLKQCLESVNDICDEIIIVDTGSNDLTKTIAKEFTDKVIDFKWIDDFSAARNFAFSHATMDYILWLDADDVLLKEDQLKFKALKDVLHEGIDGVSMLYHIAFDEYGKPTFSYRRNRLVKRSKQFHWIGAVHEYLEVSGNIISADIAVTHKKSEKTRGTQSNRNLTIYENRLKKGEKFTPRDLFYYANELKDHGKFQKATIYYREFLATRKGWVEDEIRACINMAACYKKIGSEEKELESLVSSIQYDVPRPEVSCQIGDIYKGRKQFKKAIIWYLLAIEIEIDNDYGFTQISYATWYPHLQLCVCYWQIGEIEKSIKHNNKAKEYRPNDSQVKHNENFFKEYLANKAKLE

SEQ ID NO: 1787 - protein, 629 aa, Paenibacillus polymyxa
MNKTISLCMIVKNEEKVLDRCLSSVVNKVDEIIILDTGSTDSTMEMARKYTEKVYSYQWDDDFAAARNHSLEYAKSDYILVLDADEYLESDADLKKVVESGNDYYLTRIRNLLSFGWAHTHTAIRLFVNKPQLKYKNRLHEHLDTMNENYEYSTEMAEFVILHTGYMNETVAEKDKLSRNLPIMLREVAENPNGYNLFNTGNVYYSLGNYKKAIEFYQRSYPLSKDKSYAPELLTKIATCLSYLGKHEEGLRVLEDAVEIFPNTVDLRYAQGKIYFEADYLKDAELAFRKCLIMGDKGITVTEGAGGYGAHYYLSLLYYKKGELAKSYDEIIKVIQEKKLFVPGLNHYFDVILKSNIPFNDVKFNINDIYNVSNVEELRWLMESMYSLRHPLLNEYLITYNLTVEAKIKAVALLFDKKYEESKQYWGKVPLDQENALDVVLLAIILQDEGLYNSAQMILNLSVNERKMFKSILFGGNLTKLSMTTNLEGMILKVISHLIVLQEFEIFESISLVLITSESDRIKQKLGEVLTSYGFHEVAIDILVKCFEKKPNSSSLVSLLGDICLKSGYLQDAQLFYNKLLEIKPDYSSYERCYDLYEVSENVQGMRVIKEEIKRKFPLATWVKGFSMV

SEQ ID NO: 1788 - protein, 358 aa, Thermoactinomyces sp.
MIVKNEEKNLANCLASVKDVVDEIVIVDTGSTDRTKEIARKWTDRVYDFEWIDDFSAARNESFRYATKDYIFWLDADDILESTEIEKFKHLKKSLLKEKIDVVYMKYFLPSDQVESHTTRIRMVKRDLSARWEGIVHEDIRVLGNYRYTLSDVIVTHTKDLNTPSEDRRPSRRNLEIYEQNIARGHKLSIADMFNYARECSIHKDYPNAIKYFELIRDHPEISLPNNMFIYHKLATCYVLNNQPEKELELTLQSLAMDMPYPAFSCRMGEHFIKKGKIEVAIFWYKTAYLQPLSDSYSFSVADATYHTWLPHQQLAVCYESLGEKDQADFHKRQAEYYKNRLVSNTKKVNISPQTVDS

SEQ ID NO: 1789 - protein, 418 aa, Ruminococcus gnavus
MMILCDIIYFSKIENRVIKVRKYIDKEVVAVSKEYEMKWKEKAVTKERGSVKGNVLISGIIICRNEEENISKVLDSLIDLKIDEIVVIDTGSEDGTLKIIETYIYQNSNIRMYRYQWKDSFSEARNFGIRKAKNDWLFFVDADERVTNTNDRSIQSMITYYSEMCGDEIAFCPVIVSSKFNKLYGNPRIFNKKSGYRYYGNVHEMLRKSEDEYNTIPFVCLNIIIEHEGYGKRLIKSKLQRNLRLLDFCIEKERENPIWYCYKLRDGRDFLDFDEKKQLYENVQKIYKENVNKSFYQYCFDWAASVFIQNVVKMGDIKLAKNLLIELLTYGKCSVEDQFYLKTLVKLLEIETDLLNLETECTVMQENADFSSSIIDTAGYYIDELKMRIFEKEHKMGDYFKMKEFLYSVGYICDMETI

SEQ ID NO: 1790 - protein, 348 aa, Clostridium butyricum
MLSLCMIVKNEDQNIKSCLSKVVDFVDEIIIVDTGSTDNTKNIASEFTKKVYDFKWCNDFSKARNFAISKAANDWILVLDADEFVTNFFRDNVNKFIKNSLNKKKVGRVQRINIMEDPNGNKKYIERVNRLFNRNYFNYEGIIHEQIRDLNGENYETEIVDIIVEHVGYTKEVLHRTDKIKRNISLLEVAVKNDSEDPYLYFQLGKSYYMMKDYKTSVLYFEKALSFELDFRLEYVEDLVETYGYALINSGRYSEALILENCIEIYSESPDFQFVMGLVYMNNAKFTQAVERFLKCTKFSRSNVEGITTYSAYYNIGVIYEVLGFKENAIEYYNMCGDYEPAKNRLKL

SEQ ID NO: 1791 - protein, 596 aa, Caldanaerobius fijiensis
MIESPLLSLCMIVKNEEKNLPRCLDSVKDIVDEMIIVDTGSTDSTVKVAESYGAKVFSIRWNDDFSEARNASLEKANGKWILLMDADDELDQEDKQKIRNLLTDDVEGYFFKTINYVGQNPGVEVALNMNFRLMRNRPEYRFIYPIHEQIAAVIQQIRPGAKLVSTDIKVYHYGYLDDEVVIKEKRKRNMRIIERVLQENPSDAFMRFNMGNEYFALSDYNKALYEYMLSLNNTHGKTGYLSKLYVRMTLCYNELKRYDEALSIIERGLSDYPDLTDLVFLKGYIHHVNKRYTIAERLFKECIEMGEAPFDIGFIMGVGSFRAHHALGELYLELEDYDEAYVHFEQAYKMNNSFKEPLFKMCEILMKTRGVSEAREKLEDMIDIQNPDGISLMINIFLRYKRYDICLEYLDPLLRNDKCNDEIYYLYGRCLFYLKQLDKAYDMWKMIDSKSHFYDMVIDDLMLRCVIKNEYEETIAECCRIKKAKKYEVFQRLNDLLNRKKPDILSDDIETSKEYSDIIFDILDKLLYLEEFEIFENALGLLNLIEDKTVLLRLGKLYYRYGFVQNAENEILRSMKLFNIYDQEALSILNHIIMEE

SEQ ID NO: 1792 - protein, 361 aa, Cohnella panacarvi
MRAKGNAIMISLAMIVKNEEKYLDRCLKSAAHMVDEIIVVDTGSTDRTVEIAEQYDAKLYRFEWIDDFAAARNYSLEHVTGDWVLVLDADQYFQEDFSESIKQFTNSNAKRAGLIEIISKYEQNGQTLHSTDYMARLFPRGARFEGRIHEQLTPLMPTVVTGLKLMHDGYFQTDKGTRNIPLLLKALEEEPDDAYLNFQLGKQYRGADEYNLAQHYTEKAYGLLQGSNPPFALETIIELLEVLTVNKQYEAALELASNEVEWLDKSPDFAFSVAQFLLEYAIDAQDFSVVGNIENSYLKCLELGRAGAKEIVIGASTYLAAYNLAVFYESIGNDANAKEYYALSDSYGYEPAKERLQKYTS

SEQ ID NO: 1793 - protein, 625 aa, Paenibacillus odorifer
MDKTITLCMIVKNEEKYLKRCLESVKDKVSEIVIVDTGSTDGTLVIAEEYTTKIHHFKWVDDFAAARNESLKYATSEYILVLDADEYLESDADLQKDIKPDYDYFLLKIYNDVSYGRAFTHTAVRLFANNRGLHYNNRLHEHLNILDAKTNYKSQYGEVIIHHTGYTDEIMQEKEKTKRNLPLMLQEVEENPGAYNLYNMGKTYLSINENAKAIEYFQRAYPLSSGRMFLPELITKLCYCLGELNQYDDSLRILNDAVKVYPLETDMRYMQGRIFMDAGYIKDAEITLKSCLEFGGDLGVSVTEGTGGYMTRFVLAELYEDQNQLDESYKYIVEVLQEKKTFAPGLSKYFEIVTKSNIPLDDVYQNIIQLYNISNINDLQLLLDVLYGLRHPLLNRFISVYSITAQPNVAASAMQYDKKYIEAKDMWLSMEDIQIENAVDILLLSFVLDNEELFNLAKPHLNFSEKEEKLFRKIIRKEVISSNKMTSYTEKILGDIASHLLKLQEYECLQTLLEYIEETSLKSKINSYSLLISYGFNEVAIDLFVKLFKNNPNDVEIIRLLGDLCLSCNYMEDAQLFYSKLLELASDYGSYERCYRLYEKMNDRVGMSRTIDSIKIKFPRSLWVI

SEQ ID NO: 1794 - protein, 476 aa, Paenibacillus alvei
MTRPKISLCMIVKNEESCLERCLDSVKNIVDEIVIVDTGSTDRTLQILEERGITAHHYNWNHHFGDARNHAISFATGEYILQLDADEYLDESTKGVLKEPLDCDCYILKIRNDLGSGFNEVHSSIRLFRNSPKIKYVGALHEHIDTETTKLKHGKLSVLIHHDGYQQSVIDKKNKNKRNMQIIKKEAKLNPDAFNLYNLGVQLKIEGEHLAAIDAFKKSFAAGSNYTFTPKLLVYLGQSLMELNRHEESLAVFRDSIALYPTYTDLHYFKGFVYEKIEYFRDAEACYKKCLEIGEVSETYHNSQEGVGSYLAHAQLAELYLKEERREESLNHALEALKGSKNSFPTLKVFLNIFPGGDRKQLYGILKQVWNLDSDKDLELLLIALYQIRHPLLLNYVEEYNVSIPYEMQRFLLLMDKKYEEVLEREAVNGELARDQSSQYGRDMLLLSFVTRDENLYNRASLDINLNQKESKILKR

SEQ ID NO: 1795 - protein, 642 aa, Anoxybacillus ayderensis
MKPFLSLCMIVKNEEKVLQRCLDSVYGVVDEIVIVDTGSTDLTKEIALKYTNKVYDFEWTNNFADARNFAQQHATGEWILVLDADEYVERTNLQEMIQQLKQTDDSVEAYDVSIYNFVGAYGERVLQHRHTRIYRNVPYLRYDRAIHEQLRHVSGKYVEAKTGILTIYHTGYMRHVVVEKKKHDRNAQLIEREMEAGESIAFDYFNLGNEHLSKGEVEQALQAFIQAYQHKKDIRLSWVSYCLVQIILCLKYLQRFDDALRVIADVENIYSETADFQFLRGEIYYLQHRYDDALKQLEYLLENKEKYPYTIKTFEYVEYDPHMLLGQIYKHKGNLQKAIYHFSCALSFNRKSYEALYNVLQLLARVHSETEIIQFIESKQLANDLLAISLVARIASALHLENVMKSLVAKLGDDVIQRGFEIKVNILQNAYDDALQKILKSSVADLQTYVRSGGLDSYDLLVLAFKTNQLDVVRLLLHLVSDQKEKEFLLFMLNEHEQAPESMFYLFLLERTIQLKEYELFEQFLALKNRFAPSVHIQIAHLLHRYEFMDVALQLYRSVDNMNDWDAGAFVNVMEALAMKNEIMEAMQYGLLAISFGHHDFRLYKYMIELMSICGMSEERRKIVQQAKQLYPDSEWLLKQRD

SEQ ID NO: 1796 - protein, 357 aa, Unknown
  Description of Unknown: Candidatus Marinimicrobia bacterium sequence
MAAKIPLMLSACLIVKNSEKFLRRCLESICEHVDQIVVVDTGSTDNSIDIAKSFGAEVYSFKWCDDFSAARNKSLEYAAGEWILQVDSDHVLEVKKGFDLRRALGGARQIGFFIKEVSILKNGGKQLLDRMLLFRRVPGLKYEGVLHEHPMASLISYAKNKGIEEPFSTLDSVRVLHYGYFDIEQKLKRNIRILERGIAKEPMNWHYRYKLLLSYESAGEKGKFDSLLKETFSLMERNGHRGISLAMVGIAGIVGKWMLKVGYPEGDAIEFLERYYRATRGKDLRIALPLAEFYYIKGDYKRTFDILSLILKEGYGPGFIPLTEVEKSRAFRLFSKAVEKLFSEDDRKRILKAIGML

SEQ ID NO: 1797 - protein, 389 aa, Unknown
  Description of Unknown: bacterium 1xD42-87 sequence
MAADTGNKYIRRMNRAETRRNHMIPISVCIIGKNEEKNIEKCLEPLTHYPFEIIYVDTGSTDRTKELAAKYTDNIYDFEWIGDFSAARNFSLKKASHNYVLVIDCDEYLTDLDLDGLCEAIETHPRGSVGQILRKSFSDTQYRKDYSLERVDRLFHKRSFHYIYLIHEQVADIKTDRTDYERYDIPVEVDHVGYVGTNDEKRLKAERNNALLFKEIERKPEEPYFYFQVAQSYNLIDDYENAYIYYKKAFELPLLLQNEWVHVMANNFINVMVQTGRAAEALELYVPVYNDYAHSQQFLCSMGALYLNQDPPQPLKAVMEFVKALQCTPDSESEDYSGMAFFSIGFANELLGNLPAAASFLVKSAEKGYPLALEKLEEVRKTMEERGSV

SEQ ID NO: 1798 - protein, 366 aa, Unknown
  Description of Unknown: Lachnospiraceae bacterium A4 sequence
MKFSLCMIVKNESAVLRACLDSLKEIMDEIIIVDTGSTDDTKKIAAEYTPYLYDFEWHNDFAAARNFAFSKATGDYIYSADADEVVDQENQDKLKALKRAMLPEVEIVQMIYVTEQINHPTENFARDLRPKLFKRLRAFTWIEPIHETVNLNPVIFDSDIEIHHCPQGNHSSRDFGVFERIIADKGVLSDRLMGMYLRELYKAGTEEELRRAEGFFEGALSSKRAEGKTLLCRQIIAVLLKIYRLADTPVKMLKVSLSEEATIPSAEMCMELGYFFMKKEDFQEAAEWFHRAGYDCESDIDVASSGTSALMALALCFRKLAKSPKVKALPQREYEIEHRRLMERATEYEQLARDWKPVEPKLIKEE

SEQ ID NO: 1799 - protein, 351 aa, Pseudoflavonifractor capillosus
MIVKNEEAVLGRCLESAAALVDEIVIVDTGSTDATKEIARKFTDKLFDFPWVDDFAAARNFSFDRASGDYCMWLDADDVIAEPDRARFRAMREQLLPEADVVMMPYHTAFDSHGHPTFTYYRERVVRNEVRFRWAGAVHEAITPAGEIRWSDAAVSHKKAGAGDPDRNLRIYESQLAAGKVLDPRNQFYYARELWYHSRFEEAAKVLIAFLDSGKGWLENQIEACRLLSQCMTALGRDGDALSSLLRSLTLDTPRAEVCCDIGGWFLARKQWRQAAFWYELALTRKRNDTSGAFVSPDCYGYLPAIQLCVCLYHLGDVEKAKAFNELAASFRPEDPFVLQNRTFFSSLSFS

SEQ ID NO: 1800 - protein, 631 aa, Psychrobacillus sp.
MLINNRTLSLCMIVKNEEERLEKCLTSVKDYVDEIIIVDTGSTDGTLEIAKRFTEKLFTFNWTNNFSDARNYSIAQATSEYILIMDADEYIKEAPELKRYLKGKADCFLFNIKNHLSNGGSYTHQAYRMFKKATGLSYEGKLHEHINIDHFPEVITREIPIVIHHDGYLEGVLNDKNKKIRNIKIIEVESKEHPTAYNLYNLARAQFDLGMYEKAQHNFKKSYQLDNSKSYLPDLLNKLALSLMELRRFDDGLKVISSAITLFQNQSQLWLTKGLIYFYYGYFQDAEMMFKHCLNIVEYGYEITEGTGSYIPKLKLSEVYEERGDLLKSFEEIVEVIQEHKHYAPALVRYFEVVKKTGIPKSDIVNTLNAIYPINNDRDLNTLLISLYNTRNPLLKYYIDEYSLNVNGRIQAVAETLNNNYEYPFEFWSQLDIIPQVNYLDVISLCYVRRDDSLVDKLTSLKLNKKDKSTLKRLIKRDSITQKELSNLLLEYLVNINMRLIDMMELDDFDYIYSKYLANNQQQSIRILFAKELFEAGHVNMAETVSLNLLSSYPNSKEGLKLLADCYVRLNRYEDAINTYKRALKYGNSLSIYEKLYFLYEETGNSVEKEALLTEMKLKYSLSDWLNQLSD

SEQ ID NO: 1801 - protein, 589 aa, Clostridium tetanomorphum
MISLCMIVKNEEDNLDRCLKSIEGIVDQIIIVDTGSTDSTVNIAQKYTDEIYYYKWDNDFSAARNFSLEKAKGDWILLLDGDDEVPEEYKNKILELTSNKNIEGYFFKTINFLNSSYNNKDVIVNSNFRLFQNKPFYRFSGRIHEQLASNIKKICPEAILKTEDIEIYHYGYLQENVEKKNKRQRNLKILEEEIKASPNDPFTEFNLASEYYSLRQYDKAIPLYIKAMTNCSPNLAYYTKIIIRLTLCFIETKLYEKAYDCINTGLKYYNKLSDFYYLRSLIHLNLSKPTLAIDDLNKCIEYGEPPQEIAFFSGVGSYLSYERLANIYSSLEDYEKCLDCCYKTLNYNSNINIIYLLVHCLYKLNLDKNYIRNTLNKLFGNNLSNSASIISHILVCEKDYALALEYCNVGLNSKKDDKLFYLKGLCEFKLFNFNGCLNSFSNIVSDAYKEESLLFKFLSYIKLNKEDEISNLLNEKSKVTDICKCYYLLINSKEVNDITDDENESIIYSKIIFKLLDILLEFEEYDNFEKALELLNLINDNTLLLKLGKLYFKYEKYNLSMKELLRSINLMNVMDGEGANILNKLYLRM

SEQ ID NO: 1802 - protein, 697 aa, Desulfosporosinus sp.
MRKLTLSICMMIKNEEINLRRCLESLKPLMKEVSSELIIVDTGSTDNSVEIVKEYTDKLFFHPWNNDFAAMRNTTIGYATGEWVLIIDADEELENYKGIVEFVKAKHGKSVGGALMTVINITGRKNERLPLMSARVFRRAADFCYSGVIHNQPHVKGQLLPTEASLLHYGYMTTDSELMNKKFQRTSLLLKKELEKDPENFYYRYQLAVTYSMYGDNKQALHEILKAYHLINRDEALLKQNIYILGAVVQFYVAAGYYDEEVVTIALKTLEMQPEYVDVIFFLAQTYALREEFEKSYQYYDRYLLLVENFAQLKIRYDISISHYTLNNTIEAHFNMATMSIKVGELERAKKHTAILMNSEMKNEEFRGSVYKMIVQLDYALGSFAENYQFYQSVIKAGDELTAAVVEDAETRWQGASIEVRDAYSSMFAELPDLYGTLNRVRLGRSTVADLAKEIFRKDPNQMQPYFSLTLFALMQDDLLCEIGGQLLTEQTILNFMKHLEDCHRQEFLNRSRQYVFSIELTGAVTYSKARLAKNIAKYLLFSGALDEQEYRQVFAVYLYSGSIYLQTLYNEIVFAKELVFDLKNVEEIYLLYMMLAERSKSDGSKSVQYLRKALEVYPDMSRGVEIILGSLSDKEDDGEMEQLTKQLLANVESLITAGQLEEALNMVNECETIIGGDVRLFAYKTLIIKKRHETIN

SEQ ID NO: 1803 - protein, 362 aa, Cohnella abietis
MANISLCMIVRNEEEVLARCLDSVKDLMDEIIIVDTGSTDRTKEIAIRYTDRIYDLEWTDDFAAARNYSFSLATQEYVMWLDADDFLREKDSEKLRELKQTLDPEIDSVVMEYHLAFDGYDNPIAMSRRNRIVKRSRQFTWYNPVHEYLFIEGNVYLTDIAVTHGRVHQNTKRNLHILEKIIEKNGSVEGRDVLYYANELADTDRLVEAVEQYRRFLESPVDFFEDNLMACARLSACYHQLGNYELKLQALLQSMAYDIPRADFCCSIGQCFVDKEEFSKAIYWFKQAIAQDEVPNHFGVLNLICWTWYPHFQLCICYGMEGELELAYEHNEKALKYLPDDQNLLENKNKLEQALGMGGKPG

SEQ ID NO: 1804 - protein, 627 aa, Paenibacillus sp.
MTNTISLCMIVKDEESVLERCLDSVKEFVDEIIIVDTGSIDSTLDIARKYTDKIYSFEWINDFSAARNESIGYAASDYILVLDADEYLESGHELQKDLQEELDFYVFNIKNTTNQGTAFNHTAVRLFKNDFELYYENRLHEHLNIIDNHKNLISGTSNCLIVHSGYEDSNKLEEKKVNRNLPLMKLEVKENPTGYNLFNMGKTYFGLHDYMKAIEFFKRAYPLSKDRMYLPELLTKLAYSLAEIGQSDEALNILRDATSIYPNETEMKYIQGVIYKNAGYYKDAEVCFLRCLELGDQGTAVTEGSGSFRAHLELSELYELQGDLNESYKKKKQAMETKSSLEIIFNYLEFTLRMNQPADEIIQNIEKFYKMDNIQDLQNLMNMLYGLRHPLLHYYLEKFKIEADAHINVAAMIYSKDRQVMKRALDQSGDITKEENGDDLLLLAYVFKEINLITQLQPLMNLGNKELKGIRMLFEGKALPSSMSVSLERALFVLCEKLIIIEEFDLFQELAEKLMESKQNYKITLSNLLKKYNFDELAIDMLTTLYNNKNNNIEVMQLLGDLCFRNNYLEDAAFFYDYLKENNPTYQNYERYFDLTKNSNDQSETMQLQKEISKRYPTALWVGNIKN

SEQ ID NO: 1805 - protein, 597 aa, Clostridium sp.
MGHDISLCMIVKNEEENLERCLKSVQDLVDEIIVVDTGSTDRTVEIAEKYGAKIYYFEWCNDFSAARNESLKYASKDWILIMDGDDEFCSEDKEKFKSLIEKNLNEDTIYFFETLNYSGYSVTTTDITINLNPRLFKNNYGFHYEGEVHNQLVNYEKDVKGKTYDIRIYHYGYLNKNIVSKDKRNRNITLLKEQIKKGEDTKFAYFNLGNEYFALNDKKSALDNYYKSYNNFDPSTGYASRLIERIVISNYSLKNYDKALEFIEIGTRYYPEFTDLYYLKGLIFKDKNSPLIAIKAFEKCIEIGEPPSVLKSIYGVGGFRANYELSKIYMDLKDYDTAYKYSVDTIKSKPDFLVPLYNICHILKEKNFNIEDMKKILENFFTDFPREYPIIADLFYMEGYYDTALEYINKSEKAGTLSDDLKIFKVKSLLYSCKVNECIEYIDTIEEKNLYYFQIMMYKALCFIIKDKYDLAIVSINQFNKSNLSEYNKTTLKVYKEMMNLFTNKNNNVLSDDKTMLDFTPIILQVCEFMLINKEFNKFEKTLNLLNLISDQSVLLNLGKLYFKYGYEEMAKKEVIRSIQMFEVIDKEGVNILESLL

SEQ ID NO: 1806 - protein, 300 aa, Unknown
  Description of Unknown: Candidatus Curtissbacteria bacterium GW2011_GWA1_41_11 sequence
MATISVVISALNASQTLPRTLASVRWADEIIVIDNESTDDTVAIAKKFKAKILTKENNPMLNVNKNFGFTKAKSEWILSLDSDEEIPEGLAAEIKIAIGATDTAGYWIPRKNIIFRRWIRHGLWWPDKQLRLFRRGSGKFPGKHVHEYLEVVGITGELNEPYIHYNYSSISQFIGKMDTIYTESEVAKHIQSGYQISWMDALRFPISDFIKIFFAQSGYKDGLHGLVLAILQAFYSFIVFAKLWERSKFVDIELNFPIVTRELHDRGKEIEYWTKTVEIETELNPLARVWKRFVRKLYAS

SEQ ID NO: 1807 - protein, 240 aa, Unknown
  Description of Unknown: Candidatus Berkelbacteria bacterium CG_4_8_14_3_um_filter_33 _6 sequence
MEINANSNQKNMNLPITVIVLTKNEELHIKRFLDKIAFVVEQVFIIDSYSNDETLAIARKYKKIKIFQQKFENYATQFNWALKNCPIKTEWVLRLDADEYLENKLVKYLKNNLLKINQDVNGIYFRRKVIFRNQWIRFGGFYPTWLLRLFRYQKAVCETRHMDEHIKILDGTTMRVKKDIVDYNLNSLSFWTQKHDWYATREAVDYLLNIKKPEQTRYGGSQQDQKRRWLKNRLYNRAPL

SEQ ID NO: 1808 - protein, 252 aa, Unknown
  Description of Unknown: Bacteroidetes bacterium sequence
MNNLSVAIITFNEEKNIERCLNSVKNIADEILVVDSFSTDNTEDICKKFNVNFIKNKFSGHIQQKEFAKNTAKYDYVLSLDADELLDEELIHSIKLIKSNLTFDGYEMNRLNNYCGKWIKHGSWYPDKKIRLVNKHKASWQGKNPHDSLKLINRTSPGKLKGNILHFSYSSIEEHINQTNKFTTISAEVLFKEEKSINFFKIFLSTFGSFFKGFFLKLAFLDGFYGITICLINTFATWLKYTKLRQLIKDSK

SEQ ID NO: 1809 - protein, 276 aa, Unknown
  Description of Unknown: Candidatus Giovannonibacteria bacterium GW2011_GWA1_44_25 sequence
MNKIPCSIGILTLNSGRTLRRCLDSVKDFAEIVICDGNSTDNTLDVAREYGAKIVKQYDSDEPNLRCVKDKANVRQRNMDAASYDWYFFMDSDDALSRGVIEEIQKITADPTLQFFVYRMPTRLFLDGMEIKHEASYPSYQTRLINRKIKPYFKGKVHDRLVFDEEKYKVGALNSFYDFHWPKERVQNYWKYQKMYANWEADTAGGGPWGGFFYWCVYKRLRIIAGYLYRIPKMYLLYGFKDSMPPRIQLLTLWQHFYIMYLLIKKQILYVRDKRI

SEQ ID NO: 1810 - protein, 261 aa, Unknown
  Description of Unknown: Candidatus Omnitrophica bacterium sequence
MDRLSVVIITKNGEKRIEQCLESIKWVDEIIIVDDYSQDNTVGICRKYTEKVYFRKLDSFSVQKQFGVNLATGEWVLILDSDEILSPGLEEEIKDILKKGSSYDGFFIWRKTFYLGKWIKHSGWYVPIVRLFRRTKGKLDSRFVHEKILVDGKIGYLTEPILHYSYQSIDQHIKKLSIFTTYDAKEVLRRKINITFGNAFWYLLIKPFLVFVKKFIILRGFMDGIEGFIISVFTGLSVFLTYTKVWEYQEKKRSVKDGISR

SEQ ID NO: 1811 - protein, 257 aa, Unknown
  Description of Unknown: Parcubacteria group bacterium CG1_02_37_51 sequence
MKSLSLLMITKNSGELIDSSLKSVLGLIDEIVIVDDYSSDNTRAIAKKYKAMIYKRSSENLGKQRAYGLSKCKGEWILMLDADEIISQELKNEIISVVCRQLSVVGNISGYYIPYQNHFLGKPINYGGENYRILRLFKRASTHITENVVHEHVIVNGKVGFLTHKIFHYSYRNLSQTYKKFADYARREAYRKLSQGERTSFKKLILYPIHMFWARYVKDRGFKDYGLRILLDIGFAYMEFLIYFLMLFDLKKYKKSD

SEQ ID NO: 1812 - protein, 262 aa, Acetonema longum
MYLSCLILVKNNARTIRYALESVKKYVDEVVIIESGSTDTTLDIAREYTDQIFFREWDNHYGNQRNFGLSKCHGQWVFLLDSDEFVGENFGKVVSLLNNRYRTIAIPRYQIINLAKMLQITTRPHWFDWQTRLIKNDGTIRYEDKPVHEALANYRPRLRCNLANIFHLDFVVNDYSSRQQKVNYYERQYPGAGYPRMYLFEDFPYKTACVLEMPEPHVLELLRQNKEFLSYPDHSSIMTELQQKFQYHTRSLLTKARSAWGI

SEQ ID NO: 1813 - protein, 658 aa, Pelotomaculum propionicicum
MESKISLCMIVKDEAQNLKRCLNSVAGCVDEIIIVDTGSTDGTREVAREFGALVRAFPWNENFSEARNASLELATGEWILYLDADEVLAEESREELRRLAKDDNVEGYFIKIVNYLGSEGWVETCPDLVFRFFRNRREYRFHGAIHEQIADVILENSKKANYKVAEEIVIIHYGYLDRQIEEKNKKSRNLKIIQKELEQESDNRLLRYHYGVELFRAKRYAEAAEEFIKAANGIDPKTIYLPKLLRYVVISYQSAGLPEKALDVARLGLQFFADYADLYYYSGVLCLELKQYVLAGEYFQKAVSMPEQPAQYASFSGVRGFRAFYNLGQISEIFLNYEEALRHYILCLRDNPDFTPALENIIRILEPRKNPEYTKECLEKIFEFCTPRSRLILGEIYFRQGAYALALECLEGAAENMLLSPEARLWKAICLIQERRYLEALRIIDTYTRESSFYPLAKLNELLCFWVQGKKRKVRSISLELYALGLASDTENVIALFLDTPDKHKKSYKVTLGTDGVSLLLEIIARLLYLTEIERAMKLLNKIEPDSFSGCRLKISRLFYDYGYMEKAEALLREHLTSNQEAEAHFLLGEIYQKNGNYVEAEQHYRYALEKEPDHPRYYICLIHLYENLRKEILLEAVEKYPDSEVFKQLLEEARNNL

SEQ ID NO: 1814 - protein, 253 aa, Unknown
  Description of Unknown: Candidatus Pacebacteria bacterium GW2011_GWB1_47_8 sequence
MKTSSVPVSVIILTHRSDERFVRALASAQPAKEVLIVDFNSNNDWHQLQKQFHFKYTNQPTQIRNFSTERNRALQRAHHEWVFFLDSDEVIRGDSWGEIEHIIRSSEFDGVYVRRRDLFHGKMLRHGETGSTWVLRLMKKSASQFTRPVHEIAQVKGKTARSKIVLLHNAHLSLTEFLTDITQYAKLEAEYQTDAKLPLSLLGVKTVLYPKLKFLVNYFLKLGFLDGWRGVAYAVMMSLHSLFVRVFAYENRQ

SEQ ID NO: 1815 - protein, 364 aa, Bacillus foraminis
MVSVSLCMIVRNEEEVLERCLQSVCELVDEIVIVDTGSEDETVNIARNYTDKVYFFEWCDDFSKARNYAFSKATKEYIFFMDADDLLPESEQLKFKHLKETLDPSVDIVSMYTTMAFDPQGNPAFQYRRNRFVKRSRGYKWIGPVHEYLEVYGKTVYSDIGVSHIGSVKSEFAVKSTRNLDIYQKRLERGEIFTPRDLFYYANELREHQKYEESISQYESFLVCEDGWIEDQIKAYEYMSFCYGQLGKQEERLRSLLSCLEITEPRPKTACMIGDCLLEKGKLQAAAFWFKTATEFKRYIEDPSFYEPAYHTWYPHLQLVVCQWGLGNIEESVRHNDLAAQSLPNDPKVLYNKEFFNTLKEKSE

SEQ ID NO: 1816 - protein, 257 aa, Prevotella copri
MSNNKISVVINTYNASQHLARVLETVKDFDEIVICDMESTDDTCDIAKRYGCKIVVFPRGNYQICEPARQTAIDAASHKWVFVVDADELVPMQLKDYLYGLIAHEDVAQGYYVPRKSKFMGRFMHCFYPDYQLRFFIKEGTVWPAIIHADPIIQGRIDKLPSNNENLAFVHLADDSISSRMAKINQYTESEIEKKKDRNYGIGALFYRPFVRFFRAYIQKGGFRDGIEGFICACYEGIYQFVAVSKILEDRNRKNEK

SEQ ID NO: 1817 - protein, 255 aa, Unknown
  Description of Unknown: bacterium TMED264 sequence
MKISILIPTFNCESTIERTLDSVKWADQIIIIDSYSTDNTLNIIKSFDVILYQNHYINSANQKNWALKYCENEWVLQIDSDEVLEPNSENIFRNSIKNANYNVHCFMMPRRNHVLGKWLKNGGLYPDWQNRLFRTKFSKWDEKDVHSKIKVTGQIKKINTPIIHHGMPNLSKQLSNLNRYTRYETDYLIRKGKKYSFFKMLTGPFFVFVYRYFYLRGFLDGWRGFFHATYIAIYYFIIQCKLYEISILKLKKSPE

SEQ ID NO: 1818 - protein, 267 aa, Unknown
  Description of Unknown: Candidatus Gottesmanbacteria bacterium GW2011_GWA2_43_14 sequence
MSIAFNKDEKNIDLIIIVHNEEKNILNIVNKTYYDNLIILDSFSDDSTIEKLKLFKNKLYFKKFNDFSSQRNYALSKSNLNWILVLDADEELTEGAEKRIRELVKNKNVDGYWFPRRNYINDKTYLKYGYFYPDWQLRLFRNHRGYKYSGVIHAQIQIPEKKTRFIKDVEILHSSLRSKYSSWLAFFRLKNYINIEGNDIVKSERTTVTLFSGIILETARHFFRCFYRKQGYLDGYNGFRAAVIYGMYQGSIQMYAFFIRLRKVFIR

SEQ ID NO: 1819 - protein, 263 aa, Unknown
  Description of Unknown: Parcubacteria group bacterium GW2011_GWB1_52_7 sequence
MEKAPVSVEILTFNNEMTIEATLKSVLLFDEILVIDGGSTDRTLDIARHYGAKILAQDEKAKLDGRIADFSLVRNQGLGVAKHRWFLFIDSDEMLTPELAAEIRGIAAAEQPLFYAWNVPRKYVLKGAVIDCATTYPNMQMRFFHREHVGTFVKQVHERVLPNPGETVGALKHHMLVPLPPQRALWEKWQRYLTIEEKRWQGVSRRGLLVKIFNALKPIALYFVRLPWVLFCGGRRMPMFYEIAYQRYNLSVLLRLVRHFLWN

SEQ ID NO: 1820 - protein, 675 aa, Paenibacillus ferrarius
MSTVGIHIIMKDESEWLRQCLESVKDAEEIIVIDTGSQDSSIRIAKSYGAKVFFSRWEDDFSTPRNQALQIATTDWVFYLDADEILLSGLAAIKEQIDSSDSEAFTVILENLIGTSLQDHLLHRSIRLFRNNPNYRFQGIIHEDIGTSIVKLHPSSSIKDSEIRIRHFGYMPENIRKKDKIARNERLLQKALQTEPANPYYSYNLGITFCQSGKLNEAKDAMIQALMLARDDAPYRATLVKDLSKILLELREIKQVELLLLKETERYEDYPDLHYILGQSFQIQGLWEQAYEQFRKASTLQNNKYVTEAGASSFLVFYKMGEITQNLGSLEESARLFNQTLQHHSTYAPALLGISEVFHELDVPWHEIAALLKVKVHPSIPSEHYLLLDTLVQVGAFEEAIAITPISYLTDSLFLKNYCLALIHLGHLKEADHLLQNYIKEHPVSLELEILLQWRAICNWQLDESLQTDFFASLPEHLITLYQPINEFLSTGHMSTEFDNNSLSELATSITRQSIVLGQMQLIDKLYKLTGQFKLELTKMLYGYGYILTAAEHLISLSIVNQLDDEGLFDLGEILFDKGHYLKAAEMFESILLAERTYEKAKTAAAICYLHLAEASLSDALSVAPGAPSFKEDLQQIRSSIRLLNRTGWHTQWYGRQRRIFDGQKYDFAMHDRKE

SEQ ID NO: 1821 - protein, 255 aa, Unknown
  Description of Unknown: Candidatus Gottesmanbacteria bacterium GW2011_GWA1_34_13 sequence
MNETPISVVILTANEADNIQRAIKSVVWANEVILIDNSSDNTAELAKNIISDDRLQVINNNETENFSNLRNLGLTLAKNEWVLYLDADEEITVQLKEEIKTAINEKNYNGFFIKRQDYFLGKILKYGETGNQYLLKLGKKNSGNWIRRVHEVWQLKGDIGKLNNPLMHYPHPTIAEFLERINRWTTLNAQEFNKQNIKSDFFKIFLYPLGKFILNYFIKLGFLDGMSGLIMALMMSMHSFLTRAKLYQLQNKRPL

SEQ ID NO: 1822 - protein, 306 aa, Klebsiella pneumoniae
MNKPNLTVIILTKNEQLHLRRCLNSVINFCERIVIVDSFSDDNTLEIIKEYPGIVELYQHKFINHANQFQWGLDNSGVTTDWVMRLDADEYIESELQAEIQNKLNLIDKNKNCIFIRRKYFYKGKWIKHGAVYPLNLLRIWRNGQGRIEQRWMDEHIVVNNPQPEFFKGHIVDYNLNDMKWWIEKHIKYADREVVDLLNIKYQLFNRDEDVRKQGGFQARLKRKVKEDLYFKLSPSLRSLLYFLYRYFFRLGFLDGSKGWDFHLMQGLWYRSYVDIRYKELDALISDISSDREKLSVLSKSTGLSL

SEQ ID NO: 1823 - protein, 309 aa, Unknown
  Description of Unknown: Candidatus Berkelbacteria bacterium CG_4_10_14_0_2_um_filter_35 _9_33_12 sequence
MEINANSNQKNMNLPITVIVLTKNEELHIKRFLDKIAFVVEQVFIIDSYSNDETLAIARKYKKIKIFQQKFENYATQFNWALKNCPIKTEWVLRLDADEYLENKLVKYLKNNLLKINQDVNGIYFRRKVIFRNQWIRFGGFYPTWLLRLFRYQKAVCETRHMDEHIKILDGTTMRVKKDIVDYNLNSLSFWTQKHDWYATREAVDYLLNIKKPEQTRYGGSQQDQKRRWLKNRLYNRAPLFLRVYCYYFYRYLILLGFLDGLVGLQFHFLQCFWYRFLVDSKIYEIKKYQEKHRVGIIKVVKILYNYQI

SEQ ID NO: 1824 - protein, 251 aa, Unknown
  Description of Unknown: Bacteroidetes bacterium sequence
MSTKLSIIILTYNEADVLARTMQAAAQVADELVIVDSHSSDNTLNVAEKNGATKIEVRNFVNWADQRNWAMEQSKYPWVLFIDADEVLNEQLIQAILHWKKNLHTDEEDYWGLRRSHFFMGRAMRFSGLQSDVVVRLFHHTRRYNDCEVHEKINVPKPKPLPGVLEHYTYKNWDEWASKQRAYAKRSAKDHQDKTGRIGLYHTAAKPAFRFFKHFVLRLGFLDGRAGFWYSISMAQGVFWRYVELKKLRLS

SEQ ID NO: 1825 - protein, 253 aa, Unknown
  Description of Unknown: Flavobacteriales bacterium sequence
MRKVAAAIITFNEQKNIERCINGLLNCVDEIVVLDSYSTDRTKEICHQYKVRFIQEKWEGYAQTKNKLNDLIEADYIFSIDADEVPCKTLQSEILKLKELENDHVYILNRITNYCGQWIRHCGWYPEYKMRIFPKSKARWEGEFVHERLIFDKSLDVIHIKGHLEHYSYYNIKEHQERAKKYALLGAQQYYKQGKKSYFFQSSISALAKYVNILILKKGILDGKKGFQIAKISAAANYLKYEELKKLSRSKKE

SEQ ID NO: 1826 - protein, 308 aa, Bacteroides fragilis
MDIVHCIDNSYVAQCGVTITSVCVNNVNEVILFHILTTNLSIFNREMLKKIVDKYRQKIIFYNVDEYLLNKCPLREGDHVSLATYFRILMPDILPKSLNKVLYLDCDLVVCKNIKRLWDTDISTHSLGAVYDGGTDDIRTYNRLKYDIRQGYFNAGVLLVNLAYWREFHISNKLLKFIEQYPERLMFWDQDALNSVLIQTTKILPFKYNMLDAFYTKELALREEYLFEIEGALCDPTILHFSSPNKPWLKTCDHPLKSFFFEYLKRTSWNDKFPIYPFNMSLKSRLCLFLWNKGIVLSRKELKYRELS

SEQ ID NO: 1827 - protein, 232 aa, Pediococcus pentosaceus
MKNINVLLAADENYADQLQITIKTTLENLNKKTRVNFIVLSNNLSNSTKLALKKLAHGLHTVEYLDLDPSVFAFCPTNSHINKTAYYRILAPQLLAKRNIDRILYLDVDLLVRHDLTELYDAELNHNIVGAVIDTGQAFALNRLGVDPVVAANNIYFNSGILVIDIKKWNENHITEKTLNYIKHQSHLIIFHDQDALNAVLAGHVQMLHPKWNLQIRLFSENTVQLTKPTIN

SEQ ID NO: 1828 - protein, 549 aa, Pediococcus pentosaceus
MKNINVLLAADENYADQLQITIKTTLENLNKKTRVNFIVLSNNLSNSTKLALKKLAHGLHTVEYLDLDPSVFAFCPTNSHINKTAYYRILAPQLLAKRNIDRILYLDVDLLVRHDLTELYDAELNHNIVGAVIDTGQAFALNRLGVDPVVAANNIYFNSGILVIDIKKWNENHITEKTLNYIKHQSHLIIFHDQDALNAVLAGHVQMLHPKWNLQNSIVFRKHRPINEAYDQLINEAIKNPAIVHFTTHEKPWKTLSEHPYLDEYHEELNELEINRGVVNVISAANSSFVEALATSYISILENDSENQYNFYLLPDHLDQRDMLILGSVISRYDNASIKIVKVDEKLLENAVESDRILKSAYYRILAPELLPNINRAIYLDCDIIANTNLHDLWQTSLEGNVLAAVEDAGFHDRLEHMGITHDNSKYFNSGMMLIDLVSWRSQAVTQRVLDYINHHPEKLRFHDQDALNAILYDKWLHLHPKWNAQSNIVLDALVPPRTELLKLYAETRENPKLIHFCGHVKPWHAESKHPYTNVYLKYNKKLREPVRT

SEQ ID NO: 1829 - protein, 263 aa, Blastochloris viridis
MAASPLPVSIFLIAGNEADRIGRTLAAVKDLTDDLVVVESGSTDGTPAIAREYGARVVFNAWPGYGPQKRFAEELCRHRWVLNLDADEVMPPDLVAELRALFADGEPTCDAYEIPIAEVFPVESEPHRWAYWLAPVRLYRTDRGRYADSLVHDRVVLAKGARIGRLRGRVHHFSVRSLGEQIAKLNAYTDQQADDLDQRGVSLPTWRLFVEFPAAFFKAYVGRRHFVRGVYGVMTAANYAFFRHLRLAKHLERRMVRRARGGA

SEQ ID NO: 1830 - protein, 299 aa, Leptospira langatensis
MTETSKVRETPSPKKKKKKTEPQLSLDSNRERFLKKLSVAIITYNEEANIGDCIRSCRDIADEIIVLDSNSTDATKEISKSFPEVRFSSQNFKGHVEQKNDAISLCKNEWILSLDADERLSEELRSSLRDFLSSPDDPHCNGLKVSRLTFHMGRFIRFSGWYPQTKYRVIRKSKAVWAGENPHDYLVVQGKGKKVRGDILHYSFQDLSQQVDTINKFSSIVAWTRFNKKKRFSVLRTIIKPFGKFWEIYLFKFGFLDGFPGFAIAVSSAYSTFLKEAKVYELGKQLIDRPSNLRKDYGK

SEQ ID NO: 1831 - protein, 515 aa, Leptotrichia sp.
MKLSVGIITFNEENRIGKTIDAIKGIADEIIVVDSESRDRTVEIAKFKGAKVFVEKWKGYGPQKNSVLEKCCGEWILLLDADEVVSSELKEKIKMIINSSNPSSEVYKIKLRNIAFGRKIKFGGWDDYVIRLWKNGKVKISNREVHEKYQTKEKIEKINELIIHYTYDSIEEFLEKLNRYTSQSAKEYIKNKKNPSFIKIYSKMLFRFVKMYILQLGFLDGYEGYLLAKYSSIYTMTKYTKLREAYYNTLGKDTSLVITTYNWPDALKLCLESVLAQTVLPHEIIVADDGSREETANLVRDFQISNPFVKIIHSWQEDKGFRAGMSRNRAIAKATGNYVIIIDGDLILERHFVQDHIEKKENGFFIQGSRVIISKDKSQKIINGEKLNLWKNLFDKNFKNKLNMIRNSILSKILTKKDKNLKGIRSCNMSFFKKDLELVNGFEEKIEGWGREDSELALRLFNNGIKKKKLKFSALTYHIFHKENDRSHLKENDKLLSDAIKNKKMVAEKGLNQYD

SEQ ID NO: 1832 - protein, 261 aa, Unknown
  Description of Unknown: Alphaproteobacteria bacterium sequence
MHKISAYILAHNEAEKIADAVSSVLWADEVVVVDSGSSDRTAEIAQALGARVVQVEFRGFGDLRNQALANCRHDWIFSLDADERATAEARDEILALLASAPPHDAYLVPRRNYMMGRWIRGSGWYPNFRQPQLFRKECMRYRNEPVHEGYELLTTRPPGELRAAIWQFPFRNLDELIRKMNRYSSLGAAKLSDRHVSMAGALAHGAWAFIKHYIFKRGYRDGWAGFVIALGNFEGTFYRYAKRYEQTQSWSPPPSEPLRRP

SEQ ID NO: 1833 - protein, 517 aa, Helicobacter sp.
MCMQKISVCILVKNAQETLQECLESVRGFDEIILLDNGSTDSTLEIAREFQKSFGALRIESSKFLGFGALKHLAVSYARNDWVFVLDSDEVVESCVYQELESLEFARNHIYALARKNLYNKEWIKACGWSPDFVLRIFNKTYTRFNQNLVHESIIIPTDCQKLYLTSTIKHYAYRDIEHLLDKLQKYSTLWANEHIYNTKATPLKAYTRGLWSFIRNYFFKKGIAYGYKGFIISVCNSLGVFFKYMKLYELQKKPLSCSLVVTTYNQKERLALVLDSLKNLAVLPTEVVIADDGSTKDTRELIAKYQHDFPCKLQHVWQEDRGFQLSAIRNKAINQAQGEYIIVIDGDMILDSHFVDDYIKAARKGVFTQGSRVILDSKNTENILKSQDYRLAFQKKSLKSYKCHLLSKLIFSTSTLDSSVFDKQTLIKGVRGCSMGFFKQDFMRIGGFSQKFQSWGREDSEFVARFLFAGGEFRRLKFSAIAYHLYHDESPKGTLEANHALYLETIKNKSTFCKNS

SEQ ID NO: 1834 - protein, 301 aa, Mesorhizobium temperatum
MAIHVVILTLNESIHIARCIESCKNQVESVTVIDSGSTDGTIEIAEKLGAEVISHPWKNYATQLNFGLSALVTRGGWLMRIDADEVLDPATPCSLSETVSQVGDDCDGILVQRRIYFLGRRIRYGAIEPSWQLRLWRNGRGRCEQRWMDEHVIVSGNVQKSGVIISDINLNSLTWWTAKHNQYASREAIDLLNARFKFLRIDKLPASGSSPQARARRFLKEKVYLRTPAGVRTIAYFLYRYFVRLGFLDGRPGFYFHVLQGLWYRGLVDAKIFEIEELAKQKGVPIAKAIKDRTGFVVDEN

SEQ ID NO: 1835 - protein, 351 aa, Butyrivibrio sp.
MIAKNESKNIGKCIDSIMPLVKYFDGSEVVVVDTGSSDDTAEIAKSKGAVLYNFEWMGNFAEARNYACSKAVNDYILSVDCDEFLEDYSTELADKFMKTVMANPGKIGMSTIASTYVQNGEELRSRDKIGRFYNRKVYSFFGDIHENLRTIDRDDENGYFDLPLSFDHVGYDTPELRKSKAERNKKLLLKALNDNPEDPYVLFQIGKCCIAMEDYKEGTDYYEQVMEQTINPELSYIQDMMVSYGYGLMAQKRFPDALCLEGVTDLFEGNADYMFMMGLIYMNNALFDDATAAFLKATKAKIYSVEGVNSFKAYYNIGVIEEVRGNILKAKDFYKKCAGYRPANDRLKALG

SEQ ID NO: 1836 - protein, 285 aa, Unknown
  Description of Unknown: Oceanospirillales bacterium TMED91 sequence
  MOD_RES (174)..(174): Any amino acid
  MOD_RES (214)..(214): Any amino acid
MGVRVPPSVPNSQQRKDAPVSKVSCYIIAFNEANKIRPAIESVIEWADEVILCDSHSTDETASIAESLGARVVQIDFHGFGQLRNDAIAACQHEWIFSLDSDERCTPEARDEILSIVRKNEADGPVAYFMPRQNYLLGRWVKHSGWNPDYRQPQLFRQGHLSYTLEEVHEGFIXEGPIGHLTQSIWQFPFENLEQMLHKAQRYSTLGAQKLLRXQKRGGMGPALIHGLSMFLKIYLLKSGWRDGRAGFAIAIGGFIGAFYKYAKLAELQNDWTEPSMPKVGKPKS

SEQ ID NO: 1837 - protein, 255 aa, Rubinisphaera brasiliensis
MQTGSPPLISAAVICYNEEEYIGQCLESLRWCDQVVVVDSGSQDRTLEIAREFPNVEIDVRPFDNFINQKNHALDLCKHNWVVSLDADEVLIPELISEIQQLPFDKAGYRIGRRSFIGKQEIKHGTWSPDYQLRLFQKSLSRWGGTNPHETILIEGAVGHLKTRMLHYSYRTRQEYVERNTKYIHMMVDHLLSKGRTASVMEAYTHYVGNFIKAYFIRCGFLDGSTGLFLARKIAAGSFLKYRLLAERSRHTAQS

SEQ ID NO: 1838 - protein, 520 aa, Haemophilus haemoglobinophilus
MNLPITVTMLVKNAEKYLAQSLSALRDFPEIIVLDNGSTDRSVEIAKQFTNVKIYHSDFIGFGPMKNLVATYASYDWILNIDSDEILQPKLIEEISQINFDDSYKVYALLRINHYRGKPIKTCGWYPDFVKRLYNKKLVKFNDRQVHESLEIAENIQVVHLQHEFKHYSFDNSEALINKMQQYTTLFAEQQKYRKKGSVFSAVTHGISAFFKNYFLKKGILSGGDGFIISFANASGSYYKYIKLMEANQNLTTSLIITTYNRPDALEAVLASVLAQEILPNEVIIADDGSTEDTKKLIKKYQGIFPIPLKHAWQEDNGFRAAESRNRGLSMVESEYVIIIDGDMILHPQFIADHINAAEKNVFVQGSRVLLTQDKTTALLQFPEKYQSLKWYEKGLETRFEKRFTALHFPIVARMIQKNKQADSYKGIKSCNMAFFFSDALAINGFNNDFVGWGREDSEFAARFFNNGGKRKNLKFAGIAYHLWHQEKDRAALPDNDARLKQAIEDKLISCSNGLNQIKP

SEQ ID NO: 1839 - protein, 271 aa, Dyella sp.
MQTFPLTLVVITFNEANSIARCLDSVPFATEKLVIDSGSTDDTVAIAQAHGARVVHQDWLGFGAQRNFATTQCTHDWILALDADEYLSPELTAELEGRLAALMASNICAAYLRRATIFMGAPMRWYLPAMGEKMARLFHRDRARWADVRVHESLRFDGPSVTLKAAFNHENNPSLPQKQIKVLRYAELKCRDWLEKGKPVRMWQTPFVYLLAFIKDYVLRLGFLDGWRGFVIAETSASYAAYKRMRYYEMRRNPASVQHGADALIRHGIDR

SEQ ID NO: 1840 - protein, 256 aa, Hymenobacter sp.
MPAVPLSAVIITFNEEANIGRCLGALAGLADEVVVVDSGSTDRTVAICQEHGARVVVHPFAGYVAQKNFATAQARHNHVLQLDADEVLTEALRGEIRRVLAGWQHAGYSLPRLTNYCGHWVRHGGWYPDRKLRLYDRRLGAWQGQLLHERYEVQPGRTVGQLQADLLHYSYPTIESHVQQLNKFTTIGAEELAARGKRAGALQLWLKPVWKFWHLYLVRGGWLDGSAGLSIAALSAWGVFLKYAKLRVLTRKPATA

SEQ ID NO: 1841 - protein, 270 aa, Silanimonas lenta
MPALSVFVTTFNNARTLEACLASVAFADEIVVLDSGSRDETLEIARRHGARIEHQPFLGYGRQKQRALELCRHPWVLLLDADEALSPRAQAEVRALMAGAPEAAGYRFPRHEQRFWRMCHPGVRHNRFLRLFEAARGRISEEPVHAAPVVEGKVASLSGPLYHFGETSVRVKLAKVSAYAAGLVPAKRASGRRARPWMMLLYPPFVFLRAFLFKRLFLDGWAGFIAAVVMAQYAFLKHALWYEAESFEREAGRGMPEGAPPPPPPEHGRG

SEQ ID NO: 1842 - protein, 252 aa, Winogradskyella aurantia
MLKLSGVIITYNEERNIAECLASLINVVDEIIVVDSYSTDGTKAICQRFDATFIEQKFLGYIEQKNFALSQASYNHIVSLDGDEALSNTLQQSILDLKKNWSYDGYYCNRLNNFCGQWIKHSDWYPNKKLRVFDRRKGHWQGLNPHDYVALNEANTKIGHLKGDILHKTYQSYSEFNKKTEYFSTIAAQAYFDNGKKASVWKIIWNPTWAFFKSYILRLGFLDGFNGLVICVQTANITFLKYIKLRELYRQS

SEQ ID NO: 1843 - protein, 271 aa, Pseudoxanthomonas sp.
MPLLPVSLVVITHNEASNIARCLDSAPFVADKLIVDSGSTDDTIAIAQAHGARVVHQAWMGFGPQRNFASTHAAHDWILVLDADEFLSPDLAADLQRDLPGLMASGKAGAWLRRRTWLMGAPMRWYRPMVGERMARFYHRGRARWTDARVHESLRFDGEAAEFKAPFNHADNPSLAHKQLKVLRYSELKALDWRDKRRPVRMWLTPLVYLSAFFKDYVLRLACLDGWRGFIIAQTAASYAVYKRMRYYEMQRNPASIDAAHAKLAQHGLEH

SEQ ID NO: 1844 - protein, 254 aa, Mizugakiibacter sediminis
MSGAREPLSVVVITYNNADTLERCLAAVDWAEEIVVLDSGSSDATVEIARRHGARVAVHPFDDYGPQKQRAIGMATHDWVLNLDADEVLSPGTRAVIERALTAPRAAGYRLPRRERMFWTVQHRCSWRNAHLRLFDRRRGRMNDVPVHAAVEVDGPVRTLWRADFVNDGDGDIATRVDKINRYSSGMVAHKLARRQRFTGLRMVFYPPLFFLRQFLLKRYFLNGWAGFVASAIGAFYVFLKYAKLHEARRLGRR

SEQ ID NO: 1845 - protein, 268 aa, Methylomonas koyamae
MTETSAACVRTGPRPKLSVYIIAYNEADKIAAAVESVLWADEVLVLDSNSSDGTATIAAELGATVRQIPFTTFGKLRNDAIAACSHDWVFSLDADERCTPDAKAEIERILSAPDADVYYVPRRNWFMGRWIEHCGWYPDYRQPQLFRKQAMVFDDQAEVHEGFTVNGKIGYFDSAIIQVPFLNLEQLLHKMQRYSTLGARKLERAGKRPTMATALLHGVWAFFRIYVLKLGFLDGWAGFVLALGNFEGTFYRYAKAATANLKWTPDQH

SEQ ID NO: 1846 - protein, 255 aa, Hyunsoonleella jejuensis
MIKLSGVIITFNEEKNIEACLKSLKNVVDEIIVIDSFSTDNTKDICSKYEVTFIEQRFLGYIEQKNFALKKAKYDHVVSLDGDEALSEALQKSIIKLKSNWKLDGYYCNRFNNFCGQWIKHSDWYPNKKLRVFDRRKAKWQGINPHDNVVLSNKNTRVGFLKGDILHQTYQTYSEFNKKTEYFSTIAAQAYFDKGKTSNFFKMIFNPTWAFFKSYFLRLGILDGVNGFVICVQTANITFLKYTKLWELQRKANST

SEQ ID NO: 1847 - protein, 309 aa, Mesorhizobium sp.
MSNKGKIAVGIHVVILTLNESVHIARCIESCKDQVESITVIDSGSTDGTVEIAEKLGAEVVRHPWVNYATQLNFGISTLVAKGGWLLRIDADEVLHPAAPCRLSEAVSQAGGDCDGILVQRRIYFLGRRIKYGAIEPSWQLRLWRNGQGRCEQRWMDEHVIVNGNVQKSDIIISDINLNSLTWWSTKHNQYASREAIDLLNARFAFLKADKLPASGASPQARARRFLKEKFYLRTPAGVRTIAYFLYRYVIRLGFLDGRPGFYFHLLQGLWYRSLVDAKIFEIEELAKKKGISIASAIKDRTGFVVDES

SEQ ID NO: 1848 - protein, 236 aa, Rhodanobacter sp.
MPSLPLTLVVITRNEAAKIARCLDSVPFAAEKLVVDSGSTDDTVAIAQAHGARVIHQDWLGFGPQRNFATTQCRNDWMLALDADEYLSPELAEEMQQQLPALMAGDLAAASLRRHTLYMGQPMRWYRPAMGEKMARLYHRNRARWSDARVHESLRFDGRSITFKAPFLHDNNPSLVEKQLKVLLYSELKCRDWLDRNKPVRMWQTPFVFALAFLKDYVFRLGFLDGWRGYTIAQTA

SEQ ID NO: 1849 - protein, 391 aa, Cyanothece sp.
MNADAAHGRRPLLSLCMIVKNESANLPRCLSSARSHVDEMIVVDTGSEDDTVEVARQYGARVSFFDWCDDFAAARNAALDQARGEWILVLDGDEELSLTIDLRQLLQDSVGVLSYLTLFVNVYDGDRSKSVGVVRRLFRNLPGVRYIGRFHEQVIYPGEERGLGTNISTELIKILHYGYAPEVWTDKLANRNIPILESLRTQGEASLMVLTCLADMYTAVGEQEKSQDCYQAAYDRLLPYLLAGECPPETILLRFLLQKLTWQALEAEDYETARLCLQNGLHWLPDYPPLSYLAGLNLFYLGFPRGAIAYFEECLSLYRENRYTRAESFETAYMTSHPAFSLGYSWMKLKEWQKAAEAFKLCLSFDPNYGPALERLAEISPHLNTQASEET

SEQ ID NO: 1850 - protein, 271 aa, Rhodanobacter sp.
MPTFPLTLVVITHNEADHIARCLDSVPFAAEKLVIDSGSDDATVAIARAHGARVIHQDWLGFGPQRNFATMQCGHDWILALDADEHLTPELVVELQQRLPGLMAGEAPAVWLRRSTIYMGRPMRWYRPAVGERLARLYHRDRARWSDARVHESLRFDGAAPTLRAPFNHLNNPTLAHKQLKVLRYAELKCRDWLDQGRPVRMWQTPLVFVLAFLKDYVFRLAMFDGWRGFMIAHTAASYAIYKRMRYYEMVNHRRSVADATEVLHQHRLDR

SEQ ID NO: 1851 - protein, 464 aa, Cafeteria roenbergensis
MEGTSVARDILVSVIIPVHNSSAYLDECLESVAAQTHRPVQVVAFDDCSTDDSLSKLAEWKARIDRLDGMSCVVLSGAAQGQTRARGAGFGRNRCVEASSGSVLAMLDSDDAMEPRRLELQLELLLAEEAKGGAVALPVSAWGPGEASAASSSAPAPQPGAAANGASSSSSSSSSSSSSAPCAAASDDARAASPPLVLVGAQVTRVPAGSTAKYTAWINEMPAAELWLQQYREVTLVQPTWMLRRAAFLAAGGYGFPEDLLFVHCLWAAGGRPARVDEPLVRYRCTPGSVSWNIPRRALLAVKAAAFEVRELGLPGPLGAEGVGGGHGWEQLTPESQARAVECAARAAAEAAAPARPLAGGFSVWSAGRDGSQFMASLSPEALALVRCAGDVDPKKIEARFVAVTPGFQPGAAVVKVPVIPVAEMEAPVVTCVVLTSGSEFEKGLGAWMRARGALRGADVIHMA

SEQ ID NO: 1852 - protein, 313 aa, Pseudomonas endophytica
MSQKGTIKNVSLTAIILTYNEELHLERALKSITGIAEEVFIIDSFSTDRTIEIALTYGATVLQNKFKNQAQQFQWALDNVSVRSTWILRLDADEIIEPDLSAEIYEKIPKLTDDIVGINFKRKHIFMDRWVKYGGRYPLVMLRIWRKGYGRIENRWMDEHIIISGGKSITFKGGFSDHNLNNLTFFIDKHNKYATREAIEILNQRLNLFSRDHSVTVKSTSLQTAAKFFIKEKIYNPIPFTISATLYFIWRYIFQLGFLDGRSGLIYHFLQGFWYRFLVGAKVMELEHSISHLKDKKLIIEEISRITGHSLSE

SEQ ID NO: 1853 - protein, 302 aa, Chitinophaga sp.
MSIAVIILTYNEAKHIGRCLKSMRQITDEIYIIDAFSTDGTVAIAQGFGAKVLQHVWVNYAQQFQWGLDNCGSNAAWVMRMDADEYLEPALIQEINARITQMPEEVSGIYIRRKVLFKGKWIRYGGFYPHTLLRIWRNKIGSIEQRWMDEHIVLSEGKTVLFKEHIVDYNLNEIHWWVNKHNNYAIREMVDLLNIKYGLLHADKRLLEGEGTQAKTKRFLKEKVYAALSPGMRASFYFMYRYILRVGFMDGYYGFIFHFMQGYWYRLLVDVNLKEFELKLKGDTRKENMIALLKNDYNIVLQ

SEQ ID NO: 1854 - protein, 253 aa, Thiothrix caldifontis
MIKMSGLVITYNEAGNIQACLESLFKVCDDVVVVDSLSSDDTVTIAKAAGAKVYSQVFLGYGPQKNYGLQFCQHAWVLSLDADERLEADAIAEIQGLNLADSPYDAYEFRRKNLFHGKWIRCVSWYPDHVRRLFNREKTRFSDAACHEAIQSQQYQQLHSHIVHTSFVDYSQMLQKLDEYTNQYAAANMHRKRVSAFAPPLHGLFAFFKHYLFRRGFLCGFDGFTIALLNALGSYFKYAKLLEKQRYGSGALS

SEQ ID NO: 1855 - protein, 289 aa, Leptospira borgpetersenii
MGKSIPVKKKKAPEKRKTLPQTMGKKLSVAIITYNEERNIRDCIESCLNVADEIVILDSISTDKTEKISKSFPSVRFYKQRFKGHVEQKNDAISLCRHEWILSLDADERISPELENSILTFKQKPDEDILSGLQVSRLTYHLGRLIRYSGWYPQYRYRIFRKGKAVWVGENPHDTISIQGKGDKIYGDIIHYSFRDLTHQVNTINQFSSIVAYTRQRKGRRFSFFRTIYKPFSKFIETYFFKFGFLDGFPGWVIAVSSAYSTFLKDAKQYELEKKMIERPSNVKEGYGR

SEQ ID NO: 1856 - protein, 287 aa, Rhodanobacter denitrificans
MTAFLPDPGALASGPTTLPISLVVLTYNEAHNIARCLDSVPFAAEKLVVDCGSTDATVAIAAEHGARVVHQPWLGFGAQRNAAAALARHDWLLVLDADEFLSPELVAECRERLPAWLAGSVAAVGLRRHGLFMAAPMHHYRPLRGERKLRLYHRDRARWTEARVHESLRARGPTAMLDAPLHHRTTPSLLHKQMKSVFYAELKATDRHAAGKRPWIALTPLIFVATFLKEYLLRLAVLDGARGYISAHLSANAAVYRRFRLYEMQRNPASIAQARDWLIAHDLERDA

SEQ ID NO: 1857 - protein, 245 aa, Unknown
  Description of Unknown: Candidatus Aerophobetes bacterium sequence
MISVTILTKNSSATLLPVLQSTASFNEVVLIDTGSTDDTLDIAKVFCNVKIYKRPFKAFGALRIEAAQLASHDWVLALDSDEVLTPELAREILELNLDPSTIYGFSFHNFFKNKRIRHCGWSPDKHLRLYNKLSTNFSNANVHECIEKKNLKVKFLKFNVNHYSYQNMGDFLRKMQLYSDLFAQQHKSEKHSSFFKAWVHSFFAFFKTYILKLGFLDGKEGYIIAKYNSHVAWYKYLKLEEEGSS

SEQ ID NO: 1858 - protein, 264 aa, Curvibacter sp.
MPTISVYIIAFNEVEKVSAAIESVKWADEIILVDSYSTDGTAGVATKLGAKVVQVEFKGFGDLRNQAIQACSMEWIFSLDADERCTPEAAAEIKHLVASNGMHEVYHTPRRNYFMGRWIQHSGWYPNYRQPQLFRRGAMSYDLKPVHEGYVLHSKLPIGHMTSAIWQFPFKNMAEVMHKANRYSTLGAEKIQHKKISMWTALLHAKWAFWKHYLFKLGFLDGWAGLVIAIGNFEGTFYRYVKALEIQQGDAWRTPPQALKSSNE

SEQ ID NO: 1859 - protein, 272 aa, Pseudoxanthomonas dokdonensis
MDRLPITLIVITYNEAGNIGRCLDSVPFAAEKLVIDSNSTDATVAIAQAHGARVVQQPWLGFGPQRNFASTQSGHDWIIVLDADEFLSDELIAECAQKLPALLASAQSGAWLRRRTWFMGGPMRWYKPMVGERMARIYHRGRARWKDVPVHESLDFDRGSEEFRQPFNHLHNPTILHKELKVLRYAELKARGWQAKRKSQSMWQTPLVFVASFVKEYLLRLALLDGWRGFIIAQLSASYAVYKRMRYYEMQVNPASVELARQEMIKHGLERE

SEQ ID NO: 1860 - protein, 263 aa, Unknown
  Description of Unknown: Comamonadaceae bacterium PBBC2 sequence
MNNMPLPSLAIGILTKNESRLIGRCIESALFADEVIVLDSGSTDDTLDIAQKLGAKTFTSADWQGFAVQRNRLLEKVGSDYIFFLDADEVITPELKTELQSIVQSGASGVWKVRWTVVAYGHVLKHFKSNASMERLFPRALIDHYKGVVHEEAVLRGNGPVQRSVMKHRLLHHSRQSIRASLEKLTQYAMLGAAKRHAAGKRGGIGRGTLSALSSFLKTYILQGGFLDGGPGFLYCYFVALECFFRYVALKYDRDLLTEKVSR

SEQ ID NO: 1861 - protein, 252 aa, Thermithiobacillus tepidarius
MLALSVVYITRNAARCLRQSLASAKALAADLVLVDSGSTDETLNIAQDFGARIFQREWPGFGPQKQFAVEQARHDWVLVLDADEVLLPEAVPAIRAALAKERLPAGFRLPRRNFFHGKPIRFGDWGRDRVLRLVDRRQGRFSADAVHERWETAGPVADLHAPLAHYSFENYKAMLAKLDQYSDLNAAKLVARGRQVRPHEPLAHAMAAFFKGYVLRLGFLDGSEGAGIALTTALGSFMKYAKALEMQERNSR

SEQ ID NO: 1862 - protein, 261 aa, Unknown
  Description of Unknown: Rhodanobacteraceae bacterium Dysh456 sequence
MRREPLSVVVITFNNADTLDACLVAVDWAEEIVVLDSGSTDDTLAIARRHGARVAVHPFDDYGPQKQRAIDMATHDWILNLDADEILSPGTRAVIERALIAPRHAGFRLPRRERMFWTVQHRLSARNGHLRLFDRRRARMNDVEVHASVVADGPVKTLRAADFVNAGDADIASRVEKINRYSSGLVAHKLRRGQRFTGLRMVCYPPLFFLRQYLLKRYFLNGWAGFIASVTGAFYVFLKYAKLHEARRAVSTPGRRPAGGS

SEQ ID NO: 1863 - protein, 260 aa, Unknown
  Description of Unknown: Bacteroidetes bacterium sequence
MSLIILFCSMQKLSVVIVCKNGAKVIGETIKSFSGLTDDILIYDNGSTDGTKDIVRQSNARLVEGSWEGFGKTKNKANALARYDWIFSLDSDEAIDEELKENLLQEELADETKVFEFKFKNFLGDKWLRYGEWGDDKHIRLFNRMKIKWNDADVHESLLLPTDVEVISVPGYVLHKTAPDIATYEIKMESYAALNAEKYFKQQKGAGSFKMFFSAALSFIKNYFFKLGFLDGATGYHCARINARYTFLKYKKLNELWSKS

SEQ ID NO: 1864 - protein, 518 aa, Helicobacter pametensis
MKIVLSKISVTILAKNAQSTLRECLESVREFDEVILLDNKSTDQTQEIAKEFPNVKIYESEFIGFGALKNLAISYAKNDWILSLDSDEVLERALLEEIREMEFCKGKYYSFLRKNHYRGVWIKGCGWHPDWVKRIFYKHEIRFDDALVHEGLILGGCEEVRLRQGGILHYSFFNISDLLEKLQRYSSLWAMQNSHKSSSPFKAVMRGSWTFVRNYFFKRGFLYGYRGFVISVCNGLGAFFKYMKLYEESQATPKVSLIVTTYNQKERLALVLDSIKNQKVLPFEVLIADDGSTEDTKTMIEKYQKSFPIPIRHIWQEDLGYRLAQSRNQAILRANGEYLVIVDGDMILHPRFIEDHLAFATRGVFVQGGRILLDSKETDSVMQTKDLSAVLQKKSIKNHRLKCLSRLIFALSAKTKTHLRSDVILSVRGCNMAFYKQDAQRINGFNQAFRGWGREDSEFVARFLYAGGKMKKLKFRALAYHLHHEENSRDMLEENHQIYSNCLKHQKTWCDAGLQQME

SEQ ID NO: 1865 - protein, 297 aa, Leptospira fletcheri
MSEKKIESPRSTSKKRKKSNPATLVSSHPRFNKHLSVAVITYNEERNIGDCIRSCRDIAEEIVVLDSNSTDKTEEISRSFPEVKFRSQKFSGHVEQKNDAIALCKNEWILSLDADERLSDELKESLRIFLESPEDGALDGLKVARLTFHMGRFIRFSGWYPQTKYRIFRKSKARWTGENPHDYLVVDGKGKKISGDILHYSFRDLSHQVDTINKFSSIVAWTRFRKGKVFRLTRTIYKPFVKFWEIYLFKLGFLDGFPGFAIAVSSAYSTFLKEAKIYELSDHLIQRPSNLREDYGA

SEQ ID NO: 1866 - protein, 342 aa, Enterobacter ludwigii
MENGISVIIITRNEALTIGKALASVREFADQVVLVDTGSTDDTLRIAREHPQQPEIHQTPWQNDFSAVRNLAISLCKHAWCLVLDGDEYIDESCRPNVRRLIESKMGEDSGLLYAPLIDNLNGSLLRNNPRIFSRRETLRYTGRVHEYLRDSRGAGVACLHEIIIKHSGYLPDIYQQKNKYSRNKALLEMQISEEPDSFRWKYFHLRYMEIPSPEALSVLHEFGRLPMPFESDTEVYAFNAKSRLIQCLLEEGCWEEAQAQASELYRYYSDYDTTLLYIAATLRSARSVFENIIADCNEKLVKTSALMKHEYLHESTHPSLRDRLQDELTFLCSRLLNAEEK

SEQ ID NO: 1867 - protein, 270 aa, Unknown
  Description of Unknown: Planctomycetes bacterium sequence
MSSICCRVRRVRRERVPKSITGACRNYHPIPCSNRSPRCFAAGPFAPRECRQRIAHVGSLTTEREENAVMKPPITVLIPCKNEVHHIAACIASAKPIADEILIADSGSTDGTLELVRSLGDYRIIEREYVHSADFKNWAIPQAKNDWILVLDADERLTPELREEILTLFADGSPPQDGYRVRFAPYFLGRPIRHCGWNTTTSIRLFRRSVGRYSTRRVHADVIVESGKVGMLHHKIEHYTCTSLERWMEKRNRYTERGAEELFAAGRKVS

SEQ ID NO: 1868 - protein, 323 aa, Hydrogenophaga sp.
MRITAIILTHNESLHIERAIRSIQAFTDQICVVDSGSTDGTTGIAQRLGAEVCTHAFVNQARQFQWALDTLDIRGDWVLRLDADEIIEPDLAREIAEKLPRLPADVVGVNLKRKHIFMDRWVRHGGRYPLRLLRLWRQGHGRIENRWMDEHMVVWGGRTVTFDGGFADHNLKDLAYFIDKHNRYATREAIEVLNQRLGLFAQDGALNARGASHQAAFKRWAKERIYNRIPFTLSATLYFVWRYVFQRGFLDGRSGLVYHFLQGYWYRFLVGARVMELQQAVAHLHDKAAICAELSRLTGHKLVAQSDAPRDVDVGDQRLAPRH

SEQ ID NO: 1869 - protein, 276 aa, Methylomonas methanica
MTDSSPTDLPALPEKLSVYIIAYNEADKIADAIESVQWADEVLVLDSHSTDNTESIASELGATVKQIPFTTFGKLRNDAIASCQHDWIFSLDADERCTPEAKDEILKILATPDADAYYVPRRNWFMGRWINHCGWYPDYRQPQLFRKQALVFDDAAEVHEGYQVNGKVGYFKSSIIQIPFQNLEQLLHKMQRYSTLGARKLERSGKPVSMGTALGHGLWAFFRIYVLKLGFLDGWAGFVLAFGNLEGTFYRYAKAATAKQSWQPDNPPNSETGAPK

SEQ ID NO: 1870 - protein, 250 aa, Marinicella sediminis
MNKVSAVVTCFNSAKTIVKCLESLQWAEEIVVLDSFSEDDTVALVKQHPKVKFHQQSFKGFSEQKQDAINLATHDWVMLLDADECLTPASVKKMQRWKTREPKADGYNLPRIEWVFWHWAHPWVKRNEFIRLFNRTKAHMSRDLVHESIQVDGVVRKLYAPFKHYGETSIQVKLEKINRYSALAAQQKFDRGKRCSPFRLFLYPVFYFFRQYIIKRQVFNGVAGVINATLNSYYAYLKYARLYELQQKKD

SEQ ID NO: 1871 - protein, 271 aa, Dyella sp.
MQKLPLTLVVITHNEADNIARCLDSVPFAAEKLVIDSGSDDDTVAVAQAHGGRVVHQDWLGFGPQRNFASTQCSHDWILALDADEYLSPELATELEQRLPELMAGPGPAAILRRSTVYMGRPMRWYRPAVGEKMARLYHRDRARWTDARVHESLRFEGSAPTLDAPFNHANNPTLVHKQLKVLRYAELKCRDWLDKGKPVRMWQAPFVFLLAFVKDYVFRLAFLDGWRGFMIAQTAASYALYKRMRYYEMCNNPDSVRLASAALTRHGIDR

SEQ ID NO: 1872 - protein, 271 aa, Rhodanobacter sp.
MSTLPLTLAVITHNEAASIARCLDSVPFAAEKLVVDSGSDDDTVAIAQAHGARVIHQDWLGFGAQRNFASSQCRHEWILVLDADEYLSPELADELRQRLPVLMASDAPAAWLRRSTIYMGRPMRWYRPAVGERLARLYHRQRARWSDARVHESLRFEGAAPTLREPFNHINNPTLPHKQLKVLRYAELKCRDWLEKGKPVRMWQAPFVYLLAFLKDYVFRLAFLDGWRGFLVAQTAASYALYKRMRYYEMVNNPESVARAASLLTRHGIDR

SEQ ID NO: 1873 - protein, 253 aa, Desulfarculus sp.
MIKLSAAIIVRNEEANLPRWLAAVRPVAEEIVAVDSGSTDRTVEILEQAGARVARREWTGYADQRNYLADLCTGDWILMLDADEVLGPQSTESLLRFKAAPPAGCVAFALPSRVWYFGRWLRFGGFFPEWKVRLYKKGAARWVSDEVHERLQTAGARGRLPGLYDHYSYDSKADYRARSARYALAGARRMLAAGRRSGRVAGAWHAAWAFTYRYLIRLGFLDGKAGWWAAWLEAGYTWDKYARLADLRRGPKG

SEQ ID NO: 1874 - protein, 254 aa, Halomonas beimenensis
MIHGISAVIITRDAGPTLEQTLTALTPFDEVVVYDNGSTDDTREIASRFSNVRFHEGDFLGFGPTKRHAVSLAANDWILSLDADERPDDRLLQALRRWDTDPEANAAARIRRENLLLGHPVRHSGWGNDWLVRLFNRRYCNFNDAMVHESVALSGDTQCSRMEGKLIHLAVTDLSQFLEKVNRYSSLRAESSERTKHPAVIVAKALFAFVRTYGLRLGFLDGWRGLVIAFSNANGVFWKYMKAYAADHEKSQRP

SEQ ID NO: 1875 - protein, 304 aa, Unknown
  Description of Unknown: Flavobacterium chungangense sequence
MDKVSSLTAIILTYNEEIHLQRCLDSLKDVVKEVFIIDSYSTDSTREIAESNGAHFYQNPWVNYSLQFNWGIDNCSINTDWILRIDADEYLTPELQAEIKDNLPNLNTEISGIDVPLKRVFLNKHMKRGLGEIKMLRIFRKGKARLEDRWMDEHIEILEGTTVTFKNSFADHNLNNLSWWTAKHNSYSNREVVDLLDIEYNLINNNSHVKLSKQALMKRNLKIKYVKMPLFWRCFIYFIYRYFFRLGFLDGKEGFLWHFLQGWWYRTIVDAKIYEIKKECGTDVTKMIKYIKDIYKINLTADLK

SEQ ID NO: 1876 - protein, 271 aa, Dyella ginsengisoli
MRTLPLTLVVITHNEAHTIARCLDSVPFAAEKLVVDSGSDDDTVAIAGAHGARVVHQDWLGFGPQRNFATTQCAHEWILALDADESLSPDLVAEMERELPALMASDAPAAWLRRRTIYMGRPMRWYRPNVGEKLARLYHRDRARWTDARVHESLRFEGRAPTFTAPFDHANNPTLPHKQLKVLRYAELKCRDWLEKGKPVRMWQAPLVYLLAFLKDYVFRLAMLDGWRGFLIAQTAASYALYKRMRYYEMRQNPASVAEAEAVLKRHGVDR

SEQ ID NO: 1877 - protein, 261 aa, Unknown
  Description of Unknown: Bacteroidetes bacterium sequence
MELSAVLITYNEAHRLAPTLQALVGVADEIVIVDSGSTDNTQAIALSFPGVRWYERPFAGYGPQKNYANSLARGNYILSIDADEVLSPPLREAILAEKGRWRAAAYGMLRVAVYCGAFIRASDWYPDWKVRLFAKGAAEWDSAPLHERLVLAPGIKPLWLSGELWHYTYATVEEHLERNRHYARIAAQAAYAQGRRPAFGRALLKAGARFFKSLLLKGGWRLGWRGWSIAGIGAAAYFLQELYLAVLWDRPKAPWGKEGEN

SEQ ID NO: 1878 - protein, 260 aa, Prosthecobacter debontii
MPHPLSIAIISKNEEANLRRCLASAVDLAQEIIIVDSGSTDGTQAVAEEFGARFVSQAWLGFTDQKNLCNSLCTQPWILALDCDEELSPELRRSIESFFTDGSTEKYEAAWMARRVWFLGRWIRHGDWYPDKKVRLFRRDKGRWEGHASSQVHERLVVDGPHTTLEGDLYHYSFTSMGHYLDKHVGYTDVFAEHEQAEGRGWSLVHALFRPWWRFMRAYVLRRGFMDGFPGLWIAMSTAYFTFMRYSRAYEVKVRSNQPR

SEQ ID NO: 1879 - protein, 240 aa, Yokenella regensburgei
MVADDIVIVDSGSHDDTLRICASFGIKAHHHPYAMHGAQMNHAIAQAKNNWVLCMDSDEILDQSTVDAILALKAGETPPPENAWRLPRYWYVLGQEVRTLYPVSSPDFPVRLFNRRSASFNNRPVDDQVEGDIHTEILPGHVRHDTFYSLHEVFNKLNTYTTRLVKYNKIRPSIGRGVISAIGAFFKWYLFSGAWRRGKVGAVTGIYATFYSFLKYFKAWYQHQEQKKSVAETRTDSHLT

SEQ ID NO: 1880 - protein, 250 aa, Halomonas sp.
MPAGVSVVIITRNAASTLQNTLDAVQCFENVVIYDNGSSDDTFRIAASYPNVSLHQGDFIGFGPTKRHAVSLAKHDWILSLDADEVPSPELIESITTWVNNASPSDLGEILRENWMMGQPVHYSGWGNDWLIRLFDRRSHNFNNAMVHEAISVNSISRVQRLSGTIKHTAVTDLSQFLEKINRYSNIRAESGKLKHYSVLVIFFKAVFAFLRTYFLQQGWRDGWRGLVIAVSNANGVFWKYMKNFLKIKH

SEQ ID NO: 1881 - protein, 271 aa, Unknown
  Description of Unknown: Dyella sequence
MHTLPLTLVVMTYNEAKNIARCLDSVPFAAEKVVIDSGSTDDTVAIAQAHGARVVRQDWLGFGPQRNFATTQAGNDWILALDADEYLTPALAGEIAAKLPALMAGDTCAVWLRRATIYMGAPMRFYLPSMGEKMARLYHRDRARWADVRVHESLRFDGPAVTFQARFNHENNPSLPEKQIKVLRYAELKCRDWLEKDKPVRMWQTPFVFALAFLKDYLFRLAFLDGWRGYAIAQTAASYAVYKRMRYYEMRRNPASIESGAAALHRHGIDR

SEQ ID NO: 1882 - protein, 302 aa, Thermogutta terrifontis
MHRPPISVVIPCKDEEHHLAACVQSVLGWADEILIADSGSTDKTLAIAHDFCTAHPRLCRLIQREFISFGSFKGWAVNQCRHDWVLVLDADERMTPALRREIDKVLSKSDCPDAFLVGFDHYYLGYRIRHGAWNHKVVRLFRKSVANYDAGAIHEKVVVSTGRVGILQGRLEHWTCTCLDRWYQKKNRYSTVGALEKWKRGKRARLWDLTLRPITAFVKSFIVKMGFLDGMGGFLVAVDNAVTTFQTYLKLWAIAHPRTAELTRGSSAAENDAFAHLPKRSDVTFDTGIGADSSSRVELAHS

SEQ ID NO: 1883 - protein, 515 aa, Campylobacter sp.
MDFSKISVIIIVKNAESTLKECLNSLLCFDEIILVDNQSSDNTLKIAYEFKEKFSALHIKQSEFIGFGPLKNLALSYTTNDWVLSIDADEVLEKECIEELRKLELKEQNILALSRKNLYKGEWIKACGWWPDYVLRVFNKNFTKFNDNLVHESLILPPKALKIYLKNGFKHYAFNNISHLLDKMQRYSSLWAEQNMHKQSSVFLASLKGIWTFCRNYFFKKGFLYGYKGFIISVCNALGAFFKYMKLYEFSKEKPKTCALIITTYNEPKRLALVLDSVKNLSLIPDEVIIADDGSKEDTKNLIKGYQKKFPCPLKHSWQEDKGYRLSKNRNEAIKKAKSEYIIIIDGDMILEKDFIKDHLKFSQKNLFLQGSRTILNENESKKILEKKDFSLAFDKKGFKNKKNNLLAYFIYKFSKINKKIFKKKIIIKGIRGCNMSFYKSDWQAIGGFNENFVGWGREDSEFVARFLFNNGKFKRVKFSALAYHIYHKENTKNMLEINHQIYLDTIKNKKTDWR

SEQ ID NO: 1884 - protein, 537 aa, Neisseria dumasiana
MQTHKIPASAVMLVKNSERYLQEVLTALSDFDEVLLLDNGSTDRTLEIAARFGNVRVCKHEFTGFGPMKNLAASLAKHNWIFSIDSDEVPDAELIESIRDAVEHDDPQTVYTLSRLNHYNGRLIRACGWYPDILPRLYQRKYIQFSDRKVHESLVLPPQTNVRSLKGHLKHYSFQNAEGLIQKMQQYSTLYAEENRYKKDSSPFKALWHGAAAFIKNYLLKKGFLYGSDGLIISAANAQGSYYKYVKLYEHNRNMSVSLIITTYNRPDALALVLKSALAQTRLPQEIIIADDGSDRLTTEVVGKFTQASPVPVKHTWQKDDGFRAAESRNRAIAVATSDYLIIIDGDMVLDPSFIADHIVAAKKGRLIQGSRVILSKERTEAILNHPGLPLPELSFNSNGVKKRLSALRLTKLAKLLGKRGNRKHKGIKSCNMGFFRDDALAVNGFNNEFVGWGREDSEFAARCYHSGMKRHNLKFAGIAYHLWHNEAERAALPRNDALLQATLNEKKTRCERGVNEFLENPPAPDPQLELPIEENA

SEQ ID NO: 1885 - protein, 586 aa, Paenibacillus alvei
MRYQTISLCMIVKNEEHVLSRCLESVKGIVDEVIIVDTGSTDRTVEIAEQHDARVYSYKWENDFAAARNYALEYATCDYILSLDADEWLDNDSKALLLEPLEEDYYFLRIRNIIRAGVVETHSFIRLYKRAVGFEYEGALHEQIDIGKVAGAKGEHLPVYINHDGYTKINIEKKEKHMRNMGILEKEVKRDPSAFNYFNLGTQYKLVGQFDKAIEAYKIAYSSGANFVFSHKLIINLVQCLTIQKRYNDAIKIINDSIALHPEYTDFRFYQGSIYFEMKYFKDAERSFLTCLELGEVQNHLFTSVEGVGSYMAQAYLAQIYLEIGEKEKAQQHIVDSIKLNPIHVASLKIWLDMFLMSEPNDMLRQLLAVYTTSEQANVLLLALYQLRNPLFVEYINHVDSELDCEVKAWQLQVNGDLDEAKKIWLNTESISATSFRDVLYLAVVTRDELFYRNFEKNFNLRQKDNSFFRKVINGEDCSKLDINEEVRECFRDLCYDLLMLRNFDAIEGLIDNVKIPMLRFELASQLHKFQFTELALNVLCEPEKSVDQAAVFSLAADLLNELGDYGDSYHYLIQAIQKKEIMNII

SEQ ID NO: 1886 - protein, 261 aa, Limnohabitans planktonicus
MKTKTPSLCIGILTMNESRRIAKCIESAKFADQIVVVDSGSKDDTVLIAQSLGAQVHIHTDWKGFAEQRNRLLQYCSSDYIFFLDADEVITPELEKEIQTAVSSGLNGVWEILWLQIAYGKPLKYMKATGGVKRLFRTSNLFKFEGVVHENAVLHDTNTPVITCKSRLLHYSRETVYESLQKLAQYSQLGALKRANTGKKGGVLRGFASAFVSFIQLYIFRRGFMCGPQGFLFCFFIALECFFRYTMLHYDRSMLNKSFIR

SEQ ID NO: 1887 - protein, 271 aa, Dyella terrae
MTEFPITLAVITHNEADNIARCLDSVPFAAEKLVVDSGSTDDTVAIAQAHGARVVHQDWLGFGPQRNAAQAMCAHEWILFLDADEYLSPALAQELQEKLPALMASDIPAVVLRRSTVFMGAPMRWYLPSMGEKMARLYHRGRARWSDARVHESLKYDGDAPVLNGRFNHTNNPTLVHKQLKVLRYSELKCRDWLDKGKPVRMWQAPFVFWLAFIKDYVFRLGMLDGWRGFIVAQTAATYAMYKRMRYFEMRHNPESVALAEAALHRHGIDR

SEQ ID NO: 1888 - protein, 297 aa, Leptospira perolatii
MSVDSSKKQKKLVKGKKAKVANFSRTNQDRFLKKLSVAIITYNEEKNIGDCIRSCRDIADEIVVLDSLSTDSTKEICTSFPEVVFASQKFRGHVEQKNDAIRLCKNEWILSLDADERLSEELNESLRKFLESSASGNVDGFKVARLTFHMGRFIRFSGWYPQRKYRIFRKSKASWAGENPHDYLVVNGSGKKMAGDILHYSFQDLSQQVDTINKFSSIVAWTRSRKGKRFSVLRTIHKPIGKFIEIYFFKLGFLDGFPGFAIAVSSAYSTFLKEAKVYELGKGLIDKPSNVREDYGS

SEQ ID NO: 1889 - protein, 266 aa, Unknown
  Description of Unknown: Candidatus Hydrogenedentes bacterium sequence
MIRLPISVYIIGYNEEKKIKDCLESVSDIVDEIVFVDSHSTDSTVSIVREYTTKIYTRDFNSYTDQKNYAQSLCKNEWVLNLDCDERLSPEAREELLNKFPSIQENPEIVGISFPRLTFYLYKFLRHGGWYPDRKIRLVRKCCCAWEGKRLHEEMKCKGNIVPFQGDILHYSFDSVDDHLKTIMKFSEMGAQDLWDKGRRSSLCTMVARTFWTGFRKIFLEFAFLDGVAGIIMTGFSMAATWSKYSKLYLLQKKQILNQKGNSAVQ

SEQ ID NO: 1890 - protein, 271 aa, Dyella sp.
MQTLPITLVVMTYNEAKSIARCLDSAPFAAEKLVIDSGSTDDTVAIAQAHGARVVHQDWLGFGPQRNFATTQASHPWLLALDADEYLTPALATELQQKLPALMTSDVCAAYLRRATIYMGAPMRWYLPSMGEKMARLYHRDRARWTDARVHESLRFDGPSITLDARFNHENNPSLPEKQLKVLRYAELKCRDWLEKDKPVRMWQTPFVFPLAFIKDYVFRLGFLDGWRGYAIAQTAASYAVYKRMRYYEMRHNPASRESAANALHRHGLDR

SEQ ID NO: 1891 - protein, 289 aa, Lysobacter oculi
MTRTGRDVDGSCSMAAQVSSAAGFLYWRPLPADPAMSAPLPISGVVITHNEADRIGRCIASLVAVCDEVILLDSGSTDDTVRIARDLGARVEHRGWDGFARQKNAAIAMASKPWVLLLDSDEWLEADAHAELGSLFAGDIEQADVWTLQRRTHWLGQPMRFGSFAREPVHRLFRADLRHADVPVHEYLDVEGRVVKPSRIRLEHDTARSSAEYRGKLGKYARLWAEARAARGNTAWPGRGLLAAAAYALKNLILQGGALDGRSGIAFHREHMRYAALKYRLLRELARSR

SEQ ID NO: 1892 - protein, 290 aa, Leptospira elllisii
MGKSIPAKKKKASSPKGNPTLDSAGKKISVAIITYNEEKNIGDCIRSCLEIADEIVVLDSISSDKTESIARSFAGVRFFKQKFKGHIEQKNDAISLCKFDWILSLDADERVSPELKDSILKFKREMDGGSVNGFLVSRLTYHMGRFIRHSGWYPQFRYRLFKKGKAVWVGENPHDYISIEGNGGKFKGDIVHFSFRDLTHQVNTINQFSSIVALTRQRKGKKFSLLRTIYKPFSKFVETYFFKFGFLDGFPGWVIAISSAYSTFLKDAKQFELEEKFVERPSNLKEDYGN

SEQ ID NO: 1893 - protein, 531 aa, Helicobacter marmotae
MKIPISVSILVKNAEHTLKECLESLREFDDIIILDNGSTDKSCEIAKSFPQVNIKQSEFIGFGALKNLAMSYAKYEWILSIDADEVLEAQTLALIKANLTSMQTNQIYALPRKNLYNGEWIKACGWYPDYVYRIFNKTFTHFNDNIVHESLILPKNAQIITLQSGLKHYAYDNIAHLLDKLQRYSSLWAEQNTHKTSSPLKAITHGAWTFVRDYFFKKGILYGYKGFVISSCNALGTFFKYMKLYETQKDTPPPLCSLIITTYNRKEALAPVLESILHLRILPYEVLIADDGSKEDTKTLIQSYQARFPCPLRHIWHEDKGFRLSAIRNRAIQAAKGEYIIIIDGDMIVEQDFIKDHLAHAKAGVFLQGSRILLGEHITQTITQSPKHFDLAFCQSGIKGKLKDRLKAKRNALLASLILRFSCIKANVFDKKDLIKGIRGCNMSFYKQDCLAINGFNESFEGWGREDSEFVARFLFNGGQMRRLKFAAIAYHLYHEESKRELLATNHALYLQTLASRLTYCEHGIKHSDSI

SEQ ID NO: 1894 - protein, 522 aa, Haemophilus felis
MMSTLPISVTLLVKNAEKYLDACLSALQDFAEIIVLDNGSTDSTLDIATKFPNVKIHYHDFIGFGPMKNLAESLASNDWILNIDSDEILSQALVEELKSLDLSNKNKVYSFLRINHYRGKPIKTCGWYPDYVSRLYHRTLVKFNDKQVHESLVIPKRVDVVRLKHSFTHYSFDGATSLINKMQQYTSLFAEQQQFRKRTTVLSAVTHGVFSFIKHYFIKKGILSGADGFVISFANACGSYYKYVKLAEANQRLTTSLIITTYNRPDALEAVLHSVLYQTELPDEVIVADDGSTGETSAVIQRLQKDFPVPLIHSWQEDKGFMLAEARNRALAKVKKDYIVIVDGDMVLHPKFISDHKKAAKKGLFIQGSRVVLTEQKTQELLANGKTPRALKWYEKGLETRFEKRLSAIHFPLLTNFILNKEKQYKYQGIRGCNMAFFKEDAIAINGFNNDFVGWGREDSEFVARFFSHGGKRANIKFAAIAYHLWHNEAARDALPENDKLLKDAMEQKLTWCENGVDKFLE

SEQ ID NO: 1895 - protein, 308 aa, Acinetobacter cumulans
MPNKNLAVVILTHNESMHIQRSIESVKSIASEIFVIDSGSKDETVKIAEEHGAVVLHHPFVNYAKQFQWALDNAPITADWTMRLDADEIIEPDLQQEIQAKLHHLPSNIVGVNLKRKHIFMNRWVKHGGRYPLVLLRIWRTGHGRIEDRWMDEHMVISGGETVTFKGGFADHNLNDLTFFTDKHNKYATREAIDVINQKLNLFARDESLNTESASFQASIKRIGKEKIYNKIPFTIAAFAYFIYRYIFQLGFLDGRSGLVYHFLQGYWYRFLVGAKIMELEKAIEGMSDKKEILKEISRLTGHKLADD

SEQ ID NO: 1896 - protein, 266 aa, Nitrospira sp.
MKVSVYIIAYNEAGKIADTIKSVLWADEIVLADSASTDGTDRIAAEMGARVVQIPFKGFGHLRNRAVAACTHEWILSIDTDEQCTPDVRDEILALLAGSPAQDAYLVPRRNYFMGQWVAHSGWYPNFRQPQFFRKGAMTYVESPVHEGYELLTPKPVGRLKHAIWQVPFRNFEEVLKKANRYSTLGVLKIADKRVSMGQALAHGLWSFIKHYVFKKGFLDGWPGFVIAFGNFEGTFYRYAKRYEAQENWPLPTQPPLRRPGGSPSV

SEQ ID NO: 1897 - protein, 261 aa, Unknown
  Description of Unknown: Xanthomonadaceae bacterium NML07-0707 sequence
MTYCTAMHTQVPKLPLSAVVITHNEADRIGRCVASLLPVCAEVIVLDSGSSDDTVQISRDLGARVEHRDWDGFARQKNAAIAMASKDWVILLDADEWLEADAQQALRALFASELESADVWLLQRRTHWLGQPMRYGSFSREPIERLFRSHLRHADLPVHEYLDTQGQRVRASQIRLEHDTARNAREYREKLARYAALWAKARAGKRGGAVRGFLAAAAYAIKNLILRGGILDGRKGLAFHREHMRYAALKYRLLSEQNERH

SEQ ID NO: 1898 - protein, 518 aa, Campylobacter insulaenigrae
MDIKKISVIMIVKNAQDTLKQCLKSLKDFGEIILLINESSDESYDIAKQFQKHHSHLKIYHHHFIGFGALKNLALSYASNEWIFNIDVDEVVGEEIFSELSKIQVQTNQILLLARKNLYKNEWIKACGWYPDYVMRIFNKNHTCFNDNLVHESLIIHNNTQKIKLKSALTHYAFEDINALLDKLQRYSSLWALQNLHKDSGVLKALIRGGWTFLRNYFFKKGIFYGYKGFIISLCNGLGAFFKYMKLYELKLQKPHTCSLVITTYNQKERLALVLDSVKNLSILPDEVLIADDGSKEDTAKLIQVYQKDFPCNLKHIWQEDEGFRLSQVRNKAIKASKGEYIIVVDGDMILEKNFIGDHLKFAQKKVFLQGSRVILNEKESKELLEKNDFSLAFAKKGFKNKKNTFLAKCVYKFSKLNKIFFEKSQLIKGVRGCNMSFYKSDFEAIDGFNEKFIGWGREDSEFVARFLFNNGTFARVKFYALAYHIYHKENSKNMLESNHKIYLDTIKNKKITWKENE

SEQ ID NO: 1899 - protein, 254 aa, Campylobacter rectus
MLSVVILTLNSEKYLAEVLRSCEFADEVVVVDSGSQDATEQICSEFKNVKFHKQKWLGFSAQKQLGVDLARNHWVFVLDSDEVILEPLREEILQVLQRPGFCAYEVARANIFFGKEVRTMGLYPDYTVRLFDKTRAEFDGREIHEKVVLKSVAKTDEQTSADAANLTTAKNQIGRLKNHFKHYAYGSIEQFIAKQNRYSSLGAKGAKSSKFKAVLNPAWTFFKLFFLKGGWREGWRGYVIARLYSQYTFWKYVK

SEQ ID NO: 1900 - protein, 271 aa, Dyella sp.
MPTFSLTLVVMTYNEAKHIGRCLDSVPFASEKLVVDSGSTDDTVAIAQAHGARVVHQPWLGFGPQRNFATTQCSNDWVLALDADEYLSPELAAELEQRLPKIMASKLCAAYLRRSTIFMGERMRWYLPGRGEKMARLYHRDRARWADVRVHESLRFDGPSVLLKEVFNHENNPSLPEKQIKVLRYAELKCRDWLQKNKPVRMWQTPFVYLLAFVKDYFLRLAFLDGWRGFVIAQTGASYAAYKRMRYYEMRRNPASLQTATDALIRHGIDR

SEQ ID NO: 1901 - protein, 287 aa, Leptospira weilii
MGKSIPNKKKKIEKKQGTLSTGKKLSVAIITYNEERNIGACIESCLDVADEIVVLDSISTDKTEKISKSFPSVKFYKQRFKGHIEQKNDAIALCKHEWIFSLDADERISPELKNAILTFKQEPEDESLSGLQVSRLTFHMGRFIRYSGWYPQYRYRIFKKGKAVWVGENPHDYISIQGKGNKIHGDILHYSFRDLSQQVNTINQFSSIVALTRQKKGKKFSFLRTIYKPFSKFMETYFFKFGFLDGFPGWVIAVSSAYSTFLKDAKQYELENGMMERPSNVKEDYGN

SEQ ID NO: 1902 - protein, 281 aa, Methylacidiphilum sp.
MHVSVVILTYNSERTIIPTIESALAVSDDVHVVDSYSSDNTIKILSSYPVHIIQHPFEYYAKQRNWAIENLPLKKPWELHLDADEMLSPELIEQLKNLSLFLQNQIDGFYIPRVVKFLGKILKHGGIYPTWHLRLFRRGKGRCEDRLYDQHFYVQGQTAKLQAIMIDDIQMDLTEWIQRHNRWSDLEAQEIFVGGAQKKDESKWAAGSPINQKKTLKQFYYNFPLFIRPVLLFCYRYFIKLGFLDGIEGLIFYVLQTFWFRFLIDAKLWELSRKNKLLPNP

SEQ ID NO: 1903 - protein, 272 aa, Rhodanobacter lindaniclasticus
MPAFPLTLAVITRNEAAHIARCLDSVPFAAEKLVVDCGSDDDTVAIAQAHGARVVHQDWLGFGPQRNFAAGQCAHDWILVLDADEYLGRDLAEELQRRLPALMAGDAAAAYLRRSTVYMGAPMRWYRPSTGERMARLYHRGRARWSDARVHESLQFDGPAPTLRGSFLHTNNPTLVHKQLKVLQYAELKCRDWLDHGKPARMWQAPFVYALAFLKDYLFRLACLDGWRGFVIAQTAASYALYKRMRYYEMTRNPASVEQAANALRAQGASIE

SEQ ID NO: 1904 - protein, 299 aa, Bacteroides xylanisolvens
MKQSIAAVILTKNEEKHIVRCLKSLKGICDDVVVVDCFSDDRTTELAKEHGARVIQHEWKNYATQFNYGVYECGITADWIWRIDADEFLEGELGTAVKEAVSKCSNQVNGVYVRKRIDFMGHPLLHGGWYPSYHLKVFRRGHGECENRWMDEHIRLTDGTSITVNMGNQVDANLNNLTWWTDKHNGYATREMADMLMTEYAMDAKAREVVPKLFGTEEQRKRWLKIKYIKSPLFIRPFVNFTVRYILKGGFLDGKEGFIWHILQGFWYRMLVDAKVYELKKQCGWNEEMIKAYLKEKFS

SEQ ID NO: 1905 - protein, 259 aa, Hyphomicrobium sp.
MKRLPVSCFIIAKNEADRIEYAIHSVQSWVDEVVVVIDCASTDDTLAVARNSGCKVISQPWLGFGGQKRFGEDICRNDWLLNLDADEVVTLALQEEIRRLFEHKAPARRAYSIPIDLVYPGATAPRFWPRDHRYVRLYDRRVVRYRNSPIHDSVLTGDFAVGRLKASIHHHSIRSFAHLATKLDERTWLLVENAKSRTSLSLALRLPVEFQINFLKYYIFRHHFTGGWTGIKYSAIQSWYRLMKVYRLCITPRSRRNPT

SEQ ID NO: 1906 - protein, 511 aa, Campylobacter sp.
MKLSTKISVCILVKNAQDTIKECLESLQSFDEIILLDNQSSDDTLKIANEFKNKFGNLKIYSSEFIGFGPLKNLAISYASNDWIFSIDSDEVLELSALKELENLKLNPNNIYAMPRKNLYKGEWIKACGWHPDFVLRLFNKTKTKFNSNFVHESLEVGNLNVVKLKNGLRHYAYDNISVLIDKMQKYSTLWAKQNRYKSSTMTSAVLHGGWKFIRDYFFKSGFMYGYKGFVISFCNALGAFFKYAKLYELNHQMPSVSLVVTTYNNEKYLEQVLKSIESLDYLPNEVLIADDGSGKNTANLISKFKQNFPCELRHIWHEDRGFRASAIRNRAINSTKSEYIIIIDGDMVLDRNFILDHLKFAKKNQILQGSRVVLNESQTASIIGGGNVCEFKSFKSTRNAILSKLIYKSWAIKSDFFNKKDFIKGIRSCNMSFYKGDCMAIGGFNESFIGWGREDSEFVARFLFNGGELRRMKFAGIAYHLYHTENSREMLELNHQIYLDTIKNKRVNWQ

SEQ ID NO: 1907 - protein, 517 aa, Unknown
  Description of Unknown: unclassified Helicobacter sequence
MNLSKISVAILVKNSEKTIKECLDALKNFDEIILLDNLSDDNTLEIAKQFHNVKIYQSDFIGFGALKNLAISYAKNDWILSIDSDEVLDEDAIKSINDLKLDSHCVYALSRKNHYNGEWIKACGWYPDYVKRLFNKKEVSFNSALVHESLNVPKNFQEIKLKGSIKHYSFKDITQLLAKMQHYSSLWAQQNPHRFSSPMIAILKGFWTFIRNYLFKRGFLYGYRGFVISICNGLGAFFKYMKLYENSLTTPSVSLIVTTYNQKERLALVLDSILEQKLMPNEVLIADDGSGEDTKELILDYQNKFPIPLKHIWQEDCGYRLSKSRNHAISNAQGEYIIIVDGDMILSPFFIQDHLKFAKKSCFIQGGRIILNELETQSIMQEKNHKKALNKKIFKNQRNLILSKIIFYLSQKNKKNGIKKDKLLSVRGCNMAFYKEDAYAINGFNEDFIGWGREDSEFVVRFLNAGGEMRKLKFYALAYHLYHQENSRNMLKENHQIYIQSIEQSKKWCKNGLLKDT

SEQ ID NO: 1908 - protein, 513 aa, Pontibacter ramchanderi
MSQAISVTILTKNSQQYLADCLQALHRFAEIIVLDNGSADETLAIAARFPNVRIVEHPFIGFGPMKNLAAQHATHAWVLSVDSDEVLSPQLADELLALNLGDTRQVYSFLRHNFYGKKHIKACGWDNDYVLRLYHKGTTRFADLPVHEHILTEGMQVQRLQGTMDHFSFNSISQLIGKMDQYTTLFAREKRFRKNSSPAKSCFKWAFSLFRNYVMQRGFLYGYEGMAISFSNANGTFYKYMKLHEENQRLGISLVITTYNWKEALGTVLQSAFNQSELPREIIVADDGSRDDTRALVERLAKESPVPLLHSWQEDLGFRAAESRNKAIAMATGEYVVIIDGDMVLHPDFLKGHRRAARKGYFTQGKRVLLSPSLSQDLIQRGPKVISPISSGIKNRLNATNAPFLSSLFSKEKTGIASIKSCNMGFWMEDIIRVNGFNEDFVGWGREDSEFAIRLLNSGTKRQNLAFGGIAYHLHHQENSRQSLAANDILLERAISEKSTFCPNGIDKHLTTA

SEQ ID NO: 1909 - protein, 255 aa, Chthoniobacter flavus
MPLNLSIAIISLNEEANLRRCLQSAADLAKEIVVVDSGSTDKTLDVAREFGARVQHQDYLGQRDQKNVAVSLCTQPWVLLLDCDEELSPELKAAIIAFFEKSDAERYVGAKMARKVWFMGRWITHGDWYPDRKLRLFRRDKGRCGGNAAHDKVEIEGPVTTLNGDLHHYSFRDMRHYVSKINTFADAFLEKQKSEGARWSLAATLFRPWWRFFRAYVIRRGFLDGFPGLWIAVATAFFAFVRYSRKYEDEAMNGD

SEQ ID NO: 1910 - protein, 271 aa, Rhodanobacter sp.
MPTLPLTLAVITHNEAGSIARCLDSVPFAAEKLVVDSGSDDDTVAIARAHGARVIQQDWLGFGAQRNFASNQCSHDWILVLDADEWLSPELAVELQQRLPGLMAGDAPAAYLRRRTIYMGRPMRWYRPNVGEKLARLYHRGRARWSDARVHESLRFDGVAPTLRAAFDHANNPSLAHKQLKVLRYAELKCRDWLDRRKPVRMWQAPFVYLLAFLKDYLFRLAFLDGWRGFLIAQTAASYALYKRMRYYEMVNHPESVASAAALLHKHEIDR

SEQ ID NO: 1911 - protein, 271 aa, Rhodanobacter sp.
MPTLPLTLAVITHNEAENIARCLDSVPFAAEKLVVDSGSDDDTVAVAQAHGARVVHQDWLGFGPQRNFATTQCAYDWILVLDADEYLTPELAAELQERLTELMASTAPAAYLRRSTIYMGQPMRWYRPAVGERMARLYHRGRARWSDARVHESLRFDGIAPTLRAPFNHVNNPTLPHKQLKVLRYAELKCRDWRDKGKPVRMWQAPFVFVLAFLKDYLFRLAFLDGWRGFMIAQTAASYALYKRMRYYEMINNPESVAQAAHILTQHGIDR

SEQ ID NO: 1912 - protein, 257 aa, Unknown
  Description of Unknown: Betaproteobacteria bacterium sequence
MSDPLSPLALTVVVITRDAGAEIAACLDSAAFAAELIVVDSGSRDDTVEIARHSGARVIEQAWLGFGAQKNFAVAQARHDWILSLDADERVSRDLAASIGAALAKPRHTAYAMARCNRFLGRWLRHGEGYPDWNVRLFHRAHARWSDDVVHEHVIAEGSVGKLGGDLLHASAESLEAYLTKQNRYTTLQAEALYARGERFSALRFVFSPVLRFLRFYVLRAGFLDGTAGLAHIVIGCFNSFCKYAKLRALEQAQRAR

SEQ ID NO: 1913 - protein, 272 aa, Rhodanobacter denitrificans
MPTFPLTLAVITRNEAGSIARCLDSVPFAAEKLVVDSGSEDDTVAIAQAHGARVVHQDWLGFGAQRNFATTQCAHDWILVLDADEYLSPALAAELARRLPALLAGDAPAAYLRRRTIYMGRPMRWYRPNVGEKLARLYHRGRARWSDARVHESLRFEGAAPTFDAPFDHANNPTLAHKQLKVLRYAELKCRDWLDQRKPVRMWQAPFVYVLAFLKDYLFRLAVLDGWRGFLIAQTAASYALYKRMRYYEMVNHPESVASAADLLHQHDIDRR

SEQ ID NO: 1914 - protein, 262 aa, Piscinibacter caeni
MPTVSLYIIAYNEAEKIREAIATALWADEIVLVDSHSTDGTAEIARSLGARVVDVEFKGFGDLRNQAISHCTGDWIFSLDSDERCTPEVRDEVRAIMADPNALDVYLVPRRNFFMGRWIRHSGWYPNFRQPQLFRRGAMAYTLEPVHEGYRLLTDKPLGRLKNAIWQFPFRNLHEVIRKFDRYSDLGAAKVAPGRASMPRALASAFWAFVKHWIFKRGVLDGWPGFVIAFAYGEQTFYRYAKRWEQDAGWQVPVQPPVRRAD

SEQ ID NO: 1915 - protein, 670 aa, Paenibacillus cellulosilyticus
MRRAELPGVSLCMIVRNEAAFIEACLMSARPYVAEMIVCDTGSKDRTVEIAQSLGAQIVRWEWTDDFAAARNYALSFASQPWILVLDADERLEPAAMQVWERLLLADDQWGYYIRLISRLARTDAEQEESAVTDAVCRLFRNDERIRFAGIIHEECATAAAALQGGPLAIAPLTIRHEGYRADVMEERRKVERNLRLLSKALAQRPNDPLLRYAVGTELLSAGRWLEAAEWLHPLVGQLDDACGFASDVYLKLSHACRMAGRLDEAASVAEAGLQLYGDFPDLYEALAAVHIARDDARSALQVLQQASAVGEAAPYYSSVEGAGGYRTLYAAGAACEQLYEWQEAAAYYAAALRQRPGLERAWIRLLALYQAVEGEAAYGMKELWQAAVECLLHLNVRVRREEAAPGGGQRELERVRLRVAQLLLQLHEPDRCGPYIERLVEGAGGPGVQLLGWLRLQQGDLVEAERCWLAVEQQRLLGGEWAKLGVVLRCCASDGQGGTLAVSGEAQLLAGDWAGWLERVERAASVGAEEQSLPSMLQFGVLLHSVGWSRGGGDAEGDGSPTGLGGRAGYVWPGAPPRIGGPPFEAELAAGLLAAAVGRWREACDCFAAARSAAAQPAQGRAAASALAAAFAARASETLAGSEHGSLLPQALRSWNELRLIGLTALYPP

SEQ ID NO: 1916 - protein, 257 aa, Hymenobacter oligotrophus
MPAVPLSVVIITFNEEANIGRCLAALGDVADDVVVVDSGSADRTVAICQEHSARVVHHPFEGYVQQKNFATAQARHDYVLQLDADEVLTDELRAEIRQIKADWRAAGYTLPRLTNYCGHWVRHGGWYPDRKLRLYDRRLGSWQGHLLHERYELTPGQLVQPMRHDLLHYSYHSIEQHVAQFNRFSSIGAEELAARGKRAATWQLWLKPVWKFVHMYFLRLGMLDGFAGLSIAYLSACSVFVKYAKLRVINQQDAARS

SEQ ID NO: 1917 - protein, 299 aa, Chitinophaga sp.
MKISVIILTYNESKHLARCLESMRQVAEEIYVIDAFSTDDTLEIAARYNAKVHQRKWINYADQFQWALDNCDIRTPWVMRMDADEYLEPALVKEINSIEIPAKVTGIYIRRKVLFKEKWIRYGGFYPHTLLRIWRNAAGSIEQRWMDEHVVISGGETMQLKEHIVDHNLNSIHWWVNKHNNYAIREMVDLLNIKYRFLEEDKRLLGSESSQARRKRFLKEKVYSALSPGARASLYFCFRYFLRFGFMDGYRGFVFHFMQGYWYRLLVDVNLKEFEDKLQGDTSRERLIELLRKDYNIAI

SEQ ID NO: 1918 - protein, 522 aa, Neisseria animalis
MTPTPPIPATAAILVKNSEPHLAEVLDALADFDEILLLDNGSTDRTLEIAAQFANVRCCYHEFDGFGPMKNRAAELAKHDWIFSIDSDEVADEVLIGGIRAAVAENNPRKIFMLSRLNHYNRRLIKACGWYPDVLPRLYHREFTRFSDRQVHEALILPPESVKQVLPGCLKHYSFENAEGLVKKMQQYSSLYADENQYKKPASLSKALLHGGVSFIKNYLFKRGFMYGADGLTISIANAQGSYYKYVKLYERNRRLSTALVITTYNRPDALEKVLQSALAQTRLPDEIIIADDGSGEETAEVVRRFRQVSPVPVKHAWRPDDGFRAAEARNRAIAMAQSDYIVLIDGDMLLEPHFIADHIDRAHKGRLIQGSRVLLTETRTREILSENGLPKLSAWSKGIGKRISAVRCRFLSSYAGSRGSCQHKGIKTCNMGFFREDALAVNGFDNEFVGWGREDSEFVARCYHNGMKRHNLKFAGVAYHLYHHEAERDALPKNDVRLQTTLSNRTVRCENGIDAFLSEDR

SEQ ID NO: 1919 - protein, 291 aa, Xylella fastidiosa
MRMEREDHSPQAESAVLLPMSLVVMTYNEAANIARCLDSVPFVSEKLVVDCGSTDETVEIARAHGARVVEQAWLGFGPQRNFASEQATYDWILVLDADEFLSHLLREECLRRLPELLLDEGREKPLAAIWLRRSTWYMGAPMRWYRPMVGEHLARVYHRRRAFWTEVRVHESLCFDGRSAEFVAPFHHLHNPTLVHKQLKVLRYAELKALDWNSKARSARMWQAPLVFVAAFLKDYVLRLAILDGWRGFVVAQTAASYALYKRMRYYEMRRNPDSIQQARTQLCKHRLEHE

SEQ ID NO: 1920 - protein, 258 aa, Mariprofundus ferrooxydans
MTELSVYIIAYNEADKIADAVKSALWADEVIVVDSHSSDNTAEIAAALGARVVQLDFEGFGKLRNDAIAACKHEWIFSLDADERCTSEAAEEIRNIIADPASADAWYVPRKNWFMGRWIKHCGWYPDYRQPQLFRRGALSFEQADQVHERYHIHGSTGHMQTPIWQFPFKNLEQVLHKANRYSTLGVDRLENKGVRAGMGKALLRGLWSFFRIYILKRGFLDGWAGFVIAFSNLEGVFYRYAKLRERQQRWDLPPDRE

SEQ ID NO: 1921 - protein, 232 aa, Nitrospira moscoviensis
MKACLESVAWADELIVVDSHSTDKTAAIAREFTDKVYQVDFKGFGHLRNQAVSFCTHDWVFSLDSDERMTPELREEIRLVLDAGPKADAYFVPRKNYFLGRWIKHCGWYPDYRQPQLFRKGRFRYRDEVVHESFDCDGPVGYLTKPAIQIPFRDVDHFLAKHDRYSDLMARRMKEQGRRFAAHQLVTHPTGTFVKMYLLRQGFRDGMPGLILSGLYAYYTFVKYAKLWEQTR

SEQ ID NO: 1922 - protein, 272 aa, Dyella sp.
MAPLLPLTLVVITRNEAQKIARCLDSVPFAAEKLVIDSGSTDDTVAIARAHGARVVHQDWLGFGPQRNVAATHCSHPWILALDADEYLTPELAGELQRRLPALMESDTAAVILRRHLIYMGKPMRWYRPAVGEKLARLYHRDRARWSDVRVHESLTFNGRSLTLQAPFLHDNNPSLVEKQLKVLLYSELKCRDWSDKNKSTRMWQTPFVYAFAFVKDYVLRLGLLDGWRGYVIAHTAASYAIYKRMRYYEMRLNPASRDTAAAALTRAGLDH

SEQ ID NO: 1923 - protein, 263 aa, Unknown
  Description of Unknown: Dyella sequence
MAREPLSVVVTAFNSAATLDACLASVRWADEVVVLDSGSTDATLAIAAHYGARIETQPFAGYSAQKQAAIELARHDWVLLLDSDEAMPPGAAEAIHRVLEQPAHAGYLLWRREWIFWQWQSPRSRLNHYVRLFDRRRARMSRHRVHEEVEVDGSVGVLDIVMDHYGERDIAGRVDKANRYSSLQVADLAGRRARGLRLRMLTNAWAAFFRYYLLRGHYRSGWAGFIAARIHAFYAFLKYAKLYEATRVESKETRIPAAERKDG

SEQ ID NO: 1924 - protein, 259 aa, Acidisarcina polymorpha
MLDSGSSDETVAIAQEFGARVFVEPWRGYGPGVNSAIDKCTGDWIFTLDADEVATPELSAEIQTLLNHSGNGVVSQPIRTADQSSRLRHSEPQYDAYWIPRLNLILGRWMWHGGVYPDPKLRLFRRGTARLREDTEPHATPKWDGPAGRLKSHMLHYAYPNLAMYLEHMDRYSTASVPLMLRRGKTSQSLPEFVLNMFLNPLATFLYNYVFRLGFLDGREGFLFHLNHSVYVNWKYVKAWQAAKQIAIDAAEPSSTIQG

SEQ ID NO: 1925 - protein, 271 aa, Dyella sp.
MPTLPLTLVVITYNEAKNIARCLDSVPFAAEKVVIDSGSTDDTVAVAQAHGARVVHQSWLGFGPQRNFATTQCNNDWILALDADEYLSPELAAELQQRMPGLMAGNVCAVFLRRATIYMGAPMRWYLPAMGEKMARLFHRDRARWADVRVHESLRFDGPSVTFKARFNHENNPSLPQKQLKVLRYAELKCRDWLEKGKPVRMWQTPFVFLLAFIKDYFLRLAFLDGWRGFVIAQTAASYAAYKRMRYYEMRRNPASVETANDALIRHGIDR

SEQ ID NO: 1926 - protein, 292 aa, Acinetobacter soli
MHIERAIKSVQSIASEIFVIDSGSKDATVKIAQKNGATVLYHPFINQAKQFNWALDNAPITASWIMRLDADEIIEPDLALEIQQKIPQLDANIVGINLKRKHIFMDRWVRFGGRYPLILMRIWRTGYGRVEDRWMDEHVVISSGETTTFDGGFADHNLNDLTFFTDKHNKYATREAIEVLNHKYQLFNQDKSLNSDSTSFQASFKRNIKEKIYNKLPFTLSAFAYFMWRYIFQLGFLDGRSGLTYHFLQGYWYRFLVGAKIMELENAIEAMTDKREIIKKISNLTGHSLDTE

SEQ ID NO: 1927 - protein, 273 aa, Unknown
  Description of Unknown: Lentisphaerae bacterium sequence
MPAEPVPNLSAYILTCNNEETLAGALRSVSDLAEEIVVVDSGSKDSTLDIAKQYTDRIIHQPWQGFRDQYQFAQDQCRGEWVIFLDADEELSPQLGEEIRLELARNQQRPSHAQIAGYRIPRRTFFLDRWILHGAWSSDQEIRLYKKTLGRWEGGLHACVHIHDGAVATLRNFYYHFSYRNISEQIEKLNHYSTETAKEACSLGKTSIMNVISHPIWRFIKDYFLKAGFLDGMPGLVIAVNDAWYTFNKYAKSWELAYCQEERIKKIRDEERP

SEQ ID NO: 1928 - protein, 794 aa, Selenomonas sputigena
MKLSACVITKNEEENIGTWLTSMKKIADEMIVVDTGSTDRTVEMAKEAGARVFHHAWQNDFAAAKNCALEKAKGDWILFLDADEYFSPQTIAKVRPLLLEVEKSTKPIVGVICRLVNIDKDQGNRFTGAIFQLRIFRNSPDLRYEGKIHEHVVDAHRAEHEMFVTPKLVIFHTGYSQHIVRKKLERNLDFLRQKEEAEGESVDDALHYMDCYYGLGDFAKAVEYAQKAIASKIVYMGREGAEYWGLVRALLAQKRPKEELVPVLQEAMEKYPDLAEFPMEFGLLAWEERDYLLAEKMFRRGMACREKVPTSLRADNSLQMFPFVCLSLGKIEAMKGRPAEAFDYFLRAVKEYPYDTRIFLALYDALAGQKPADVIALLDTLYDKERDAPFITAALAMRELTHVALYYARFLPPEKRDEVLLYRAAGRTDAAAVELSARLKSFSSLLAEAKGETGVLPEEDAVSLLLAEPYKRHWRRKALPLVSIMIPTYNRPKFFELALQSALRQKYENLEIIVCDNGTDDRTEALIEKYLGDPRLCYHRNRTAKTKEENFAPFEHLAKGEYLQWLMDDDILLDGKIEKMMQAFRENPAARLVTSRRAQIDGEGRVQPNPCTEGVPESEADYSVFEGEAVGRETLLGCRNFLGEPSAVLFRRADLKHHYWRAESRGYKTISDVAMWLKLLEGGDCIFFQKPLSCYRRHEEQEGQQAEVILLSRLEWLRLIKEYFERRIYVATEEEYAQPLELLYGEYLEERDRFDRAAAGEMWREYEEAMRSTRRTLEKMKKKERAHGKREGKR

SEQ ID NO: 1929 - protein, 251 aa, Escherichia coli
MELVSIIIAAYNCKDTIYATVESALSQTYKNIEIIICDDSSTDDTWDIINKIKDSRIICIKNNYCKGAAGARNCALKIAKGRYIAFLDSDDYWVTTKISNQIHFMETEKVFFSYSNYYIEKDFVITGVFSSPPEINYGAMLKYCNIACSTVILDRTGVKNISFPYIDKEDYALWLNILSKGIKARNTNLVDTYYRVHAGSVSANKFKELIRQSNVLKSIGIKAHHRIICLFYYAINGLIKHCFSYRDKRNA

SEQ ID NO: 1930 - protein, 249 aa, Halomonas sulfidaeris
MLAELSAVIITRNAAATLARTLDALEAVGEVIVYDNGSTDETLDIARHYANVSLHQGEFLGFGSTKRHAVLLARYDWILSLDADEAPTVQWLESLADWLPGADLEQVVEVHRENQLLGKPVHHSGWGDDWLIRVFHRSRHNFNDAVVHESVMVNRTTQTVRLEGCLEHLAITDLGQFLDKINRYSTLRAQSDKLRVYPVAFILLKAMFAFWRAYLLQRGFLDGWRGLIIAVANANGVFWKYMKRRVRDL

SEQ ID NO: 1931 - protein, 511 aa, Campylobacter sp.
MKLSTKISVCILVKNAQNTIKECLESLKSFDEIILLDNQSSDDTLKIANEFKAKFNNLKIYSSEFIGFGPLKNLAINYASNDWIFSIDSDEVLEFQALNEIANLDLNPQNIYALPRKNLYKGEWIKACGWYPDYVLRLFNKTQTKFNSNFVHESLEAKNLNIIKLKNGLRHYAYDDISTLIEKMQKYSTLYAIQNRAKKSNISKAVLHSVWKFIRDYTFKNGFLYGYKGFVISLCNALGAFFKYTKLYELNSKKPSVSLIITTYNSEKYLEQVLKSVQNLDYLPMEVLIADDGSGVATKNLIERFKSNFPCKLRHIWQEDKGFRLSQIRNKAINSAVGEYIILIDGDMVLEPNFILDHLKFAKKKQFLQGSRVVLDESQTGFIIQGGDTSEIKNFKSKRNILLANLIYKSSAIKANFFKKRDFIKGIRGCNMSFYKIDCDEIGGFNENFIGWGREDSEFVARFLFSGGELRRLKFFGIAYHLYHAENSRKMLESNHQIYLNTIKEKRVKWR

SEQ ID NO: 1932 - protein, 299 aa, Leptospira wolffii
MTETAHSKEASPIKKKKKTKGISRTSDTIKERFSKKLSVAIITYNEEKNIRDCILSCRDLADEIVILDSDSTDKTREISISYPEVRFSSQKFKGHVEQKNDAISLCKNEWVLSLDADERLSEELKESVRKFLESPEDRELNGLKVSRLTFHMGRFIRFSGWYPQTKFRIFRKNKAKWIGENPHDYLSVEGQGKKIPGDILHYSFQDLSQQVDTINKFSSIVAFTRWKKKKRFSLLRTLVKPFVKFVEIYLFKFGFLDGFPGFVIAISSAYSTFLKEAKVFELGRNIIERPSNLREDYGK

SEQ ID NO: 1933 - protein, 256 aa, Hyphomicrobium sp.
MSRLPISCFIIAQNEADRIVRTIRSVEPWVDEVVVVDSGSTDDTVSVAQGAHARVISQTWLGFGRQKRFAEEQCHHDWVLNLDADEVVSPELRTKITELFRSGEPAREAYGMPIHVVYPQRSKPRIWARDHWCVRLYNRQVVRFRDSHVHDTVVTDGHAVGRLTAPIHHFSIRSFDHMRAKLDRRMSLAAEHASITSPALTLARLTIEFPLNFYKYYIVRRHITGGVMGVRYAALQARFRAAKVYRLWRRHRRPHA

SEQ ID NO: 1934 - protein, 271 aa, Dyella soli
MPTFPLTLVVITHNEANAIGRCLDSVPFAAEKLVIDSGSTDDTVAVAQAHGARVVQQPWLGFGPQRNFATTQCQHDWILALDADEYLSPALASELEQRLAELMASDICVAYLRRATIFMGAPMRWYLPSVGEKMARLFHRDRARWTDARVHESLRFDGPSVLLKAPFNHENNPSLPQKQIKVLRYAELKCRDWLEKDKPVRMWQTPFVYLLSFIKDYLFRLGFLDGWRGFVIAQTGASYAAYKRMRYYEMRRNPASLDSATDALVRHGIDR

SEQ ID NO: 1935 - protein, 252 aa, Halomonas sp.
MPIPASVSVVIITRNAAATLRQTLDSVQDFDDVVIYDNGSSDDTLKIAADYPNVTSYEGEFLGFGPTKRHAVSLAKHDWIVSLDADEALSPILVEAILAWVDKALPNDLGQVLRENWMMGRPVRHSGWGNDWLIRLFNRQCHNFNDAMVHESIALSQHSRVQRLTGTITHTAVTDLSQLLEKVNRYSTIRADSGKLKAYPVPIVFIKALFAFIRTYLLQRGCLDGWRGLVIAVSNANGVFWKYMKNYLKTNR

SEQ ID NO: 1936 - protein, 270 aa, Rhodanobacter sp.
MTLPVTLALIARNEAAVIGRCLDSVPFAAEKLVVDSGSTDDTVAVAQAHGARVVHQDWLGFGPQRNFATTQCGNDWILVLDADEWLSPQLAAELERALPALMASAAPAAYLRRNTVYMGKPLRWYRPGVGEKMARLYHRDRARWSDARVHESLQFAGAAPVFKAPFNHANNPTLVHKQLKVLRYAELKCRDWLDKGKSARMWQAPFVYVLAFLKDYFVRLAFLDGWRGFLIAQTAASYALYKRMRYYEMTRNPASVAQADAALREHRLED

SEQ ID NO: 1937 - protein, 271 aa, Rhodanobacter sp.
MPTFPLTLVVITHNEVENIARCLDSVPFAAEKLVIDSGSDDDTVAVAQDHGARVVHQDWLGFGPQRNFATTLCANPWILALDADEYLTPELAIELQQRLPELMASKLPAAYLRRSTVFMGAPMRWYRPAVGEKMARLYHRDRARWSDARVHESLCFDGTVPTLRAPFNHVNNPTLVHKQLKVLRYSELKCRDWNDKNKPVRMWQTPFLFLLTFVKDYFLRLGFLDGWRGYLIAHTAAVYAVYKRMRYYEIRQNPESLPRAATALTRHQIDR

SEQ ID NO: 1938 - protein, 266 aa, Thioflexothrix psekupsii
MTVKISAYLIAFNEARKIKAAIESVLWADEVVVVDSFSTDNTADIAQQLGATVVQVPFSGFGELRNAALAACAGEWIFSLDCDERCTAEVREEILTVIANDTPPHELYLVPRRNFFMGRWIRHSGWYPNFRQPQLFRRGAMSYSLDAVHEGFVSHSQLPVGQLQQAIWQMPFENFHEVIRKANRYSDLGAVRLQQRQVTMGMALRHGLWAFTKHYVFKAGFLDGWAGFVIALGNFEGTFYRYAKAYEKQQHWSLPASSPLRRSDES

SEQ ID NO: 1939 - protein, 256 aa, Hymenobacter sp.
MPALLLSVVIITFNEEANIARCLQGLGNIADEVLVVDSFSTDRTMAICQAHGVRVVQHAFEGYVEQKNFATDQARHNYVLQLDADEVLTDELRQNILAVKNNWQHAAYSLARLTNYCGTWVRHGGWYPDRKLRLYDRRLGRWQGLLLHEYYEVQPGQTTGALAGDALHYSYASVAQHVSQLNRFTSITAQELALKGKTRVTLFQLILKPLWKFLYGYVFRLGFLDGFAGLSIAAISATGVFLKFAKLRTGTQNARA

SEQ ID NO: 1940 - protein, 260 aa, Desulfobulbus propionicus
MNKLSVYIIAYNEADKIEAAVNSVLWADEIILADSFSQDDTAAIAERLGARIVQVPFQGFGDLRNQAMAACSHEWIFSLDSDERCTPEAQQEIRSTLQAPQADAYYIPRKNFFMGRWIQHSGFYPDYRQPQLFRKGALHFKNDPVHEEYEVRSDKPVAYLNNAIWQLPYKNLEEVVHKANKYSTLGAEKLEQRGKTGGMAKALGRGLWSFFHMYILKKGILDGWPGFIIALGNFEGTFYKYAKLHERLAKWEPPASPPLR

SEQ ID NO: 1941 - protein, 290 aa, Leptospira gomenensis
MGKSIPAKKKKASSPKTKPALDSAEKKISVAIITYNEEKNIADCIRSCLEIADEILVLDSISSDKTESIARSFPSVRFLKQKFKGHIEQKNDAISLCKFDWILSLDADERISPELKDSILNFKKEREETGINGFLVSRLTFHMGRFIRHSGWYPQFRYRLFKKGNAVWVGENPHDYISIQGKGAKLKGDIIHFSFRDLTHQVNTINQFSSIVALTRQKKGKKFSLLRTIYKPFSKFLETYFFKFGFLDGFPGWVIAVSSAYSTFLKDAKQFELEQKFVDRPSNVKEDYGS

SEQ ID NO: 1942 - protein, 287 aa, Vulgatibacter incomptus
MRIGGFVIHGNNRSTIGACLDSLLAVSDEVIAIDSSSTDGSAEIVKSKGVRSLDIPWQGYGIARAAAVRELEGCDYVFFLDSDERLAPGAVEIFQEWRRSNPTLPYYRLALRDWADLPTGSFVLRTEWKTRIMRRDIANWQPEMIVHETLPDRECAPITAVIDHQFVTSIQTLVDKQDWYARLWAVQAHAEGKRADPTFLKRVGHVIRNCVVKGGLARGGLASVRLAWAVSRYHARKHQYLRLVQNGGLPEMVTAYREKRFLDLYALRNTPAGGAKPAPGQEPRPTA

SEQ ID NO: 1943 - protein, 599 aa, Helicobacter macacae
MNNAGKISVCIIVKNAQKTLAECLESVRDFDEIILLDNGSTDKTLQIAQEFNATYKNLRAKQSEFIGFGALKNLCVSYAKNEWILSLDSDEVLELDALNEINALDLEPNQIYALPRKNLYNGEWIKACGWYPDFVWRIFNKNFTRFNDNAVHESVMIPPTAQKIHLKGAIKHYAFANIDSIIAKMNRYTSQSAQEKLKNGRKTSFFSAFARLHFVFFKDYFLRKGFLYGYKGFIVALLNALGAFFRYAKLYELSKDKKEPKVIAFDRRLGVGDIISSIPAFYITKQLYPQATFILITNKIGASLCRNFDFIDKFIIEGVDFEIKDFAKVVDENEVEVLLLGHRSSANIKLAKQSKCPKIITWRHLHSIFSQRFIHPKHIKRSQRLEILRCLDLVRMIDAPKYDKNIDKFELKSLPIQIQTDRKNKIFVDEFLSDAKKYEKIIAISPFGISSAKYNLAIDDWISLVKNLAKKFDKALFVFMNFRGSGYDFKPFMEENIKVFVNNDDLLNLVELTSRVNLCISLATGNIHIADNLGIDTLGFFAYTDEFLFPCGNYGGNFEVLYLPKDWEKDYEYYKNSFYQKAQKCVEKTLLGHKNKKEK

SEQ ID NO: 1944 - protein, 203 aa, Unknown
  Description of Unknown: Proteobacteria bacterium sequence
MHKVSAYIIAFNEAEKIADAVASVLWADEIVVADSGSTDATAEIAQGLGARVVQIPFHGFGDLRNRAIAECRHEWIFSLDSDERCTREVRDEILGILAGEPPHDAYLVPRRNYMMGRWIRGSGWYPNFRQPQLFRQGAMRYDDGPVHEGYQLLTARPLGSLRSAIWQYPFRNLEEVIGKMNRYSSLGVRKLAGKRVSMGGALG

SEQ ID NO: 1945 - protein, 433 aa, Unknown
  Description of Unknown: Oribacterium sp. KHPX15 sequence
MKISQAMIVKNEEKNIGKALGCVKGVAFEQIVVDTGSTDDTVRIAEEAGATVYRFKWIDDFAAAKNFAIDKCKGDWIVFLDADEYFEDASNLCEVISKAEEKKEYVIASKLLNLNDEGKVIGTITQPRVFKNHVGIKYEGKIHEHLKNDQPTDIYDATDELIIYHTGYSETVYNEKNKDKLYKTMLEKAIAENPGDSDLYGYLGDIYAKNKKYAKAEELYFKSIKYMDDKVTEESERRGDTLRHLLMILGEDKKRTGDILKIYNYARAILPHDADFSCVVADHYYRFKKYIKAADYYKEAIDIYDKYGSFQRSDHVEAYFPKICSKMLDSYYQEKEYTKVVEESGYCIGKQKYNAEYLGYLMSAFKALRQNGNVELKTQDEIKIINDLYDLGTIKDKAFVFVNSYKTDDKEVFEHVISLCSAAELEAFKQQLL

SEQ ID NO: 1946 - protein, 528 aa, Helicobacter jaachi
MSNIPISVTLLVKNAQDTLAQCLQSLQAFDEIILLDNQSSDDTLKIAQDFNQTFKNLRIYQSEFIGFGALKNLAISYAKHDIILSIDADEILESSALEWIQSHLDSMQPNHIYALPRKNLYRGEWIKACGWYPDYVWRIFNKQFTRFNDNIVHESVIIPPNAKTIKLPYGLTHYAYENIAQLLDKLQRYTTLYATQHTHKSASPLKATIRGLWSFVRNYFFKKGFCYGYKGFVISLCNALGSFFKYMKLYEANKPSPSDCTLIVTTYNQKERLALVLDSIKALNPLPKEVLIADDGSAQDTRELIESYMPHFPCALKHIWQEDRGFRLSAIRNLAIKAAQGKYIIIIDGDMILESHFIKDHLRAAQRGVFIQASRVILDAKTTQHIMDSHNFRKAFAKKDFKATRCALLSALIFKTSKINARFFAKKDFIKGIRGCNMSFFKADCVDINGFNEAFVGWGREDSEFVARFLFHGGQLKRLKFAAIAYHLYHKENTRDMLASNHAIYLDTIKHKSHFCAQGLKHTTSQGE

SEQ ID NO: 1947 - protein, 266 aa, Unknown
  Description of Unknown: Candidatus Nitrospira inopinata sequence
MKVSAYIIAYNSADRIADAVNSVLWADEVVVADSHSTDGTDRIAQALGAKIVQIPFEGFGHLRNRAVEACQHEWIFSLDTDEICTPEVRDEILALLSRTPAHDAYLVPRRNYFMGRWIKHSGWYPNFRQPQLFRKGAMQYMELPVHEGYELLTDKPVGRLRHAIWQIPFRDFEEVVKKANRYSTLGAQKLDGKRVSMGAALWHAMWSFLKHYIAKRGLLDGWPGFVIAFGNFEGTFYRYAKRFEQQEQWAIPKQPPLRRPDHLSSG

SEQ ID NO: 1948 - protein, 255 aa, Desulfobacter postgatei
MSPFSAGKLSVYIIAYNEADKIEDALKSVVWADEVVVADSFSTDDTAKIAQDYGARVVQIPFEGFGQLRNDAINACSHNWVFSLDADERCTQDAKQEILQIINDPDSLDAYYVPRRNYFMGKWIRHAGFYPDFRQPQLFRKGALKFMPDAVHERYEVLSDRKCGYLSSSIFQIPFKDLEEMFRKMNRYSTLGAQKLDAANQRSGIFNALAHGVWAWFSMYILKLGCLDGWPGFIISLSSFESTFYKYAKLHLKQK

SEQ ID NO: 1949 - protein, 279 aa, Unknown
  Description of Unknown: bacterium BMS3Abin08 sequence
MKAKMSKLKDGLSVVVIAKNEENILNRTLRHITGIADEIVFIDTGSHDNTVEIAGKFRCRTFEFQWCDDFSKAKNFGVEQARYKWILNIDCDEVLYDKNAKLLIEKACRINNKPAYIIWQDNLYDNGGVGQVKVMRLFRNDPGIRFRNHVHESICESVYRNWPGYKPEVVDIHLRHYGHLSFNATGKHERNIGILRKWIESDPDNIYANYKLAMTLFETGRIEESLPQFEKTFDVISEVKDKNTYPFIGDFMNFYYRILVDSGFAEKACGLRGIVEAWV

SEQ ID NO: 1950 - protein, 255 aa, Hymenobacter sp.
MRAVPLSVVIITFNEEANIARCLEAVRGIADEVVVIDSFSTDRTVEICREHGAQVVQHAFAGYVQQKNFATAQAQHDYVLQLDADEVLTEELRQSILAAKQNWRGSGYTMARLTNYCGTWVRHGGWYPDRKLRLYDRRQGQWMGLLLHERYEVSSGEPVGMLAGDALHYSYNSVEQHVAQLNRFTSIAAEELWIRGKRNVSLFQLVVKPWWKFAHGYFFRLGMLDGFAGLSIATISAWGVFLKFAKLKTKNSGAK

SEQ ID NO: 1951 - protein, 262 aa, Amphiplicatus metriothermophilus
MARDAKPPVSAYIRARNEARMIADVARAALQVADEVVVVDSGSTDDTARLAAEAGARVVRQDWLGNGHQKRFAEEQCRHDWLLDLDADEIVTPELAAEIRALFDGGEPPRPVYRTPMAIAPPVGEPWTRFGLAKRCKLYDRRVVRAPAHAAWDQFAVPAGVKTGRLKNPIIHHAFADTAHLVDKLNRNSSTRARELAPKPMPVLALRVFFGLPFYFARRYLLDGLFRGGVYGFSFALLSAWGRWLRDVKMFERRKKEAERRK

SEQ ID NO: 1952 - protein, 262 aa, Parvularcula bermudensis
MTDHAAARPPLSCYIRTKNEARLIGEVVEAALTVAREVVIVDSGSTDDTVARAQAAGAQVYDVAWRGTGRQKRAAEDLCHYPWRLDLDGDEVLSPDLAKEIAALFEGEGPSAAVYALPMVIAPPIGPIWWRVDPDQRNKLYDARVIRMPDSAAWDQLDIPKTMKVPKLRHPIIHHAFTDIGFLLRKQERNMTQRAKSAPLKPLWQLRIRIVLGLPVYFLKRYVLKGLFLKGIYGFAFSLTIAYGRWLKDIKMYERHRLGEGR

SEQ ID NO: 1953 - protein, 252 aa, Arenimonas caeni
MATPLPLTGVVVTRDEAARIARCLRPLLAVCSEVVVLDSGSTDDTVAIARSLGAQVEHQEWLGYASQKNTAISRASQPWVLLLDADEWLEPAAVDALRALFADGAVETADAWRLRRRAHFLGHRMRGGGFAREPLPRLFRRHLRYEIQPVHEQLDTRGQRVATSRIRIEHEIARCPAAHWRKLEQHARLWAEDQAARGRVALPGRGELAALAYVLKHLVLRLGVVDGLPGLRFHWLQARYARLKYALLRELA

SEQ ID NO: 1954 - protein, 263 aa, Parvularcula sp.
MTNPETRPPISAYIRTKNEARLVAEVVRAALQVAREVIVVDSGSTDDTVRLAEDAGAKVISMDWLGTGKQKRAAEDLCEHPWLLDLDADEVIPAKLAAEIAALFQNGEPAHKIYALRMIIAPPVGEPWRHVDPDHRNKLYDSREIRMPDSAAWDQLDIPSGTQVPKLKTPIIHYAFTDIGFLLTKQERNMTQRAKSAPLKPLWQLRFRMIFGLPVYFLKRYILKGLFLKGAYGFSFAMTIAIGRWLKDVKMYERHHFEKKDGK

SEQ ID NO: 1955 - protein, 251 aa, Aquimarina sp.
MVKLSGVIITFNEERKIETCLASLQGVVDEIVVVDSFSTDATEEICKKYNVKFVKQKFLGYKEQKNFAIHQATHNHIISLDGDEALSPELQKSLIKLKSNWTHEGYFMNRYNNFCGQWINHSDWYPDKKLRAFVKGKGEWKGINPHDSYKLYDPKNCGKLKGDILHWNYPTYSAYNIQIEKFSSISAQSYLELGKKASLWKILFNPSWAFFKAYFLRLGFLDGVNGFVICVQTANLTFLKYIKLRELTKKK

SEQ ID NO: 1956 - protein, 384 aa, Selenomonas ruminantium
MNGGWNIVFKGGQLVQDIKLSVCYMVKNEAENLPISLASVKDAADEIIVVDTGSTDNTKAIAIEYEARVFDFPWQDDFSAPRNFAIEQAKGEWILFLDADESFPKPLDRMELLNYLAGVSAEVVLLKLHNVDTLAEQHKFNTDWVPRIFRRRADLRYRGRIHEHISKQNGDLQVVYAPQRFYFLHTGYAECISEAKCRRDLQIMQQVISEGDWEPVYDYYLTDCYYGIHDYEQALAHAQSFARSGTVVHGGNGHTYRMILECMRALGLPDADMLPWAEEACRMYPDLPEFYAEQGMILCGLGRLDEAQMLLHTALRRYDTDTAETCHASYFSPEVAAKVAARLGEIADLHGEKEKAAVYFVQALDYCSTNKKVLEKAKKFLKST

SEQ ID NO: 1957 - protein, 554 aa, Helicobacter fennelliae
MIDVKINNAKKISICILVKNAQGTIKECLKALKDFDEIILLDNESTDSTLEIARGVSEEWTRDSRIVGNLEHEDSKDSKNSAKPAKPATIRIFSSPFLGFGALKNLAISHARNEWVFVVDSDEVIEQGIYAELETLDLSCVRAIYALPRKNLYAGEWIKACGWSPDFVLRIFNKSYTHFNENLVHESVILPSDSKKHYLKTALKHYAYDDVAHLIDKMQHYSNLYAKQNLGKPSSPTKAFVRGTWSFVRNYFFKKGILYGYKGFIISVCNALGTFFKYIKLYELNTHTHTICSLIITTYNQKERLALVLDSVRALNPLPFEVIIADDGSKEDTRELIESYARDFPCALKHIWQEDKGFRLSEIRNKAINASKGEFIIVLDGDMIVDSYFVGDYLKVSRKGVFVQGSRVILDSNITKKILESKNYHLAFTKKPLKARRCKILSKFIFKRSVLKAKVFDKKELIKGVRGCSMGFFKEDFARIGGFSEQFRSWGREDSEFVARFLFAGGEFRRLKFSAIAYHLYHDESPKTSLESNHQLYLETIKNKSKSCENLSEH

SEQ ID NO: 1958 - protein, 254 aa, Hymenobacter swuensis
MPAVPLSVVIITFNEEANIARCLEAARSIADELLVVDSFSTDRTVAICQELGARVVQHTFEGYVEQKNYATQQAHHHHVLQLDADEVLTEELRQSIGQTKTNWQGAGYTLARLTNYCGSWVRHGGWYPDRKLRLYDRRLGRWEGLLLHERYELAAGQPTPLPLFGDVLHYSYDSVEQHVQQLNRFTSIAAQELWLRGKRHVSLFHLLLKPWWKFVHGYFLRLGFLDGFAGLSIAVISAWGVFLKFAKLKTKSTA

SEQ ID NO: 1959 - protein, 260 aa, Halomonas sp.
MISANIIAFNEEANIADCIASARQVCDDVVVVDSGSQDRTVAIATELGARVVHQAYLGDGIQKNVALEHVKYDWVLSLDADERLTPEMVEAIRQLELAATEHDAFAFRRRNMIGSRWIQVCGWYPDYCIRLYNHRHARFADVKQHAKVIAANPKRLDADMIHHSFDNLGQLFAKPGRNFSGRAAKIMFQKGKRANAFSPFAHGLNAFVRKYVLQRGFMGGVDGMTVAVSAGLNSYLKYAKLLEYQRDPKVLEAEDFNKVW

SEQ ID NO: 1960 - protein, 266 aa, Mucilaginibacter gracilis
MIPVSVVIITLNEAHIVGQTIAKAQLISNDIVVIDNGSTDDTVQIARRNGCRVYQKAWDGYGANKNKGIELAEYDWILSLDADEIPDDKLIASLHQLVLCDCNQVYDIKFRSYIGKKQVRFGKWGRDHHVRLFNRTQVKWMAAQVHETLLIPKGVKRERIKGNIHHYSVKDVAELQTKSETYAALNAVKYYGEGKEASMLKLYVSPVFNFIKNYLFCLGFLDGKAGWQIARTTFKHTHLKYLLLQKMNNSKVAKKVYIQKKFAIEY

SEQ ID NO: 1961 - protein, 281 aa, Pontibacter ummariensis
MQPYNSGFPVSCYILTYNSARYLPQILQALEEAVEEVVLVDSGSTDATEAIASQYGARLVYRKFDNFIQQRNFGLEQCRHKWVLSLDSDEVPSADFVAQLQQLKKRLGNEEGPEAYRMERHWVLFGQEVRTFYPISSPDYPVRLFRKDVVTFGKGSNFVHEKPEGFTKAEVLAGAVHHYSCDSVEELYRKLNLYTSLAAKDMGRKGKKASLAKLIFSPVAAWFKWYLKKGGWRDGNVGFILGRYAYDYTYQKYLKLYLSSRAASELPKEHKQAIPGQELKA

SEQ ID NO: 1962 - protein, 517 aa, Neisseria sp.
MTSKIPATATMLVKNSERYLSEVLTALDGFDEILLLDNGSTDRTLEIAAGFKNTSIRKHEFIGFGPMKNLAARLARNDWIFNIDSDEVADTELMESIRAAVAENRMQKVFSLSRLNHYDGRLIKACGWYPDIIPRLYHRRFTQFSDRQVHESLKLPENTETQILAGRLKHYSFENAEGLIRKMQQYSTLYAEENRYKKPASPAKALLHGGVSFVKNYFLKRGFAYGSDGLIISAANAQGSYYKYVKLYERNRHITAALVITTYNRPDALELVLKSALAQTRLPDEIIVADDGSAQDTAEVVDAFKRISPVPVKHSWRPDDGFRAAESRNRAIAAASSDYIILIDGDMLLDPSFIADHLKLARKGRLIQGSRVILTEERTAALLENSSLPALSCFSTGIRKRTSALRLRLPAKIVGSHGNRKHKGIKTCNMGFFRDDALAVNGFNNEFVGWGREDSEFVARCYHAGMKRHNLKFAGVAYHLWHHEAERDSLPQNDALLQQTLFEGKIRCEDGIDAFLK

SEQ ID NO: 1963 - protein, 271 aa, Rhodanobacter sp.
MSTFPLTLVVITHNEADNIARCLDSVTFAAEKLVVDSGSDDDTVSIAQAHGARVLHQDWLGFGPQRNFATTACTHAWILALDADEYLTPELAAELQQRLPDLMAGSMPAAYLRRSTIYMGRPMRWYRPAVGEQMARLYHRDRARWSDARVHESLRFEGNAPTLQAPFNHVNNPTLPHKQLKVLRYAELKCRDWLDKGKPVRMWQAPFVYVLAFLKDYVFRLAFLDGWRGFIIAQTAASYALYKRMRYYEMVNHPESVSRAAHILTHHGIDR

SEQ ID NO: 1964 - protein, 219 aa, Leptospira interrogans
MAKSIPAKKKKQTQKKGILQESIGKKLSVAIITYNEEKNIKECIESCLEIADEIVVLDSISTDKTEMISKSFSSVRFYKQRFKGHIEQKNDAIALCKYDWILSLDADERISTELKNSILSFKQKQDDETLNGLQVSRLTYHMGKFIRHSGWYPQYRYRIFKKGNAIWVGENPHDYISIQGKGSKICGDIIHYSFRDLSHQVNTINQFSSIVAFTRQKKG

SEQ ID NO: 1965 - protein, 512 aa, Flammeovirga sp.
MTDKKIKNITVAIIVKNAEPTIEKCLKSLDAFEEIILLDNGSTDQTLEIAAQFDNVKIHHSEFIGFGPLKNLAASHAKNDWVLSIDSDEYPTEQLIDELSNLKLQDNQVGKVHRLNAYKGKIVNGCNWNNDKIIRLFNRTATRYHDVQVHESINLENVKVVNLKGKLLHDAFDNASELLQKLQYYSDLYADQHYRRKNSGPWMIVFKTFVSFLDNYFLKRGFLYGWRGILISMSNTMGVFYKYFKLFERNKSVSNSLVITTYNKTQELDLVLQSVASQTVLPDEVIIADDGSTSETKELIDSFRDRLNIHHVWHEDSGFRLAEIRNKAIAKASKDFIIMVDGDMILGKDFIKSYILKVKKGRYYQGSRVMISEEASETLKKENKSSMSFFSKGIKNHLNAINSPLLSSLFSKRKKTDIGTKGCNMGFWKEDIDRINGFNEDFKGWGREDSEFVVRMLNSGIKRINFRFGAVAYHIYHEERSRGNLGVNDELLQSAIDNKLAFCENGIQKYYE

SEQ ID NO: 1966 - protein, 290 aa, Leptospira barantonii
MGKSIPTKKKKTAKKTQTPDSTSGIKLSVAIITYNEEKNIGPCIESCLDIADEIVILDSVSTDKTEKISKSYPSVKFYKQKFKGHIEQKNDAIALCKFDWILSLDADERVSPELKNSILTFKQKKDDETVNGFQVSRLTFHMGRFIRFGGWYPQYRYRIFRKGSAVWVGENPHDYISIRGKGNKIYGDIIHYSFRDLTHQVNTINQFSSIVAYTRQRKGKKFSSLRTIYKPFSKFMETYFFKFGFLDGFPGWVIAVSSAYSTFLKDAKQYELEKGMVERPSNVKEDYGRG

SEQ ID NO: 1967 - protein, 526 aa, Helicobacter canadensis
MKKIKISAVLIVKNAEATLQECLDSLQNFDEIILLDNGSSDNTQKIAQDFNVLHKNLKIYTSEFIGFGALKNLAVSYASNDWIFSIDSDEVLESNTFELLAKLFSNLEDFPPSCTLIAMPRKNLYNGEWIKACGWYPDFVTRVFCKNYTRFNDNIVHESIVIPKDAKVLKLDSGLKHYAFNGISHLLEKMQRYSTLWAQQNANKASSPLKAIIHGSWTFFRNYIFKKGFLYGYKGFVISVCNGLGAFFKYMKLYENTIQKPKSVSLIITTYNQKEKLALVLDSVRDLSVLPTEVLIADDGSKEDTRELIESYARTFPCPLRHIWQEDRGFMLSAIRNQAIKAAKGEYIIIIDGDMILHPLFVADHLAFATPKVFLQGSRVILDSPASQAMLEARQNNQIKAYESAFNLGGFKAKRCRILARIIFEFSHLDSKFFDKKDFIKGIRGCNMSFYKSDCEAIKGFNENFVGWGREDSEFVARFLFNGGVFRRLKFAAVAYHIYHPENTRDMLESNHKIYLQTIKEKKILW

SEQ ID NO: 1968 - protein, 259 aa, Unknown
  Description of Unknown: Verrucomicrobia bacterium 12-59-8 sequence
MSRLPISISIISLNEEANLRRCLASVADLAQEIVIVDSGSTDRTAEIAAEFGAKFVHQDWLGYTAQKNHCLKLCSQPWILALDCDEELTPDLLNSIQNFFKSDAFVRFDGAWMSRLVWFMGRWIRHGDWYPDRKIRLFRRDKSQWAADGGGQVHERLDVAGPCTTLQGDLLHYSFKNIQHYLVKHVQYSNVFLETQRSKGKHWSLLHTVFRPWWRFTRAYFLKLGFLDGFPGLWIAVATAFFTFDRYSRMYESAAEGRK

SEQ ID NO: 1969 - protein, 271 aa, Rhodanobacter sp.
MPTLPLTLAVITHNEADNIARCLDSVPFAAEKLVVDSGSDDDTVAIAQAHGARVVRQDWLGFGPQRNFATTQCSHPWILVLDADEYLTPALSAELQQRLPALIAGDAAAAYLRRSTIYMGAPMRWYRPAVGERLARLYHRDRARWTDARVHESLRFDGSAPTLRAPFNHVNNPTLPHKQLKVLRYAELKCRDWRDKGKPVRMWQAPFVFALAFLKDYVIRLAMLDGWRGFMIAYTAAGYALYKRMRYYEMVNNPESVASATDLLNKHHLDR

SEQ ID NO: 1970 - protein, 277 aa, Luteibacter sp.
MASHSLTLVVITYNEAHTIARCLDSVPFATEKVVVDSGSTDDTVAIAQAHGARVVHQDWLGFGPQRNFATTQASHDWLLALDADEFLSPELAAELESALPSIQASGDAAAFLRRRTIYMGAPMRWYRPAVGEKMARLWHRERARWTDARVHESLRFDGAARTLRAPFDHVNNPSLVEKQLKVLRYAELKCRDWYDKGQSPRMWQTPFVFLLAFIKDYVFRLAMFDGWRGFIIAQTAASYAVYKRMRYYEMRHNPASRESAATALHRHGLDRGSETPT

SEQ ID NO: 1971 - protein, 289 aa, Leptospira adleri
MGKTIPAKKKKTEKKTGTAPFTKGKKLSVAIITYNEERNIGECIESCLEIADEIVVLDSNSTDNTEKISKSYPNVRFFKQKFKGHIEQKNDAISLCKFDWILSLDADERVSPELQSSLRKFKEEEGFEERNGFQVSRLTFHLGRFIRYSGWYPQFRYRIFKKGNAIWGGENPHDYISIQGKGGKLSGDIIHYSFRDLTHQVNTINQFSSIVAMTRQRKGKRFSVLRTIYKPFSKFIETYFFKFGFLDGFPGWVIAVSSAYSTFLKDAKQYELEKKLIERPSNVKEGYGS

SEQ ID NO: 1972 - protein, 262 aa, Dyella jiangningensis
MKREPLSVVVITYNNADTLDACLNQVDWADEIVVLDSGSTDDTVAIARRHGARTAVHPFDDYGPQKQRAYDMATHDWILNLDADEILSPGTRQEIERALTAPRHAGFRLPRRERMFWTVQHRWSWRNGHLRLFDRRRGGMNDVEVHSAVEVRGPVRTLWRADFVNDGDGDIATRVEKINRYTTGMVAYKLRKRQRFTGLRMVFYPPVFFLRQYIGKRYFLNGWAGFIASVTGAFYAFLKYAKLHEARELAARDLKKGSRTKA

SEQ ID NO: 1973 - protein, 311 aa, Leptospira interrogans
MTEKEFILPLEKEPIPGINQTDGKINSSQEKKQTQKKGILQESIGKKLSVAIITYNEEKNIKECIESCLEIADEIVVLDSISTDKTEMISKSFSSVRFYKQRFKGHIEQKNDAIALCKYDWILSLDADERISTELKNSILSFKQKQDDETLNGLQVSRLTYHMGKFIRHSGWYPQYRYRIFKKGNAIWVGENPHDYISIQGKGSKICGDIIHYSFRDLSHQVNTINQFSSIVAFTRQKKGKRFSILRTIYKPFSKFIETYFFKFGFLDGFPGWVIAVSSAYSTFLKDAKQYELQKEILERPSNVKEDYGRH

SEQ ID NO: 1974 - protein, 517 aa, Helicobacter cinaedi
MQKLPISVTILVKNAQSTFSECLSALVDFDEVIVLDNGSDDGTLDIAKKFANVKIYQSEFIGFGALKNLAISYATHEWILSVDSDEILESSTLEQIRLALSSMQPHHIYAMPRKNLYNGEWIKACGWYPDYVWRLFNKTFTRFNDNIIHESVILPKNAKLIKLTSGLKHYAFRDISHLLDKLQRYSSLWAKQHSFKRSSPLKALTHGLWTFVRNYLFKKGILYGYKGFAISVCNGLGAFFKYLKLYELGQTPPTCSLIITTYNQKERLALVLDSVKNLAFLPNEVLIADDGSLKDTKELIENYQKSFPCPLKHIWQKDDGFRLSEIRNKAIKAASGAYIIIIDGDMILHPHFVKDHLHFAKKGAFIQGSRVILNEKNTQEIMDSLSYHLAFKYGDMKAKKIPLLAKMIFATSTIKASYFDKRDFIKGIRGCNMGFYKADCVAINGFSEEFIGWGREDSEFVARFLFNGGEMRRLKFSAIAYHLYHKENTRSMLESNHAIYLRTIQNKSTFCQKGLKS

SEQ ID NO: 1975 - protein, 742 aa, Lactobacillus agilis
MSDEYQAGLDALQAGKVQLAKELFAASDDERASGELAKLATRQKDQLISACLITKNNQRTLAECLASLYRYNFEIVIADTGSTDKTVEIARQFTDKVYHFDWVNDFAAARNFAASKASFDYILTLDSDERLVGGSKEELQDFFINTDTKKTVGLYKVVNILSSGKKQNQVINNVIRVYDRRYCKYYYRIHEQVGLIADESALLDTKVLKFRTIHYGYQDEKLLQKKSQRNVELLLAQLAVTPDHVYFIYQLAKSYYILKNYQQSFEYFAKFFLIQKNYRLQWVRDGIDAYLKLCIKTKRYDKALECVNLCQEQCQDSFDMLCIFATVYVVTDNDEQAIRALKKALTLASPDKGEFGWTTADACKDLAKIYERQGRWVLAKEMLTKVGDEKLKLNLDQQLTVVVLVDEETTKLTACLQSLAVLRANYLILVRGTNPQTITLARQYSQAVYHFSGQEDELGNYCLTKLTTDYGLIVHANEKLLGADPDVLKQITSKKAAIVGRVRIKVPVKGDEFGRQTHELRLLVKSYSKFNGPNLTDISSRKPRQLLKQVELPLILAKNLTYEAYYQSEVAKQTRLKASLKQKPNPTASFELAESYYHFENYEAASQAYLDFLSGPLELAKEETLTAVTNLISALIEVKDYQGAFNIVTTFNPYYQGLSDFQFAAGLAYMNIGQFADALTAFENARKLANSDSLGINTYLSYYQQGVIHEAMGNKQQALGAYRLAGKYELAKAGVERLLRKK

SEQ ID NO: 1976 - protein, 271 aa, Dyella jiangningensis
MPTFPLTLVVITYNEANSIARCLDSVPFAAEKLVIDSGSTDDTVAIAQAHGARVVHQDWLGFGAQRNFATTQCSHDWILALDADEYLSPELAAELERRLPELMASDNSAVILRRATIYMGAPMRWYLPSMGEKMARLFHRDRARWKDVRVHESLVFDGPSVTLHARFNHENNPSLPQKQIKVLRYAELKCRDWLEKNKPVRMWQTPFVYLLAFIKDYFFRLAFLDGWRGFVIAQTAASYAAYKRMRYYEMRRNPASLESAADALIRHGIDR

SEQ ID NO: 1977 - protein, 272 aa, Unknown
  Description of Unknown: Verrucomicrobia bacterium sequence
MPFPLSISIVAHDEERNIARCLESATDLAEEIVVVDAGSNDRTREIAAGFDAKVIHQEWLGHRDQKNVALSHCTKPWVLALDCDEFLSPDLWTSISSFFREGLPEKFDGAWCNRKTWFLGRWIRHGDWYPDRQLRLVRREKARWGGSPEHDKIDIHGPTMGLAGDLCHDSFPSMNRYIEKINIYSDVFLQRQNQLGKRWSLIQNVARPLWRFFRAYVLRRGFLDGYPGLWIAVATAFSTFVRYSRQYEEESRQKNASCDSPLISRPDRPEIS

SEQ ID NO: 1978 - protein, 254 aa, Thiothrix nivea
MANISGLVITYNEATHIRACLESLLKVCDDVVVVDSLSTDGTAEIAQEMGATVRARPFLGYGPQKNFGLPFCRHVWVLSLDADERLDADAIADIRSLDLDNSAHDAYEFRRKNLFHGKWIKCTSWYPDHVRRLFNRDKARFSDLQCHEKVETGNSKQLASHIIHYSYRDYQHMLHKLNQYSSQYVEDNVGRKKPISAWSPPLHGLFAFLKNYFLKRGFLCGFDGFTISLLNALGSYMKYAKLLEKQRYGSKGEQ

SEQ ID NO: 1979 - protein, 422 aa, Streptomyces hygroscopicus
MPGATSHVPLLSVVIPTYNRAALLDRTLGTLARQTTALEDFEVVVSDDGSTDTTRDVVRSYEDRLRIKYVFQEDLGYRVASARNGGARLASAPLLAFLDTGVLAGPQYVQSVLAAHAGPAPAKVVLGCCYGYDPRNPHPELHSLVEEFPPEEAVRRVGDAPWFQDMRLPEFTAVDFDLSRMHMPWLWFWTLNVSLPAADFWRVGGFDEDFTGWGGEDIELGYRLHAHGIPMTVSRESWGIEAPHERTHEANVSSLMLNCDRFVRKHPSLLPELFWAVTNRGIFGSVETERLRFEEWASQARGQQVLDEIAIGLDTLPPSQHTQRVAVFGSGTEGLPITPRQNVELFLCDYDEGVLARQESRDDAAVSTWHLSGLRTPWPDQHFDLVIITSRMDGPRQAWGEAFTKEAHRIASSVVEPSLRGD

SEQ ID NO: 1980 - protein, 266 aa, Unknown
  Description of Unknown: Litoricolaceae bacterium sequence
MSKVSCYIIAYNEATKIRPAIESVVEWADEVILCDSHSTDDTAKIARELGARVVQIDFSGFGALRNGAIAHCRHEWIFSLDSDERCTPEARDEILSIVRQNNQSGPVAYFMPRNNYLLGRWVKHSGWNPDYRQPQLFRRGLLSYTLEEVHEGYICDGPVGHLTQPIWQFPFENLEQMLHKAQRYSSLGAQKLLKKNKVGGMGPALIHGLSMFLKIYLVKSGWRDGRAGLVIAIGGFIGAFYKYAKLAELQNDWTEPTMPKVGKPDS

SEQ ID NO: 1981 - protein, 311 aa, Pseudomonas panacis
MKRETVSVIILTYNESLHIARAIESVRAFSDEVLVVDSFSSDDTCEIARRHGALVVQHAFVNQAKQFQWALDNLPITGNWTMRLDADEIIEADLAAQINTRLPTLDQGITGINFKRKHIFMGRWVRHGGRYPLKMLRLWRTGQGRIEDRWMDEHISVAEGRTITLEGGFADHNLHDLTFFTHKHNQYATREAIEIINSRLGLFAVRHELNEGHSSFQAKLKRLVKNRVYNRVPFTLSSTAYFLWRYIVQLGFLDGRSGLVYHLLQGYWYRFLVGAKVLELETAIAHLDDKDSIVRELSKLTGHNLTLPIPK

SEQ ID NO: 1982 - protein, 253 aa, Hymenobacter wooponensis
MPAVSLSVVIITYNEERNIARCLEAARGVADEVVVVDSFSTDDTVSISQQLGARVVQHAFEGYVQQKNYATAQATHNHVLQLDADEVLTAELRQSILAAKQNWQGAGYTLARLTNYCGSWVRHGGWYPDRKLRLYDRRLGQWEGLLLHERYEVAPGQSVGVLTGDALHYSYDSVEQHVQQLNRFTSIAADELWLRGKRRVSLFHLLLKPWWKFVHGYFFRLGFLDGFAGLSIATISAWGVFLKFAKLKTKAAA

SEQ ID NO: 1983 - protein, 255 aa, Acinetobacter sp.
MIPCSVYIVTLNCGAWLQDTLESVKDFTEVVILDSGSTDDTYAIAKSFSNTRIAHQDWLGYAAQKSLALSQCHQDWVLNLDGDEVLSPELKAEIEQTIKADQIDALITPINDVFLGVPNSKHTKKHAKVRFFRKSKGHYDLENKVHENVIIDGQSVRAEGDIYHYGESSIFVKVEKNNQYSNLKAAEKFQKGKKPSLLKLSLVMPVTFLKSYFIRRSCLNGWRGFVNSMINAFYAFLKEAKLFEQYQNAKKEQDK

SEQ ID NO: 1984 - protein, 250 aa, Leptospirillum ferriphilum
MRLPLSVCILTYNEEANLSDCLASVRELADEIVILDSGSQDQTSRIAEKFGARFIVHPFDDFGSQYNRLFSLATHEWILNLDADERLTPELAQSIQDVFSKKNNLMEFQGFSFNRLNYFIGKPIRHSGWAPDPLVRLFRKDSGEMERRKVHVQILVRGKIGTLAGNFLHYTYRSLDSYLQKSIQYARLAAMEMKKNGRTPSLFPLFTHPIAMAFKMYILKKGFLDGKEGVFLAILYSYYTFLKYLYLYYL

SEQ ID NO: 1985 - protein, 263 aa, Unknown
  Description of Unknown: Methylobacterium sp. 17SD2-17 sequence
MDAPTQPDRALPVAVSCTIIAQNEADRIVRCIESVKGIAREIVVIDSGSTDETVALAERHGAVCHFNPWTGYGQQKRFAEDKARHDWVLNLDADEWLPEPVRAELIDLLSRPIPPEIHGFAFTISHVYPGHARPRPLADYHTYVRLYDKTRCRFPESSVFDEIKLAPEHRGRVRAPVYHQSIRSLGHLIAKNKAYFRLQAREVRKPRLPTLLRIFVEPVTTFLKYYLVRRHITGGVYGFLVASTIAGLRTYRLALFLKGRREP

SEQ ID NO: 1986 - protein, 255 aa, Unknown
  Description of Unknown: Acidobacteria bacterium sequence
MSLSVAIVAMDEEANIGRTLASVRWADEIVLVDSGSKDRTREIAHEHGARVVEEPWRGYVAQKQYAIELCTKDWVLLLDADEEVSPELTEEIREALANPGDMNGFWLPRQNLFLGRWMQHGGFYPDPKLRLFRNGIGFVTGHDPHDRCELQPEVAQRSRQFRNALVHYTYPTLSYYIAHMNRYSSLGAELAVSQGRQSFSVADIVIRPLATFFYNYVVRLGFLDGGEGLLMHLYHAVYVSWKYAKAWEMTRIKSH

SEQ ID NO: 1987 - protein, 254 aa, Unknown
  Description of Unknown: Comamonadaceae bacterium sequence
MNLSVILIARDESANLKACIDSVATADECIVAEYGSQDDTLQVASDAGATVIVTADWPGFGPQKNRALQAARGDWVLSIDADERVTPALMAEIMQAIRSGDADAYEIPRLTQFCGRWIHHCGWTPDRVLRLFKRDAAVFSDDLVHEKLVMKSSTPMVRRLKNPLLHYSYPTPAHYWRKLERYSHDWAVQRHARGQTTTMTRAALSGCTAFLRSYVFRLGFLDGAMGFAVCTMQAQSAFGKYFELYCLERQNEKS

SEQ ID NO: 1988 - protein, 263 aa, Unknown
  Description of Unknown: Candidatus Eisenbacteria bacterium sequence
MTRLSVVIPTQNNEDTLPAALASVAFADEIIVLDSGSVDRTRDIALGAGARVVERPYRSDGDQRNAGWAEAAGAWVLALDSDEALDSTLAEAVRGVASKDPNAGDPVAYALRFRCHFLGFPLDHGGLDRDVHVRLGRRERTRWESALHSSLIVDGPVGRLPGVVDHFTATELPGRLRKLAAYAADRAERMRASGVRPSVPRALWEPSRFFLGRVVIRGGWRDGLPGVVWWWLQSTEILLAYLLLYRRSRPGSEGPRSTGSRPA

SEQ ID NO: 1989 - protein, 263 aa, Desulfotignum phosphitoxidans
MAKLSVYIIAFNEQDKILDAVQSVAWADEIIVADSFSTDRTAAIAQDIGARVVQIPFKGFGDLRNQAISACTHDWIFSLDADERCTRAAREEISRIIHDPDSKDAYYVPRRNYFMGKWIRHGGFYPDFRQPQVFRKGALRFENDAVHERYEVISQQPCGTLKSFIHQIPFKNLEEIIHKANRYSTLGAQKMFEAGKRPGMASALLHGVWAAFSLYVLKLGFLDGWPGVIIALGNFEGTFYKYAKCHLQSKNLASFLDTDLPEN

SEQ ID NO: 1990 - protein, 277 aa, Unknown
  Description of Unknown: Desulfobacterales bacterium CG23_combo_of_CG06-09_8_20_14_all_51 _8 sequence
MTKVSEKTYSLSVIIVAMNEADRIIPCLDSVAPIADEIIVFDSGSQDRTVEICRKYTDKVFVTPDWPGDGPQKQRALGKAVCQWVLCIDADEVLTPELREEIHAVLISWPVEKGFKLKWLPVIFGHKLYHGRSARAPLRLFQREGAGFSTAVIHGKLTLAPGRIGKLKGRLLHYTHRDFEHYLYKNRLYAWIGAKNRFEAGKTGFGLSGAAFRALLTFIVVYFLRLGFLDGRVGFLVAVMYSQSSFNKYAGLWTLRQESAMKQAAAMKKKAGDSGDR

SEQ ID NO: 1991 - protein, 262 aa, Luteibacter sp.
MAQRSPDATRLPISVCVIAQNEADRIVACLTSASFCDDLVVVDGGSTDDTVALAESAGARVIHRPFDGFRTQKDFAVAAARHEWVLCLDADECVDLGLRAAMEKRFAEGFGDTAAFRIVRRNRFLGKVMKYGNAGSDRVVRLFDRRKAGWHGAREIHESVVVRGETRAIDGWLDHDPYRSLSAMLAKQERYAHLMAEEAFAKNKRTGLAQIVLSPMFRFLKGYVFRGGFLDGWRGLVYALLRVEYVRRKYLKQYLLQKGFKP

SEQ ID NO: 1992 - protein, 386 aa, Mobilicoccus pelagius
MPADVFAQAQNGLRTNDGQVIDPQLRHRRDSPMSDRSPRLSLAMIVRDEERCVARALDSARPLVDEMVVLDTGSVDATPRLAREHGARVESFEWPEDFSVARNATIERCTGDLVLILDADEWIEADDADTLRRWTAAATPGTAGLVTVASETESEGRQVTSHTESVRLLPRSCRYVGRVHEQPQGYAQTEPVPGVVLRHDGYLPEQSRRKQGRNERLLLRSLNDDPGNPYLLFQVGRERQIAGDFAGACAAYEQALPGITDSTPWRDELRARLLFSLEREGRHADALRSAQEILRSPDVSAEVLLAAGNLFVDLAGVHPQKHAAFLQMARRAWLTCLEVGDPTDGRDHTPGCGGHLAATNLAALSTGLGDEEGARFWTKRADELRR

SEQ ID NO: 1993 - protein, 270 aa, Phycisphaera mikurensis
MKLSVLICCADAADTLPAALASVTPWADEVLVVDSGSEDATPRIAADAGARVVEEPWRGYSEQKEFGITLTRNPWTFVLDGDEEADPVLQRELCSLGDGFERSVDLAWMRRKNYVFGRWVRAWSPDWQSRLFHRDRVSWTGHVLHDQREARRPGAVRRLRGHLLHKRVSTAGFEDYFSGARLDARLMMQARQMHAAGKRTRFFDLAVRPPATVFKQLVLKRGLLDGSFGWMMAQKTATTTQLKYAALRAVEMDAAREREAPRAQPGSSQG

SEQ ID NO: 1994 - protein, 284 aa, Paenibacillus sp.
MDSVKGVLGGPGSYPISVVIIAQDDEVRIAKAIASCRRFADEVVVIDGGSKDGTVRLAESLGCRVFVNPWPGYAKQREFGVERAVHDWVFLIDTDEVVSEELAEDILQRKPGLTDRTTAYSLYRIGDFLGRWLDKGEYLVRLYNRKAYGIRNSLVHEMPDVEEERMVRLNGVLWHHGFRSINDHVARFNKYTDLEAQTAYASGKPFKLSRLLVRPPARFVQKYVVQGLFKKGMSGFAVSVFWVMYEFMVGFKHYELVKSGKATRENAAVPAEKESKGERGYAVQ

SEQ ID NO: 1995 - protein, 656 aa, Thermosinus carboxydivorans
MVRTISLCMIVKDEEANLARCLNSVRGAVDEIVVVDTGSTDRTRAVAELAGAKVISRKWQDDFSAARNASLELATGDWILFLDADEELAPGSADVLRRVITDECEGYFMKVVNFIGAADNIETVPDLVFRMFRNKPEYRFRGAIHEQIVDVILEKNKQAIFKVAEGIVIRHYGYLQQHIIAKDKINRNLSIITRECANDPDNKTLRYHYGVELYRAERYLEAADELAKVAAAVDSGVVYYPKLLRYIALAYYGAREYELALAAITKGLQLFPDYADLYYYGGIIQLEQQAYAGAWEWFQRAIATPEQPAYYASFAGCRGFRAYYQLGALAEMFGDEEEALRYYILSLRDNAEFALSLKAIVRILNPRKYPEYAMRAIEKICEFCTADAYRLIGMICFAEGAYELALNYFEKIDSSSIEAYTEVLKAICLIQQQRLMEAIRILDKMPPGHPQFPLAQFNKIVGFWLLKNRKKVRSLCDEFLAAGLSADASKVVAMLKDSLYTRRSVPLQVLGKEGIDLVKDIVLRALDRRELALAQGLLARLDKTVQKEYALELSHVFSKYEYWDIALEYAELYLQEHDDSAEAWFHLAEILVQTNQFERGSLCYHRAITIDTRRPQYYVKLIKLYQAMRRKLLGDAAQQFPQMPIFKQLLEEAPQE

SEQ ID NO: 1996 - protein, 275 aa, Unknown
  Description of Unknown: Methylobacterium phyllostachyos sequence
MPAAGATGALPLSIFLIAHNEADRIGATIRAVRDLTDDLVVVDSGSTDGTLALAESLGARVIHNPWPGYGPQKRFAEEQCRHVWLLNLDADEVVPEALAREIRALFAAGEPPRPAWRIGIAEVFPGEARPHPLAYTLTPVRLYRKDRGRYAASPVHDRVALEPGVTAGRLKGVIHHFSVRSLGDQLDKLNRYSDQQADDLEARGVVIPSWRVFVELPGNFLKAYLGRRHFVRGTYGFLTAMNYAISRHLRIAKHVERRRLAAARQDRVDPPGPTF

SEQ ID NO: 1997 - protein, 267 aa, Cupriavidus oxalaticus
MTDTRATISVIIVAMNEAHDIGDCLASVRDWATEMIVFDSGSTDGTQDICRSYGARVFETDWPGDGPQKNRALDQATGEWVLCLDADERVGDELRAEIFAVLEGRAPDPSHVAYSMPRRSSFCGRFMKHSGWWPDRITRLFRRGKGRFTDVRTHTHIELQGTTGRLRHPIIHISIPTLHEALDKNNVYSSEGAKTMYEQGKRSSLAKAIGKGLWAFLRTYIFRLGVLDGQEGFMLAVANAESTYYRYLKLMLMCKAADKAARQVYTA

SEQ ID NO: 1998 - protein, 269 aa, Luteimonas terricola
MPTPISATVITFNEADRIGDCLAALAFCDEVLVVDSGSTDATREIAAAAGARVLVRPFDGFRSQKQFAVEQATHDWVLSVDADECVTPQLAASIQAERARGFEGAAGYRFARCSEYFGRYLRHGNAYPDRKLRLFDRRRGGWRGDREIHETASVDGPVRTLAGDLLHHPFRSFEHQLAKGRQYAQMMAEHANARGRRATLGKLVLAPAWRFWRGYLLRGGFRDGWAGLVYAYVTADTARQKTVRLWLLQRAAGDVSSAPGPNNRSGGAA

SEQ ID NO: 1999 - protein, 259 aa, Pseudovibrio sp.
MSQVLPPISILIRCFNEADRIGRTLESVKELGQEIIVIDSGSTDDTVAIAKSHGAKVVYNPWKGFGPQRSFGETQCSFDWVFYIDADEVVTPGLRQELTQMFAIGEPVHACYLVRNTMVLPGDSKPRLFADFRKVPRLYNLKHARIKLDPSYDRMQLDDGYKMGTLRNPQHHYSFRTWAHALSKLNYTSELAAETQKQKPIWLLRLRLVTELPVEMFKYLFVRRFIFAGWKGFAFAATQSFSRFSRILKMLEKQQNVQH

SEQ ID NO: 2000 - protein, 285 aa, Eoetvoesia caeni
MTTTRGADSALDGEAAEAGSTRLRQLQNDAAPFTAAKATLSVIVITKDEARHIGDCLDSVSFADEIIVVDSGSTDGTRDIAQAKGAKVHITEDWPGFGPQKNRALDLATCDWVLSIDADERVTPELKQAILRELAAPRAQAYKIARLSNFCGRWIRHSGWWPDHVLRLFKRTTARFTDAAVHESVKAQGQGAVLEGHFLHYPYADMDAMIGKVNRYSTDAAQMMHARGKTTSIPGVLGHAFWTFVRIYIIRRGFLDGKEGLILAITAATGSFFRYSKLWFLNKSK

SEQ ID NO: 2001 - protein, 276 aa, Stenotrophomonas panacihumi
MSSSTAPSERPRLSACIIAFNEADRISDCLASLAFCDDVLVVDSHSTDATVALAQAAGARVLQRPFDGFRSQKDFAVTQAAHDWVLCLDADERVSDELRASILAARDGGFAGQAGYRFNRLSDYFGRFLRHGNAYPDRVLRLFDRRRGGWRGKREIHEAASVDGPVATLRGDLIHYPYRSLEQQLAKTQRYARMMAEHEHARGKRASWSKLVLAPAWRFWRGYVLRAGFLDGWRGLVYAYVRANYVRQKSIMLWLLQHGQPVGDPPRAPDQPRRNG

SEQ ID NO: 2002 - protein, 308 aa, Unknown
  Description of Unknown: Rhodopirellula sequence
MSHLTSVSVVVIAKDEAHIIQSCLDSLSWADEVVVVDDYSSDHTPSIAERAGARVITHRFDTFAGQRNWALKHARLRNEWVLMLDADEACTPAFTEAIENALNSVNDDTAAFKMCRKTMLSGRWLRYSDGYPVWIMRLVRNGRARFEDSGHGEVPVPSVDGRVQTIVEPFVHQPFSRGIQHWWDRHIRYAQREAWQECQEAANLDFRALVARDPSQRRAALRAFSRRLPCRAAFRFCYQYLFKRGFLDGAAGLQFCRMMACYEQMIVTKKWELAQSMLAESCVDRHKALLPTNPPTNQAVDEPRVHAV

SEQ ID NO: 2003 - protein, 266 aa, Unknown
  Description of Unknown: Sterolibacterium denitrificans sequence
MTPSPLASQGEAVPAPLLSVVVITKNEAHCIGACLEAAGFADEIVVLDSGSTDDTLTIAAAHGARVHVCADWPGFGPQKNRAVALAGGRWILSLDADEIVTPALAAAIKQAVSPDAAQDIAGYWIERRSLYCGQLIRFGDWRNDRVLRLFRRGAGRFSDDVVHERVICDGRTATLAGYLRHDSMTSFAELREKTERYARLGAAKLCARGKGGFFSACLHGGWSWLRGYLLRGGLLDGRAGWIIAGQNARGTFLRYLWAAREKNRAA

SEQ ID NO: 2004 - protein, 358 aa, Roseateles depolymerans
MSSAPRPTRRVVLVVIARDEAAHIARLLDSVSPWVDGMLVLDTGSRDATPQIAAACGARVEHFDWCDDFSAARNRALTLAGGDWHLLLDADEWLLEGGEALLALRDQPTDFVGTLALDDRFDDGRPRSAQSRLSRVLPGSVRYAGLVHEQPEHTLPVRALPLRVAHDGYLPERLAAKRGRNAVLLERSLQQAPGDAYLWYQLGKDHAVYDRADAAEQAFARAAALPHPMGAWWLDLVPRRLFALKQLKRHADGVMLAEAEMAACGESPDFFFALGDLLLDFAADEPAQAEALLPMIEAAWRRCLEIGERPDLPGAVAGRGSHLAAHNLALVLELLGRAADAAELRAAHGLAQPVGAPA

SEQ ID NO: 2005 - protein, 266 aa, Stenotrophomonas acidaminiphila
MSSSRPPAISACIIAFNEADRIGDCLASLAFCDEIVVVDSYSTDATVAIAQAMGARVLQRPFDGFRSQKQYAVEQARHDWVLCLDADERVGETLKASILQARANGFGMAAGFRFARLSDYFGRFLRHGNAYPDRVLRLFDRRRGGWRGTREVHEAASVDGPVQRLAGDLVHYPYRSLEQQLAKTQRYARMMAEHDFARGRRATLTALVLSPAWRFWRGYLLRGGFRDGWHGLVYAYVRANYVRQKAIMLWMLQHGLPVSTPTATQD

SEQ ID NO: 2006 - protein, 263 aa, Unknown
  Description of Unknown: Desulfobacteraceae bacterium 4572_130 sequence
MISAYIIAFNEEEKIGAAVKSVKWADEIIVVDSNSTDKTVEIAESLGAKVVQIPFKGFGDLRNKAMQACTYDWIFSLDSDERCTKEAEQEIKKIVIDKDSVDAYYIPRKNFFMGKWIKHSGFYPDYRQPQLFKKGTLVFKNDPVHERFEIKTLKPVGYFKNHIYQIPYKSLEEILSKANRYSSLGADKLDQAGKKPAMYKALLHGIWAFFDHFIMKLGFLDAWPGFIIAFSNFEGTFYKYAKLYENKKCPNPVTHLNEKIEKN

SEQ ID NO: 2007 - protein, 261 aa, Oleomonas sp.
MTDKLPLSAFIITLNEEDRLGPAIESLLPLVDDIVVVDSGSTDGTVALATRLGARTVHHDFAGYGPQKRFAEAQCGHDWVINLDADERVTPELAAEIRGLFAGGAPAQGGYHLPILQLYPHQTRPTPGAFEYDPVRLYDRSRSRYSDSPVHDRVVLGEGVSAGRLKGGLLHQSIRSLSHLIEKSNAYTDKQVADMLAKGRRVPALRLAVEFPLAFAKAYVGRRYFLMGAYGIIVSTTFAYFRFMRLAKLYEANLLRRRDKP

SEQ ID NO: 2008 - protein, 271 aa, Unknown
  Description of Unknown: Rhizobiales bacterium YIM 77505 sequence
MNAALPLSVFIIAKDEADRIGDTIRAVRDLTDDLVVVDSGSTDGTQSIAEALGARVIFNPWPGYGPQKRFAEEQCRYDWLLNVDADEVVPPPLAAEIRALFSTSEPPRPAYKLGIAEIFPGEEKPHPWAYTLWPVRLYRKDKGRYSPSLVHDRVDLAPGVKPGRLKTVIHHYSVRSLGDQLDKLNRYSDQQARDLELRGIEIPTWRIFFELPANFLKAYIGRRHFVRGVYGFLTAMNYAISRHLRVAKHYERRKLAKAGEGRAAAPGRAPW

SEQ ID NO: 2009 - protein, 530 aa, Selenomonas ruminantium
MPVSPARMGNRAGMPDAGGGSRFDAARSASLSSVDSAEGKAMKMRISACVIVKNEAENIGRWLESMQAIADEMIVVDTGSTDETVAMARAAGAKVYSFAWGNDFAAAKNYALEQATGNWILFLDADEYFTPASQAKVRPLLMRLEPHLKIEGVLCRLINIDTDDNNRIMTTLVQLRMFRNRRNLRYSGKIHEVLTLTKGRPLELANEIEIYHTGYSTHIVQAKLRRNLKIMEERIAANHGRTELLDDRYFMDIWYGLGDHAKAIAYAKRLLAHEELALDLRGRAYETWASCCIDDKHPAEETEACLAAAIRDCPQLAEFPLMRGLWHFDRREYLQAEQDLQAGLALTKDYPKDTVAGVMNNAARLLPSVYWRLGLLAQWQGDAARAQECYWQGLQQNRYHGGLLVTFWHFLQQQGIEAADCIAVLNVIYDKQADAAFLAQQLARQNGGLVYIYYAKQAGSSERPVLDCLAAGRPDGAAQLASKQLAFLYRLGLAAGDSKPSLMTALLPVGCEDIERAAQQMLKDMRDKDL

SEQ ID NO: 2010 - protein, 284 aa, Paenibacillus wynnii
MESVTSVLGGPGSYPISVVIIAQDDETRISSAIQSCRLFADEIVVIDGGSKDGTVQLAESLNCRVFVNPWPGYAKQREFGVERAIHDWVFLIDTDEVVSDELAADILERKRGLTDITVAYSLYRIGDFLGRWLDRGEYLVRLYNRKQYGIRNSLVHEMPDVSEDRTVRLEGVLWHQGFRSINDHVSRFNKYTDLEAQTAYASGKPFRISLLLLRPPARFLQKYFLHGLFKKGISGFAVSVFWVMYEFMVGFKHYELQSKNSLAQHNAEGQAEKEKKGERSYAVQ

SEQ ID NO: 2011 - protein, 262 aa, Hyphomicrobium facile
MPKVPISCFIIAKNEGDRIAQTIRSLRPWANEVVVIDSESTDNTVSVALAEGCRVITQPWLGFGAQKRFGEDQCRNDWVFNIDADEVVTPELAQEIIATFKNGNPKFVAYGLPIDLVYPGAEAPRPLARDHWYVRLYNRRFIRFRNSNVHDAVVTDGVAVGALKSPIYHYSMRSFADMKRKLDERTWLMVENAGSTSQGVLASRLIVELPMNFFKYYIVRRHWTGGLVGLRYASIQAVFRFLKIYRVLRSDKTKTSARDVTA

SEQ ID NO: 2012 - protein, 320 aa, Unknown
  Description of Unknown: Deltaproteobacteria bacterium sequence
MPCAGSIASSSSRNRRPRRCSRRCAPICTSREPTTPRTACPSASWWPRWAGARSSPAIPRIIPPPISSPACAGSSRYSVRLSATVIAQDEERDLPDCLASLRGFCDEVLVVDGGSRDRTREIARAAGARVLERPFDDFARQHEFARTEARGEWVLSIDADERASLELTRAELGGAHAAYSLPFKNHYRGVWMRHGGFWPDRHVRLFRRDACRYDLSRPVHEKLLVDGSIGDLDSPILHYTYASLDDCLGKMGRYGERAALALHAAGRRAGAWDVAARPLWRFLRSYFFQLGFLDGPAGAAMAWGKAFEAWVKYARLWELS

SEQ ID NO: 2013 - protein, 253 aa, Unknown
  Description of Unknown: bacterium P3 sequence
MERISAVIITQDEARNIGRCLESLRGVADEVIVVDSGSTDDTGSICRASGARFVPHPWEGFSGQKNYADSLAQYPWILSIDADEALSDDLRTTLMDLKKNGFAADTVYTLCRLNNYCGRWLRHGGWYPDEHVRLWRNGVARWDGVVHEQLQYVCPVRRQRLKGILLHYTYYSVDEHVRRTAKYASLAGEKAFEQGRRCGMGAVVWKPVGTFLKNYLLKGGFRDGSMGFVSARVSAFYTLIKYTRLFEKSKSKD

SEQ ID NO: 2014 - protein, 269 aa, Bosea sp.
MAPLSIFIIALNEADRIGRTLEAVRGLSDDVIVVDSGSTDGTQDVAKAHGARVIFNAWPGYGGQKRFAEEQCRHDWLLNLDADEVLPPDLAAEIAALFQRGAPPLDAYKLRIAEIFPGEKAPHRFAYALAPVRLYRKSKGRYSPSPVHDRVDLVPDARIGKLKGTVHHFSVRSLGEQMEKLNAYSDAQADDLDARGITVSGFRLVTEFPANFIKAYIGRRHALRGIYGFMTAMNYAFYRYLRAAKHWERRLRRNSGIDAPKSGGDSAGG

SEQ ID NO: 2015 - protein, 279 aa, Paenibacillus sp.
MNHMSSVPVDNRISVVIIAQDDEVRIAKAIQSCASFADEVVVIDGGSKDNTAQVSEALGCRVFINPWPGYAKQRTFGIERAQYDWIFLIDTDEVVNQELARDLVEKKATLHDPAKAYSMYRIGDFLGKWMNKGEYLVRLFNRRIYGITNSLVHEMPDVAEEQTIRLNGVLWHYGFRSISDHVMRFNKYTDLEAETAFSKGKSFKIMNLLFRPPARFCQKYFVQGLYRKGIAGFAVAVFWVMYEFLVCFKHYELTKRSKQVTLKNEEPAEKKGETSYVVQ

SEQ ID NO: 2016 - protein, 263 aa, Cohaesibacter sp.
MTSSRRKLPVSAFIITFNEEDRIATAIRSVVDWVDEVIVVDSGSTDRTCEIAAAAGANVSHNDWPGYGEQKRHAEDLCRNDWLLNIDADEEITHTLRDEIVALFDPLPDTDICKFEILDIFPHEAHAKSWGYGYWQYRLYDRHKGRFSDSSVHDTVRPLPDARIQTLKGKVNHRSMRSLSISVEKMNRISSMQRDDMLKRGRKISLWRVLTEFPLAFLKGYFLRRQFIYGFWGIVLAYNYAFSRFLRVAKMYEAELIEKNNSE

SEQ ID NO: 2017 - protein, 671 aa, Kineobactrum sediminis
MIQSKRGRQLLAALFLAGVGGSLLAPTMLSWATLLLAIAGLWLMHRQVLGRQGWEKPRELRLIHFGCWFFVLVYVLFWIASGFDYNALKELDGPARLIFFWPLVVAITWAKVRADTVFAAFAVAALGAIANVVADIWLGSVEVFAGIPRAGLAINLIALGNLALLSAALTLVGALYWFRAGHARLGWAAAVLAFLALAAALQTQTRSNLVALPVLLLLMLPLVSARYRLPVVAAGLAIIAIASLSSDRLVRTVTDMRAGQLDPPIESRLEIWDLSWGLFVDQPLTGAGLNGYTRAVERAIATEQVTAPEFVARCCRDHTHNDLLQSLATRGLAGGLSWLLLLSLPLLVFARYVRSRDITSAHLAVAGTLFPVGFFVFGLTEAAFSRTLFVTWYLVGVAAIAAALFLALNRACHRQRTVSLSAIVITRDEEAHIGACLQSLQGVVDEIVVLDSGSTDNTVAIAREYTDSVENTDWPGFGVQKQRALERATGEWVLSIDADERLSPQLAAEINHVLNAPDADAYKLPWAVTIYGTRLDFGRSGRAPLRLFRREGVRFSDALVHEKILLPEGRKVRTLRSRLVHYTHRDFGHALLKGAQYAWLGANEKYRQGKKVRTLVYPTLRGLLTFVQVYVLRLGFLDGSVGFLSAVLYAQVSFNKYAGLWTKARPRYGAE

SEQ ID NO: 2018 - protein, 277 aa, Chelatococcus asaccharovorans
MSISVLILTLNEENILPACLASVAWSDDVVVLDSFSTDRTVEIAKAAGARVYQRTYDNEHTQHTYGLKEIPFKYPWVYIPDADEITPPDLRDEMLAAVADPDCPEAGFRVRFKVIFMGQWLKHSSLYPTWVMRLVRPEKAHFEREINSVCVVDGPVGRLQAHFTHYSFNKGLNAWYEKHNRYSWHEARESLMSLERGSFRMSDLFSREAPRRRRAMKELSFRLPCRPTLRFLYMYFVRRGFMDGWAGYVYCRLLVAYEYMIVIKIAEIRRRRRGLPV

SEQ ID NO: 2019 - protein, 295 aa, Unknown
  Description of Unknown: Marinibacterium profundimaris sequence
MILTRDEARHIGRALASVSRIARRIVVVDSGSTDDTIRIARAAGARVLRHPWTNYATQLNWALDQLPPETGWVLRLDADEIVTPPLAHEIARQLPLQSPDTDGIYVSRRMTFMGRPIRWGGVFPVRVLRLFRHGRGRCEARWMDEHVLVSGPTGDFGGEILDDNRNTLGWWTDKHNAYAAREVVDLLNLEHRFLAHETIAGLQRGRPSGVKRWIKEHLYARLPGGWRAGAYFLYRYVVRLGFLDGREGAAFHVLQGFWYRYLVDAKLYQVRRHMRETGADAPTAIAEVLGIRVLD

SEQ ID NO: 2020 - protein, 514 aa, Sanguibacter antarcticus
MASTTATPTISAVLIVKDEEDVLEASLAALGWVDEIIVYDTGSTDSTRDLAGRHTPHVIEGYWDDDFGAARNRALEHATSEWALIVDADEIFEGDTAHLLRRLAADEANLFLVAVETVDGDTPRPEGPNVTARIFRRSEYRYAGRLHEQVVPIDPSTRPVLEPVLHVCIKHSGYTDAAIAKHDKRARNLTIAQRDLDEALARETPPVMLDILRTNLARALGMAGEHEASLALATVVRTNGVVPAVGLTDLAVSAVGSALALELDDVVDEWLTVWQHADSSPVWARATRVRILAGRGDLQGALDLLDQLPTTSVDSSGRRFHKHELSGIAVSALAATGRRRAAARAARESALAGYASVGPTILSRIFVQADRLDSYIRDLPDQVWREHAVWCVHEATPDSIAFLMAMAAVRPDDLTVLLCLAKIAPSLGLEDLAVSAAALRRVGLAEHCPLVTVSRSGDVEPQLRAIASAMAVGIYEDDRAVPGLEAALAAVAPQDEAELLRQLEIVTPGLVTAS

SEQ ID NO: 2021 - protein, 263 aa, Unknown
  Description of Unknown: Alphaproteobacteria bacterium sequence
MQKISAYILAFNEAEKIADAVSSVLWADEIVVADSGSTDRTAAIAQSLGARVVQLPFHGFGDLRNRAIAECRHEWIFSLDSDERCTAEVRDEIFALLSSPPDHDAYLVPRRNYMMGRWIKGSGWYPNFRQPQLFRKGAMRYDHDPVHEGYELLTERPLGRLQSAIWQLPVRNLEEVGNKMNRYSSLGMRKLSGKRVSMGGALGHGLWAFIKHYVFKHGYRDGWAGFVIALGNFEGTFYRYAKRYEEMKAWSAPSTAPLRRPPL

SEQ ID NO: 2022 - protein, 255 aa, Luteibacter yeojuensis
MTQRPISLCVITQDEADRIRDCLASASFCDDLVVVDGGSRDETQAIAREMGARVIEHRFEGYRSQKAFAVAQAKNDWVLCLDADERVGDELRAAIEQACDGGFTGAAGYRFYRRNDFFGRFMRHGNAGADKVLRLFDRRRGGWRGPREIHESVSVDGEVKMLAGHLDHFPYRSLAELMGKQERYAHMMAVEEFAKGKRATLAQIIISPMWRFFRGYVLRAGFLDGWRGIVYALLRVEYVRRKYVKLYLLQHGQKP

SEQ ID NO: 2023 - protein, 269 aa, Marinobacter halophilus
MKLPLSVYYITLNEEDRLPESLEKVKDWADEIIVVDSGSTDSTRRIAESAGARVVHRDWEGFASQKAYAASLCANDWVLDLDADEVLSDELVTNIQALFSQPAPVDVAGFRMRWVLSQPNPDHPFRHDKTKKILRLYNRSRAAIHSETNSNDDRPRVHRGKVLDLKGDVLHRTLISLEQMEKKYCQLSSEQARFLMQKGRRISTPRLMVEFPLKFLKYYLVHRQILNGWFGFSVAITAANRNFMRLAKAKELQMIERLEGKSQRSEHSR

SEQ ID NO: 2024 - protein, 299 aa, Rhodobacter azotoformans
MLTVVILTRDEERHIARAISSVAGIADRILVVDSGSSDRTAEIAKGLGAEVLHNAWRNYATQFNWALDRLPDSTQWIMRLDADEIVSPELAVQIAATLPRLGPEVEGIVVGRRMAFMGRVIRHGGLFPIRVVRIFRHGKGRCENRWMDEHVIVRGAVCDLPGELLDDNLNSLTWWTEKHNSYASREVVDLLNLEYGFMASDRTADMCTGQARTKRWLKERVYARLPGGLRAFAYFLYRYVMRGGFLDGREGLAFHVLQGFWYRFLVDMKLQEVRRLMRSHDIDIATAIRRVLNIEVATQ

SEQ ID NO: 2025 - protein, 267 aa, Unknown
  Description of Unknown: Planctomycetes bacterium sequence
MSASPARTPISACIIAMDEEERIGACLDALSFCDEIVVVDSHSTDRTRELAAAKGARVIERDWPGHVAQKEFAVRAATHEWVLCVDADEVVSQELRGEIEALRGALSNAGPAGYDFPRCTYYFGRWIRHGTWYPDRQLRLFDRRRGHWGGRDPHDRVELDGSRAALAGELMHWPYRDLSEHLATIDQYTTIMARGLHERGVRAGWSDLLVRPLVRFLRFYVLKLGFLEGWRGLWLACVAAHYVRLKYAKLLLLQSPPAPPLSSRPRS

SEQ ID NO: 2026 - protein, 467 aa, Unknown
  Description of Unknown: Peptococcaceae bacterium BRH_c23 sequence
MKTQKTVSLCMIVQDEEDCLLSVLQSVQGLTDELIIVDTGSTDRTPQLALAAGAKLFHATWTNDFSVARNFALQQATSDWILVLDADEVLESIDPETFSALLTNDQIEGYFLQIRNILDSSQIESSDQVVRLFRNKPIYRFEGAIHEQVTPSILRTNNGNGLASAPLTIHHFGYLKDRLQTKEKFTRNSEIIKKELQQNPNNPFLLYCLGLEYYQQDSISKGLNQLSKALVHMSGHEGYFEDVLLNMALGYLRLEEITPLSDFLSKALRMYPDHADFLFLRGTANFRQGNYPQATEDLEQSLSIGTIKLATSYQVSCLLGDVHHSSGNLQQAYEAYICALESSPTSSYPWQQLLSLIQKGYPIDDLLDYLWKYSRQVTGCPNLAANQLSSPESSQALLYEYAHKLVTLALKEIHFCSVIIEENDMGSTYFNLKNQVESTIQDALLIFCHIFMDSKVTIGFQGKEHIE

SEQ ID NO: 2027 - protein, 283 aa, Unknown
  Description of Unknown: Rhodanobacteraceae bacterium sequence
MSERPPISACVITLNEADRIDACLASLEFCDEVVVVDSGSADGTRERAAARGARVIEHAFEGFRAQKDFAVSQARHDWVLCLDADERVTPALRASIEAARAEGFAGAAGYRFARATEYFGAFLRHGNAYPDRVLRLFDRRRGGWRAGREIHEHAVVDGGVVTLAGDLEHVAYRSLDDQLARYRRYATMMAAHLHASGRRAHLANLLLNPFWRFLRGYVLRAGFLDGWRGFVFACMEADYVREKFARLWLLQHAAIDADRHNDASHSDGDGVDRSGTAPSSGQS

SEQ ID NO: 2028 - protein, 277 aa, Sulfitobacter sp.
MSISTLIMTLNEEENLGRCLDSLKWCDDIVVLDSCSTDRTVEIARAAGARVVQHAYESELEQRMFGLTQIEFRHNWVYTPDADEVTPDDLREEMLAISADPTRREAIFQARYKNMFMGRWIRRSSLYPTWITRMVRPELVRFERKVHSRCVSDHPTGRLKSHFIHYSFNKGLSAWYDKHNRYSSVEASLALSQGNHPRIAWEGLVSGDPADRRASIKAIAARLPFRPTLRFVYMYLLRGGFLDGWAGYTYCRMIASYELMIEIKTEERRRRDEGLPI

SEQ ID NO: 2029 - protein, 265 aa, Solimonas aquatica
MLSARPPRRHRLSALLICRDEADRIEACLQSLAGWVDELIVLDSGSRDDTVAIARRYSTQVYETDWPGYGAQRQRALEKASGDYILSIDADERATPELRAEIDALLAQAQPACGSWQLRWEFWFLGARIRHGRFESPQTRLFRREGLRWPPLPVHEAPILPPGPTGLLQARLPHHSFRNLRHAYEKHSEYAWLIAQQKYAAGKRASLGMAMLRGGWELFVQLLLRGLWRDGAPGLQLALLLAHYAFLKYAYLASLSLESPPVSGT

SEQ ID NO: 2030 - protein, 258 aa, Unknown
  Description of Unknown: Methylobacterium sp. sequence
MPPLPLSIFIIAKNEADRLPRVIEAVRHLSDDILVVDSGSTDGTQEAARALGARVIEREWPGYGPQKRFAESQCRHNWVLNLDADEVVPPDLADEIAGLFASGEPAAEAYEIRIAEIFPGEAAPHRFAYALAPVRLYRRDRGTYSASPVHDRVDLQPGARVARLRGTVHHFSVRSIGDQIGKLNAYSDQQVADLAARGKSTATARVFLEFPIAFLKAYIGRRHAVRGTYGFITAMNFAFYRWLRVAKDFERRNRERMP

SEQ ID NO: 2031 - protein, 273 aa, Lysobacter spongiicola
MPAPADARTPGPLPKLSATIISFNEADRIGRCLASLAFCDEIVVVDSGSTDGTRELASAAGARVVERPFDGFRSQKQFAVEQASHDWILSLDADEALSPELQASIRAEQQRGFDRAAGYRFARSSEYFGRFLRHGNAYPDRKLRLFDRRRGGWRGEREIHETATVDGAVATLDGDLLHWPFRSFEHQLAKGRQYAQMMAEYAHARGKRASLSKLILAPAWRFWRGYLFRGGFLDGWAGLVYAYVTSDTARQKTIRLWLLQRELATRTGEGPDQ

SEQ ID NO: 2032 - protein, 253 aa, Unknown
  Description of Unknown: Flavobacteriales bacterium sequence
MKQVTLIIPTLNAADSLTRCIGSCRGLYDELLLVDSLSTDATCAIAEGMGARIIAREYENSASQKNWAIPQAAHPWILLLDADEWLSPELHAEIAAWRASSAAEPHDGYWIYRANHFLGRRVRFSGWQGDKVIRLFQRDRCRYAPKQVHSEIEATGRIGRLKHRMNHNTFVDLPSWEAKLRRYAEWQAGDYHARTPRVTPYHTMVKPAWRFFKHFVLRGGILDGYVGYKVSAYAAWAVWLRYDVLRRRRTSSE

SEQ ID NO: 2033 - protein, 281 aa, Unknown
  Description of Unknown: Gammaproteobacteria bacterium 2W06 sequence
MGQALSLSVAIITKDEEPNLPRLLDSLEPLQPAEVVVVDSGSTDSTVVIARDHGAQVIETDWPGHVEQKNRALAACHQPWILSLDADEPISPELAANIRNLLEKQGQNQKAGYEVSRLTWYLGDWLRHVWYPEWRLRLVKNGAAQWTGHNPHDRLEVDGPTGRLSGDIHHYSYADIDDHFRRSIDYARIGAEALAARGRPFRWHKMIFSPLARFIRLMIFRQGWRDGWRGWIIAWSSMFSAFLKYAFLYEIERGRRNSGGNFDGNFGTGTKPTPTSDKNNG

SEQ ID NO: 2034 - protein, 258 aa, Halomonas halocynthiae
MTPITGIIITLNEADNITECIASLKPVCDEIIVVDSNSQDDTAVRATAAGAQVISQSYLGDGPQKAFAVPQAKNDWILALDADERLDDDAIAAIHQLALDDPKTAYRFRRRNFAGHHWVKAAGFYPDPVTRLYNRTTSGYLPKKAHSSVKAPKEVDLNAHICHFTYRDLSHWITRINQLSSRDAWAMKERGKKPSNWRPALHAINAMLRKLIFKGGIFQGADGMTVAITTAFHAYMKYAKLNELYENERAAKHNDSTD

SEQ ID NO: 2035 - protein, 273 aa, Granulicella mallensis
MRPSIILLAFNSADSLPATLASVDGLSDDVVVVDSGSTDDTVALAERAGARVLHHPFKNYGDQRNWAIDNASIRYAWQLHLDADERLTPELRDEIAALPEQTELSGFYLPRLLQFMNRILRHGGMSPTWHMRLFRNGAGRCEMREYDQHFLCTGATAQLRNVMIDDLRMPLTEWTARHNRWADAEVRELMRGENEGRIQGKATGNVLEKKRYLRGLYNDAPYFVRPICLFFYRYIVRAGFLDGMEGLIFYTLQTFWFRFLIDAKLYEARKRLG

SEQ ID NO: 2036 - protein, 274 aa, Xanthomonas arboricola
MSSSTAPDEWPRISACIIAFNEADRLRDCLRSLAFCDEIVVVDSGSTDATVTLATAHGARVLQRAFDGYRSQKAFCVTQASHDWVLCLDADERVSDALQASIIAARDGGFADAAGYRFARLSDYFGRFLRHGNAYPDRVLRLFDRRRGGWRGKREIHEAASVDGAVVTLAGDLIHYPYRSLAQQLAKTQRYAQMMAEHEHARGKRATWSKLVLAPAWRFWRGYLLRGGFRDGWHGLIYAYVRANYVRQKTIMLWLLQHNQPVQDPPRADERRGD

SEQ ID NO: 2037 - protein, 451 aa, Brockia lithotrophica
MDEGVRLSEVPKREAFLLSVAMIVRDEAEKLPRALTSVRDFADEIVVVDTGSADDTSEIAAAHGAQVFSFPWRGSFAEARNASLERCRGRWILVLDADEWLTTESGPALRELLEREKRTPCCEAYQVRIVNLVADAMGEPRRLAHFAVRLFRNNPAYRFTGRVHEQILPSILQHASSRHSYVVGTAPIELLHDGYKHVAKDKVMRNLELLEREWAEDPANPFTAYNLGVEYLRLKDTERAVEFLERSIALSPPRMAYLPLAYRYLAHAYASKGDLSNALKAATRGTETFPDAPDLWHLRGDLAWRAKDVPAARQAYLAAYALGNPPPGYPHEEGLGTYRTAFALGRLNEEEGNAEGAVTWYMRALRHRSNDAKVLAALFRLVARTWGEEALPRFVLTHLRAQDEDAWEFLVRLLKLLGHTRQAQALRRELRKREVKTAEKGGSGKPENSVP

SEQ ID NO: 2038 - protein, 285 aa, Cellulomonas sp.
MSGDVPVSVIVLTRNEEATLGNSLRRLERFDDVVVVDSGSTDRTAEIAVEHGARVVPFTWDGGYPKKKQWSLEHAGVRHDWVLLLDADEFPSPALVDEIAALVRSGRVDEHGAYDVALLYRFAGRYLRHGHRVTKRSLLDRRRCAFPEVGDLDAPGIREVEGHYQPETTGTVGALRHRVVHDDRDPVASWFDRHNRYSDWEAYLRRHAALRADVAARRTAKGALFDRVPFKPLAFFVYAFVARRGFLDGRAGFDYAVALATYYWQIGVKVRELERADQAVARRAG

SEQ ID NO: 2039 - protein, 262 aa, Labrenzia alba
MTERLPLSVFIIARNEADRISRPIESVIDWVDEVIVIDSGSTDDTISVAEKLGARVISNDWPGYGPQKRFGEDQCRNDWLLNLDADEEITPDLAQEIRSKFDDGSYIQADGWRIMIRDMYAHESEPASWAYGYHQIRLYDRRKGRFSASIVHDTVRPDEGTRIDNLSGIMAHRSIRSLDFQVGKYNRYSGMQVEDMRSRGRKLSRARLVTEFPVSFFKAYFVRKYRKYGWWGFILAMNYAHARFLRVAKAYEVELNDRQKRS

SEQ ID NO: 2040 - protein, 271 aa, Herbaspirillum sp.
MNTPPETAAVRLSVILITKNEVHNIKACLNSVDFADEIIVVDSGSTDGTVELARAAGAVVIETTDWPGFGPQKNRALEAARGEWVLSIDADERITPELADEIRQAIEQRASADACDISRRSWYCGRFIKHSGWTPDYVTRLFRRGKAKFTNDIVHEHLVVEGSTQRLKSVMLHYSFRDFSQVLQKIDNYSTLSARQAYARGRRASVGQAVLHGMWAFMRTYFLRLGFLDGANGLALAISNAEGSYYRYLKIWLLDQQDPLASSSANTVDRR

SEQ ID NO: 2041 - protein, 763 aa, Paenibacillus curdlanolyticus
MLLGVHLIVRNEAERLGGCLDSVWPWADELVIVDTGSTDATVQLAASYGARIVTSAWADDFAQARNIGLGQARTRWVLVLDADERVGAETDWANVRKMLLASGETAYRVMIENALGGAEGDEQPLLRSEAIRLFRADLGYQYVGAIHEQLAAMDGSGRLRDVDGPLAAIRLMHTGYSPALMAQKRTAERNGRIIREQLVERADDPFYWYNLGVTCCQQGEAAEASVAFARARMLAAPDAPYRPSLILDSARAMLAQGKEEEALALLGDGVQRYPNYADMQLLHGRLLERHGAWDEAKQAYFAAIAAGAGEGSEPETALTGGPAAIRPAAYITEAGAGGYQACTAFANLARRRGDRQTAAHYFERALVEQPGWQEALDGLAELLHEAGAEDAAIARTIVAYAGEEVQAAYEECREQQRGHGMSAADGKRTEAGHGDIRRQERAAAVAQALTGIGAYSAALPLWRLAGVPFGANGAVDTEGATAGGSVAVGESAKQPLHGVSRQELYAACLIRSGQYREAATWLYEQAYENNRCLSHSLGLDAALCCWMEGTRLSEYADLFLEEGTLALCMLAERVLLGHSEEAGTDMSGGESNTELAELMDRAVSHGLLRLALRWAAAREEAFAVSLHRHGYTEAAAERLLQRMAEGRLAAPGYAALGEMLYDRKLYGEALALFERAIETAPADERARLGAAAACMQLATEALIEREADRSAAAWLQEDRRRLASSAARLEGLGWRTVRTGAQRRRMRSGGAHEADFLMHDRQE

SEQ ID NO: 2042 - protein, 255 aa, Frateuria terrea
MSRVPISACIITFNEADRIDDCLASLAFCDEVVVVDSGSTDDTRARAEGRGARVLQRPFDGFRSQKAFAVAQAQHDWVLCLDADERVDATLRGRIEAAREHGFDDAAGYRFARLSEYFGAFLRHGNAYPDRVLRLFDRRRGGWRGEREIHEAVSIDGPVRTLEGNLEHHPYRSLSEQLAKQERYAQMMAEYQYARGKRAGLRHILLNPWWRFVRGYVLRGGFLDGWRGLLYALVRVEYVRRKFLKLWLLERGYRP

SEQ ID NO: 2043 - protein, 250 aa, Rubrimonas cliftonensis
MIADVVAAALGVADEVVVVDSGSTDGTQRIAAASGARVIDQPWLGNGLQKRAAEEACRHDWLLDLDADEIVSPDLATEIRALFAKGPPPEAAYALRLVTQPPYGALWADFSVASRVKLYDRRKLRMPEHRAWDQLEMKGARAGRLAGDLIHHSFTGIAQAADKLNKVSTARAREARLKPYPVVICRVLAALPFYFLRHYLLRGLWRAGVYGFAISMNSAYGRWLRDVKMLEAHYRAGRGPGAQAAGKSPR

SEQ ID NO: 2044 - protein, 252 aa, Unknown
  Description of Unknown: Gammaproteobacteria bacterium sequence
  MOD_RES (54)..(54): Any amino acid
  MOD_RES (69)..(69): Any amino acid
  MOD_RES (252)..(252): Any amino acid
MLSAIIITKNEQDRVGRCLRSVAGIADEIIVVDSGSDDDTVAIAKTYTDKVYVXAWPGYGLQKQRALEXATKEWVLSIDADEVLTPELADEIKSVLSSSPTEVSFKMQWAVMLFGRRLDHGRSARFVERLFRREGARFSDDIVHEKIILPKGKISNLKNRLLHYSNRDFKHLLDKMSLYSNLGAEKRHKAGRYGGGLIVAALRSILVFFQIYILRLGMLDGGRGFLMAAIYAQYTFNKYAGAWAIRENKNAX

SEQ ID NO: 2045 - protein, 608 aa, Acidimicrobium ferrooxidans
MLVRVCDHERVGADGAAWVLVPGESVPPDQIAAAPAVVIVVEDALVDARSARRLVELASQGVVAVPRSPSVVGRGHVLLTTGDDVGTVEGREALAERVSKHFAGLTEDLELVPTLAVAVPGAWAARALDERWTTVHELFARLVDSRPAELAFDAVAVARRPVEGLVPAAPRRRPLVSACMIVRDEAVWLADAIDSLAGFADEVVVYDTGSTDATVDVARRHGARVIEGTWDDDFGAARNRSAADARGEWIVWLDADERLGGDLATARARLADPLAQWEGYSVRIRNLTGVGLTWADHFAMRLFRRAAGAWRGALHETVWSRDHARPLNAHPASELHLVHLGYLDVVMRQRGKGERNLRVASHNESASEPLEALVHEIRSRLLAGEHATVVALVEDRVLPAPPGPLRKLGLLAGFESALALGSFDVARTFVDALATQPDVPAAFALEASARLAATTGDLEGALRDLAGIDTRVEDVDGLVVDPERLAGLTARCLAGLGRFDEASDVVVAALARGTVDVDLREVVAWFDHANRPLADLESAIHPEQRQLIAASVLPAAELAERLFWAFVEANPACTVWLAAGELAARRVGGPVHERWRRLLADAGLVPSA

SEQ ID NO: 2046 - protein, 259 aa, Niveispirillum lacus
MPDKLPLSVFIIALNEADRIGPVITAVRDWVDEIVVVDSGSTDGTQDVARSLGAHVIHHDWPGYGPQKRFAEEQCRHDWLLNLDADEVPAPELEAAIRALFADGRMPAHQAYRIRTVMVLPHQRRPHRFAPRHNYIRLYDRRHGRFANSTTHDAVEMHSGSVRALAPIIMHYSIRSHSDLINKLNRYSTAQADEIVSRGKGRRYGALRSVTEFPINLFRYFFLKGYWVFGLYGLELAAIIAFFRFARIAKVREILQRTS

SEQ ID NO: 2047 - protein, 262 aa, Bosea sp.
MPPLSIFIIARDEADRIGRTISAVRELSDDIIVVDSGSTDGTQAVAEGLGARVLFNPWPGYGQQKRFAEEQCRHNWMLNIDADEVVPADLATEIAALFANGEPAADAYKLRIAELFPGENAPHRFAYALAPVRLYRRDKGRYSPSPVHDRVDLLPEARVASLKGTIHHYSVRSLGEQMAKLNAYSDAQADDLDQRGETISVFRMVAEFPANFIKAYIGRRHALRGIYGFMTAMNFAFYRYLRAAKHWERRLQRRGRAKSDNV

SEQ ID NO: 2048 - protein, 263 aa, Marinobacter gudaonensis
MKLPLSVYYITQNEELRLPESLAKLSGWVDEIIVVDSGSTDRTRDIAEAAGARFVHNDWHGFACQKAFAASLCRNDWVLDLDADEVLSDRLVGNIQALFSRPVAEDIAGFRMRWVLSQPDARHPFRHDKSKWILRLYHRKRAAIQPEQDSNDDRPRVMAGRVLDLKGDVLHRTLISLEQMERKYCQLSSEQARFLAKKGRKISSARLFVEFPLKFLKYYLIHRQILNGWFGLSVAITAANRNFMRLAKARELQMLASFDDDAK

SEQ ID NO: 2049 - protein, 351 aa, Lactobacillus agilis
MQVSVCIITRDESQKLARCLESLKSLQGLVAEVLVLDTGSSDDSIQVAERFGAQVYQQAWRGDFAWARNYLASQAKCDLVLFLDTDEWVAGVDIPALEALLGQVDLQQTVGRIVRLNLNQTSQTQSLEPRLYLKSYFNFGGKIHEQVNRRDEGPVYYQDIPLVIKHDGYASQELLLAKAQRNLDLLLAELVKQPDDPYLLFQVGKSYYSQKNLELARKYFEASLKLKPAYSLGYVFNCLECLVLILLATEQVTAAQRWLATYPEYEHDGDYIYLQALSFFVEKNYDFAKKYFNLALKQPIVKVAGRNDFLAHYYLGLVYKEEGALELAKQHLSLAADKFSPAKEELLQLLQ

SEQ ID NO: 2050 - protein, 273 aa, Unknown
  Description of Unknown: Candidatus Curtissbacteria bacterium GW2011_GWA1_41_11 sequence
MKLSVVLAVFNEEDVLATCLESIKGLADEIIIVDGGSTDKTVEIAKKYGAKVFVTDNPPIFHINKQRAVDRAKGDWILQLDADEVVPEALSIEIRTVIPAIEPGSRQEKDWIPGQARNDNGFNGYYVSRKNYFLWYWMRKGGQYPDYVVRLFKRGKGSFPQKSVHEQIVVDGPIGYLKTPLEHRPYTSFAEYWQKAHTYAMLRAREMAGVKLEVTPETFVQYYFLRPTKTFLNLYVRHKGFVDGIFGFLFALFSAYQEPLAFRKYIQYGKNFN

SEQ ID NO: 2051 - protein, 318 aa, Unknown
  Description of Unknown: Peptococcaceae bacterium CEB3 sequence
MTNKPAPGGTNNILNPNLSLNLKLSLSLCLITRDEEQSLPACLESIRDLAAEIIVVDTGSRDETIQIAAAAGARIFHFPWSGDFSAARNYALSQAHGDWVLVLDADERLQVVEHTTLRGLLDNEGADGYYLEIQNSLAPGLVSHDKAVRLFRNKPCYRFRGAIHEQIAPSILEYGGPERLACAPLVLLHEGYTPEKMKLKRKSERNIEILERELRLQPDDPFLLYCLGLEHYQNNQVGQGLAHLENALTHMPGGEGYLEDAVLYTALGYFCLGHRQKLESFIAQALLMFPEHPDLLSLRSLSRLNPRGDCPPGEPPAS

SEQ ID NO: 2052 - protein, 274 aa, Unknown
  Description of Unknown: Rhizobiales bacterium sequence
MSDRLPISAFIIAKNEEDRIPNAILSVRDWVDEIIVIDSGSTDNTVKTAEALGAKTYFNEWRGYGPQKIYGENLCRNKWVLNIDADEEATPETIAEIKALFAKGEPEKKAFSMRTNCVFRFEDKPRRFAVSMIHGRLYNRDYAGFKDSTVHDSVVLRDGGKLELLKNGLNHYIFRSHHHTIEKVNFYSSMQAEDLFRKGRNPGVLKLIFTPLWAFFKAYILRGYILYGLDGVVRSHIYAFSRLIRVAKAREKFQEAEYNKRKAEQTSKGGASEI

SEQ ID NO: 2053 - protein, 251 aa, Arenimonas malthae
MNEAGRLGDCLASLSFCDEVVVVDSFSTDDTVAIARAHGARVLQRAFEGYRSQKQFAVEQAAHDWVLCLDADERVDATLRAAIEAERAAGFADAAGYRFARLSNYFGRFLRHGNAYPDRVLRLFDRRRGGWRGNREVHESASVDGLVKTLRGDLLHFPYRSLEQQLLKTQRYARMMAEHDFRRGKRATLAKLVLAPAWRFWRGYLLRGGFLDGWHGLVYAYVRANYVRQKTVMLWLLQQGQPVADPPQDRP

SEQ ID NO: 2054 - protein, 265 aa, Marinobacter guineae
MKLPLSVYYITQDEELRLPESLAKVSGWADEIIVVDSGSTDRTREIAEASGARFVHHDWQGFACQKAFAASLCRNDWVLDLDADEVLSDELVSNIRELFSKPVDSDIAGFRMRWVLSQPNPRHPFRHDKSKKILRLYNRTKAVIEGEKDSNNDRPQVKAGRVLDLKGDVLHRTLISLQQMERKYCQLSTEQARFLAEKGRKISNARLFVEFPVKFLKYYLVHRQVLNGWFGLSVAIIAANRNFMRLAKARELQMLAALEKDRTTD

SEQ ID NO: 2055 - protein, 263 aa, Unknown
  Description of Unknown: Alphaproteobacteria bacterium CG11_big_fil_rev_8_21_14_0_20_39 _49 sequence
MQKLPVSVFIIAKDEEDRIPRPIKSVIGWVDEVIVIDSGSSDKTMAVSASLGAKTVFNEWKGYGPQKVFGETLCKNQWLLNIDADEEITPELRDEIIELFKDGEPECKAYHVKIKVLGTFDNKPHRFAPYHNQLRLYHKDFAGFKDSTVHDSVVPKDDTDCPLGQLKNIVRHRSFRSYSHAIAKINRYSTMQAEHMYKKGRKPSSVRIIFEPFIGFFKGYFVKGRFLLGIDGFIESLIYSFGRVLRLIKAREMWKKHHMKKLD

SEQ ID NO: 2056 - protein, 666 aa, Ammonifex sp.
MADRISLCMIVRDEEQNLSRCLESVAGAVDEIVVVDTGSTDDTRQIASEFGARVHSFPWNDSFSDARNASLERATGDWILFLDADEELAKESRDVLRRLTAEGTAEGYFVKIINYLGGEGWIEPCPDLVFRLFRNRPDYRFRGAVHEQIVDVILEKNSQARYQVAEDLVILHHGYLNRQIQEKDKKHRNLELIRRELAAAPENRLLRYHYGVELYRAERYEEAAAELIRAANGIDPQTIYLPKLLRYIVLAYHAARRPGEALEIVRLGLGLFPDYADLYYYGGLISFEQKDYARAYDFFQRAVSLPEQPAYYASFHGVRGFRSYYYLGQLAEIFLNEEEALRCYITGLQDNPHFTAALESIVRLLKPHEDPVYARDCLEKLCDLCTPEAVLLMAQVLFRQSAYLLALEHLERVTGQGEVPAEILLWKAICLVQQRRYLEALRIIEDFGPGHSLYPLAKLNKILCFWLQGNRRRVRALVEELFALGLSADTGAVVGLLRDSLSRRRRVPEVALGKEGISLLLDIVMRVLDLGEKDRAKSLLAGLSPECLGKNARDVGQLFYRYGYLEAAEDYLRLYLKNDPGCAGTCFTLAEIKCREGAFLEAADFYRRALTLDPGEPRHYIGLIRLYEKTRREILREAVKRYPDVPIFRELLEEQFVQQGHTPADG

SEQ ID NO: 2057 - protein, 366 aa, Streptacidiphilus anmyonensis
MGHVSLSMIVKDEAESIVEVLGDASAFCDELVVADTGSTDGTQELARAAGARVVDVPWTEDFAAARNASLDACTGDWIIWLDADDRVPPASQQAFSRVLAALDGDVDAVISPYHCAFDESTGAPTFTTLRERVLRRAAGLRWSGAIHEVVDITAARTRSEPELVVEHRRTEAQAAKDEGRNLRILERLYAEGDRSPRTLYYRANELRDLGRHEEAAAAYAEVLETEQPAWERYFALMSRAECLQAVDRGAEAAEVALRAVLLDPTRPEAWMVAGMIPYEQHDWARAVPFFSAATAARTRPAEGFVRDRDHGWAPWDFLSVCLGNSGRHEEALHAGVRALRGNPQADRVRGNLGWFVSELPVTDSIG

SEQ ID NO: 2058 - protein, 253 aa, Flavisolibacter sp.
MRPEISVVIVCKNEEHIIGKTLQSVQSFAGELLVYDTGSTDGTLAIAKEFGARVVQAPWEGYGRSKQKAISLAVNDWVMNLDSDEVVDEEAQQQIRQLPLTDEKICYRFRFRNFLGQKALRFGEFGFDSHIRLFNRRQVLWNDAPVHEKLQQAAGVREQSLKGRILHYTMKDTAEFVQKSVNYALANAASYFERGKRATWVKQYLSPLVMFVKYYFIRLGFLDGWAGLFSARMAALYTYLKYARLRELQERER

SEQ ID NO: 2059 - protein, 249 aa, Herpetosiphon aurantiacus
MLLSVAMIARDEERHIGAALASIGDLADEIVVLLDPRTRDRTAEICLQAGARVVEAIFESFPAQRNRALAECQGQWVLFLDADERITRNLQHEIRQLLQGQPEYAGYWIPRFNRYWGRALRGGGWYPDHQLRLLQRSKAQYETSRLVHELVILDGLKGRLTQHLEHINIESWAELREKQQRYAQAEAATLYRNGVRVKPQNYILQPWRAIWRRYITWGGYRDGLLGMLLALVMGWYEFKMYLALAKHRA

SEQ ID NO: 2060 - protein, 410 aa, Sulfobacillus thermosulfidooxidans
MGQLTLAMIVRDEARWLPSCLQSVKGIVDEMVVVDTGSRDDTPRIARQFGARVIEIPWRQDFARARNVSLDYVKTPWVLVLDADEQLHPDDAPLIRMALQTDKFHAYDLWQVSLLSDAQDVAWARVTRLFRNLPGIRYEGRIHEQVASNVVRHGYQLASLDARLWHFGYLRDIWTEKAKAERNYNLLQRAVREEPGNGYLWWQLAQSAISLEEWNMVQEATKKALDAGTLPDSLVPVAWLTLGKGAAGQGVWTVAAAAFARAEQTALPNPFADAVFYRGEVHRANRAWAAAEQAFSQALTIGDTTPIPLHEQGTGSYRAWHGLASTYWARGENDRAAATALVAYRHYPAYRPLWLLIRQIFGNYTPREFAQVIPNVAADLPGLVRSQAWFPGDLVDQEIALGWENLPVLP

SEQ ID NO: 2061 - protein, 270 aa, Unknown
  Description of Unknown: uncultured Stenotrophomonas sp. sequence
MSSSSTSPPPVRLSACIIAFNEADRIGDCLASLAFCDEIVVVDSFSSDTTVAIAEAAGARVLQRAFDGFRSQKAFCVEQASHDWVLCLDADERVDATLRAAIEAERDARFARVRGYRFARCSEYFGRFLRHGTAYPDRVLRLFDRRHGGWRGDREIHEAVTVEGPVALLPGDLLHHPYRSFLQLLDKKQKYARMMAEHEFDRGKRANLGKLIVSPTWRFFRSYVFKRGFLDGWPGLIEAFVSANYVRQKTIMLWLLQNGQPLADPPRTRP

SEQ ID NO: 2062 - protein, 406 aa, Austwickia chelonae
MDTRLSIAMIVRDEAENIQRALDSVRALGELVAEVCVYDTGSVDGTAELAEAAGARVERGSWDDDFSRARNAALDMCRTEWVLMMDADEVVQADEMLFPALLELGVREGIHAFHVLQVNTGDDGTATDSVLQTRLLRPAAARYVGRIHEQVDARHGELVSESAPQDVIRLHHSGYAHAERTAAKLARNSAISQQALADPALADEERSRIRLHHARSIEASDPSSAEAGYRELAAEQGPYQVRAQEHLAHLLLDQERWEDAALALEALTATSSNKPFAAFLFARWCLGVGELDTGLSLLRELDQVWTSGGVIIPQHLLYTTRARVADELGLWDEALSCRLTAMASPGAGQAEVDAMFHQWGARPADPLMQLLREVLPVADPAIEDCLHRTRSASTQVARAVQRRRYR

SEQ ID NO: 2063 - protein, 527 aa, Paenibacillus taiwanensis
MNNEVHHPVHSHTAHSLQKGQCYTLQDSSQKNRIDHVPPHAHTAFIETKGHHTTPTPYPIAATPISQTMPVEKCMPHTSLLPITLCLIVRDEADVIGRCLASAVPLVREIIVVDTGSTDDTPHIAAAYGAAVHYFTWADDFAAARNASIVLAHQPWILVLDADEIMDPVSWQAESVLPLLLQDRVHAYYVRCVHLAERWHIGQPRPDALAVDMACRLFRQDPRFRFQGCIHEEIAASVQAAYPDGLQWAPLTLWHDGYAPEVLRLKHKSDRNRQLLLKQLEKYPDEPLWWYAYGTELFQDEQYKECLPWLMRTLSILTEPEPFDMPGYMSDVCLKSVYALQMTGQLDQALELAHLGNELYPNFPDLLELHAYLLGALNRFEEAYKCAQKATCCGSIEHLYTTTEGAGGWRSHWTAACMAEHLHRSGLAAKHYEAAAKDSKQPALRMMLTAASAAHRYDFHAAIQYMLLALNTTAASPFSAFAAHVHAALSMLYSMLQRQLVGQSHTDTQHKLTMGIQMAPYIRPFIK

SEQ ID NO: 2064 - protein, 654 aa, Desulfotomaculum ruminis
MGNRVSLCMIVRNEEENIGRCLESVAGLVDEIIVVDTGSTDETPRIAREMGARVYSFTWKDHFGEARNVSLTYATGDWILFLDADEELARESRDRLVQYTAEEQVEGYFIKIINYIGKEGWVETCPDLVFRLFRNRPEYRFRGAIHEQMVDVILEKNPQAAYRIANDIKIFHYGYLDRQIDEKDKKNRNLRIIQRELEQQPENDLLRYHYGVELFRFERYDEAAAVFIEVANGIDPQTIFFPKLLRYITMAYASSGQPAKALEVIRQALRFFPDYADLYYYGGRCCMELKQYAKATELFSQAVALPEQPPQYASFGGVRGFRSLYHLGEIAEFFLNQEEALRYYLESLRDNPDFRPSLEKIVKILDPRLNPEYTRECLKKVLDFSTPQATLLLAEIFFQQDAYRLTLDFLNDLMQWGVASEEFLFQKAYCLIQERRFLEALRILSGYTAESTLYPQVKVNELFCFWLQGKRKKVREIVETLRQMGLSKDTDNVLKLVVKAQENRKTQRKITLGEEGIILLLDILKRLLDLKEPQKAEEILSPVAPECLAPWKWDVILLYRKYGYLEKAVELAEEYLTQKRNGEVHFLLAESHQELGNFTEAELHYRYAIEQDPDQPAYYIQQIQLYEEWRKRLKKEHDGNQGEMTLCPEEVCPS

SEQ ID NO: 2065 - protein, 273 aa, Marinobacter zhejiangensis
MTLPVSVYCITKNEELRLGATLAKVADWADEVIVVDSGSTDGTETIARQYGARFVVHEWQGFAAQKAHAASLCRNDWVLDLDADEVLSDELVANIKALFTADPDPGFAGFKMRWVLSQPLAGHPFRHDRSKRILRLYHRGRARIQGIAGSNDDRPKVLKGKVGVIPGDVLHRSVINLEQMERKYLQLSCEQAQFLAEKGRKISSARLFVEFPLKFLKYYLLHRQIMNGWYGLSVSIAGANRNFMRLAKAKEIQMLAELEPGEKPSRSAGVGDG

SEQ ID NO: 2066 - protein, 311 aa, Unknown
  Description of Unknown: Xanthomonadaceae bacterium sequence
MAAVAGRPPVRHGDAVAGHRRCNATRATVATALPAGWRGASAVRPPRYRAGPPEDALVIRAPVKLPLSGVVIAKDEVDRIGRCVASLAEVCSDVLVLDSGSTDATAELARAAGARVEQQPWLGFAAQKNAAIARATQPWVLLLDADEWLDGTAAGALRSLFVDGGVERADVWQLPRRTHYLGTPLDHGGWGREWVERLFRPDLRYLSAEVHEKLDLRGRRVARVEARIEHDTARSDAEYAAKLDRYAALWARQRHAAGKRAGLFAAPLHAAAYWLKNFVLRGGFLDGGNAPRYHWLHARYVYRKYALLRAM

SEQ ID NO: 2067 - protein, 256 aa, Methylibium sp.
MTLSVTLITRNESRHIAACLQSVAFADEWVVLDSGSTDDTREIAASLGARVVKTEGWPGFGVQKNRALELARGRWVLSIDADERVSEALASQIQAVMKSEQSADGYELSRVSRFCGQWIRHGDWYPDRVLRLFRRESGRFTDDLVHERLKVNGRVERLEGDLLHDTMPTLDDALDKMNRYSSGRALDKVAAGRTGGLGAALAHGLWAFVRCYGLKRGFLDGRLGFVLAVYVAEGTYYRYLKMGLLTQQARNPIEPI

SEQ ID NO: 2068 - protein, 255 aa, Arenimonas oryziterrae
MALPLPLSGVVITKNEADRIGRCVSSLTGICAEVLVLDSGSTDDTVALARAAGARVEHQDWLGFSAQKNAAIALASQRWVLLLDADEWLAEGAETKLRALFADQRVERAEIWRLQRRTHFLGKALNFGGWGREAVERLFWQPVRYWPARVHEKLDSEGLRCKSLAVRIEHDTARSADEYRRKLDRYAELFAEERHAAGRRAGKLSPYTHWLFYVLKNFIVRGGFLDGPRGWQYHYLHARYVFRKYALLRALKKPR

SEQ ID NO: 2069 - protein, 260 aa, Zavarzinia compransoris
MADLSVFFITLNEEDRLGPALASVRDLVDDIVVVDSGSTDGTVRLAEQAGARVVHNDFPGYGRQKRLAESLCRHDWVLNLDADERVTPELAAEIRALFAGGRPPQGAYHTPILQLYPHQDRPTAGAFEYDPVRLYDRARSQYSESPVHDRVVLGAGVAAGRLKGGILHQSIRNLSHLIAKSNAYTDKQLEEMLAKGRKVSGLRLAVEFPFSFLKAYVGRRYFLMGTYGIGVAATYAYFRLMRLAKLHEARLLKEKVQAKG

SEQ ID NO: 2070 - protein, 272 aa, Unknown
  Description of Unknown: Gemmatimonadetes bacterium sequence
METTLPGTEAAARPLGDARLSACLIVMNEGDRIGDCLASLDFCDEIVVIDSHSTDATRELAAAAGARVIERDWAGHRAQKQFAVEQATHNWILALDADERLSSDLRMEIVALRAMGFTGADGWSMPRLSYHLGTWIRYGSWYPNRQLRLFDRRCGHWGGGDPHDRWKMQGSEGRLLGDLLHIPYRSFDEHLRTLTRYASISAARMHEEGRRANVLDLLIRPPLRFVRGFVLKRGFLLGWRGLVLAWLDAHSVWLKYTHLMVLARVQDQVSRQ

SEQ ID NO: 2071 - protein, 265 aa, Unknown
  Description of Unknown: Desulfobacteraceae bacterium sequence
MSKLSACIIALNEEDKIGPALKSVEWADEIIVADSYSTDRTAIIAQEHGARVIQIRFTGFGDLRNRAMEACSHDWILSLDADERCTPDARREIEQIISGNAAIADAFYIPRKNFFMGKWIRYAGFYPDYRHPQLSRKGMITFLPDAVHAGFDVHSDKPVGYLKSHITQIPYKNLEEILNKANRYSSLGAEKLEEKQIKCRMYKALTHGIWSFFTTYFFKLGCLDGWPGLIIALGNFEGTFYKYAKGYLKQKGLESFFEHSPVQDE

SEQ ID NO: 2072 - protein, 285 aa, Unknown
  Description of Unknown: Xanthomonadaceae bacterium NML93-0399 sequence
MRALSPVRTSSWTAWPRRRMRQWFDVRRTQPMASTLPLSGVVITRNEADRIGRCLASLAPVCRELRVLDSGSDDETVAIARAAGAVVEHQDWLGFAAQKTLATSRASQPWVLLLDADEWLDAQSQERIAGLFASGQIESRDVWCLPRRTWFLGKPLRFGSWAHEYVHRLSRPDLRYLPVLVHEGPDLTGKRVGHCEARIEHETARSLDEYRAKLAGYARLWAQQRREAGRRAGRMSAAVHAAAYWLKHYVIRGGFLDGRTGWQFHACHTRYVYDKYDLLRRTPSA

SEQ ID NO: 2073 - protein, 265 aa, Camelimonas lactis
MTLDQNHFSVFVIALNEADRIGATLDAARKVTDDLIVIDSGSTDGTQDVARAHGARVIHHDWPGYGRQKRFGEDQCRHDWVLNLDADEVMPDALIGEIKGLFAGGKPPFDAYRIPIAEMFPGEKAPHPLGFSLAPVRLYRRSVGRYSPSPVHDRVALPAGTATGKLRGVIHHYSVRSIGDQVAKLNRYTDMQAADLDARGAHVSTWRLLAEFPANFIKAYIGRRHALRGVYGFMTAMNFAFYRYLRVAKHVERRLADKARREGRL

SEQ ID NO: 2074 - protein, 351 aa, Kineococcus rhizosphaerae
MVLLTACLVVRDEAPRIAATLAALEPLVDEIVVHDTGSHDDTPGIARRAGATVLRGQWRDSFAEARNVALAAAHGDWVLSVDADETATGEPAALRALLTGASEPDLAVTLHNLREDDRTSGGGYTSTAVRLFRRAGARWSGRVHERVERDGAVPGRAPRLVPATLLQLEHHGYATEQVVRTKAMRNGQLARVELDELVAAGAPAPELARAVLKVGRAAVGTGEVQRAVDAFEAVRELVPAGGTRQEATDYLARVLLGAGEAELAVVLADELEQAGADVSYCRWLRAQGLAQSNRPVAALEQLEGLTCIVDTAGRRHDPRALEALRGLCRELLEAAARDRAAHLASSRGGAR

SEQ ID NO: 2075 - protein, 265 aa, Microvirga sp.
MLPISVFIIAKNEADRIGETIRAVRDLTDDLIVVDSGSTDGTQAVAEGLGARVVYNEWPGYGPQKRFAEELCRHKWLLNLDADEVVPPNLAQEIRDLFANGEPPKDAYRIRIAEIFPGESAPHPLAYALSPVRLYRLDAGRYSPSLVHDRVDLNPGARVGRLKGTVHHWSVRSLGDQINKLNRYSDQQAVDLDIRGVSIPTWRVFFEFPAAFIKAYIGRRHFLRGTYGFLTAMNYAISRHLRLAKHYERRLLSLATRKDGAPGGG

SEQ ID NO: 2076 - protein, 263 aa, Unknown
  Description of Unknown: Candidatus Phycorickettsia trachydisci sequence
MNNPISAFIIVKNGEKLIGHTINSIKNIVDEIIVIDSGSTDNTVQVAKDLGANVVFKEWPGYTQQKIFGESLCKHQWILNLDADEALSPELQDEINYIFQSASQDKYKGYKMHVTILLPNDQKPRLGAPAHLFTRLYNRNYISFANTSDPNTTHDSALLLPGLKEKDNLLTLVSPVYHRSFTSISGLLTKINFYTDEAAKTLAKQGRRVSKLRMYTEFFLCFFKYFFIRRYWVFGTYGVIYSYMFAFSRFIRLAKVYELQNSK

SEQ ID NO: 2077 - protein, 268 aa, Unknown
  Description of Unknown: Gammaproteobacteria bacterium sequence
MQNNKASYTLSVIVITKNEQDRIAKCLDSVIAIADEIIVLDSGSTDNTVAIAKTYTDKVYVTDWPGYGPQKQRALELATCDWVLSIDADEVLTLELAQEISDKLARSPPEASFKMQWAVMLFGKRLDHGRSARYVERLFRRQGARFSDDLVHEKVILPKGKTSNLNNRLLHYSNRDFGHLLDKTSLYAFLGAQKRFKAGRYGGGLFVAALRAGWVFFQIYVLRLGLLDGGHGFLMAMIYAQYTFNKYAGVWAMRQDDKKNNVASRNNI

SEQ ID NO: 2078 - protein, 281 aa, Unknown
  Description of Unknown: bacterium BMS3Bbin04 sequence
MTDTTSQPVNRPKLSIVIMARDEELNIVDCVKSADFADEVIVVDTGSADDTRQLAAENRAIVKELAWHGFGLTKSKALEMGTGDWVLSLDADERIPPALAEEILTEIRSSKHDGFELPRRSFFLGHEMRHGGWDRDWVLRLMRHGQFKVTGDAVHEKIIVKGSFKRLYHPLDHHTNPTFAAYQAKIELYSTLAAIKIAKDKSRHAGVWAGVRHGLAAIIKKYLLQQGYRDGALGALLAVSTGYEKFLRYTKAGLIRKGMVDELTRTRLNVVALEDSDKNSP

SEQ ID NO: 2079 - protein, 266 aa, Microvirga massiliensis
MLPLSIFIIARNEADRIGETIQAVRDLTDDLVVVDSGSADGTQAVAAKLGARVIHNDWSGYGQQKRFAEDQCRHEWLLNLDADEVVPPDLASEIRALFERGEPPLQAYAFRIAEVFPGESAPHRLAYALAPVRLYRKSAGRYSPSPVHDRVVLNPGVKVGRLRGVVRHYSVRSLGDQIAKLNRYSDQQAEDLDARGVSIPAWRVFVEFPAAFLKAYFGRRHALRGTYGFLTAMNYAISRHLRLAKHIERRRADAASGRAPRNGAAR

SEQ ID NO: 2080 - protein, 253 aa, Inmirania thermothiophila
MRPITATIITLNEEEHLPACIESVRPVCDEVIVVDSGSTDRTVEVARALGARVLEQPYLGDGPQKAFAVPQARNDWILSIDADERLEEDAVAAIGGLDLDRDDVDAYALRRRSFVGNHWIRAAGFYPDYVVRLYHRGRAGYLPRKAHSRVEARRVVRLQAHLRHLTYRDVAHWVERINALTSYDAWAAYERGRRARPWTPALHAAAALVRKLILKGGILQGMDGWNVAVTTAFHAYVKYWKLLERQRREDGPR

SEQ ID NO: 2081 - protein, 259 aa, Hydromonas duriensis
MNTLTIAILTQNEARKIGKCLASAAFADQVIVMDSGSTDQTVLIAKAAGAETYIESDWQGFAVQRNRILPHVTSDYIFFLDADEEITPQLRDEILSQVQSSADAIWEVFWEQFAFGRSLRPMNNNKSGGVQRMFKTASLSHFEGVVHEGAVMNSKNLSVKPLRSYLLHYSRDNIYDAILKLAQYSRLGAFKRQQKGKVGGIWRGFASAFALFFRLYVLRRGFLCGGAGFLYSFFVALECFFRYAMIKYDADSLSQFVKR

SEQ ID NO: 2082 - protein, 278 aa, Pelobacter acetylenicus
MTIPVSVLILTLDEEINLPRCLASLQWCDDVVVLDSGSQDATQNIATEWGARMVERPFDNYARQRNFGLEKIPYKHPWVLMVDADEEVPSELVEEMNKTIAGCCEKTTLYRMRRKDFFLGRWIKRSSGYPTWFGRLIKVGHVRVERAINEEYNTDGYIGFLQGHLHHYPFNKGFSAWLEKHNRYSTMEADLMVKGGIDTPALSDLFGSDPANRRRAIKSLVYRMPFRPLLMFVALYVFRGGFLDGRAGLSFCLLRSFYEFMINCKAQEVHLRQNDMPL

SEQ ID NO: 2083 - protein, 266 aa, Unknown
  Description of Unknown: Acidobacteria bacterium sequence
MPAISATIITFNEADRIAEAIGSLSCCDEIIVVDSGSIDQTREIALARGARVIECPWKGYSRQKNFAAEQAQSDWILSIDADERLSMELADEIVYWKKSAARASGFEKACDPHPARHGAALSQGGKAVSMPRRVFYLGRWIKHSGWYPDRKIRLYDRRVCRWEGDFVHEWLKVDGAVSAFKGDLLHFPYRDWNDHAARTARYSELAARAARSSGRRGNIGRLLLAPPLVFLKAFLLRAGFLDGWRGLAIAYMGARYVFQKEFRILR

SEQ ID NO: 2084 - protein, 275 aa, Unknown
  Description of Unknown: Stenotrophomonas sequence
MPSPSTTLSSQRPRLSACIIAFNEADRIGDCLASLAFCDEIVVVDSFSSDATVAVAEAAGARVLQRAFDGFRSQKAFCVEQASHDWVLCLDADERVNPELRAAIESERDAGLPRAVGYRFARCSEYFGRFLRHGTAYPDRVLRLFDRRHGGWRGDREIHEAVSLDGPAALLKGDLLHHPYRSFLQLLDKKQKYARMMAEHEFGKGKRASLGKLIIAPSWRFIRSYVIKRGFLDGWPGLIEAFVSANYVRQKTIMLWLLQNGQPLVTPPTGAGPGN

SEQ ID NO: 2085 - protein, 253 aa, Xanthomonas sp.
MSTSAAPAPLPVSGVVITRNEGDRIGRCLDSMRALCAEMIVVDSGSTDDTVAVATAHGARVVHQDWLGYAAQKTFANTLAAHGWLLLLDADEWLSPGTEAKIRTLFADGRVETADGWLLTRRNWFLGHRLRGGEPMERLVRAGWRYLPSQVHERPDLAGKTIRSMDADFEHDTSRSHAEHVAKLSKYAALWAAQRREAGKRAHALDGPLHAGAYLLKQYLLRGAFLDGAAGWRFHKAQAHYVLEKYRRLRALS

SEQ ID NO: 2086 - protein, 257 aa, Breoghania corrubedonensis
MNRIPLSIFIITRNEADRIGATLDAVRDISDDIVVVDSGSDDDTRAIAEARGARVLVNPFTGYGAQKRFAEDQCREPWLLNIDADEICPPDLVAEIRALFTDGGPSHQAYRVPIAEQFPGEGAPHRWSYTIAPVRLYHRDAGRYCASPVHDRVDLATGVTPARLRHRIHHRSIRSLSDELRKLNAYSDMQVADLEARGKRLPAWRMVSEFPFAFLKAYLLRRHFVRGRYGFLTAMNHAIYRHMRIAKHLERRWRNRS

SEQ ID NO: 2087 - protein, 308 aa, Unknown
  Description of Unknown: Dehalococcoidia bacterium sequence
MLDVGRGRAELDVGCWMLEVGAGGMSEITVIIPARDEAVHIARCVASARELGRVIVVDSGSTDATREIAASSGAEVVEHAWEGHAAQKNWALGHLDIGTEWVLFLDADEYLLEETVAEMREAIRSDDAAGYELPRRYIFLGKELRHAWWYPDYQLRLFRREGARCEDVQVHEHMIVDGPVQQLRAPIMHENLKGLSAFVARHNRYSDLEAAELANPASNRKRGSFTGSWAERRRALKDRVWFRLPMRPVVRFLWLYFVKRGFLDGRRGLLFCYLIAMYDFLIDVKLLERRLAAAAEPMAAPARMEVQP

SEQ ID NO: 2088 - protein, 235 aa, Salinibacter altiplanensis
MISVLILTLNEEENIGACLDSVAWSDDVLVLDSGSEDRTVDIARQHDARVMHRDFDTFAGQRNYGLEEGNLRHNWVLDLDADERVTPSLREEIETVVRNTDKTAFRVPSKLMFRDTWLKYSGMYPTYQVRLGRRDTLRFDQVGHGQRGALPRKDIGTLDEPLLHYAFSKGISDWIERHNRHLTDEARQIVENDPERIAWKDLLEGDTQSRRRALKDLSYRLPLRPLWRFFVYTTT

SEQ ID NO: 2089 - protein, 276 aa, Unknown
  Description of Unknown: Methylobacterium sp. Leaf108 sequence
MTVLPLSIFIIARNEADRLGATIAAVSDLTDDLVVVDSGSTDGTQALAVSLGARVIHNDWPGYGPQKRFAEEQCRHVWLLNLDADEVVPPDLAHSIRAVFSAGEPALAAYRLAIAEIFPGEARPHPWAYRLTPVRLYRRDRGRYSPSPVHDRVDLQAGVDAGRLPGVVHHFSVRSLGDQLDKLNRYSDQQADDLDARGVTIPTWRLFVELPGNFLKAYIGRRHAVRGAYGFLTAMNYAISRHLRVAKHYERRLLQRHRDPSARPHANRVDPPDTKF

SEQ ID NO: 2090 - protein, 252 aa, Unknown
  Description of Unknown: Candidatus Phycosocius bacilliformis sequence
MALSVFIIAKNEADRLARTLESVRHLSDDIIVVDSGSTDGTQALAESLGARVIFNPWPGYGLQKQFGEDQCRHDWMLNIDADEVVTEELATAITHALSSPDVAPSAFETQIVEMFPGEPRPHPWAFRLNPVRLYHRKVGRYSPSPVHDRVDLVAGTKVQRLAGIIEHRSIRSLGHELIKLNAYADMQADDLDRKGRKIAGLRLILEFPLAFLKAYVARRHFVRGLYGFMTAMNYAFYRYLRLAKYWERRLGR

SEQ ID NO: 2091 - protein, 266 aa, Bosea lupini
MPPLSIFIIARDEADRIGRTIAAVRGLSDDIVVIDSGSTDGTQDIAMNLGARVIERGWPGYGPQKRFAEEQCRHPWLLNLDADEVTPPELVAEMAALFAGGQPACDAYRLRIAEIFPGEGAPHRFAYALSPVRLYRADKGRYSPSPVHDRVDLAPGARVGKLKGTIQHYSVRSLGEQMQKLNAYSDAQADDLDARGETLSVFRLVAEFPANFIKAYIGRRHMLRGVYGFMTAMNYAFYRYLRVAKHWERRLQRRSVRGNGNGGPGG

SEQ ID NO: 2092 - protein, 271 aa, Bosea sp.
MPPLSIFIIAQNEADRIGLTIAAARAVSDDIVVVDSGSTDGTQGVAEALGARVIFNPWPGYGQQKRFAEEQCRHDWLLNLDADEVLPADLIAEITALFQAGAPAADAYRTRIAEIFPGERAPHRFAYALSPVRLYRKSKGRYSSSPVHDRVDLQPGTKVGKLKGTIHHFSVRSLGEQMDKLNAYSDAQADDLDARGATVSAFRLIAEFPANFFKAYIGRRHALRGLYGFMTAMNYAFYRYLRVAKHWERRLQRNAGITPAGSLTGKQPNDG

SEQ ID NO: 2093 - protein, 444 aa, Anaeromyxobacter sp.
MAHVSLCLIAKDEERMLPGCLESVRGVVDEIVLVDTGSTDRTRELARAAGARVLERPWDDDFAAPRNLAAAHATGDWILPLDADERLAPGAGVALRRALRRATFDVGLVRCHNADAPDAPAGEVLSGARRAGPPALLPRVVRRAPGLRWTGRIHESVLEWAAARGGRIAALEVDLVHLGYSKEIWDGRGKRARNLALLRRRAEDEPGSVIALGYLAAELLALGQAEEAGEIAERAWAALDRQPRHRSIRRLAVVRAALAVRRGDAAVALEAVDRAEAAGGPNPDLPFFRACALEISAGAPGAPGREERLVRAAAELRRALALLEGGVFDQVIYAQRARALARLGAVELRAGRAEAARAAFRAARTPARPADALAPAEGIEAAAGEAEALVALGRAGEALAALEPVLAAGGPPRAWAAAARAAHALGALDDARLFLARARAAAAA

SEQ ID NO: 2094 - protein, 283 aa, Phycisphaera mikurensis
MPAVRLPISILILVKDEEEHLPLLLETLGGFEDIVVLDSMSTDGTIEIAEAAGCRVVRRQFDTWAEHQNWAMENIEFRHRWVFYLDADERMTDAVRGEIHQIAASPQEPPPHRAYYVGRDNRLFGRSLRHAMGGGVVMRFFQPAHIRFARRVNPQPVLEGEPGYLRSRFIHHHFARGFAQWFEKHNRYAGWEAQEWIEAVDATPLRWKPLFARDRNTRLQAIKRASFHLPFRPLLKFLHMYLWRRGFLDGSPGFHCCVLMSIFEYMIGLRVKEMRRRSAGKPV

SEQ ID NO: 2095 - protein, 245 aa, Unknown
  Description of Unknown: Deltaproteobacteria bacterium sequence
MTRLSATIIAQDEERDLPDCIASLQGFCDEILVVDGGSRDRTREIAASLGARVLDRTFDDFARQHEFARVEARGEWVLSIDADERASPELRRAPFGGAAAYSLPFRNHFRGIWLRHGGFWPDRHVRLFRREACRYDPGRTVHEKLIVDGPVGSLDAPILHYTYDSLQDCLLKMERYGEQSARMLHARGARASAWEVALRPLWRFLRGYVLRLGFLDGAPGAAMAWARAYEAFRRYARLWELSRFS

SEQ ID NO: 2096 - protein, 262 aa, Labrenzia sp.
MTERLPLSAFIIAKDEADRIHKPIESVIDWVDEVIVIDSGSSDDTVAVAERLGARVIRNDWPGYGPQKRFGEDQCRNDWLLNLDADEEVTPDLAAEIRAKFADGSYKSADGWRIMIRDMYAHESAPAPWAYGYHQIRLYDRQKGRFSVSIVHDTVRPEPGARIDNLSGIMAHRSIRSLDFQVGKYNRYSGMQVEDMRARGRKLPRTRLLTEFPVSFLKAYFVRKYRKYGWWGLILSMNYAHARFLRVAKAYEAELLEKAGKD

SEQ ID NO: 2097 - protein, 274 aa, Oharaeibacter diazotrophicus
MSDQTTDRTTGAAATPPLSCYIRTKNEAGRIGEVVRAALACADEVVVVDSGSTDDTVALAEAAGARVVSVPWRGNGGQKRAGEELCRNDWLLDLDADEIVSDELAAEIRALFAAGPPARPVYELTLVTVPPTGEVWSTFVLAHRRKLYDRRVVRMPDHPAWDQLELGRGAAVGRLGGPVYHHSFRDFEHVVAKLNRISTVRARETRPRSRAELAARVLFALPFYFLKHLVQRQLWRAGVYGVALAGISAFGRWLRDVKMYEALRMADPPGPRRR

SEQ ID NO: 2098 - protein, 367 aa, Roseateles depolymerans
MSARWRTCLVVIARNEAAHIGRLLDSVRPWVDDMLVLDTGSTDPTPILAAQAGARVAHIAWPDDFSRARNAALDLASADWHVVMDADEWLIDGGEALQALRQTPPGFVGTLALDDHFDDGIAHTRLSRVLPGTVRYAGRIHEQPRHALPIQPLPVRIGHDGYLGSRLKDKQGRNRKLLEAALADHPQDAYLWYQLGKDASVYEDFAASEDAFATCAACLSGSTSASTSGSTSASTNVSPIGNPSWWPDLVARRLFGLKRLARHADGVVFADSQLAACEHSPDVFFALGDLLLDWAAEDPTQAEVLLPMIEEAWRRCLVLGERPDLPGAVSGRGSHLAAHNLALVLEGTGRADEAKALRTEFPAPTRP

SEQ ID NO: 2099 - protein, 364 aa, Paenibacillus sp.
MSQPISACIMTKNEQDNIGACIDSVKPYVKEIIIVDTGSEDDTVKIAISKNVRVHQMEWKNDFSIVRNEMIKIATQPIILMIDADERVLPNQEESFRDTCNLLFDDHDKIGRVTILNEQENKETLKSSISRIFKNSSSFSYAGAIHEQIQSESSNTTYFQSGITLEHKGYLNSSLIAKDKYERNLSLLFNELKNARNGSYINFQIGRTYYVMGENKKAIDYLKEVYHEELLNQPYYSTVIQIYGWALLKEKNYSELFNLLQRGIELYPDYTDLYYLFGCTLIEMKSAEYVYLIPETFQTCIELGEPDSNKYETVEGVGSFKARYNLGLYYELTHQIDKAVVEYRLSASENFKLATARLEKIILA

SEQ ID NO: 2100 - protein, 373 aa, Unknown
  Description of Unknown: Candidatus Rokubacteria bacterium sequence
MDGRQVAPVLSATLIVRDEAAVLPRCLASIRDLVDEIVVVDTGSADDSRRIAADFGARVFEFPWRDDFAAARNAALEHARGRWILYIDADEAIVPTSHDTLAGHLLDPGLVACTVRFRPRTGFTRYQECRLFRNDPRIRFRNVIHETMLPDIENVKHADGLRMGHSALAVDHFGYDGNQDAKHRRNVPLLRDRLARDSDHVYSWNHLGQALAGLGDMDGALNAWWRAVEVVRARGVQSALDRLPYGSLLLHPGAAAEAPRLLPEALECFADDHLFRWLHGRRLADAGQLAEAIPLFERLAAIDAELHCDDQGIAYDARIFGVFSYEALGLCHFRLERYEDSARYYALADRVDPGNPVHRLKHRLATSRLSRGA

SEQ ID NO: 2101 - protein, 264 aa, Marinobacter zhejiangensis
MPDGYFCGPGSGGLSLKLSAVLITKNAGPDFRRCLESLAFADEIVILDSGSTDDTLAIAEEAGARVFTSEDWPGFGPQRQRAQEYALGEWVFWVDSDEVVTDELAQSIQAAVVSAPANMVFQLNRLSWFFGRFIRHSGWYPDRIVRLYRRAEYRYDDALVHEKVTCDGARVGSLEGDLLHYTATDFHDYMSKSVRYSDAWAEGRARKGKTATLGSAISHSVGAFLRKYLLQRGFLDGRHGFLLAVFTAHYVFNKYAALWIRSRR

SEQ ID NO: 2102 - protein, 264 aa, Unknown
  Description of Unknown: Candidatus Parcubacteria bacterium sequence
MKRPNLSVYILAYNEADKIRDAIESVRGWADEILVADSHSTDGTATVAKKLGARVVQIPFQTFGQLRNKAIAACNHEWIFSLDADERMTEEAKREIDEVLRLPAADLYFVPRRNFFFGRWIRHCGWYPDYRQPQLFRKGTLTFSEADEVHEGWKAKGEIGYLRHAIIQIPFSGLNQLQQKACRYSDLGARKLLREGQPVGMWRALAHGIWAFVRIYILKLGILDGWAGFIIALGNFEGTFYRYAKAVERRDGLNKFNSRFSADE

SEQ ID NO: 2103 - protein, 267 aa, Unknown
  Description of Unknown: Planctomycetes bacterium sequence
MTTAPAPCRRAPLSACIIAFNEADRIEDCIRSVDFCDDIVVVDSGSTDATRELAAALGARVIEREWPGHVAQKEFAVRAARHDWVLCVDADERISPELALEIRSLQSDGFSGERQAPAGWSMPRLTWWMGQPIRYGTWYPNRQLRLFDRRRGHWGGHDPHDRVILDGDFDQQRGLLAGDLLHHSYRDLDDHLATIAKLTAVAAAGLHARGRRARLGDLWLRPAVRFVRFYFLKRGFLLGWRGLALAFLAAHYVRLKYLRLRILQAQA

SEQ ID NO: 2104 - protein, 367 aa, Unknown
  Description of Unknown: Gemmatimonadetes bacterium sequence
MPSTGWRRSPHCPPASKDCHSRSSRGWRSASRSWRRGREEAPTSSRRAKRGCSFRRWSRARGPRRSNGCSAIRRSPHGSGPVAASWCGGSTRSSAWSSARRPYIVKRWSAASSREGRVQAPITIVIPTLNEAAQIAACIRHLDWTADVVVVDGGSTDDTVALARAAGARVITDGPRGIGEQRNAGIAVARHGWVFALDADERIGPELAQEIMAVPAGATPAGATHEAYRVKRRNAFQGRVLQRGHWGNDWVVRFARREFRYGGSAVHPGLQGLRDVGTLTQQLDHTPYRDLSHHIEKLVAYAQTSARALAARGQRARWSDLALRPAAHFWREYLLRGGFLDGRMGVIQAAMGAIGGFLKYAFLWEQE

SEQ ID NO: 2105 - protein, 297 aa, Methylococcus capsulatus
MNLTAIILTHDEEKHLARCIDSLQGVADRVVVADCFSTDATLAIAKAKGARVIQRAWVNYATQFNWALTQLDPDTGWVLRIDADEVLTPALAAEIRARLPELGPEIDGVNFGRRMTFQGRLIRWGGVFPVKVLRLFRYGRGQCENRWMDEHIKVAGATVDFTGELIDDNLNPLTWWTDKHNRYASREAVDLLNLKYGFMPHDTVASLRGSQAGVKRWVKEEIYARLPGGVRAFVYFFYRYVLRLGFLDGQAGAAFHVLQGFWYRYLVDAKVVEVERCMAQRGCSVVEAIEAVLGIRL

SEQ ID NO: 2106 - protein, 355 aa, Actinokineospora cianjurensis
MTSLSVTMIVRDGAATLGRVLEHAGAFCDELVVVDTGSRDDSRAIAKAAGARLAEFPWRDDFAAARNASLDLCRGDWVMWLDADDVVPAASRAAVKELVLDDRLDAVTAPYQYGFDPVTDACVALVPRERLARRVPGLRWVGAVHEVLAVPGDRREYRADLVVEHRPAPGRSRGTRNLDILERVVRQGDRSRRTLFYYARELRDLGRDAEAVDQFTAYLTDPGADWEHHAALLCLADCHAHLGDPHAQLDALHTALRVDSSRAEAHLALGTFHADRDQWPQALPYFSAAASTTPPTTGFITLPTYTWRAWDYLSLCLAKLDRHQESITAALHSLRLGNPDRTRLLDNINWSARSI

SEQ ID NO: 2107 - protein, 364 aa, Paenibacillus panacisoli
MGSLLPISACILTKDEEDLIAETIRSVTPYVREVIVLDTGSQDNTVHIARTCGAKVFETEWLDDFAAARNHLLGLAQEEYIFMIDADERYQGKGEDLKRYIQAKHRMPGRIKIINELDQGENSVSYITRLIPNNGQYSYRGSIHEQLYCSDESVSGMDTEITVLHEGYKKSILEKKKKTDRNLRLLMKQLNDYPQDPYVLFQIGKTLYVAKDYSQANEYLAASYHLLMNEEAYDYTFTPNVVLQYCYCLLKEKKWLELRNILGKALEKYPNYTDLYFIQASSIIESGNVQEFHSIPNIYYSCLELGEVRSGTYETVAGVGSYRALYNLGIYFEITGQIERAKEYYAASAKQGFIQATKRLEILD

SEQ ID NO: 2108 - protein, 268 aa, Unknown
  Description of Unknown: Chloroflexi bacterium sequence
MPNPTITAVVIARDEAKQIAACLASARPLTDDLLVLLDDRTSDDTARIAEAAGARVVVSRFVNFSAQRNRALETAGGDWVLFIDADERLTPTLIAEIKKCLAALPSALPPPMREASIAGYWAARRNYMFGHWVRHAGWYPDYQLRLLRRTAARYDESRAVHELAQLSGPDAKLREPLIHYNYETWAQFRAKQRYYTAFEARILYQQGQRVRLRNFVLQPLREFRRRYISLEGWKDGWLGLALALAMTWYEFRKYVMLWRMGKLTCHCR

SEQ ID NO: 2109 - protein, 304 aa, Pseudovibrio sp.
MRPAISSQSKIINIKERRAQRVELACDESSVKPRIPLSVFIIAQDEEDRISRAVSSCIDWADEVIVIDSGSSDQTIDVAQRLGARVLQHDWHGYGLQKRYGEDQCCNDWVLNIDADEVVTDKLRQEILGLFQTTVLDAYDFWKVDICDVWPHEKTAAKHAYAYTQIRLYRKSIGRFSENAVHDTVRPPKNARLGTLKGRMDHRSIRSISFHYEKMNRYSTMQVKEMRGRGRILPKSRLLYEFPVAFLKGYLVRGYCRYGWWGLIASTNYAVGRYLRLAKSVEAELMERSAKTDARPKAPQKEPA

SEQ ID NO: 2110 - protein, 305 aa, Panacagrimonas perspica
MPERRAFTLSVVMICRDEEDRIERALQSVQGWADEIIVLDSGSRDATVEIARRYTAKVWVTDWPGYGPQRNRAIGKASGDWILSLDADERVTPELRDEIDACLSNPDLEYNVLKMPWRTYFCGAPLRFGRFSTPQTRMFRREGASYRNLQVHESLEMPDKRVGVLKSSLEHHSWRDYHHAQEKHLLYACLLAEQKYAEGQRSSLLYASSRLVFDFLVQYIGRLCVLDGWRGFLISVILAQYAFHKYAALAMRQNGAPAMRPRVFAAPRAAVAQRRQVRPAWKKGARTRLPVPHAASLLAARTTPP

SEQ ID NO: 2111 - protein, 282 aa, Unknown
  Description of Unknown: Sinobacteraceae bacterium sequence
MSEPLKPRAPRRHTLSVCLICKNEADRIEPCLQSVAGWADELIVFDSGSTDGTVEIVRRYTDQLWITDWPGYGPQRQRSLEAARGEYVFTIDADERVTPELRAQIDAELAKETVPCAVYRMPWGPIFFGKRLRFGGRYASPQARLFRREGAEFPMAQVHETLKFPPGPVGRLSGRLDHDSYRDYRHMVDKHTQYAWLLAQEKLARGKRTFLLAGPLRFVWEFILQYLIRGLVLDGRRGFLLAVLLSQYAYHKYAALYTLQLSGAKPDPKFAPENRQRRVGGP

SEQ ID NO: 2112 - protein, 271 aa, Unknown
  Description of Unknown: Bacteroidetes bacterium sequence
MEPNTGISVVIIAYNEANKIGDCIDSVTGIANEILVVDSFSTDDTYNIAIEKGARVIQHPFEGHIQQKNWAKDQASFDWVLSLDADECLSIELQDQLKLAIQNRLTYGKIKGYSFSRLNHLGGQPIRGCGWYPDTKLRLWDRRCGCWSGRNPHDKFLIDKQHSLGSISGDILHYTYTDLAAVKHQALRFGKIGGQALKHKFTNHPGYFIQRRGLDFYLLFKILTAGLTRFIRNYLLKGGWKYGSNGLLICFWQSVEVSYKYGFALFGKAEQ

SEQ ID NO: 2113 - protein, 260 aa, Methylorubrum extorquens
MAPLPISVFIIVKNEADRLGATLAAVRALADDIVVVDSGSTDGTQALAASLGARVIHNDWPGYGRQKRFAEDQCRHDWVLNLDADEVVPPDLAEQIRAVFAQGEPAHAAWSIAIAEVFPGETRPHPWAYVLTPVRLYRRDLSTYSTSPVHDRVVLGPGVTTGRIKGRIHHFSVRSLGDQLAKLNRYSDQQADDLDARGVTIPAWRLYVELPGNFLKAYFGRRHFVRGAYGFLTAMNYAISRHLRVAKHYERRVTTPRRPG

SEQ ID NO: 2114 - protein, 285 aa, Streptomyces sp.
MRKLPIVVAIPTRNEAENITAAVRSVVDHFEAVVVVDSDSTDDTRALAKAAGAEVVSYTWDGKYPKKKQWCLDHVRPGTDWMLFVDGDERVGPELLAELRRIFDVPPGMTVRPAAFDIPLGYWFAGRRLRHGYTIVKRALLDRTRARFPEPDDLRAPGMGEQEGHYQPLADPVVRLKGTIEHEDLDPVRTWFDRHNRYADWEAWLEHHPEVREQIRKAKTRQGQVFHRAPFKPLVSFGYAYLVKRGFLDGRAGLDYALAMSFYRWQIGLKTREYGWLADRPDAPR

SEQ ID NO: 2115 - protein, 256 aa, Unknown
  Description of Unknown: Rhodanobacteraceae bacterium sequence
MPARPGLSACIITLNEADRIGACLDSLAFCDEIVVVDSGSTDDTRARAVARGARVLDHPFAGYRAQKDFAVAQARHDWVLCLDADERVTPALQISMEAEREAGFAAAAGYRFARATEYFGAFLRHGNAYPDRVLRLFDRRRGGWRGDREIHEHVSVDGRVVTLAGELEHRAYRSLDDQLARYRRYATLMAADMHARGRRAKLLDLVTHPAWRFLRGFLLRGGYRDGWRGFLFACMEADYAREKFARLWLLQQGAGP

SEQ ID NO: 2116 - protein, 303 aa, Unknown
  Description of Unknown: Salinarimonadaceae bacterium HL-109 sequence
MNQDPDKVPAKEQVPAGEQVPAARRRLPVSCTIIACDEADRIGRCIESVRDLVDDVVVVDSGSRDDTVAVAEAHGARVIFNAWPGYGPQKRFAEDAARHAWILSLDADEWLPREAREEIAALFAQGEPALAGFRFRIPTVYPGRARPRPFAGYHAHVRLYDRRRVRIPASLVHDAITFDPATMRLAKHPIHHESIRSLAHLVEKNIAYFHLQAVEMRRSKLTTLPRLLVEPVAVFAKYYFLRRHVTGGLFGLRYALTVAYIRSYRLAVLAGFFHARTEATRLGLEAGRGADAAQPPAQSRATE

SEQ ID NO: 2117 - protein, 272 aa, Unknown
  Description of Unknown: Flavobacterium phragmitis sequence
MENKFSIVILAYNEEDTLGGCLDSIKWCDDIVVIDSFSSDATVAIAKENGARVFQNKFSDFAQQRNFANDTVDFKYEWVFHLDADEHFTDALRTECNKAIESYHYGAFLVPAKEILWGTWLKHSAGTVYQMRFHKLSDARFEQYGHGQRECDLKRGLGKLENSYEHYFFSKGVNQWFVKHLRYAAEEAENEKNVSLKKIPFGKLISGESHEKRRVLKALSYKMPFRPLFKFFYMYILKMGFLDGKVGFKFCVMKSIYEQFIILKKFESEWNN

SEQ ID NO: 2118 - protein, 264 aa, Luteibacter sp.
MRAEPLSVVFTTFNNADTIGACLASVAFADDVVVLDSGSTDATHDIAASHGARVEVRPFAGYSAQKQAAIDLARHRWVLLLDSDESLPAAAAARIEAALTAPTVAGFVLLRREWVFWRWQADRARMNHYVRLFDRTRARMSGHEVHESVVVDGPVGRLDVVIDHYGERDIEGRVAKANAYSSLQVRDRHARTPAFLRTRMVMYPTVAFARYYFWRGHWRAGWAGFVAARVHAFYAFLKYAKLYELRRSGGQREGRPLDTERREK

SEQ ID NO: 2119 - protein, 273 aa, Unknown
  Description of Unknown: endosymbiont of unidentified scaly snail isolate Monju sequence
MPVSQPTTPLPLSVFVIARNEERCIGAVLEAARALSDDLVVIDSGSTDRTVEIAETAGARVFHHDWAGYGPQKRLAEEQCRHDWLLNLDADEVLTPELIEEIRTLFAKGEPPLPFYRIKVTTVYPGDEKPRWLAEHNDVIRLYDRRVGRFPDHPTWDAITPPKGAGVGLLKAPCYHFSSPGLHHYVDKFNRYTTLQANTQKLKPYPVLAARLLLGFPLDFLKAWLLKRHITGGLYGFVLAFSHAYSRFLRNAKMLEKHRLQRRSADRRKDSPP

SEQ ID NO: 2120 - protein, 264 aa, Desulfoluna spongiiphila
MPEHSRTTPTLAVAVIVKNEADNLCACLKTVEGWVDEIVILDSGSTDATEDVARQFTDKFFVHDTWPGFGPQRRIAQEHVSSDFILWLDADERVTPELRASIEGAVAANAPSTVYRISRLSWVFGRYIRHCGWYPDRVVRLYPTKLTRYDDSLVHEKVEVTEEMNVENLAGDAIHYTYKDLHHYLVKSAGYAKAWADQRNARGKKTSLGQGIFHALGCFLKMYILKVGFLDGRQGFLLSLLSAHSTFVKYADLWIITKTERPRD

SEQ ID NO: 2121 - protein, 267 aa, Microvirga sp.
MLPVSVFIIAKNEADRIGATIRAIRGLTDDIVVVDSGSTDGTQAVAQELGARVIFNPWPGYGLQKRFAEDQCRYDWLLNLDADEEVSPELLAEIHRLFAQGEPPCQAYGIRIAETYPGESAPHPLAYRIAPVRLYHRDAGRYSSSLVHDRVDLKPKTKVGKLKGLVHHRSVRSLGDQLAKLNSYADQQAVDLEVRGVSIPTWRVYFEFPAAFLKVYFGRLHFLRGTYGFLISMNYATWRHLRLAKHYERKRLGALTKSNADAKRVKA

SEQ ID NO: 2122 - protein, 279 aa, Unknown
  Description of Unknown: unclassified Streptomyces sequence
MTELESRIPVVVAIPTKNEAENIAATVGSVIGHFEAVVVVDSDSTDDTRAIAESLGAQVVPYTWDGKYPKKKQWCLDNVHPDIPWLLFLDGDEVPTPELIDELREIFARQPVLPAAFDIPLLYWFAGRPLRRGYTVVKRSLLDRTRVSYPEVDDLGAPGMGEQEGHYQPRADGPVGQLRGRIEHRDLDPVRTWFERHNRYSDWEAWLEHHPGAKEQVRGLKTRQGRIFQRVPFKPLLFFGYTYLARRGFLDGRAGFDYALALSFYRWQIGVKTRENAPS

SEQ ID NO: 2123 - protein, 265 aa, Bosea sp.
MPPLSIFIITRDEADRIARTIEAVRALSDDILVVDSGSTDGTQAIAESLGARVVFNPWPGYGPQKRFAEDLCRHDWLLNLDADEVVPADLATEITELFSQGQPAADAYKLRIAEIFPGEPAPHRFAYALSPVRLYRKAKGRYSPSPVHDRVDLAPDARVARLKGTVHHYSVRSLGEQMDKLNGYSDAQADDLDRRNATLSVFRLVAEFPANFIKAYIGRRHALRGVYGFMTAMNYAFYRYLRVAKHWERRLQRRSSAKRPDGRDG

SEQ ID NO: 2124 - protein, 363 aa, Alicyclobacillus sendaiensis
MRMASWSLCMIVRNEADTLPRCLASVGDLVDEIVVVDTGSTDDTPDIAQSLGARVHTFAWCDDFSAARNYAFGLATADYILWLDADDVIRPEDFPAWKALKSSLDPAVDAVTAWYHLAFYGDKPSYSSRLVRVVRRSAGFRWRGQVHEYLEVRGNVLHSDAAVCHRPVRHDADRNLRIYEARIRAGEMLGARDTLYYANELVDHGRMVEALTQYESFLKMQDIWKEDAIFACYRMSDCHLKLGQREEARVAVLRSFLYDAPRSEACCRLGHAALELGDLDAALAWYRLAILCRRPPGFMGFLNRACETWLPHIQLFVILARLGRIREAYEHNEWAAKFLGDEDPMVVHNRAQLAALLEHSEGA

SEQ ID NO: 2125 - protein, 286 aa, Unknown
  Description of Unknown: Alphaproteobacteria bacterium sequence
MQKISAYILAFNEAEKIADAVSSVLWADEIVVADSGSTDRTAEIAQSLGARVVQLPFYGFGDLRNRAIAECRCDWIFSLDSDERCTAEVRDEILAVLSSSPAHDAYLVPRRNYMMGRWIKGSGWYPNFRQPQLFRKGAMRYDDGPVHEGYELLTQRPLGQLQSAIWQLPFRNLEELINKMNRYSSLGVRKLSGKRSSMGSALGHGIWAFVKHYLFKHGYRDGWAGFVIALGNFEGTFYRYAKRYEEMKAWPPPPSAPLQRPSLSPATSAGAGIAAAGRESSTSTKA

SEQ ID NO: 2126 - protein, 266 aa, Afifella marina
MCDNSHKPQVTVPLSIFIITRNEADRLGETLAAVRGLTDDIVVVDSGSTDGTQELARRLGARVVHHDWQGFGPQKRFAEEQCRYDWLLNLDADEVPQPEVVGGISALFADGEPPLSLYRIRIVTIYPRHHHPRLFADFVSPVRLYDRRVARYSPSLTDDRVVDHGLPSGLVPGAVWHFSFRSFAHIRAKLDGYSDLQTIEKAGRRSPLVLRLRLLTEYPMQFAKYFIFRRHWTGGVLGARYAHEIAAAKQRRIRRFLEARQKLSST

SEQ ID NO: 2127 - protein, 236 aa, Unknown
  Description of Unknown: Deltaproteobacteria bacterium sequence
MLSAVIIAKDEADRIEAAVRSVAFADEVLVVDSGSADATVARAEAAGARVVQTDWPGFVAQKNRAWALARGEWVLSIDADEAVSAELQTAIRAAVASPAAEGFEVKRKTRWLGHDLAHGFAFPDPRVRLARKDRARWEGIDPHDHLVVAGSVAPLQGILHHDPYRSFEEHLRTIDRYTALDARRGSWLDVLARPPWHFIRGYLLKGGFRDGWPGLAFAALGATYTFTKWSRGHWDP

SEQ ID NO: 2128 - protein, 252 aa, Limnohabitans sp.
MPTLSIIIAAKNEAHNIGDCVKSAAFADEVIVLDSGSTDGTAEVATSAGAQVVATDWPGYGPQQSRGIGLATSDWVLSLDADERISPALQAEILQAIQEAKADGFRLPRLSSLCGTFIHHGGWRPDYTLRLVKREKAGFTHHFLHAHMTVDGTKADLNESLIHYSYRDLDDVLEKLNRYASGNAKDLDAKGVRGSFSKAISHGIWAFVRTYIFRAGFLDGRYGFMLAIYNAESTYYKYLKLLALQEARASKA

SEQ ID NO: 2129 - protein, 251 aa, Azonexus hydrophilus
MNPVSVVIITKNAGSVVGACIDSVRGLADEVVVLDSGSNDVTREVCESRGARFVETDWPGFGPQKQRAVQAARNDWVLCLDADERLSPALLDSMRKAMAQPAFAAYRFARSNRFMGRYLKFGEGYPDWSLRLFDRRVAHWSDDVVHEKVLCSVPVGTLAGDLLHDSAETLASYMTKQNRYTSLAASAALIEGRRVSVARLLLSPLVRFVKFYFLRAGFRDGLPGLVHILLGCFNSFAKYAKMLEQRRTGDQ

SEQ ID NO: 2130 - protein, 291 aa, Unknown
  Description of Unknown: Acidobacteria bacterium sequence
MRETGYSLGVTLSVVIITYDEEANLARTLESVMPLVRDGKGEIIIVDSGSTDRTLEIARSFGAKVFIEPWKGYAAQKNSAIEKARGDWILSLDADEEVDAGLAEEIGFLILGNPRHLVSGGVSVHQKGGVASTVHGFWIRRKNHFLGRWIKHGGLWPDPKLRLFRRGEASFEERAVHETVQVEGATRRLLTGALVHHSYPTLSDYIDHMNRYSSLGAETAGAKGHRGFSVIDIVLRPLATFVYNYFFRLGFLDGREGLLLHLYHAVYVSWKYAKAWELARADSSRTEVRSD

SEQ ID NO: 2131 - protein, 245 aa, Unknown
  Description of Unknown: Gammaproteobacteria bacterium sequence
MITFNEADRIEACLRSVAFCDEIVVVDAHSTDGTRELATALGARVIERDWPGYRSQKQFAVDAARHDRVLCLDADERVSAALRAEILALRAQGFTGPAGWSIPRITDYFGRFLRHGNAYPDRLVRLFDRRRGGWSGYEIHENTHVQGRTGRLHGRLEHYAYRSLADHQNRMQRYAELMAQAMYERGRRCGLTPVVVNPQWRFVRGYLLRLGFLDGWRGLVFALIEANYVRRKYLALYARSRGLPL

SEQ ID NO: 2132 - protein, 261 aa, Unknown
  Description of Unknown: Acidobacteria bacterium sequence
MAEARLPLSVLVTTKNEQETIGACLASVAFADEIVVVDSGSDDRTVEIARSHGARVLEHPYESPARQKNWGLAQCRHERVLILDADERVPEPLADEIRALLRADGPLADGYWIRRENVFLGRVIRHGGWESDRVIRLVHRDRARYDDRMVHEEIALDGPLPQLRHPLRHETFRSFDQYWPKVDRYARWGAQDAWQRGRRAGALTPVARGAATFLKMYLLRRGFLDGGHGLVLAGFSALTTFVKYARLWELTLAERRRAAAR

SEQ ID NO: 2133 - protein, 272 aa, Stenotrophomonas maltophilia
MSSTTAPIERPCISACIIAFNEAGRIGDCLASLAFCDEIVVVDSQSTDATVAIAEAAGARVLQRRFEGFRSQKAFCVEQASHDWVLCLDADERISPELRAAIEQARDGGFSGHAGYRFARLSEYFGRFLRHGNAYPDRVMRLFDRRQGGWRGKREIHEAASVDGSVGTLRGDLIHYPYRSLQQQLAKTEKYARMMAEHEFARGKRATLGKLVLAPAWRFWRGFLFRGGFRDGWHGLVYAYVRANYVRQKTIMLWMLGNGQAVADPAPSADRP

SEQ ID NO: 2134 - protein, 373 aa, Streptacidiphilus pinicola
MRPRIGPMARVSLSMIVKDEAESIAAVLADASVFCDELVVADTGSTDGTQELARAAGARVVDVPWTDDFAAARNASLDACGGDWIIWLDADDRVPPAAQQAFVRVLAELEEDVDALISPYHCAFDENTGAPTFTTLRERVLRRAAGLRWAGAIHEVVDITQARIREVPQLVVEHRRTEAQAAADEGRNLRILEKLYAGGDRSPRTLYYRANELRDLGRHEEAEVAYAEVLTLSQPAWERYFALMSRAECLQAVGRSAEAGEVAVQAVLLDPTRPEAWMVAGMIPYEQCDWARAVPFFSAAAAARSRPSEGFVRDRDHGWAPWDFLSVCLGNSGRHEEALQAGVRALRDNPQAERVRANLGWFVSELPVSDSTS

SEQ ID NO: 2135 - protein, 258 aa, Halomonas huangheensis
MTAITGIIITLNEQDNVEEAIASLQPVCEEIIVVDSGSTDNTVALAEAAGARVIHQPYLGDGPQKAFAVPQARNDWILALDADERLDQDAVSAIRDLSLDDPRKAYRFRRRNFAGRHWIRAAGFYPDAVTRLYNRTTSGYLPKKAHSSVEAPEVVDLEAHLSHFTYRDLSHWITRIDQLSTRDAWAMKERGVAASAWQPAIHALTALIRKLILKGGLLQGQDGMTVAMTTAFHAYMKYAKLNELYENEQAGRDADTHR

SEQ ID NO: 2136 - protein, 251 aa, Marinobacter persicus
MSVKISAVLITKNGGPYFQQCLDSLAFADEIVVLDSGSTDDTVAIAEMAGARVFVSEDWPGFGPQRQRAQEHARGEWLFWVDTDEVVTDDLAASIQDVVARGPENTVFQVKRLSWFFGRFIRHSGWYPDKVVRLYRRGEFGYDDALVHEKVHCPGAMMDTLDGDLLHYTATDFADYMAKSLRYANDWADARAVRGKTASLFSACSHSLAAFFRKYVLQKGFLDGRHGFLLAVTTAIYAFNKYAALWLKTYR

SEQ ID NO: 2137 - protein, 380 aa, Frankia canadensis
MATPYRLAPRPFRPASRTRPGRRPGQVATRAAWPVPYGTAASSGDAIWPVPGTVPVTTIILTRDEAPNIVRVVRSAGWSRQIVVVDSGSTDDTVELARAAGATVWYEPWRGFAGQRQWALSHPGIAHDWVYFLDADEWVSAELAAEIASQAGSTDPAGPAAYAHRRRLVFQGRWIAHCGWYTNSWQVRLLDRRAACFDQDVTYGERPSVVGRIGRLSADLIDEDQKGLAAWLHKHVRYAELKAESQPARGAARHGVALTWAAIRHRGASTRPLGRIVARELVFPLLPARPLLLFVYMYLVRGGWRDGRSGLLFCIYHAWYELTVGALVGARRSPGRPPATDRPLPVVPRQRAAGPAGGRADQPDSRAPAGREAAAGPVPS

SEQ ID NO: 2138 - protein, 369 aa, Unknown
  Description of Unknown: Acidobacteria bacterium sequence
MSRFAARATDAARGGVRKPCPGFGQLDRTGPASANGPLRPLRTPGSASGRASPRQRRAAPGTAAESHRSLGAAFSVTARKAPPGRRPRGLEFRFPAPPERGGTTTVASGKGAAGPRLSAAIITRNEAHNLPRLLEALRGVADEVVVVDSGSDDGTPEIARRFGARVIETDWPGFGLQKQRALAACRGEWVLSIDADEVPDEALAAALSRLPPPDSTTYRGFAVDRLTWYLGDFLRHVWSPDWITRVVRRGAGRFTDSRVHERLVVDGPVGRLPGRLLHYSFRDLSDHIERTVRYARLGAQELERRGRRSRAVDLALRPAASFVQRYLLKRGFLDGYRGLIAAGVTAAGTFFKYAFLFERSLARNGGEKR

SEQ ID NO: 2139 - protein, 261 aa, Unknown
  Description of Unknown: Metallibacterium scheffleri sequence
MAREPLSLVVTTLDNAATLARCLDSAAFADDILVLDSGSTDATRAIAEAHGARIERHAFDDYAAQKQRAIALARHDWILLLDADEALTPAAAAIIQRELRAPRAAGYRLPRREQMFWTFQHRRSRINTHLRLFDRRHGGMNAVPVHAAPEVLGRVRTLRAAVFLHFGEPDIATKVRKLNDYSSGLVAHKRARGTRFVRTRMLLYPPLFFLRQYLFKRYFLNGWAGYISAASGAWYVFLKYAKLYEARRDQGGAGDDSGGRA

SEQ ID NO: 2140 - protein, 265 aa, Dechloromonas sp.
MKHSGGNRGAVRNEKAGMKLSVVVITKNEAHCIGDCLRSVSFADEVIVLDSGSSDKTVEICRGLGARVEVTDWPGFGPQKNRALDFARGNWVLSLDADEAVTDALREEILQVMEAGVSNVYMMPRLSSYLGRPMRHSGWWPDYVARLFRRGSARFSPDLVHEKLVFSERPGHLRAHLEHEAFTSLEEVIDKMNRYSSAGAEMARQKGRGSSLGLAVLKGLVAFLRTYVIRAGFLDGREGFMLAVSNAEGTYYRQVKLMLLNDRQR

SEQ ID NO: 2141 - protein, 253 aa, Unknown
  Description of Unknown: unclassified Xanthomonadaceae (miscellaneous) sequence
MPISACIITFNEADRIGDCLASLAFCDEIVVVDSGSTDATREIAAAAGARILERAFTGFRSQKQFAVDQARHDWVLCLDADERVSPELRASLLAARDAGFADGAGYRFARLSEYFGRFLRRGNAYPDRVLRLFDRRRGGWRGDREIHEAASVDGPVKTLPGDLIHYPYRSLMQQLQKTERYARMMAEHEFARGKRASLAKLVLSPAWRFWRGYVFRLGFLEGWHGLVYAYVRANYVRQKTIMLWMLERGQKVE

SEQ ID NO: 2142 - protein, 260 aa, Unknown
  Description of Unknown: Acidobacteria bacterium CG_4_9_14_3_um_filter_49_7 sequence
MEITGIVIAKNEANQITGVVESLFSVCERIIVVDSGSTDETCTLAEKAGAKVVSHAWEGFKGQRRFADGQAETDWILVLDADERLSDGLKAAILKLKEQSDSPVVHAYSFQRNLHFMGKCFRNSPLTCERKIRLYNRNYSKWDGGSVHEAVSVIGKIRKISQTIDHYPFESMEEARNKLRGYAFLKATDKHQRGKRTGFWSVALHIIFTFLKKYIWQCYFLKGTPGLILSWLETDYTAITYMKLYELNHSFDDKESKHEQ

SEQ ID NO: 2143 - protein, 264 aa, Unknown
  Description of Unknown: filamentous cyanobacterium CCP5 sequence
MASELMMENQPHHALSAIIIAQDEADCIAQAVRSCQHFADEILVVDGGSQDDTPAIAAELGAVVHHNPWPGYAKQRNYGADQAAHDWVFFLDADEWVDDQLAAALNDWKRQPTLPAQAFSISRIGDFLGVWLAQRPESHIRLYDKTRFRIKDVLVHETPDVGDAPVVKLPGTVLHAGFRTVGELAERFNMYTDLDAQKAYGEGQRFNLLRFLLKPPAKFLQMYLRNGMFRAGKAGLFLASLWSYYIVLKELKLYEIDWAAKQPN

SEQ ID NO: 2144 - protein, 677 aa, Marinobacter pelagius
MMEPRMMHLPHALLPLLFMTGLGGALFSSSILAGATALLAIAGITLIFRKSLNQSGWVVPKELRLMHFAFWFFVLVSFCSWALEGFTYEGGKNLGTHARLILFWPLIIALTYSGIRARGIFTGLALISASVIIVFLMALAARSGAWDKLLNTRFGGGINPISFGNIALLGGMLTVTGGLFFVRSKRPLPATLMCIVGVTAVIVSMFSETRSNLVALPALLLLLLPLISRKLRIAGAIAILVIVVATIANSDRMSRSVEHLLEGGKLDTSMDVRIEVWGLAWDLFLESPLTGSGLGGYTRGVEEAVTAGEVPRKIGDCCTGHAHNDFLNNAATSGIPGILSWAFLIFIPLSVFSRHIFNKHAPTAHIAVAGSMVATGYLVYGLTEATFDRSLFLTFYLLVMAGLASALFTELRASCYRERKVRVSATVIAKNEEDHIADCLQSARLVADEIIVLDSGSSDRTAEIARQYADIVEVTDWPGFGIQKQRALEKATGDWVLSLDADERITPELAREINHHLADPDADAYKLPWAVTIYGKRLDFGRSGRAPLRLFRREGVRFSDALVHERILIPEGRKIRTLRGRLTHYTHRDFGHSLEKSAKYAWLGSQEKHRRGKKTRTMIYPTLRGLMTFIQVYFIRFGFLDGAVGYLTAVTYAQVTFNKYAGLWTLGRPTQDNRNTE

SEQ ID NO: 2145 - protein, 500 aa, Unknown
  Description of Unknown: Clostridiales bacterium PH28_bin88 sequence
MNRKKTASLCLIAKNEEEHILSCLNSAKQLIDEIIVVDTGSEDQTAPLAREAGAKVFHFPWTGDFSQAKNFALEQAASDWILFLDADEVLDPVSRENFEQLLYRSDIEGYFLTIISYLGNGHEVISDRVVRLFRNKPIYRFQGAIHEQVAQSIMQANDGRGLTDAPLVIRHYGYLASESRKKNKTKRNTLIIERELKQNPRDPFLLYCLAVELYQQGDVQEGLNCLEKALHHLRGTEGYVEDVIHQMAVGLLHLRYWGQLISFINKALSALPQQTELLLIRGLGFYHTGHYLAAAQDLEKVLQQGGSASLPLYHVLGVLGDAYNLAGHYAKAEKAYFSALGQSTRFLYPFTQLLGLVQGGRNTVSLAQFSRLISFKDNKFVWQELIKAGEIPLALIIILFAIHEVASGSGYEDILVQLSQELTSILARVEPLPARKESFEYLSVVAVEMDAYAATLAKGYHLEPLPAKKLLGLVEKTILLLVTEFCPRWSPQLLGVELKE

SEQ ID NO: 2146 - protein, 255 aa, Asticcacaulis sp.
MGPTSLSCCIIARNEGDRIGDVIRAVSGLVDEVVVIDSGSTDNTIVVAEALGARVVHHDWPGYGPQKRYSEDCAAYDWILNLDADEVVTPELYSEIKALMSAGPTLNAYRFRIMNVYPGWNAPRLWADFHNYVRLYDRRVVRFRESPVHDTVDTRDEPVGQLTGTVTHFSSRSFEHIRQKFESYNTLQAKVLKKPSWQLWARLPLEYPLGFLRYYVFRRHFTGGVDGLRVSHIAAEARFKRILKFLAAKRNGRVA

SEQ ID NO: 2147 - protein, 369 aa, Paenibacillus sp.
MITISLCMIVRDEEETLGRVLDGVKDIVDEIIIADTGSVDRTKEIAAAYEQCRIVDFEWIDDFAAARNFSFSQAGMDYILWLDADDWLREEDRQGLLRLKKTLDPSYERVTMPYNLAYDSAGNAVSSLRRNRLVRRDRGFKWIGPVHEYLEAWGKALDSDVCVSHGKEKEYSDRNLRIYRNRQQAGEDFSIRDLYYFANELKDHAFYDEAALYYEQMLRTGQGWIEDNIQACLKLADCYGQMGHKDLQLQAALRSLCYDKPRPESSCAIGNGLFEREQYEAALYWYGLAVALEPPVTMGIINRTASTWYPHLQMCLCLDRLGRFREAFEHNEHALAFHPDHPSMLHNREYFRSSHGMVPDAGVTAAVKD

SEQ ID NO: 2148 - protein, 270 aa, Halothiobacillus sp.
MPPKLPISVTIITQDEADRVGPAIESVIDLVDEVIVVDSGSSDGTEAIAEGLGARVVHHDWPGYGRQKRYAEELARNDWVLNIDADERLMPELRDEIAARFEGDPGEDAFRLPIHDRFLCSERISRKAQYLPVRLYRRSRGRYSESPVHDRVQMEKGARIGELSGRIAHDSTRSLSHRLQKMDGYTAMQAEDMRRKGRRGSGLRLVADFWLSFLLGYFTKGFWRAGLVGYIYAMNYAYSRFLRQAKLWELERCGKADSVSKAEDSPRAGS

SEQ ID NO: 2149 - protein, 271 aa, Unknown
  Description of Unknown: Rhizobiales bacterium sequence
MAPLSIFIIAQNEADRIGRTIEAARPLSDDIVVVDSGSSDGTQALAESLGARVIFNPWPGYGQQKRFAEEQCRHDWLLNLDADEVLPPDLAAEIGALFASGEPPADAYKTRIAEIFPGEKAPHRFAYALAPVRLYRKSKGRYSPSPVHDRVDLQPGARVGRLKGTIHHFSVRSLGEQMDKLNAYSDAQADDLDARGATVSAFRLVAEFPANFIKAYIGRRHALRGVYGFMTAMNFAFYRYLRVAKHWERRLQRRAGIAPPNSPAKQEPSDG

SEQ ID NO: 2150 - protein, 280 aa, Leptospira perdikensis
MPLPLSCAIITLNEEDNISRTLVALSFIEDIVVIDSGSTDKTVEIAKSLGARVFFRKFDNYADQKNYAIEQTKFDWVLAIDADEVVSIGLQTEISNLFTKDKLQSVGYLVPRLTYYLGKWIRFGGYYPNYQIRLFKKTAGEFSGGLVHERVKLTGKPIKLKNPLYHYSYKNISDHLQFIDRYSSLFAEEEFRKGKTSSVFWAFLKACFKGFYMYWIRLGILDGKQGFVLALLGFYYNFLKYLKLYEKSKSISSFFVMVDSVHDVKSGKSTKEDSNQIHVG

SEQ ID NO: 2151 - protein, 258 aa, Parvularcula oceani
MPDTRPPLSAYIRTLDEADHIEEVVRAALAVARQVVVVDSGSTDGTPDLAEAAGARVFTRDWQGSGKQKRIAEELCRHDWLLDLDGDEVVSPALAGSIAKLFENGEPPEPVYALPWVIVPPFGAPWHEVDRAFRAKLYDRRRIRIPDHPAWDQLEVDKNRAPRLEGPLYHHAFEDIGDLTRKVERNMTGRARGVAQKPKGVLALRIVFGMPVYFLKRYLLKGLFRKGVYGFAFCVAQAYGRWLKDVKLYERHLRDETE

SEQ ID NO: 2152 - protein, 270 aa, Unknown
  Description of Unknown: Acidobacteria bacterium sequence
MPAISATIITLNETDRIAEAIGSLSCCDEVIVVDSGSTDQTREVARACGARVIERLWEGYSKQKNFAAGQAQNDWILSIDADERLSIELADEIVSWKKKPLPLGEAAPRSASPIGRSLNGSAGEGSGGERAFSMPRRVFYLGAWIKHSGWYPDRKIRLYDRRACRWAGEFVHESLEVDGGVGAFKSDLLYFPYRDWNDHAARIARYSELAARAARSRGRRGNICRLLMAPPLVFIKSFVLHAGFLDGWRGLAIAYMGARYAFQKEFRILG

SEQ ID NO: 2153 - protein, 265 aa, Unknown
  Description of Unknown: Rickettsiales bacterium Ac37b sequence
MKIKLPISAFIIAKNEQDFIGTAIKSLVDWIDEVIVIDSGSQDKTVEIATNLGARVVYNEWSGYVNQKIFGESLCRNKWIINIDADEEFSENLKEEVFLLFSKNTLTPSAYYINVVMVHRFKKKFLCKIAPRNKVIRFYNIEIAGFCYGDLSSLYRDSVKLNKKMEVSPLELKNVIWHRSFRSIQQMMDKINFYTNIQVEEDLKKGRKINPIRVLIEFWMVFIKFYLLRRYFIYGIDGFIDSMIYAFSRFIRLAKLREKTIKNKY

SEQ ID NO: 2154 - protein, 370 aa, Desulfosporosinus sp.
MKTKETVSLCMIVKDEEDCLLAAIQSVQDLTDEVIIIDTGSIDSTPQLALAAGAKLFKLDWTADFSLARNFALKQASSDWILFLDADEVLEPIVPEIFNKLLNNVHIEGYFLRIKNILGPTLGESYDEVVRLFRNRPIYQFEGAIHEQIAPSILRANNGSSLASALLTLNHFGYLSNRLQSKEKFSRNCNILFEELDKNPSNPFLHYCLGLEYYQRDFITEGLQHLTKAITRMSGNEGYFEDILHNIAFGYLRLEETIKLIDFLSQAMVMYPDQSDFLFLRGNAYLSQANYHEAAEDFNHLLEILGTRTSKSNSDNAKNISYTFLTLALKEIQFCSLALKRQALEPMHSKAKNKINGALKEAFLFFIQRK

SEQ ID NO: 2155 - protein, 293 aa, Loktanella sp.
MTEITVIILCKDEAAHIGRAIASVAKIATRIVVVDSGSSDDTVAIAKAAGADILFNPWTTHARQFNWALDQIAGVAGWVLRLDADEVVTPELAQQIGRGLPDVDGIYLRRNICFLGQEIRYGGVYGLSVMRLFRNGAGRAEQRWMDEHIVVNGPTATLSGAIVDDNRKPLDWWITKHNGYASREVIDMLRTEFGAQNGPAQTGAKRWIKTHVYRRLPGGLRAGTYFFYRYVMRLGFLDGPQARSFHVLQGFWYRYLVDAKYAETRRHMVMNGCGWEQAVSDVLGVTIKDEDMR

SEQ ID NO: 2156 - protein, 274 aa, Terriglobus saanensis
MRPAVIILTFNSAETIATTLRSVRSLTDEIILVDSGSTDETIQLATELGAFVVSHPFENYGAQRNWAIDNLEITKTWQLHLDADEDVSEDLAREIEAIPESTAMDGFLVARYLKFMGRVLRHNLAPTYHMRLFRSGKGRCEARMYDQHFICSGPIGTLKHSMVDDIRMPLTEWTRRHNQWADAEVKELRMKRANAEIQGRWFGNKIQVKRRLRQCYENLPLFVRPGILFIYRYILTGGFLDGHEGLIFCVLQTFWFRFLIDAKLFEADRQSATK

SEQ ID NO: 2157 - protein, 289 aa, Hyphomicrobium denitrificans
MNARLPLSCFIIAQDEGDRIARAIRSIKPWVDEVVVVDSGSSDDTVAVAQSEGARVIAQPWLGFGGQKRFAEEQCRYDWVLNLDADELISPKLRTAIEALFHSGSPEFVAYGMPVHVIYPGRQKPRIWARDNWYIRLYNRKIVRFRDSRVHDTVVTGEHQVGRIEAPIYHYSIRSFEHMRAKLDERMSLSAEHKPARNRLTMLARLLVEFPLNFYKYYVVRRHFTGGTIGLRYATIQSTFRVKKVYRMWRSRNPVPTIKDASPSNNNKTAWSNLDVANLSRHGKRHRHR

SEQ ID NO: 2158 - protein, 296 aa, Unknown
  Description of Unknown: bacterium A52C2 sequence
MNEHSTFRAGFPEIAKASPGTEGLASAAPGTAKPVRSLTALIIAQDEEDCIARAVLSCRPFADEILVVDGGSRDGTADAAREAGARVLVNAWPGYARQRNFAAEHAGEDWVFFIDADEAVGSELAEAITAWKARPEADPLQAFAVTRMNNFFDTWWTKGERQVRLYNRRQHRIRNVLVHETPDATPDQIVQLPGRLWHFGFRSVGNLVMRFNRYTGLEAEKAYLGGRRFSLFRLMWRPPARFVQQYLVHRLCREGMAGFSASVLWVFYEVFTEIKLYELQWQARRTAPPQTPEALP

SEQ ID NO: 2159 - protein, 255 aa, Unknown
  Description of Unknown: Betaproteobacteria bacterium sequence
MAANPEKLPLTVAVIALNAESQLGELLSSVGFADEVLVVDSGSTDGTVRLAEASGARVIRKEWLGFGRQKQFAVSQARHDWVLCLDVDERVTPRLAQSIREALAGGRFKAWRMARRNRFLGAWLSHGEGYPDWSLRMFHRAHASWSNDEVHEAVLTTTEVGRLDGDLLHDSAEDVATYMAKQNRYTTLHAEALYRQGVRAGYAKLLVNPLVRFLKFYVLKLGFLDGGPGFAHVVIGCNNTFHKYLKLIELQKAGR

SEQ ID NO: 2160 - protein, 256 aa, Acidithiobacillus ferrivorans
MGARLSVLYITKNAGQYFDRSLASVAHIADELLVVDSGSQDNTLMVARSAGARIIERSWPGFAAQRQFAVAAAENPWVLMMDADEILTEAAAKAIRNTFLIGEPAGVAGYLLERISFFHGKEICYGDWAHDRVLRLFDRRCGAYGENLVHEAWETHGTVESIPGRALHHYSYANYGELLNKMRLYATLNAQQVHQRGKALHAYMPMTHALAAFWRGYFWRLGFLDGVEGAAIAWTTALGAFMKYAIALELRDCDRQ

SEQ ID NO: 2161 - protein, 274 aa, Unknown
  Description of Unknown: Planctomycetes bacterium sequence
MKISILILTLNEETNIGACLDSVSGFDDIVVLDSLSKDATKQIAVAKGARVVERPFDNWAAHQNWAMANIDFRNPWVFYLDADERMTPELRAEIQAIAADSKRAEVAFYCGRKNFFMGKWIRHAMPPGMIMRFFKPTKIKFERLVNPVPVIDGPHGYLSNYFEHYNFSKGLTEWFDKHNKYSLLEAMEGMKLRAKPVGFSAIFSGDRFDRRRALKELSFKLPMRTAIKFCYLYFLQRGFLDGRAGFTYCKLQSIYEYMIVVKMRELARRERGLP

SEQ ID NO: 2162 - protein, 273 aa, Desulfatirhabdium butyrativorans
MYPKRDFRSDIGSFSISKRNTLEKPKISVAIIARDEADRIGGLLRSLGFADEIVVVDSGSTDGTQAICESFGARVVFNPWPGYVEQKQFALDATSHEWILSLDADEEVPDALAAEILRSIQQAGPNVAGISMPRLSRYLGRWIRHGGWYPDRKVRLVRRGRGRWQGVNPHDKLVADGDVIQLSQPFLHYVYRSISDQVVTMNRFSEIYAQQGASRRGWFVVAGVFHAIGKFLECYVWKFGFLDGIPGLIIAMNSAGYVFLKHAKRWERRLTEV

SEQ ID NO: 2163 - protein, 251 aa, Unknown
  Description of Unknown: Comamonadaceae bacterium CG1_02_60_18 sequence
MQLSVIIITRNEEANIGDCLKSVDFADEVIVLDNASSDRTQEIAKSLGASVHVAPDWPGFGPQKNRALALAKGQWVLSIDADERLTPALRDEILGWIARPDAPSGYCIPRSSWFCGRFIQHSGWTPDYVDRLFKAGTARFSDDLVHERLLCQGVAQPLKNALLHYSHRSFSDVLTKIDRYSTAWAEQALAKGKRASVLGAVGHGCWAFIRAYFFKAGFLDGAHGLALAIASAEGSYYRHLKLWRLGQTHSA

SEQ ID NO: 2164 - protein, 254 aa, Hoeflea sp.
MGLSVIIITQDEEQNIGPCLESVGFADEVVVLDGGSSDRTREMAAEMGARVHVASNWQGFGVQKNRVLALAQEQWVLSLDADERVSPELADAIKAVVAGQSSSDAYEMSRMTWYCGKFLRYSGTSPDYVLRLFRRGTARFSDALVHERLVPDGAVARLPGKLLHYSFRNFSDVLKKTDAYTEASARQALEAGRTSSVGKAVSRGMWMFFRTYVLKRGFLDGGHGLANAVSAAQGTYYRYLKIWNGQQAGPKAPK

SEQ ID NO: 2165 - protein, 797 aa, Conexibacter woesei
MAPRPLNGSTPPLQAQAAALLRRGDVDAYRALFADAAALEDRNARYLERCHLVNAALAHGGVGAAVGVRAGLEELLTVLEQEPAEPVLLNQAGVLLAMFDGFAPALAVLEAALRLDPGLDDVAVNAAKIRQLLSARTRGRIDRSGELGRRAARVAARAMPAEGMTVSLCMIVKDEEEMLPRSLAAAAPAVDEIVVVDTGSSDRTIEIATSYGARVIERPWTGSFSEARNVGLDAATGDWLLILDADEVLVADDVPNLRALLGRTWREAFYVSAINHTGELDDGTATTHSTVRLFRNRPGHRYSGRLHEQIVESLPQGAPERFEATPVRIEHFGYLGAVRDAKEKSRRNIELLERQRDEGDSSAFMHFNLGSEYGALGDAEAALAEYERAVALLGDVAGGSGFIGALTSRHVRALRVCGRGDDAIARAEEALERFPGFTDLVFEQAAAAQALGRTDDAIAYFERCIAMGDAPSRYTATVGMGTYLPTIALAEIRHQHGDPAAAVELLDGALAAHPGFFGLVLPFAAALLDDGAEPDVVVARVEELVAKLTPTVRFMLGTALYEHGETEAAEQQYRELLAQQPSSGHARVALAEALLSQRRWDEAAAVAAELNDAEPHAGAARRSELFARITGGDHTGAAAVLARPEPDDAVVLGPGDRALFAAWLAAAGGEREDSVLPAEAVGLLAVTLEALLRVEEVDAFGTLVGLLDRCPIAPREQRELRAGMYLRRGFLASAAEEWLAVCGADATDVRALVGLAQVAVAQGMTDEALDFAREAHALDPGDARATRLLQRLEPLAA

SEQ ID NO: 2166 - protein, 271 aa, Aeromonas veronii
MSRQTGNNREPHFVKKPTLAAVLIVKNEADNLRKCLASLDGLVDEIVILDSGSQDETPAIAAEFGARFFVNAKWPGFGKQRRLAQSHVQSDWVLWLDADERLTPELKTAIANVMANPASDTIYSLPRLSWVFGRFIRHSGWYPDRVLRLYPKALTSYNEALVHEKVEVRANMKIVNLYGDLHHFTYRDLEHYLVKSAGYARAWADQRTARGKKGSLSQGLMHAVGCFIKMYLLKAGFLDGKQGLLLAILSAHSTFVKYADLWVRQQPQQPE

SEQ ID NO: 2167 - protein, 258 aa, Glomeribacter sp.
MKRATLSVIVVAMNEAHDIGDCLESVQHWADEIIVFDSGSTDGTPALCREFGARVFETDWPGDGPQKNRALAQACCDWVLCLDADERVSPELREEIDCMLTDGSAHAAFSTPRRSSFCGRFMKHSGWWPDRIDRLFRRGQARFTDVRTHTRLIIDGTVGKLNAPIIHLAIPDVREALDKANAYSSAGAQTLFERGQHASLSQAIGHGLWAFIRTYLVRLGFLDGKEGFILAVANAEGTYYRYLKLMLMHRQNSKNGAR

SEQ ID NO: 2168 - protein, 239 aa, Sphaerotilus natans
MAFADEIIVVDSGSTDDTVAIARRLGARVEVTPDWPGFGAQKNRALALARGRWVLSLDADEWLDETLAAEIRRVVATPPAGVAHRLSRLSSFCGQWMRHGGWYPDPVLRLFPRGTARFSDDRVHERLLWDGRVEGLGGHLLHESMASLTVANDKMNRYSSGRAADLAARGRRGGLGRAIGHGLWAFVRTWILRRGFLDGRLGFVLAVHNAEASYYRYLKIWLECADAPQPPSSPRPPSR

SEQ ID NO: 2169 - protein, 362 aa, Paenibacillus illinoisensis
MSLPISACILTLNEEKQIGESIKSILDYVEEVVVLDTGSTDRTIEEATVAGARVHQVKWVQDFSYARNELINLASSPYILMMDADERYKGNGKDLLQYINQSSLPGRVKIINKLDGGEQTETFTIRIFPNNGVYKYKGTIHEQLTESDAVVVGEDTEIPIYHFGYTKENIERKRKVDRNLDLLLRELDNNAEDPYLLYQIAKTFYVSKNYVEASSYYKMSLLYLEENNLNYKFIPNLLLQYSYSLLNEKNWVELEKNLLESIEKYPDFTDLYYIYASWIIEEKKIELFKILPELYKKCLEIGEADPTKYETTKGVGSYKALYNLGLYYELTGNTAKAKECYTLSGQMNYPNAINRLNNLSNI

SEQ ID NO: 2170 - protein, 430 aa, Mobilicoccus massiliensis
METPLLAAALIVKDEEANLPGCLDSLRALGDLMSEICVYDTGSTDRTIEVAEAAGARVERGYWDDDFARARNAASAMCASKWVLTLDADERIVVLDPVRFKSALRSALTAELYGADALLVAVADVRGGVELQAHESIRLHRPGRCRWRGRVHETIVSLRSPERPVAADLPRSVVYIDHHGYGDQAKNPLRFDRNLKLADAAVRDLQSTEDLPAYVQALVDRARTKRALGDVGGALSDLRAAWLQPVSTSYRAFGGELLVETLIQVGQFSDAEAVLRQLRSEGVSRAGYCDWLEATMATALGDTSRALCLLRGVGVIASSLGVVVGPRILLEDLMWAAIAEGQNLEAASSLVNLMAAQGVIRRKFGDLLLNLASDVPTDGLIDVLLEHDRGHIPELAAELELSRAPGPEIAAALRRRSPAKSPAVQACSRR

SEQ ID NO: 2171 - protein, 271 aa, Stenotrophomonas sp.
MPQPSSSSPSSRPRVSACIIAFNEADRIGDCLASLAFCDEIVVVDSFSTDATVAVAEAAGVRVLQRAFDGFRSQKDFCVNQARHDWVLCLDADERVDPALRAAIEAERDAGFPRGPGYRFARCSEYFGRFLRHGTAYPDRVLRLFDRRHGGWRGDREIHEAVSVDGPVALLKGDLLHHPYRSFLQLLDKKQKYARMMAEHEFSRGKRASLGKLIISPAWRFFRSFVFKRGFLDGWPGLIEAFVSANYVRQKTIMLWLLQNGQPVQTPPASR

SEQ ID NO: 2172 - protein, 251 aa, Unknown
  Description of Unknown: Rhizobiales bacterium TMED94 sequence
  MOD_RES (48)..(48): Any amino acid
  MOD_RES (51)..(51): Any amino acid
  MOD_RES (62)..(62): Any amino acid
MNNKLPISCFIIAKNEADRITKTIKSVEGLVDEIIVIDSGSTDGTQDXVKXLGCKLYYNEWXGFGPQKRFGEDKAKNKWLLNLDADEYLSNELKVEIRNLFSRKLESNFYSMRVIPIYPNWNKPRLFSAHHLCIRLYNIKFGRFSASEVHDSVQTNSKKIIRLKNPVFHKSVRSFSHLIEKEDSYIKMQIESLKKKNKLFLFSRLIFEFPLSFIKYYFIRRHFTGAFTGLVTATILAFYRWKRIYLFFRKT

SEQ ID NO: 2173 - protein, 265 aa, Bosea sp.
MPPLSIFIIARDEADRIGRTIAAVSSLSDDIVVVDSGSTDDTQAIAEGAGARVIFNPWPGYGQQKRFAEDQCRHDWLLNIDADEVVPPGLVAEIAALFAQGEPGADAYKMRIAEIFPGEAAPHRFAYALPPVRLYRRDKGRYSPSPVHDRVELVPGACIGRLKGTVHHYSVRSLGEQIDKLNAYSDAQADDLDKRGLSLSVFRLVAEFPANFLKAYIGRRHALRGVYGFMTAMNYAFYRYLRVAKHWERRLSRGNAVKPPDRGDD

SEQ ID NO: 2174 - protein, 290 aa, Salinibacter altiplanensis
MISVLILTLDEEVNIGACLDSVAWADDVLVLDSGSEDRTVEIAREKGARVMHRAFDDFASQRNYGLEEGNLRHDWVLHLDADERVPPALRDALRGKADHGEHRAYRVPSKLMFQGRWLKHAGMYPTYQVRFGHREALTFTQVGHGQRGALSPEQVGTLDEPLLHYAFSKGIADWVRRHNRYSSDEAEHARETRLRDVDWTALMTGNAQTRRRTLKDLSYALPFRPLLRFLYVYVGRLGLLDGRPGFDYAVLLAFYEYLIGLKRRERGHRNERTVGGKSSAPLQETETNET

SEQ ID NO: 2175 - protein, 265 aa, Marinospirillum insulare
MVKEKTHTLSVCVITKNEADRIRTCLDSVKHLADEIVILDSGSTDNTVEIIREYTDQVEVTDWPGFGPQKQRCLEKAKMDWVLFIDADESLDATAQKALAKLLTQETIEEVAFTIKWGVVRHGKMLRFGRSGRAPLRLFIREGSSFSPDQVHEKVIHPKGKVSRLPGILMHHTVRNYGEALAKNAKYGWLGSQKYFERGRRNHSLALVILRSYWTFFHIFILRGGFLDGRVGLLVALDYMQTNFAKHAGLWTLTQEEKLKKNTPV

SEQ ID NO: 2176 - protein, 266 aa, Stappia stellulata
MTAATPISVFIIAHNEEDRIGRAIRSVESFADEVIVVDSGSTDETVRVAESLGARVLVNPWPGYGAQKRFAEDQCSNDWLFNLDADEAATDSLGREIQALSASGALFKTPFWRVRIKDVFAHEAGPAPFAYGYNQIRLYDRTKGRFSASPVHDTVRPPEGAHVAQLKAAMAHRSIRSVAFHVEKMNRYSTMQADDMAARGRRIARWRLVTEFPFAFLKAYLLRRYALYGWWGLVISTNFAYTRFLRLAKAYEAELLAKSDTQDTSK

SEQ ID NO: 2177 - protein, 272 aa, Marinobacter sp.
MKLPLSVYYITQNEELRLPESLAKVTGWVDEIIVVDSGSTDKTKEIAESSGAQFVHNHWQGFACQKAYAASLCRNDWVLDLDADEVLSDELVANIKTLFEKPIPGNIAGYRMRWVLSPPKPGHPFKHDRNKKILRLYNRTRAAIEAETDSNNDRPQVSEGKVLYLKGDVLHRTLISLEQLEKKYCQLSTEQARFLVSKNRKISSGRLFAEFPLKFLKYYLIRGQFRNGWFGFSIAITSANRNFMRLAKAKEMQMLAEIDGQAENGFQPGGPQ

SEQ ID NO: 2178 - protein, 336 aa, Sphingomonas sp.
MMSRPVSIAATLIVRNEARCLARCLGSVAPFVDRMVVLDTGSTDGTVAIAKAAGAEVHHLPWPDSFSVARNHLLDLADSDWALMLDADEWLVTGGELLREWCGGPARLGRVCIHNQHDDGETATRSWITRLIPRGARYEGRVHEQVASPLPRVPLPLHVAHDGYLAAQIAPKRNRNHILLLRDLAEQPDDPYLHYQIARDARMRDDLDAACTHFAQALALTPADANWRHELVVTAITVLTKAARLDEALALADREMPHWPESPDFFFVLGDLLLDRAMADPANAIGHWLPLAEGSWQRCLAIGERPELEGSVAGRGSHLAQHNLDVIRSQLAMLAA

SEQ ID NO: 2179 - protein, 337 aa, Unknown
  Description of Unknown: Planctomycetes bacterium sequence
MDHPLLGDLHAHAADAPVLGTRVDARLGDGPRPFARGIPAVRGVPDHLDARQPAHGTNLRSVSDPRSPSSGPCDLSVAIVCRDNADTIGRVLRSVKGLASQLVVVDSGSTDATMDLVLACRDWAEVVLLETQWRGHVATKQLALRACTRRHALSLDSDEPVTPELARSVRDACARDIPAARVNRVVEYRGRLLRHCWQPEWRLRLIRTDLVGDGRAKWGGLDPHDKLEVEPGVAVENLAGTLIHESFPSFERHLHNQLRLQAVAARSLRAAGRPGSVWKLVTSPPGAFLKQVVLKGAWRDGRAGWLAGGTAAAGALIKHMILLELDEPAGPGTVKRS

SEQ ID NO: 2180 - protein, 266 aa, Stappia sp.
MTAAPPISVFIIAHNEEDRIARAIRSVESFADEVIVVDSGSTDQTVRRAESRGARVLVNPWPGYGAQKRFAEDQCRNDWLFNLDADEAATTSLAEEIKTLAACGALERAPFWRVRIRDVFAHESGPAAWAYGYNQIRLYDRTKGRFSASPVHDTVRPPKGAAIAQLEGAMAHRSIRSVAFHVEKMNRYSTMQADDMAARGRRIGRWRLVTEFPLAFLKAYVLRRYALYGWWGLVISTNFAYTRFLRLAKTYEAELLAKSARQEPPE

SEQ ID NO: 2181 - protein, 276 aa, Unknown
  Description of Unknown: Methylobacterium sp. GXF4 sequence
MDAPASDVAPLTLSIFIIARNEADRIGATIRAVRDLTDDLVVVDSGSTDGTQALAASLGARVIHNPWPGYGPQKRFAEEQCRHVWLLNLDADEVVPTALAAEIRALFAAGEPSRPAWRIGIAEVFPGEGRPHPWAYTLTPVRLYRKDRGRYVPSPVHDRVALEPGVKPGRLRGVIHHFSVRSLGDQLDKLNRYSDQQADDLEARGVVIPTWRVFVELPGNFLKAYLGRRHLLRGTYGFLTAMNYAMSRHLRIAKHYERRRRTTTGPDRVDPPDPTF

SEQ ID NO: 2182 - protein, 263 aa, Lysobacter sp.
MSLSSPSPQRVPLSAVIIAFNEADRIGDCLASLAFCDEVVVVDSFSTDDTVAIAAQRGARVLQRAFDGFRSQKQFAIEQAAHDWVLCLDADERVSPPLREAIEAERARGFDGAAAYRFARLSEYFGKFLRHGNAYPDRVLRLFDRRRGGWRGTREVHEAASVDGAVRTLRGDLVHHPYRSLDQQLAKTQRYARMMAEHDFARGKRATLAKLVLAPAWRFWRGYVLRAGFLDGWHGLVYAYVRANYVRQKTIMLWMLRNGQRVD

SEQ ID NO: 2183 - protein, 278 aa, Paenibacillus alginolyticus
MSHYSDAVGENRISVVIIAQDDETRIASAIASCKPFADEIVDIDGGSKDGTVRVSEQLGCKVYVNAWPGYAKQRIYGSDKATYDWIFVIDTDEVVSEPLAASIQKLKSDLSNPSKAYAVLRIGDFLGRWMGKGEKLVRLYNRTEIQYQESLVHETPDVASENIVYVPGVLWHYGFRSIHDHIQRFNKYTDLEAEGAVAAGKRFSLLRMIVRPPLRFVQKYIVHRLYKKGIPGLAVSLFWGIYEFLVCMKQYELGLARKRVKKSQEEPIKEGKAYATLQ

SEQ ID NO: 2184 - protein, 252 aa, Variovorax paradoxus
MSSPSPSLSVIIAAKNEAHHIADCVRSASFADEILVLDSGSTDATAALAAEQGARVVPTDWPGYGPQQQRGIAMARCDWVLSLDADERISPELQAEIRAAIASGAADGYRLPRLSSFCGQFIHHSGWRPDYTLRLVRREKAGFTAHLLHAHMTVDGTRQNLRHSLVHYSYQDLDDVLEKLNRYSAVGARDMQARGKKASLGSAIVHGLWAFVRTYLVRQGFRDGRAGFLIAVYNAETTFYKYLKLMALNTPR

SEQ ID NO: 2185 - protein, 276 aa, Unknown
  Description of Unknown: unclassified Methylobacterium sequence
MSAPPLSIFLIAFNEADRIGATIRAVRDLTDDLVVVDSGSTDGTQALAASLGARVIHNDWSGYGPQKRFAETVCRHDWLLNLDADEVVPPDLSRTIRDLFAAGEPAHPAYRIAIAEIFPGESRPHPWAYALHPVRLYRKDRGRYSPSPVHDRVELDPGASVGRLKGVIHHFSVRSLGDQLDKLNRYSDQQARDLEARGVTIPTWRIFVELPLNFLKAYLGRRHFVRGVYGFLTAANYAISRHLRVAKHYERRSALISTPLPPIEPAKRVDPSDAKF

SEQ ID NO: 2186 - protein, 255 aa, Unknown
  Description of Unknown: Rhodanobacteraceae bacterium Dysh456 sequence
MSRPPLSACIIAFNEADRIDDCLASLAFCDEIVVVDSGSTDDTRERAAAHGARVIQRPFAGYRSQKAFAVAQARHDWVLCLDADERVSARLRTSIEAAQAAGFEGAAGYRCNRLSEYFGAYLRHGNAYPDRVLRLFDRRRGGWRGEREIHEAVSVDGPVRTLAGDLEHHPYRSLSEQIAKQERYAQMMAEHLHARGERATLGRILLNPWWRFVRGYLLRGGFLDGWRGLVYALVRVEYVRRKFLKLWLLERGYRP

SEQ ID NO: 2187 - protein, 266 aa, Marinobacter sp.
MKLPLSVYYITQNEEMRLPESLAKVIGWVDEVIVVDSGSTDNTRDIVKSAGARFVHNDWYGFACQKAYAASLCRNDWVLDLDADEILSDELVENIKALFEAPIPADIAGFKMRWVLSQPNPGHPFRHDKSKKILRLYNRKKAAIEAEKDSNNDRPQVREGKVEYLKGDVLHRTLISLEQMERKYCQLSSEQARYLVAKGRKISAGRLFVEFPLKFLKYYLIHRQVMNGWFGLSVSITAANRNFMRLAKAKELQMLAEIDGQSRAEK

SEQ ID NO: 2188 - protein, 382 aa, Ideonella sp.
MTASPSPSVYRVALVMIVRDEAPRIGRALQSLRPWVDEMVVLDTGSRDDTVAQAQAAGARVGHFTWCNDFAAARNAALDLAGADWHVVLDADEWLSSGGPSIAALRQQAPAFVGQVRVDSHFGHDGERAPSWLPRVLPGWVRYEGRIHEQPRRGPPTQRLPVVFEHLGYAPAALAEKAGRNAALLGQALKDNPRDPYLWYQLGKDHDVYERWAQALDCFDQACQALPPHGPLPPWRHDLEVRSLHALKRTGRHADGVLRAEQGLGQWSHSPDFFFALGDLLLDWATQDLSRADELLPMIEDAWQRCLMLGERPDLEGSVAGRGSHLAARNLMLLYQVLERPEDAAALASLARPPAPTRLEQAPPGAAYQPAASPPAAAASAP

SEQ ID NO: 2189 - protein, 265 aa, Luteibacter sp.
MAREPLSVVVTTFDNAETIGACLASVRFADDVLLLDSGSTDATVAIALSHGARVHVQPFAGYSAQKQAAIDLAAHRWVLLLDSDEALPALAAERIQAALVAPDVAGFELLRREWVFWRWQPDRARLNHYVRLFDRTRAAMSGHEVHESVRVDGPVRRLDAIIDHYGERDIGGRVDKANRYSSLQVRDRLTRQPRLLRLRMVVYPSIAFARYYLWRGHWRGGWAGFVAARVHAFYAFLKYAKLYERRMSGGQRHGHGAFETERRDN

SEQ ID NO: 2190 - protein, 251 aa, Unknown
  Description of Unknown: anaerobic bacterium MO-CFX2 sequence
MPVELAVVILTYNEADHVAACITSVGWADRIVVFDSFSQDNTPALAQAAGAEVIQHAFEDYARQREAALQAVDADWILFVDADERSSPEQAAEIRDLIRHGEHNGYWIPRHNYIFGKLTRHSGWYPDYQLRLLRRANAHYDMERQVHELVNLEGEPGYLKTPFVHYNYTSFAQFRAKQRRYVQYDARMLQQQGIHPKPHKFITQPLRQFIWRFITLQGYRDGWHGLRLSLLMAWYEFQKYVHLRRLSSADR

SEQ ID NO: 2191 - protein, 258 aa, Edwardsiella piscicida
MPPRLSVVLICKNAADLLPECLASVAWADEIIVLDSGSSDETQRIAQAAGAKVYENRDWQGFGIQRQRAQQYASGDYILMIDSDERVTPALKEAIAQVLTQPVTERVYSIARRNLFLGRFMRHSGWYPDRVIRLYPRQRYGYDTSPVHESLACRGASVTPLQGDLLHLTCRDFTGFQQKQLCYATAWAHERHARGKKTSMLGIFSHTVGALLKTLLLRGGVLDGKQGWLLAVVNAQYTFNKYAELWALQHGYTEKTPL

SEQ ID NO: 2192 - protein, 261 aa, Polymorphum gilvum
MADRLPVSAFIIARDEADRIAGAIDSVAGWVDEVIVIDSGSSDDTVTVARSRGARAVENAWPGYGPQKRFGEDQCRNDWLLNLDADEAVTPDLEAEIRTLFATGRHTEADCWRIMIRDVYPHEAGPAPWAYGYHQIRLYDRRKGRFSASTVHDTVRPDAGARVASLQGIIAHRSIRSLAFQVGKYNRYSDMQVADMRARGRGLPRWRLLTEFPFAFLKAYVGRRYARYGWWGLILAVNYAHARFLRVAKAYEARLAERTRR

SEQ ID NO: 2193 - protein, 261 aa, Lewinella marina
MRRPLSIIYTTFNEIDIIGRSLESVEGWSDDLHVVDSFSTDGTAEWLAARPDVRLTQRAYTGPADQKNWAIARARHEWVLLLDADEVVTPELRREIDDLLAAPDLVDAYWIGRDNYFMGRPIRYSGWGNDRVVRFFHRDRARYNQQQVHEEIEVRNLRVGSLRGRFQHFTFKSVDHFLDKNRRYARWKAMDQGASTPRVGLFHLLVKPVFRFFRHYVIQGGFRDGREGLIICTVAAYGVFLRYVYLLAERRGGEGRGAPSP

SEQ ID NO: 2194 - protein, 258 aa, Breoghania sp.
MPAPLPLSIFLIAFNEADRIGATIEAVRGLADEIIVVDSGSSDDTRDIAAALGARVLHNDWQGYGPQKRFAEDQCRNDWLLNIDADEICPPALIAEIRALFASGAPSCGAYRVPIAEQFPGEKAPHRWSYTIDPVRLYRRSAGRYADSTVHDRVELAQGTSVGRLRTSIHHRSVRSLSHEIAKLNAYSDMQAENMEARGVRLPFWRILTEFPMAFLKAYVLRRHFLRGRYGFLTAMNYAIYRHLRIAKHLERRRSGGR

SEQ ID NO: 2195 - protein, 266 aa, Marinobacter fuscus
MRLPLSVYYITCNEEARLPESLARVKALADEIIVVDSGSTDRTCHLAEAAGARVVHRDWEGYASQKAYAASLCRNDWVLDLDADEVLSDELVANIQERFSQPISEQVAGFRMTWVLSPPDPEHPFRYERPKRILRLYNRQRAVIRPEKDSNDDRPKVVSGRVLDLPGNVLHKSVVSLQQAEAKFIQLSTEQARYLAAKGRKVSTARLLSEFPLKFLKYYVLRRQYRNGWFGFSYSILSANRNFMRLAKARELQLMAALRARRAAGD

SEQ ID NO: 2196 - protein, 386 aa, Unknown
  Description of Unknown: Candidatus Carbobacillus altaicus sequence
MNGMLDPSTPSSKTSSHTLSITMIVRNEEQTLPRALDSIREAADEIIIVDTGSTDRTIDIACSYGAHVIRVPWHDHFSEARNKALEAARGTWILTIDADEWIPAEDIKLLRQLLNDPSVSAYFVHVISFVGPNGEKKALNRTIRLFQNDPAHRYEGRIHEQIALSIQRHNPQAKFAISPLRLFHDGYLNDVVQSKHKIERNIALIRQMIREDPENSFHTFNLGVEYMRAGRWQEAQSALDAALAKLPPGISYAHLLYKYRLLVAMNLGKTEDAENILQEALSLFADYTDLWHIQGDLARRKGDVKQAYASYLKALTLGPAPAPYHTEIGVGSYLTAQALGEIAEQIGDERLAIAYYSRALMIEPSYTPVRERLRSLLNRSERFSPV

SEQ ID NO: 2197 - protein, 486 aa, Alicyclobacillus hesperidum
MVATLTHIETVKSQLLAGDYSTAKVNAVKAIRQSEKLNAQLWEFLGEALEHLGEYDAAWAAYDRAWLLDPQAEWAEPARMRLRERVTGKVPVWIQELLAAPHVTISAAMIAKNEARTIGDAIAALTPAVDEIIVVDTGSTDETIAIAEAAGAKVYRYEWNDDFAAARNFALDQVSSDWVLWVDADEVLFEEDVHNPRIVAGLFNELDPPAILRIGQINVFDDRVEPNYDMSRLFAVRTGLRWLGRIHEQIGLPEGGVFAGNFVRPAVRIRVRHDGYKPEVMNAKQKLQRNIHLLKAAVNDNPNDIASWGFLGRDLLLAGHVEEAVNALYTTERLAPSNPQYARLPEIRMFLIDALVSLGRRAEAIAVGERAKAEHPNYPGTWFALGRALMNTAIHELGQAKEAFVKAQQSAQGYRGMVAFDPQILTWRSTAAIADVEKLLGNSFQALKLYEDALSKSPGNKAIAGQIEWLRNQARMIHGETSSSGK

SEQ ID NO: 2198 - protein, 271 aa, Unknown
  Description of Unknown: Candidatus Pacebacteria bacterium CG10_big_fil_rev_8_21_14_0_10 _44_54 sequence
MQEKITAIIIAKNEADMLAACLATVAWCDQVLVLDSGSTDDTAKIAEQAGAKVVLFSHSSFARLRNEALKHVSTEWVFYLDADERVLPQLAREIQVHIETGKDTTLQLERKNVFFGQAFSAGGWSPDYVTRIFRKTSLRGWSGVVHESPEFEGGVVQLQIPLVHLTHRSVSDGLKKSVVWTALEAELLSETLTFAVTPRTVIRKGVMEFLRRGFFWRGYKDGTPGMMEALIQGINKMLVYLQVWELQQQPPIEQQYKAAEKEIADLWRKKS

SEQ ID NO: 2199 - protein, 279 aa, Unknown
  Description of Unknown: Methylobacterium sp. CG08_land_8_20_14_0_20_71_15 sequence
MSAAPPLPLSVFVIARNEADRLGATLRAVQGLSDDIVVIDSGSSDGTQELARSLGARVIHNDWPGYGPQKRFGEEQCRHDWLLNLDADEVMPPDLVAEIRALFARGEPDKPAWSVGIAEVFPTERRPHPWAYTLTPVRLYRRDVGRYSPSPVHDRVALPEGTPTGRLRGVIHHFSVRSLGDQLDKLNRYSDQQADDLAARGVAIPSWRVFVELPGNFLKAYFGRRHFVRGVYGFLTAMNYAISRHLRVAKHYERRHTRAPAPQRDPAKPERLDPPAPTF

SEQ ID NO: 2200 - protein, 359 aa, Acutalibacter sp.
MNTISLCMIVRDEEDVLGRCLESVADLVDEIIIVDTGSKDHTREIARRFTPNIYDFTWIDDFAAARNFSFSHASCDYCMWLDADDIIAPPDRQKFLDLKKRLDAGVDVVMLRYYTGFDEQGRVTFSYYRERIIRNRAGMVWKGAVHEVIETRGNVRYSECGITHWKLHPSDPDRNLHIFEKLLEQGTTLDPRQQFYYGRELYYHKRYQEALKVLENFLKEGRGWIENSIEACRQCAYCWYALGDERRALEALFSSFAYDIPRAETCCDIGQHFLDRECWERAAYWYVRALECERRDDRGGFVLPDAYGYLPCIQLCVCYSRLGRQEEARRYNERAAEFQPDSPAVAYNRAYFAGLEPAM

SEQ ID NO: 2201 - protein, 569 aa, Unknown
  Description of Unknown: candidate division NC10 bacterium sequence
MKTRTSLMTMREKQKKRSTLSLCMIVKNEEQYLSDCLASATPFVDEIIVIDTGSTDRTVDIAKAAGARLFHEEWRDDFAAARNRSLCHATGDWILVLDADERLSGDGGRIMRDRIEVPGVAAYLVRLQCPTHGGSALGTMSLKWLPRLFRNGVGARYEGIVHECLLPSLRGKGKIVHSEITLEHLGYLQSDEVMRVKAMRNLHLLEGQAARTPDDSLTWIQLAETYLTLSRHDQAIASYQKALTLLTHERDHGQRTISNATAAVAYQQLGALHLLRGGCDEAIVVLRQAIDLWPALASAYLYLGQAHENKGELENARESYGMAIEWAQRPEPPGHPVRLVPWLPWLLKGTVECKLQRYDAARDALDQAICLNPDFPGAHTMLGVIDRVLGRPHAALEAFETARRLGDATASLLINIGTTHHHLGNFDKAVQAFQEALVRESESRDARLGLCRAYVQLGQWSDVADEGYALLERGVVDPDLYRLVGQALRSLGMWTAAVSVYEALCAMTNPIPADWSGLAIVALGAGQPIKALQAAEYALSVNPPEDLRSILQAVTEQAQEALPLESALL

SEQ ID NO: 2202 - protein, 260 aa, Unknown
  Description of Unknown: Rhizobiales bacterium GAS113 sequence
MPPLSVFIIALNEADRLPQVLEALGDLVDDIVVVDSGSDDGTQDVARRFGARVIEHAFPGYGPQKRFAEGECRHPWLLNLDADEVISQALRAEIAKLFASGEPAADAYEIAIHEVFPGEDEPHPFGYALAPVRLYRRDKGSYNPSPVHDRVDLVPGAKVARLKGRIRHISVRSLGHQLEKLNVYTDAQVRDLEARGIRVTTLRVFLEFPGAFLKAYFGRRHCLRGIYGFMTAMNFAFYRYLRVAKALERRRLREKGIEPQ

SEQ ID NO: 2203 - protein, 254 aa, Aquidulcibacter paucihalophilus
MSLPLSIFIIAKNEVDRIGPTLESVRGLSDDIVVIDSGSTDGTQELAEGLGARVIFNPWPGYGLQKQFGEDQCRHDWMLNVDADEVVTPELADAIRTVFSQPDLAPCGYETDIIEMFPGEARPHPWAFRLSPVRFYHKTVGRYSASPVHDRVDIVKGTPIKRLVGVIEHRSIRSLGHELIKLNAYADMQANDLDRKGRNISALRLVVEFPLAFLKAYVTRRHFVRGLYGFMTAMNYAFYRYLRLAKHWERRLGR

SEQ ID NO: 2204 - protein, 271 aa, Luteimonas arsenica
MNTSSSPGPALSACIIAFNEADRIGDCLASLAFCDEIVVVDSGSTDATADIARAAGARVLQRKFDGFRSQKAFAVAQATHDWVLCLDADERVGEALRASIEAARATGFGDAAGYRFARLDNYFGRFLRHGNAYPDHVLRLFDRRCGGWRGDREVHEAASVDGPVRTLAGDLVHFPYRSLEQQLAKTQRYARMMAEHDFARGKRATLGKLVLSPAWRFWRGWLLRGGFLDGWHGLVYAYVRANYVRQKTIMLWLLQNGQAVATPPAPGAADD

SEQ ID NO: 2205 - protein, 264 aa, Pseudovibrio sp.
MSNNLPISAFIISQDEEDRILMAINSVKTLVDEVIVVDSGSTDNTVALAEKAGAKVIYNKWDGYGKQKRFAEDQCRNTWLINIDADEEITLKLADEITEIFTSTPRADIYKVHIVDVFPHEKTAKKWAYGYWQYRLYNKEKGRFSSSSVHDTVRPHEGAKIARLKGKVDHRSQRSIQFTVEKFNRYSDMQVQDMIFRERRISPLRLLTEFPLAFLKSYFIRRGVFYGLWGIVDAHNYAYSRFVRLAKYYQYQLIERAKKANKER

SEQ ID NO: 2206 - protein, 295 aa, Lysobacter sp.
MAGHRRRRRTGAAAAAALPAAGAGDRAAGATRPRGRAPQAALVSAVADKLPLSGVVIAKDEGDRIGRCVASLAALCREVIVLDSGSGDDTVAVARAAGARVEQQPWLGFAAQKNAAIARATQPWVLLLDADEWLDAAAGSTLRTLFAGGAVERADVWRLQRRTHFLGTPLQHGGWGREPVERLFRPDLRYLPAEVHEKLDLAGRRVAAVPARIEHDTARSFAEYADKLQRYAQLWAQQRRAAGQRAGALAAPLHAAAYWLKNYLLRGGFLDGPMARRFHALHTRYVFLKYKLLRG

SEQ ID NO: 2207 - protein, 254 aa, Lysobacter sp.
MPAPLPLSGVVITLNEADRIGRCIASMREVCDEIIVLDSGSTDETVSIARSLGARVKHRDWDGFARQKNAAIERARHPWVLLLDADEWLEPVARDEIRKLFASNIESADCWLLQRRTHFLGHAMRAGSFAREPVHRLFRQAMRHGDVPVHEYLDVDGWNVRLSSIALEHDTARSEDEYSAKLQRYARLWADARATRGKRPSALRGPAAGAAYLLKNLVLRGGFVDGHAGWRFHRLHARYSVLKYRLLRERLRPG

SEQ ID NO: 2208 - protein, 271 aa, Unknown
  Description of Unknown: Chitinophagaceae bacterium IBVUCB2 sequence
MVVEMVENRKDLIFVAMQSLSVVIVCRNEAGIIGETLQSLQGLTDDIVVYDNGSTDDTVEKAKAYTEQVHQGSWEGFGKTKRKANALAKYDWILSLDADEAIDAALKESLLSFKPANDYEVGEIKFKNFFVDKWLRFGEWGNDKHIRLFNRKQVNWDDAAVHEKLLIPAGSSVKKIKGHILHKTVKSIDAYKQKMQQYAMLNAGKYHQAGKKATWVKRYLSPAFTFINYYIFRLGFLDGYAGYVCARITAWYTSLKYERLRELNRGVGRGK

SEQ ID NO: 2209 - protein, 270 aa, Stappia sp.
MQTTAGGTPVAISVFIIAHNEADRIARAIDSVAGFADEVVVVDSGSTDGTQDLARAHGARVIENAWPGYGQQKRFGEDQCRNDWIFNLDADEAATPALAREIAQLAASGALTSAPFWDVAIKDVFAHEDGPAPWAYGYIQIRLYDRRAGRFSDSPVHDTVRPPDGARRARLKGAMEHRSIRSVAFHVEKMNRYSTMQAEDMAARGRRIARWRIATEFPLAFLKAYAIRRYALYGWWGIVISVNFAYTRFLRLAKAYERELCERAEQRRRS

SEQ ID NO: 2210 - protein, 359 aa, Emergencia timonensis
MITISLCMILKDEEDVLDRCLSSVKGLVDEIIIVDTGSTDATKQIALQYTDQVFDFAWIDDFAAARNYAFSKANMEYCMWLDADDVIEEKDRLDFLTLKNTLTLDTDIVMMRYNTAFDDDGNPSFWYYRERIIRNDQSHPWQGAVHEVITPNGSLLYSDVAICHRKLGAGDPDRNLNIYRKLLAEGRILSAREQYYYSRELYYHQLYDDAIEAFGVFLSLPDGWMEDKIEACIMSSKCYMLTGKSDEALLMLFRSLLYDIPRAEVCCEIGDCFMKTGRFETAAFWFETALDCQMDYRKGGFILPDCYDYIPAIQLCVCYDKLGEVEKAKAYNDKAGEYKPNASAFLHNKKYFDKKLKSH

SEQ ID NO: 2211 - protein, 630 aa, Unknown
  Description of Unknown: Chloroflexi bacterium sequence
MRTPIEKSLHCFSWSGNPFPAGLCGPRPPIDHSPPISRRLTSCQLVTGRLSAVQSGPLGTRSTPFVGRRGRGRSPYMTRNRHDQVSSFAQVERRGNRRSSRWAQEGFAMSESGRARADKPLISLTMIVKNEEANIGRALDSARGIADEMIVVDTGSTDRTVEIARGRGARVIPFTWVDDFSAARNFALDHATGEWILILDGDDVAVEESIGALRAEIVAQPAGIQILRVPVRSRRADGLGFTVSGGRRLFRNSPEIRWIYPIHENIVHCREDPDMEGGSAALVVEHSGYADTTGREAAGKHKRNLRLLRRELRQRPDAPELYYYLAVQHAEMGHHVTALRHARAALRRFAGRIRPDFAGLIRVVAMRSAMQLGQAVLAVRIGELGVRDYAYSDLCFTLGCAHGQTGNLVQAERFLNLAMALRDRATEFQVDAGSGSWKALVELGTVAWSKGNFELAIERWRRAYDWMPNEAVTNLALGRGLLANDEAGEALDYLRRAAEAAPRLVETHTRYCQALVATGQNQAAYDYLDDLTRRNPDVSAYWLLLGDLLHRLGEHEECARVLGGAIDRHQTEPKIYILLGSALRFLERHHDSLNAFVLAARLDPGSIVARNGMRAAAESVERIHAELLTA

SEQ ID NO: 2212 - protein, 257 aa, Niveispirillum irakense
MAHKLPLSAFIIALNEADRIGPVIRAVRDWVDEVVVIDSGSTDGTQALAASLGARVIHHDWPGYGQQKRFGEMECRHDWLLNIDADEEAVPELEAEVRALFATGSPPLQGYRIQTVMTLDGQARPHRFAPRHNYIRLYDRRHGHFADSETHDAVIMESGAVGQIKSIIIHRSIRSHADLINKLNRYSSAQAAEIIARGKARRFSALRLMAEFPVNLLRYFFLKGYWVFGLQGLEIAAIIAFFRFARIAKVRENLRKG

SEQ ID NO: 2213 - protein, 483 aa, Alicyclobacillus sacchari
MVPAVDAVKDQLLRGGYGEAKTLAVESLRDKGKLNAQLWEFLGESLEHLGEYDAAWAAYNRAWLLDPQAEWAEPARMRLRERLTGKTPVWIQELLAVPHVTISAAMIAKNEARTIGKAVAALSPAVDEIIVVDTGSTDDTVAIAEAAGAKVFRYEWNDDFAAARNFALDQVSSDWVLWVDADEVLFEEDVENPRIVAGLFNQLEPPAILRIGQINVFDDRVEPNYDMSRLFAVRTGLRWLGRIHEQIGLPEGGVFAGNFVRPAVRIRVRHDGYKPEVMNSKQKLQRNIHLLRAAVRDNPNDIASWGFLGRDLLLAGHVEEAVNALYTTERLAPSNPQYARLPEVRMFLIDALVALGRRAEAIAVGERAKAEHPNYPGTWFALGRALMNTAIHELGQAKEAFTKAQESAVGYRGMVAFDPQILTWRSTAAIADVEKLLGNSYNALKLYEDALSRSPENASIAGQIEWLRNQARMIQQERDKQGD

SEQ ID NO: 2214 - protein, 271 aa, Bosea thiooxidans
MPPLSIFIIAQNEADRIGRTIEAARALSDDIVVVDSGSSDGTQAVAEALGARVIHHPWPGYGLQKRFAEEQCRHDWLLNLDADEVLPPDLADEIAGLFTGGQPSADAYRIRIAEIFPGERAPHRFAYALAPVRLYRKSWGRYSPSPVHDRVELLPGAKVGRLKGTIHHFSVRSLGEQMEKLNAYSDAQADDLDARGETLSAFRLVAEFPANFFKAYIGRRHALRGAYGFMTAMNYAFYRYLRVAKHWERRLQRRAAQPDDATAARPGASDG

SEQ ID NO: 2215 - protein, 268 aa, Unknown
  Description of Unknown: Desulfobacterales bacterium CG23_combo_of_CG06-09_8_20_14_all_ 52_9 sequence
MEKERRREDRPVERVKDQTIGIAVIAQNEADRIMKLINSISFADEIVVVDSGSTDGTPSLCTQMGARVIQRPWQGYAAQKQFAMECVRSDWILNVDADERVSEALAHEITAAVASAPPETAGFSMPRLSFYLNRWIRHGGWYPDRKIRLVRRGKGEWSQDALHERLIVQGKVIPLSQPLYHDVYRNIADQVATINRFSDVAASEKGPRTGKHLLLGLLHGAVKFFESYFWKLGFLDGYAGMVIAANSSWYVFLKHAKAWEFSLKTPEK

SEQ ID NO: 2216 - protein, 265 aa, Microvirga sp.
MLPVSVFIIAKNEADRIGATIRAIRGLTDDLVVVDSGSTDGTQAVAEELGARVIYNPWPGYGLQKRFAEDQCRHEWLLNLDADEEVSPELLAEIRALFAHGEPPCQAYGIRIVETFPGEAAPHPLAYRVAPVRLYRRDAGRYSSSLVHDRVDLNPGTKTGKLKGLVHHRSVRSFGDQLAKLNSYTDQQAVDLEKRGISIPTWRVYFEFPAAFVKAYFGRLHVLRGTYGFLIAMNYATWRHLRLAKHYERKRMNALAKANSRTERA

SEQ ID NO: 2217 - protein, 256 aa, Unknown
  Description of Unknown: Deltaproteobacteria bacterium sequence
MSLSAVVVAQDEEERIAACIASVRGFCDEVLVVDGGSRDATVRIAEEAGARVVSRPFDDFARQHEFARSEARGTCILSLDADERASDDLARTARPALERGAAAYALPFRNHFRGVWLRHGGFHPDFHLRLFRKDLCRYDLTRPVHEKLIVQGAVERLEAPILHFTCSSLAQCLAKMERYGERAAWSLFAQGRRGQAWEVAFRPLWRFVRGYFLLGGFLDGAAGAAMAWARAYEAYARYARLWELSQFPESRGDALR

SEQ ID NO: 2218 - protein, 272 aa, Lysobacter gummosus
MDANEPARMRVSACIIAFNEADRIGDCLSSLAFCDEIVVVDSNSSDATVAIAHAAGAHVLQRRFDGFRSQKQYAIEQAAHDWVLCLDADERVSDALRASILAARDRGFADAAGYRFARLSDYFGRFLRHGNAYPDRVLRLFDRRHGGWRGKREVHEAASVDGAVVTLGGDLIHYPYRSLEQQLAKTERYARMMAEHDHARGKRATLAKLVLAPAWRFWRGYVLRGGFLDGWHGLIYAYVRANYVRQKTIMLWMLQHGQPVTTPRRENDTTPE

SEQ ID NO: 2219 - protein, 274 aa, Unknown
  Description of Unknown: Gammaproteobacteria bacterium sequence
MALIGEYSTQLQRVSGEVRVASRTGLSACIITYNEADRIEACLRSVAFSDEIIVVDSHSTDATRELASALGARVIERDWPGYRSQKQFAVDCARHDWVLCLDADERLSNELRGEIEAVRDSGFEGFAGWSVPRITDYFGRFLRHGNAYPDRLVRLFDRRRGGWTGYEIHENTRVQGRIGRLRGHLEHYSYRSLTDHYERLQRYADLMAQALYSSGKRCGLTQVLVNPRWRFVRGYILRLGFLDGWRGLVFALVEASYVRRKYLQLYMRGKGQSS

SEQ ID NO: 2220 - protein, 357 aa, Rubrivivax sp.
MTAAAPCRLALVVIARDEGRRIARLLNSVRPWVDDMLVLDTGSTDDTVQVARAHGARVETFTWCDDFSAARNHALALAGADWHLVLDADEWLIAGGEALQGLRGTPRDFVGALQLRDRFDLSAGQAGEAIAWLSRVLPRPVRYAGRVHEQPQHALPVRRLPLVVGHDGYVAERLAAKQGRNRRLLQQALADAPGDAYLWYQLGKDCAVYDEHAQAEAAFALAAGAADVEAAPWWLDLVSRRLFGLKCLGRHADAMDFAQTQMAAGVESPDFYFTVGDLLLDLAAADPAQAGEALPMAEAAWRRCLELGEHPEQPGAVAGRGSFLAAHNLAVVLDGTGRAGEAAELRARHPWPPQPTP

SEQ ID NO: 2221 - protein, 274 aa, Edaphobacter dinghuensis
MRPSIVLLTFNSSDSLGATLASIRGLSDDVHVVDSGSTDTTIEIAQAAGAQVTYHPFSNYGSQRNWAIDNLQLKYNWQLHLDADERLTDELKNEILLLPENPDCSGFFIGRFLQFLGRVLRHGGMSPTWHMRLFRSGEGTCESREYDQHFWCRGKTANLQHSMIDDIRMPLSEWTSRHNRWADAEVREILSDQKDGRIAGNLRGNLVERKRFLRGGYDRLPHFFRAFALFGYRYIIKLGFLDGIEGSIFWVLQTFWFRFLVDAKLYEHQKNTKV

SEQ ID NO: 2222 - protein, 722 aa, Unknown
  Description of Unknown: Actinobacteria bacterium sequence
MSHPPVSVIVTASGSPADFSACLDWLRPELGPQDEVVCVVPHDRPQLRRELTGQSWLRILDDDSADQAGRWSAGLAATRHPIAVLLDGDVLGSARWLDRVVQPFADPQVVAAGPRCHRSYGPQGASLPDHALASPASFREYAREWRDEHREEPTAVDRLGPVCVAVRRAALDQVGGPTADLPYEQLRAAGRLVVVHSALVAHVGTGRCALRSGVPGPRPLVSASMIVKNEEDMLADCLTALRGFVDEIVVYDTGSTDRTVDIAREHGARVVEGYWNDHFAEARNRSIAHCRGEWIFVVDADEIVTGDPASMRSALDQVTGPAAEVLVQCVEGHGLEGRGVLSIRLFRADGRYYGRLHEQVVDRVTGEPLTGSLLPGVELAHFGYTELRFAVKDKVARNLHLAELAVEDEDGSHDAVANLARSLVFAGRLEEAVAVCQRERAQARGSARQTFLEVLVQAAAGLRRFDLAEEALAELRTIDGAALSAQELDARLRYTQGDYAAALALVEAFPRTAPTGQAVQVLSRGQLVRVEIMSLHKLGRHEDAARLLCECIERGEFPFGMAEMTALLVAAGRPATTIAAVVPHRSVRELLLVAAQVPGAAFDDLLEVLWSRYPGDPAVLAFAARVGAHLPLIRSLDWAARLRQHGFADSCTLVALSGAAQRTPRERALAAAIALEMFGDDRAMPPLERALAEISDEEAPGLLDEMRQLAPGIAAAIEPAGV

SEQ ID NO: 2223 - protein, 305 aa, Lysobacter antibioticus
MVSPTDGLHNAGIRRAACRHQVSIIDTTRPAATTPTDGRPKLSACIIAFNEADRIGDCIASLAFCDEVVVVDSYSTDATAAIAQAAGARVLQRAFDGFRSQKHYAVEQAAHDWVLCLDADERVDARLRASIEAARARGFEDAAGYRFARLSEYFGKFLRHGNAYPDRVLRLFDRRRGGWRGKREIHEAASVDGAVATLAGDLIHYPYRSLEQQLSKTERYARMMAEHEYARGKRASLSKLVLAPAWRFWRGYVLRAGLLDGWHGLVYAYVRANYVRQKTIMLWMLERGQPVTTPPRKDDAGTPHD

SEQ ID NO: 2224 - protein, 255 aa, Aquitalea sp.
MTPLSIYVLTFNSEKYLSAILQAVAPLADDLLVVDSGSSDQTVAIATQCGARVLHRPFDDFRQQRDFAQQQCRHDHVFFLDSDEIPSPELVAHLLQLKQSGFQHDAYAIQRDWIVMGQQVHALYPVGCPDFPVRIIEKNRVRLSEQAVHEDFVGYRSRGRIELPIKHQTFHSMDEINRKLELYTNLDASDLARMSSRKNFALRQWTSPVGAFFKWYVKSGNWKDGRVGLILGVYAARFAHRKYKKALQIRRETGL

SEQ ID NO: 2225 - protein, 255 aa, Luteibacter sp.
MTRRPISLCVITQNEADRIRDCLLSAAPFCDDMVVVDGGSTDDTVAIAEAAGARVIHRPFDGFRSQKAFAVVQAKNDWVLCLDADERVGADLRAAIEQVADAGFGAAGYRFHRRNDFFGRFMRHGNAGADKVLRLFDRRQGGWRGPREIHESVSLDGDVRMLPGFLDHYPYRSLSELMAKQERYAHMMATEEFAAGKRATLGQIVVSPMWRFFRGYVLRAGFLDGWRGIVYALLRVEYVRRKYVKLWLLQHGQRA

SEQ ID NO: 2226 - protein, 273 aa, Unknown
  Description of Unknown: Gemmatimonadetes bacterium sequence
MRRSPHGSGPVAASWCGGSTRSSAWSSARRPYIVKRWSAASSREGRVQAPITIVIPTLNEAAQIAACIRHLDWTADVVVVDGGSTDDTVALARAAGARVITDGPRGIGEQRNAGIAVARHGWVFALDADERIGPELAQEIMAVPAGATPAGATHEAYRVKRRNAFQGRVLQRGHWGNDWVVRFARREFRYGGSAVHPGLQGLRDVGTLTQQLDHTPYRDLSHHIEKLVAYAQTSARALAARGQRARWSDLALRPAAHFWREYLLRGGFLDGRM

SEQ ID NO: 2227 - protein, 844 aa, Desulfotomaculum sp.
MNKETVSLCLIAKDEEEFVQSCINSVKHLVDEIVVVDTGSLDKTAKLAVEAGAQVYSFGWTGDFARARNFALEQASSGWILVLDADEILKPVSAGEFYRLLQAADVEGYFLRVESFLGTGWETATDQVVRLFRNKPAYKFAGAIHEQVAPSILSANGGKGLAAAPLVINHYGYLKAQVIKKNKFYRNTSIINRELESNPADPFLLYCLAVEHYQRGDFTGGLDCLEKALVLLQGTEGYFEDVLLNLALGLLKTGSMERLIDFTTKSLQMFPEHRDLILLRGLGYLSRGKHLEAMKDLNKSSQASDAGLLHGFGPRKLRKKKNLPVKLRVLTASPVRQKEAVLREFLESLQLLDTSGLELDFAFIDDNNRHNLLGAFSKKMKNVRIIPGVTADNYLCDETTHHWQENLIWKVAGYKDKFIRMALEGDYDYLFLVDSDLFLHPKTLSHLVSLGKDIVAEVFWTKWEPYLAPLPQVWVSDSYQLYHTRRGEVLSEEELNKRIAEFLKLLSNPGTYKVGGLGACTLISRKALSAGLCFKEIYNLGFSGEDRHFCIRAAALGLELYADTHYSPFHIYRESDLKALQEYKEKIFKSDGGSTQKKRGAASAPGQRRKKERAPKITLAMLVRNEAGRYLERVLENASRYVDNAVILDDASEDSTVEVCKKVLKGVPLTLVSNKKPGFENEIVLRKQLWEITVGTKPDWILILDADEIFEDSAPAAIRSLAAKPGIYHYSFRLYDMWDENLYRSDQYWNSHNFYRPFMVRFTPGFNYQWKETPQHCGRFPVNITGLGGDSSQLRVKHLGWMKPEDRLAKYCRYKKLDPYGKYGVMEQYLSILDPRPGLAPWVE

SEQ ID NO: 2228 - protein, 256 aa, Enterobacter cancerogenus
MSASLSVVTIAKNAADLLPDYLASVSWADEIILLDSGSTDNTVEMARAAGVKVYVDTDWQGYGIQRQRAQACATGDYVLMIDTDERITPALQQSIQAILAAPQPGAVYSIARRNYFLGRFMRHSGWYPDRVMRLYERTRYQYNDNLVHESLACENAQVIPLTGDLLHLTCRDFASFQRKQLSYATAWAQERHQRGKTASLTGIFTHTLGAFLKTLLLRGGVLDGKQGWLLAVVNAQYTFNKYTELWALCRGYSEKT

SEQ ID NO: 2229 - protein, 582 aa, Paenibacillus sp.
MSRLQRKPLISLCMIVRNEADTLARCLTSIHGVADELIIVDTGSTDSTLSIARSFGARIVSYPWTGDFAAARNAGLEQARGTWILVLDADEELDAQSKGELLLCAEHTEYEAFFVRIHNHKGTEFSSPVITVNPILRMFRNRPQYRFSGIVHEQIASAIVEATPAAAMHLSTVSVHHYGYADKVVAKKDKISRNLSLLKEQLRLNPRDAFHQFNTAVEYMRLGDYTQALEHIRLSLAEAEPDTSFIHLLYKYEARCRIMSGDQSGALDACIKGCALFPDYPDLHHIKGVLLLQAGAFAAARQAFRQALDIGVSPPGYHTESGLGTYLTYAALGQLCQETGEAGEAIACYTRAAQLHPAPAPLLVRLVRIMKCAGREHELAGWLEAHLPQLTADVPRLAGLLLAEGCLAAAAEVIGACAGAADADMPGGGAGTMNENPPRGDAEVSDMRAPGGAGTAGVADMPGGGSMTPLDGKWPAVHEPVSGAASSGLPSDNAAADLLRLLQRVNAVPADQLLHQDITLLLSHPAACVPEHSPSAAGPASRSSRAWLLMADRMLAALPAASGYGAAAARVRLTLPLPRTGE

SEQ ID NO: 2230 - protein, 276 aa, Unknown
  Description of Unknown: Methylobacterium sp. Leaf99 sequence
MTSPAVTCLPLSVFIIARNEADRIGATIRAVRDLTDDLVVVDSGSTDGTQALAASLGARVIHNDWPGYGPQKRFAEDQCRHVWLLNVDADEVVPADLAAAIRAAFARGEPARPAYRIAIAEIFPGEGRPHPWAYRLTPVRLYRKDRGRYSPSPVHDRVDLAPGAAIGTLRGVIHHFSVRSLGDQLDKLNRYSDQQADDLAARGVAIPTWRLFVELPGNFLKAYLGRRHFVRGTYGFLTAMNYAISRHLRVAKHYERRRADSRANPESRLDRPDAKF

SEQ ID NO: 2231 - protein, 580 aa, Selenomonas bovis
MRRQRVPAVISGTRRGALSTISGRAARRSASRGRRLQGARNGRCRRIRHGARRRSMEQKRKVIRVSACVIVKNEAENLPRWLAGMRQVADEMIVVDTGSTDDTAAIAAAAGARVVSFPWRDDFAAAKNFALDQARGRWIIFPDADEYFTEASLERIPQLLRQGDRDNSVGGYLCRLVNIDKDDGGRVSSVTTQVRIFRHLRQLRYQGSVHETLAIPRGKKLLLVPDITIHHTGYSREIVREKLQRNLALLEKNRKEHKHQDDVQEKLYYMDIYYGLQEYEKAIACAKEIIEDRKATETMRTRCYETWASACIEGHFPADEIEESLNAAIAARPEEAEFLLMKGLWLYEQQDYLQAEALLRQGLALHEDMQQIQQQRYQTGDIREVNLSLLEDNAERLLPHTWWRLGSLAELQRKGEDALACYEAGLRLQPRHARMLQAYWRLICAVGIDDVDRIQILRRLYRAEDVAWLAEQLSGLGAGRVYLYFARAAGVPLDTVAAQLAAGRADAAAEQAADCLDTACRFGLWAEASGAGGLDALLGNLPLRWQRVRSDYQAGHRTPEVHALQRLEREMQTILSRRMR

SEQ ID NO: 2232 - protein, 353 aa, Pelomonas sp.
MPAMAHVAPFSTALVVIARDEAPRIGRLLASVRPFVDTMLVLDTGSRDATPALAREAGARVEQFDWCDDFSAARNRALELAGADWHVVLDADEWLIEGGEALRELRSMTPDFIGTLQLRDSFDDAGQAREASAWLSRVLPGRVRYDGVVHEQPQHALPVRRLPLLVGHDGYRAERLADKRGRNRRLLARALQAAPNDAYLNYQWGKDCAVYDEDAAAEAGFARAAALGSPELPWWTDLVARRLFTLKRLKRHADAMDFADAQMPRCADSPDFFFAIGDLLLDLAADEPARAAELLPMIEQAWGECLALGERPGQLGAVAGRGSWLAAYNLALVLEGTGRADEAAALRAAHPAP

SEQ ID NO: 2233 - protein, 513 aa, Cellulomonas marina
MATRARLSIAAVLIVKDEEDVLRPCLESVGWADEVVVYDTGSTDATVEVARACGARVVEGYWDDDFGAARNRALEHVTADWVLSIDADEVFEGDPHQLRRRLGAGGAPVHSVLQVSTAAPGEHPVGASVIRVHRRGDVHWVGELHEQLVLDGGGPLLVRALPDVVLRHSGYDTDRFAERDKARRNAEIAENDLEAARAEGRPAVEVATREANLARSWVLVGRAQEALDLAERLVAEGHMTRRTTTTLARAMVGAADEASRPDLRERWLERWEETGSNPAEPWAVRATLAAAAGDAPATLEALEHVPTTSVDEDLVRLDRRSLAAAEVWALATVGKTARARRVAVDAAARGFAPGPPMVLLALLGEEALAEVAGAMPAPLWPPFVARCLTEPGTQALRVLDVLVAVRPDSGAALLAASRLHPVMDLEETARWAARLRGAGLEQDCTLVAVACDEAREPRDRAIAAALAYDVWRDVRGADALEDVLELVAPHEEDALLSELSVVAPGLVSRAASA

SEQ ID NO: 2234 - protein, 262 aa, Ahrensia sp.
MLLVATMQIFLPAISCTIIAFNEADRIAQTLSAAGKVCDEIVVVDSGSTDGTQTICESLGARVVHNDWPGYGPQKRFAEDQAAHDWILNLDADEVPTQELLDEIATWKRTVPQLSGYRFRQTTVYPGRAKPRPFADHHTYVRLYDRRVMRFRNSLVHDVVDSDGHEIGRFEGDCLHWSWRSLDHLARKLDGYTTLQAKEIRRPAWKLWLRRPIEYPVLLFRYALLKRHITGGLYGIRAAHTIAKGRAARIPKILAAQANERV

SEQ ID NO: 2235 - protein, 271 aa, Unknown
  Description of Unknown: Microgenomates group bacterium GW2011_GWA1_46_15 sequence
MPTISAVIIAKNEEKMIANCLDTLQWCDECIVIDNGSTDSTPMLAEQAGAHVIELKNAGFAEARTKGKDEAKSDWILYIDADERVTPKLKSEVQRVISSPGYQAYSVPRNNIHYGKWMQYGGWEKDRVVRLFQKKHLSAWEGKVHEHAIVDGVTGELREPLVHLTHRNMKEGLEKSIVWTDIEAHLFLAAGHPNMTTLRLIKVTLWEFFSRVFKKKAYKDGTEGMIEAMVQAMNRFLVYERVWELQRKPSLDETYQKIEKEIASLWRKQNG

SEQ ID NO: 2236 - protein, 263 aa, Asticcacaulis sp.
MEPPRLTPLSCCIIARNEGDRIGDVIRAVSGLVDEVVVVDSGSTDNTVAVAEGLGARVIHHDWPGYGPQKRFSEDCAAYDWILNLDADEIMTPELCAEIRALIASRPRLNAYRFRIMNVYPGRSAPRLWADFHNYVRLYDRRVVRFRESPVHDTVDTRNEPVGQLKGTVTHFSSRSFDHIRQKFEAYNTLQSKVLKKPSWQLWARLPLEYPLGFLRYYIFRRHFTGGIDGVRVSHIAAEARFKRILKFLDAKRNRQATNGPPA

SEQ ID NO: 2237 - protein, 262 aa, Aidingimonas halophila
MVNITGVVITLNEADNIMACLQSLSHVCDELIVVDSGSNDETCKLAERAGARVIRQPYLGDGPQKNVGPTHATHRWILSLDADERLTEEAIHCITALDLSTTTHDGFALRRRNYLGSRWIKACGWYPDYCIRLFDRDRTGFSDSQQHASVQARHPARLDADLQHFSFADLGELFTKASGRFSKRAAKIMYRRGKRANGWSPFLHGSSAFLRKFVFQKGFTAGLDGLSVSLSAAVNSYLKYAKLLEFQRDSRIRDNEDFDKIW

SEQ ID NO: 2238 - protein, 363 aa, Unknown
  Description of Unknown: Aquabacterium sp. sequence
MSARLALVMIARDEARCIERCLRSAAPWVDEMLVVDTGSKDATPALAAAAGARVLHFDWVDDFSAARNFALSQTGADWRLVLDADEWLEGGMRELQELLASSSAGFVGQVEVRSDFDDAGQVRQASSWISRLLPRGVHYAGRVHEQPVHRLPVQRLALRIGHDGYRSARQQAKGDRNERLLQAALRERPDHPYLLYQLGKEAEIRDDFHAAATRFKRAHAVLRGADALVGARINGTAAERPEREPGWLHDLVVRLIFSLKRDGEHAQAVQLAEREMAHWAQSPDFYFALGDLLLDWAASQPQRAGELLPMIEAAWLRCLEIGERPELEGAVAGRGSTLAAHNLALLYDSLGQGDKASAYRRMT

SEQ ID NO: 2239 - protein, 268 aa, Lysobacter sp.
MDTPRAAANPVPPLSACIIAFNEADRIGDCLASLAFCDEIVVVDSYSTDATVEIARAAGARVLQRPFDGFRSQKQYAIEQAAHDWVLCLDADERVDERLRTAIEAERERAFDGAAGYRFARLSEYFGRFLRHGNAYPDRVLRLFDRRRGGWRGQREVHEAASVDGAVRTLPGDLIHYPYRSLEQQLAKTERYARMMAEHDYARGKRATLAKLVLAPAWRFWRGYLLRGGFLDGWHGLVYAYVRANYVRQKTVMLWMLQNGQRVTTSDS

SEQ ID NO: 2240 - protein, 262 aa, Unknown
  Description of Unknown: Rhizobiales bacterium sequence
MPPLSIFIIARDEADRIGRTIAAVRELSDDIVVIDSGSTDGTQTIAEQCGARVIFNAWPGYGQQKRFGEDQCRYNWLLNLDADEVVPREMAVEIAALFAHGDPPADAYRTRIAEIFPGERAPHRFTYALSPVRLYRKDKGRYSPSPVHDRVDLSPDARIGRLKGTVHHYSVRSLGEQMAKLNNYSDAQADDLDKRGETLSVFRLVAEFPANFVKAYIGRRHALRGVYGFMTAMNYAFYRYLRAAKHWERRLKRHSDKDARNG

SEQ ID NO: 2241 - protein, 302 aa, Unknown
  Description of Unknown: Planctomycetaceae bacterium sequence
MNTSGNPAAADFYAGRSLVGRCADPSSLGQTDRLSACTRPITAVIITLNGATHLGRVLESVGLCSERLVLDSGSTDGTVALACAAGARVEQQAFLGYGLQKQHAVQLATHDWILSLDDDEVLDPEASDAICRLDLSDPLACWSIRRRTFIGAREMRHGPWKNDCVLRLFNRQTAAFKPLMVHEQVQPQRPPQLLPGSVAHYSYDNCCDLLARALRYAPLKAGLMHAKRQRVHTWMLPLRGLATFVRCYYLQGGWRDGAAGFTVALSRVIDATLPRTMLLLGEADEATKSSADQRHEKHASRK

SEQ ID NO: 2242 - protein, 255 aa, Unknown
  Description of Unknown: Candidatus Amesbacteria bacterium GW2011_GWA1_47_16 sequence
MFSVAIIAKNAADVIGSCIESVSPLTTDIVVVVDSSSSDTTSAVAEKSGARVFHRQFDDFASQKNYAVSLTKFKWVLSLDADETASEELIKEIKSAVPGTRFAAFAFPRINYIFGKSIYHTNWSPASDKHVWLFDKTRSHWENAVHERVSVDGPVGSLSAPKYHFHYRTVEEFLHKTNQYTTLDISSGSQSRFSSLIRPHWLRLILQPKWKFFRHYFLFAGFLDGWHGLFLSYLMAVYGACLAVKSWQKQNPHTS

SEQ ID NO: 2243 - protein, 263 aa, Hirschia maritima
MSKLPISVFIIAKDEEDRIVPVIHSVIDWVHEVIVIDSGSSDNTVKVSEAAGAKTVFNEWNGYGPQKVYGETLCSQKWLLNIDADEEVSGQLRSELESMFAEGKEPSLAGYQIPILICFPFDKGPRPFAPSNDPVRLYHRDKAGFKPELVHDSVVLNQGESSGKLKHHINHRCFRSHHHALEKINRYSSMQAEDMLSKGRKPSVLRLLTEPITAFLKSMILRRYGLFGVNGFVESCIYSFARFIRLAKAREEWAKHEAEKRKT

SEQ ID NO: 2244 - protein, 255 aa, Unknown
  Description of Unknown: Bacteroidetes bacterium UKL13-3 sequence
MAEVQLSVVIITYNEQRNIGKCIDAIKSIADDIVVIDSFSKDDTLIIAKEKGARVIQHLFQGHIEQKNFAITQAKFPHILSLDADEMPDEIFLTQIKQIKQDWQCDGYSVNRLNNYCGKWIYHGAWYPDVKLRLWDSRKGKWSGTNPHDRYQMTEGSAIKHLPGKILHYSYQSIDEHKKKSDYFSSIAANAYLAKGKKSSWFKIIMSPIFRFTRDYIFKKGFLDGKYGWIIATITANEVAMKYKKLYSLQCTTTG

SEQ ID NO: 2245 - protein, 260 aa, Pseudoxanthomonas suwonensis
MPLSACIIAFNEADRIGDCLASLAFCDEIVVVDSGSTDGTREVARAAGARVLERPFDGFRSQKQFAVNQCAHDWVLSLDADERVDARLRAAIEAERDAGFARAAGYRFARMSEYYGRFLRHGTAYPDRVLRLFDRRRGGWRGDREIHEAVSVDGPVALLPGDLLHHPYRSFMQLLDKKQRYARMMAEHDFARGKRATLGKLVLAPAWRFFRGYVLKAGFLDGWPGLVESFVSANYVRQKTIMLWLLQNGQPLVDPPRHGK

SEQ ID NO: 2246 - protein, 255 aa, Acidithiobacillus caldus
MNKVKLSAVYITKDAGAYFRASLASVVDLVEDIVVVDSGSRDDTLTLAEAAGARIYQRPWPGFGAQRQYAVEQAKTDWVLVIDGDEVLRPEGGARIRALLERPLDAAAYALRRRSYIGRRAIRHGDWGEDWVLRLLDRRRGHYDAGDLVHESWRCAAPGQRLPGLHLDHYTFASYADMLTKLARYGRLNAEQLYRRGRPIGSRMAMNHAVAAFLRSYVLRLGFLDGVDGAAIAWTTALGSFMKYAIAYEMQREQP

SEQ ID NO: 2247 - protein, 265 aa, Unknown
  Description of Unknown: Methylobacterium sp. 17Sr1-43 sequence
MADLAPLPLSVFIIAQNEADRIGAVIRAVRALSDDIVVVDSGSTDGTQALAESLSARVIHNPWPGYGPQKRFAEEQCRHPWLLNLDADEVVPDDLSAEIRALFAMGEPARPAWRLAIAEIFPGETRPHRWAYTLTPVRLYRLDAGRYSPSPVHDRVELRAGIEPGLLRGRVHHFSVRSLGDQLAKLNRYSDQQADDLEARGVTIPAWRVFVELPGNFLKAYLGRRHFARGTYGFLTAMNYAISRHLRVAKHYERRRRASAPGSPR

SEQ ID NO: 2248 - protein, 264 aa, Microvirga vignae
MVPISVFIIAKDEADRIGATIQAVRDLTDDLIVIDSGSTDGTQAVAEELGARVIFNPWSGYGPQKRFGEDQCRHEWLLNLDADEELSPALHEEVKALFAHGEPPCQAYGVRIAETYPGEAEPHLFAYRIGPVRLYRRDAGRYSSSLVHDRVDLKPGTKVGKLKGLVHHRSIRSLGDQIAKLNAYTDQLAIDLEVRGVSIPIWRVYAEFPAAFIKAYFGRLHFLRGTYGFLIAMNYAIWRHLRLAKHYERKRLNAQAKANKVEPA

SEQ ID NO: 2249 - protein, 324 aa, Unknown
  Description of Unknown: Mycobacterium tuberculosis H37Rv sequence
MTASELVAGDLAGGRAPGALPLDTTWHRPGWTIGELEAAKAGRTISVVLPALNEEATIESVIDSISPLVDGLVDELIVLDSGSTDDTEIRAIASGARVVSREQALPEVPVRPGKGEALWRSLAATSGDIVVFIDSDLINPHPLFVPWLVGPLLTGEGIQLVKSFYRRPLQVSDVTSGVCATGGGRVTELVARPLLAALRPELGCVLQPLSGEYAASRELLTSLPFAPGYGVEIGLLIDTFDRLGLDAIAQVNLGVRAHRNRPLDELGAMSRQVIATLLSRCGIPDSGVGLTQFLPGGPDDSDYTRHTWPVSLVDRPPMKVMRPR

SEQ ID NO: 2250 - protein, 262 aa, Salinicola sp.
MAAITGVVITLDEADNIEACLASLARVCDELIVVDSGSRDDTVIRAEALGARVIHQPYLGDGPQKRVGPQAASYRWVLSLDADERLTDEAVAAILALDLDDAGHDAYALRRRNFIGSRWIRHCGWYPDYCIRLFDRDRTGFSDSHQHASVPATNPQRLDADLEHYSFANLAELFGKASGRFSNRAAKIMYLKGKRANGWSPALHGANAFVRKYLFQRGFAGGLDGVSVALSAAVNAYLKYAKLLELQRDAKVRDAEDFDRIW

SEQ ID NO: 2251 - protein, 250 aa, Geobacter lovleyi
MPISATIITLNEGDNIADCLAALDFVDEIIVLDSGSSDQTEELCRACPKVRFYHQEWLGYGRQKNRAAELARHDLILNVDADERVSPQLRRSIEQFDSSSFAAARMARENYFGRRWIRHCGWYPDYSSRLYDRRRCSFSERAVHESLQTAGAVATLAGNLVHYTYNGVGDYLERMNRYSTLAAEEYHRAGKTAGLLRMLVKPVATFIKMYLLRRGFLDGRTGLVLSLLYAVYTFCKYAKLSELNAEEHRK

SEQ ID NO: 2252 - protein, 259 aa, Unknown
  Description of Unknown: Xanthomonadaceae bacterium NML08-0793 sequence
MTYSTAMPTPPQKLPLSAVVITRNEADRIGRCVSSLLPVCAEVIVLDSGSSDDTVAIARALGARVEHRDWDGFARQKNAAIALASQPWVILLDADEWLEPAAQQALHALFAGEIESADVWLLQRRTHWLGKPMQFGSFSREPIERLFRQHLRHADVPVHEYLDTQGHVVKPSRIRLEHDTARNTQEYREKLTRYAALWAKAHAGRRGGAIRGLLAALAYAVKNLILRGGILDGASGLAFHREHMRYSALKYRLLAEQER

SEQ ID NO: 2253 - protein, 262 aa, Salinicola sp.
MAAITGVVITLDEADNIEACLDSLARVCEELIVVDSGSTDATVARAEARGARIIHQPYLGDGPQKRVGPVAATHRWVLSLDADERLTDGAVAAIAALDLETTPNDAFALRRRNFIGSRWVRHCGWYPDYCLRLFDRERCNFSESRQHASIPASQPARLDADLEHYSFANLGELFGKASGRFSNRAAKIMYAKGKRANAASPALHGANAFVRKYLFQRGFVGGLDGMSVALSAGVNAYLKYAKLLELQRDAKVREATDFDKVW

SEQ ID NO: 2254 - protein, 256 aa, Yokenella regensburgei
MSRRLSVVMIAKNSADLLPECLDSVQWADEIILLDSGSNDDTVALAQSRGVKVFEDRDWQGYGIQRQRAQAYATGDYVLMIDTDERVTPELKTSLQQTLTAPQPGAVYSIARRNYFLGRFMRHSGWYPDRVLRLYERERWQYNDKLVHESLECGKAQVIPLQGDLRHLTCRDFGAFQQKQLAYATAWAQERHQKGKKTSLAGIFGHTLGAFVKTLLIRGGILDGAQGWLLAVVNAQYTFNKYTELWALNRGYSEKA

SEQ ID NO: 2255 - protein, 291 aa, Unknown
  Description of Unknown: Gemmatimonadetes bacterium sequence
MPCSRRGPAAQPAILSGGSTVSTAWSSALKLFIVKRWSVAGPGEERVLAPITIVIPTRNEADQIAACIGHLDWTADIVVVDGGSTDDTVALARAAGARVVTDGPRGIGEQRNSGIAVARHGWVFALDADERIGPALAKELITVSAHATHEAYRVKRRNAFHGRVVRRGHWGNDWVVRFARREFRYGGSPVHPGLQGLRDVGTLTEQLDHTPYRDLSHHVEKLVAYAQTSARALAARGRRARWSDIALRPAAHFWREYLLRGGFLDGRMGVIQAAMGAIGGFLKYAFLWEQE

SEQ ID NO: 2256 - protein, 281 aa, Marinobacter mobilis
MTLPVSVYCITKNEEVRLGATLSRVVDWADEVIVVDSGSCDGTEAVACHYGARFVHHDWQGFAVQKAYAASLCRNDWVLDLDADEVLSDELVSNLKALFEQEPDPDFAGFRMRWVLSQPVPGHPFRHDKSKRILRLYHRERARIEAVPGSNDDRPRVLSGRVGFVPGDVLHQPVITLEQMERKYLQLSNEQAHFLAEKGRRITSARLFVEFPLKFFKYYLLHRQILNGWYGLSVSIVAANRNFMRLAKAKELQMLTRLGEGHGESQSGVAPVDSDRPPRQR

SEQ ID NO: 2257 - protein, 490 aa, Sulfobacillus thermosulfidooxidans
MEKTTLQQYEVTTAELLRAGRWSAAQARAVEGLMHFPAGAQLWVYLGESLEHLGQRGPARTAYDRAWMLDPAAAWVPATWARLQHVAPTVPDWLERVLAVPAVTVTAALIARDEEDTIGTAVARLIPAVDEVLVVDTGSTDATVARAREAGARVVAYEWTDDFSAARNFGLEQVRTDWVLWVDADEWLFPEDVAVPRVVAGLFHAADPPPILRIVQMNRIGSVVDPNYDSSRMFRVGQGFRWVGRIHEQIAPPSAGASLIPWPRPVVRIRVDHAGYDPAVVQRKGKWDRNIRLLRQAVAEAPHDVVPLGFLGRDLFLAGHTEEAVEVLRQAETLAVATPGYGRLAELRQVLAEALWRLGRLDEALAVTERQTTDAPTFPGGWYLRAQLQLAQAVTLLDAAAEGFQTALQHAPTYRGVVSFDSQIATWKALVGLADVAKLKGRWDEALRLYEQARTVVPDNAAISQQIRYLQTQAAWVHDHVTSQRLGTAR

SEQ ID NO: 2258 - protein, 262 aa, Unknown
  Description of Unknown: uncultured bacterium sequence
MPQKISQKLPLSVFIIAQDEEDRIPACIKSVVDWVSEVIVVDSGSQDQTVSVSKSLGARVIEKDWPGYGPQKRFAEEQCRNKWVLNLDADESISPELALEIQKVFHTLPPKNKAFKLKIKDVYPHQKKPGFWPYTYQVVRLYHLDQGRYSKSPIHDRILLKNGTEYITLKGDVYHKSIRSLSHLIEKANVYTNLQATVFINQGKKVSLFRLAFEFPLSFLIGYFTRGNILRGRYGLILAYHYAYIRFMRLAKLWEKQVIINE

SEQ ID NO: 2259 - protein, 271 aa, Unknown
  Description of Unknown: Bosea sequence
MPPLSIFIIALNEADRIGHTITAARSLSDDIVVVDSGSTDGTQAVAEALGARVIFNPWPGYGRQKRFAEDQCRHDWLLNLDADEVLPPDLAAEIAALFQAGMPPADAYKTRIAEIFPGEKAPHRFAYALAPVRLYRKSKGRYSLSPVHDRVDLEPDARVGKLKGTIHHFSVRSLGEQMEKLNAYSDAQADDLDARGETISVFRLLAEFPANFIKAYIGRRHALRGLYGFMTAMNFAFYRYLRAAKHWERRLQRDAGITPPGASAGKRANDD

SEQ ID NO: 2260 - protein, 287 aa, Enterovirga rhinocerotis
MTYRSNRDGPDDTSAARQPLSVFFIARNEADRIGAAIRAARDLTDDLIVVDSGSTDATVAIAEGLGARVVHRDWEGYGPQKRFAEELCRHDWMLNLDADEIVTPELRAEIRSLFARGEPEEDGYRIGIAEVFPGEERPHRFAYTLHPVRLYRRSRGRYSASPVHDRVDMAEGARIGSLRAILHHFSVRSLADQLAKLDRYSDQQADDLAARGIVIPTWRILFEFQASFWKAYIIRRHFLRGTYGFLTAANYAIARHMRVAKHYERSRGLTRGPLSDATSVDPPQAKP

SEQ ID NO: 2261 - protein, 263 aa, Microvirga subterranea
MLPVSVFIIAKNEADRIGETIRAVRDLTDDLIVVDSGSTDGTQAVAEELGARVIFNPWPGYGPQKRFAEEQCRYPWLLNLDADEVVPPKLLAEIRALFAKGEPPCQAYRIGIAEIFPGEAAPHPLAYTLTPVRLYRLDHGRYSPSLVHDRVDLEPGTKVGKLKGVIHHWSVRSLGDQLAKLNRYSDQQAVDLEIRGVSIPTWRVFFELPAAFIKAYIGRRHALRGTYGFLTAMNYAISRHLRLAKHYEKRRLKVLGKSPSQTG

SEQ ID NO: 2262 - protein, 249 aa, Geobacter sp.
MADKISCIVIARDEEARIGDCLDSVRWADEIVVVDSGSSDNTVAIAKGFTDRVHVIPWQGFGPQKQAAVELAAHDLIFSIDCDERVTPELAAELRELAEAGDRLPGYTVPRRTFVGKNEIRHCGWYPDRTIRLFDRRRARFSDSPVHERVIVSGTVGDCCHHLLHYSFAGFRDMLAKMNHYTDLAAEQMHAAGRFAGYADITVRPLYMFIRTYLFQLGFLDGFAGYLVSVSNAVSVFAKYAKLMERNRK

SEQ ID NO: 2263 - protein, 295 aa, Yoonia litorea
MTTITVIILTRDEALHIKRAIASVAGFASRIVVVDSGSADDTVAQARAAGAEVLEHPWRNYADQFNWALDQIAGCGGWVLRLDADEIVEPDLAGAIRAGLPDVAGLIVTRRITFQGQPVRFGGVGAVPSLRLFREGQGRCENRWMDEHIEVTGRVAALHGSICDDNRKGLDWWMAKHVGYANREVVDLMARASEGSGLSGRPAVVRWIKQHFYRKLPSGWRAGVYFVYRYVLRGGFLDRAEARHFHVLQGFWYRYLVDTKMAEVVRYMKETGAPRRRAIREVLGIDIGSDREARP

SEQ ID NO: 2264 - protein, 260 aa, Unknown
  Description of Unknown: Methylobacterium sp. Leaf456 sequence
MSALPISVFIIARNEADRIGATIRAVRDLTDDLVVVDSGSTDGTQALAESLGARVIHNDWPGYGPQKRFAEEQCRHPWVLNLDADEVVPPDLADAIRAVFAAGEPAHAAWRIDIAEIFPGETRPHPWAYVLSPVRLYRWDRSRYSPSPVHDRVELGADVTAGCLKGRIHHFSVRSLGDQLDKLNRYSDQQADDLDARGVTIPAWRVFVELPGNFLKAYFGRRHFVRGVYGFLTAMNYAISRHLRVAKHYERRITSPRQPG

SEQ ID NO: 2265 - protein, 363 aa, Butyrivibrio sp.
MCDFLWVKAENTRRNLECIGGVTVATISLCMIVKNEESCLGKCLDSLKGIVDEMIVVDTGSTDNTIQIAKERGAKVYNFKWTGDFSDARNYSFSLASCDYIYTADADEELDEENRQRFLKLKEDIVELDVDIVQMYYSNQLSFRTVYNFDKELRPKLYKRIRKFRWVDPIHEQVALDPVVCDSDIEIIHKPKENHAGRDLAAFRKAVNDGRKFSRRLLGMYARELFMAGEDDDFIQAKDFFVQATLDNNRSLDEIKEASCVLAHIAVLEKDAESMLKYTLKDAITEMSSEMCYELGDYYYGKRDLDEAIVWYFNAAYECSSILDIKKSMELPRLAIAKCYRELGNEEQAADYEREAADVANME

SEQ ID NO: 2266 - protein, 276 aa, Microvirga pakistanensis
MSISVLILTYNEENILPECLESVSWSDDIVVLDSFSTDRTVEIAKAAGARVYQRVYDNEDSQHTYGLKEIPFKHPWVYIPDADEITTPELRDEMLAIAAAPDRPEAAFRVRFKVMFMGRWIRNSSLYPTWVVRLVRPEKAHFVREINSRCVIDGPEGRLRSHFLHYTFNKGLTAWYEKHNRYSWHEARESLKGLRDGFDWKDLISLKPEIRRRGMKELSFRLPFRPMLRFLYMYFFRLGILDGWAGYVYCRLLTTYESMIVFKIAEIRRREKGLSV

SEQ ID NO: 2267 - protein, 257 aa, Lysobacter silvestris
MNEAAGAKPPVTGVVIAKNEGDRIGRCVASLVPLCREVIVMDSQSDDDTVAAAAAAGARVVQQPWLGFAAQKNAVIALATTPWVLLLDSDEWLAAGTADAIRTVFADDHVERADVWKLLRRTHYLGTALDHGGWGKEKVERLFRNDLRYKPASVHEALDTAGKRVATLQARIEHDTARSDDEYASKLQRYATLWAQQRHAQGRRASAIDAPLHAGTYWLKNYVLRGGFLDGGTSARYHALHARYVFDKYRKLRGLAR

SEQ ID NO: 2268 - protein, 497 aa, Unknown
  Description of Unknown: bacterium sequence
MMPLNPRSPGPIPGLDVHASIRNRESCAPMKRKTVSLCLIARDEEATIGAAIKSVLALVDEVIVVDTGSRDNTRIIAEGYGARVLEVPWNDDFAAARNAGLGEAVCDWVLVLDADECLQPCRPVEFQRYLHDPQVAGYRVRIVSPREESGPDGRRQVRLFRNSPEARYEFPVHEQITPALEAWARSTGLVIQDTPLVVIHDGESPERRTRRRERNLRLLNQALETHGQEPYFPYRLACETMLRLDGEVLPVGGLDEALGYLQRSWRLLSPKDDEELRCLHWLPDLGTRIASGMLAMGEVPAARSTLGTLRGLVPGHPLVLLHGVAADIRYLAERTNDLTSDDASRIIAAARADLERLRSGEPVPPQDTIDGRVRDLYPLRYFGELALLEGRVTEASERFEQALEWDPNYSFAWLGLAECSRFAGDRKRAMKLYLRAVTESEWNHRAWFRGAALMADMGFHDNAASWLRTACARFPEHPRARRERLEALDHGEIPAHV

SEQ ID NO: 2269 - protein, 268 aa, Tepidamorphus gemmatus
MTSPVPVSCFIIAKNEADRIGPVIESVVGWVDEVVVIDSGSTDGTIDIARGLGARVVHNDWPGYGPQKRFGEDQCRNDWVLNLDADEVPTDELCREMIALFDHGRPPAPFYRFRIKLVYPGDTRPRLWADYHNYIRLYDRRAGRFSDSPVHDTVQTSGGRTVQLRGVAYHFSYRSFSYLVEKLNSYGDLQAKTIRKQAPTLLALRLPFEFPVAFTKYYLLRRHFTGGRKGFTFAMINAFFRFLRVVKLLEAAGSPPRSPTNSSDSPAS

SEQ ID NO: 2270 - protein, 337 aa, Unknown
  Description of Unknown: Chloroflexi bacterium sequence
MRAGGACGASGRAKHRAGAPGKRASSVDKPAASLSQASSAMESCAGPADDWGRDEAAGANARPRSGPCGCLPDNCDGGAETMKLFAVILTYNERENITACIETVRFADRIIVLDSYSQDDTAVLALEAGAELIERPFDNYASQRNAALAAVRGRADWVLFVDADERVTPALEDEILRAIEQPGYAGWRIPRLNYIFGRLTRGAGWYPDYQTRLLRVGRARYDETRAVHELVVLDGQEGTLTKPFLHYNYKTVAQFHAKQERYARLEAQTMFEKGIVPKPRNFVLQPLRQFWWRFITLGGIREGFHGLRLCTYLAWYEYRKYVMLRALWQQQVSDRVR

SEQ ID NO: 2271 - protein, 303 aa, Hyphomicrobium sp.
MSRLPISCFIISKDESDRIVRTIRSVKSWVDEVVVVDSESRDNTVALALAEGCRVITQPWLGFGPQKRFAEDQCRNDWVLNLDADEVVTPELRDEIIGMFSAGRPAQIAYAMALDLVYPGDQRPRRWARDHWYVRLYDRQVVRFRNSHVHDTVVMGGHAVGSLRHSVYHYSYRSYDDLKQKLGERMLLSAKHAQNSSQVMLFARLLLEMPINFFKYYIVRRHFTGGFKGLRYAWIQGTYRQVKIVHMWRARCEKSASAATVPCNGNTGLEARADIQGAMVSPRTDFGLYPKTPPAGEIYAERA

SEQ ID NO: 2272 - protein, 255 aa, Phycisphaera sp.
MRLSVAIVCKDSASTIGRTLDSVSDLADEIVAVDSGSTDATLDMLREADARIIESDWLGYVKTKQLALDSCEGDWILALDSDESLLPELIEGIKAALESPGEHTGFEVNRKVFIHGKALDHAWQPEHRLRLVKGGHYHWQGLDPHDHLAPIDPGEPISRLNGDLRHDSISTWPEFLEKQHRHAETMARSMLAEGRKPSRFKLLTSPAAALLKQLILRQAFLDGADGFRAAFATAKAAKLKHKALFRLSKGPSNPS

SEQ ID NO: 2273 - protein, 266 aa, Microvirga pakistanensis
MLPLSVFIIAKNEADRIGTTIRAVRELTDDLVVIDSGSTDGTQAIAEGLGARVIFNPWPGYGQQKRFGEDQCRHEWLLNLDADEELSPALREEIRALFAQGEPSCQAYGIRIAETYPGEAAPHPFAYRLAPVRLYRRDVGRYSPSLVHDRVDLKPGTKIGKLKGLVHHRSIRSLGDQIAKLNVYTDQLALDLEVRGVSIPTWRVYFEFPAAFIKAYFGRLHFLRGTYGFLIAMNYAIWRHLRLAKHYEKKRLNGKAKTKANSAEQA

SEQ ID NO: 2274 - protein, 280 aa, Leptospira bouyouniensis
MSSIPLSCAIITLNEADNLSRTLKAISFIDDVVVVDSGSTDETVEIAKSMGARVYYHKFDNYADQKNFAIAKTKYDWVFAIDADEVVSPKLKEEILKLFSNQDIKTKGFLVPRLTFYLGKWIRFGGYYPNYQIRLFHKAEGQFSGGLVHERVKLNGRPLKLKNPLFHYSYKNISDHLKFIDRYSSLFAEEEFRNGKRSSIFWAFMKGCFKGFYMYWIRLGILDGKQGFVLALLGFYYNFLKYLKLYEKTNSVPSFFVMVDAIHDVKGKKTTKKNSDQIHV

SEQ ID NO: 2275 - protein, 274 aa, Chelatococcus sp.
MQRVPPLSIFIIARDEADRIGRTIEAVKGLSDDILVVDSGSTDGTQEVAAKLGARVVHNPWPGYGQQKRFAEELCRHRWMLNLDADEVVPPGLAAEIAALFTGQGPEADAYELRIAELFPGEAAPHRFAYALAPVRLYRRDKGRYSPSPVHDRVDLLPGARVARLKGTVHHYSVRSLGEQIEKLNAYSDAQADDLDARGLSVSVFRLVAEFPANFVKAYIGRRHALRGIYGFMTAMNFAFYRYLRVAKHWERRLQRAGASRQPAAQQGSDGRNG

SEQ ID NO: 2276 - protein, 250 aa, Unknown
  Description of Unknown: Xanthomonadaceae bacterium sequence
MTGPLPLSGVVIAKNEADRIGRCLQSMRPVCSEMLVLDCGSDDDTVAVARAAGARVEHQDWLGFAGQKNEAISRATQPWLLLLDADEWLADGAEARLRELFASGRVEQADVWRLVRRNWFLGSRLRGDERPERLVRPDHRYLPMKVHERPDLAGKRVLDCDVVIEHNTARSLEQHRRKNSRYAQLWAEQKFEEGKRCSALAPWTHVAAYWLKAYLLKGAWREGRNGWHFHASHARAVIEKYQRLHALGKT

SEQ ID NO: 2277 - protein, 259 aa, Unknown
  Description of Unknown: Acidobacteria bacterium sequence
MKITATIITFNEADNIRAACESVAWADEILVVDSGSTDATREIAQACGARVIERAWPGFAAQKQFAADEAQHDWIFSLDADERVSIELRASIEDLLYTNEAQLADGYAMARRAFYMGRWIRGGGWYPDWQLRLYRRSRGRWEGAYIHESVKLAPDARKEILQGDILHYTVSDAAHHHRMIGERYAPLAARKMFEQGRRTTPWQIATVGPATFIRNFILKGGWRDGLAGFSIATFAAHHVFLKYLMLWELQNSKIVTSDK

SEQ ID NO: 2278 - protein, 264 aa, Roseibium sp.
MSKRLPVSAFLIAKDEADRIGRAIDSVVDWVDEVIVIDSGSQDDTVKIAEAHGARVVFNAWPGYGPQKRFGEDQCCNDWLLNLDADEEITPDLRTEIEALFETNRHEEAGSWRIMIRDVFAHENEPAAWAYGYHQIRLYDRRQGRFSPSSVHDTVRPDKDTVIRELSGIMAHRSIRSLDFQVGKYNRYSNMQVADLRERGRQLPRWRLLGEFPIAFFKAYFVRKYMRYGWWGFILSINYAHARFLRVAKDYEATLLERSPKAGS

SEQ ID NO: 2279 - protein, 461 aa, Unknown
  Description of Unknown: Acidobacteria bacterium sequence
MGRPLLSACLIVRDEEERLGRCLTSLRPVADELVVADTGSADRSREIARRHGARVVDIAWRDDFAAARNECLERARGAWILVVDADEVLENPDRAALEGLLAASDAPGFTVEIVSARDGGDEEIAHVARLFRNLPSHRYRGRVHEQILPALAASAGRPDWTPPRSGLRLRHEGYLAEVRERRNKLERNRRLLREEIARRPHDPGPRYFLARELAPHIGGDLLDMPPADEAWEAVRPAVEAVLSGPPCGLTDPLGALGVRLAVVRGEDELARRWSEMLGKRVGRSARWCYAEGERLLTIGAMGDREAAETAAGWFAAAAHAPEGSPAVITPRRLRTCWAPVRRDLARCLAGRDRPAQTATGEGVEPLLARAWAEAASGRSAAAVRLLADGVRRDRGDPRLWLALAVALRVDGETRRACRAARAALAAAPGWRAAEEWLAGRPAPFRGLLAPWSLAARESARA

SEQ ID NO: 2280 - protein, 258 aa, Pannonibacter phragmitetus
MSDVPAPISVLIRCFNEGDRIGRTLQSVQGLGREIVVIDSGSTDDTVAVCESFGARVISNPWAGFGPQRSFGEKQCGNDWVFYIDADEVVTPALRQEIAGLFRNGEPQHACYLVRNTMVLPGDERPRPFADYRKVPRLYNLKHARIRLEPSYDRMDVDEGFTTGILKGRQHHFSFRTWGHAIAKLNYTSDLAAATQKKKNGLLLRLRLVTEFPVEMLKYLIMRRFIFAGWKGYAFATIQSFGRFVRILKMLDKQRSSN

SEQ ID NO: 2281 - protein, 269 aa, Bosea sp.
MPRLSIFIIARDESDRIARTIEAVRTLSDDILVIDSGSTDGTQAIAEALGARVIFNPWPGYGQQKRFAEEQCRHDWLLNLDADEVVPADLAAEIASLFASGVPAADAYQLRIAEIFPGERAPHRFAYALAPVRLYRKDKGRYSPSPVHDRVDLVSDARIARLRGTVHHYSVRSLGEQMAKLNSYSDAQADDLDKRGVSLSVFRLVVEFPANFIKAYIGRRHALRGVYGFMTAMNYAFYRYLRVAKHWERRLQRRSAASASPPQRESHDV

SEQ ID NO: 2282 - protein, 274 aa, Unknown
  Description of Unknown: Methylobacterium mesophilicum sequence
MSAGPASPLPVSVFIIAHNEVDRLGATIQAVRDLTDDLVVIDSGSTDGTQALAASLGARVIHNPWPGYGPQKRFAEDQCRHTWLLNLDADEVVPETLAREIRTLFASGEPRRPAWRVGIAEIFPGERRPHPLAYTLTPVRLYRKDRGRYSASPVHDRVALEPGVTPGRLKGVIHHFSVRSLGDQLDKLNRYSDQQADDLEARGVVIPDWRVFVELPGNFLKAYLGRRHFVRGTYGFLTAMNYAISRHLRVAKHVERRRLAAARRDRVDPPDPTF

SEQ ID NO: 2283 - protein, 263 aa, Pannonibacter carbonis
MPARLPLSVFIIARDEADRIADTIRSVKDWVDEVIVIDSGSVDATVAVAEAEGARVVFNAWPGYGPQKRFGEDQCRNDWLFNLDADEVVTSGLAEEIQALMGAGGHLGADGWRVMIRDVYAHEDEPASWAYGYHQIRLYDRRKGRFSASTVHDTVRPEPGARLADLKGVVAHHSIRSLTFQVEKYNRYSTMQVNDMRARSRSLPRWRLVTEFPFAFLKAYVARKYVRYGWWGLILSVNYAHARFLRVAKAYEADLVDRHKPDR

SEQ ID NO: 2284 - protein, 252 aa, Unknown
  Description of Unknown: Proteobacteria bacterium TMED72 sequence
MKAPLSICLIARDEELELARCLDSLPSADEVIVVVDSRSVDGTEQLARERASRVEVRPYTGQSDQKSHCLSLARNEWVMIMDPDEVVPAALAAEIEEKLADPDEGLGGLSVNRRTWHLGRWIMHGDFYPDWTLRVFRRSRSRWVGDDPHARIEVDGRIDRLSEDLEHYSYRDLADQVDRIQQFSAESARALSEAGRRARLRDLLFRPPARFLRAYLLRRGFMDGIPGLVIAWATAFHVFLKYAKLWERQQRG

SEQ ID NO: 2285 - protein, 255 aa, Unknown
  Description of Unknown: Rhizobiales bacterium sequence
  MOD_RES (154)..(154): Any amino acid
  MOD_RES (203)..(204): Any amino acid
  MOD_RES (228)..(228): Any amino acid
MQLSVFIIAKNEADRIGRTLEAAAKLSSDLVVIDSGSTDDTVKVAEKFGARVVLNEWPGYGPQKRFGEEQCQHDWVLNLDADEVLSDELITEIRHLFANGAPEKSGYTLNVVTVYPGHQRPRPFADFYKINRLYDRRKMRFSASRTDDRVVENXLPVGELAGPVWHHSFRKIEDIAPKMENYARQQVAEKASKRTKSGLKARXXIEYPVNLLRYLFGRRHITGGLLGXRYAHEVAKSKKKRLKIFLQALEDQNQH

SEQ ID NO: 2286 - protein, 269 aa, Kushneria sinocarnis
MTDSRQGTTPISGVVITLDEADNIEACLASLAQVCSELIVVDSGSSDATLARARAMGARVVEQPYLGDGPQKNVGPALASHRWVLSLDADERLTEQAVTAIRALALSDDGPDGYALRRRNFIGSRWVRACGWYPDYCIRLFDRDRTAFSDTRQHASVQATRTVRLDADLEHYSFADLGELFTKAGGRFSRRAAKIMYLKGRRVNAWSPWLHGSNAFMRKYLFQRGFTAGVDGLSVALSAALNAYLKYAKLLEYQRDAKVREAEDFERIW

SEQ ID NO: 2287 - protein, 255 aa, Unknown
  Description of Unknown: Acidobacteria bacterium sequence
MERGMPTVPVSAVLITRDAERWLGAVLSPLAVCNEVLILDSGSTDRTREIASACGVMWHEHPFDGYGSQKRRAVELARHDWVLSIDADEILDEEAAEAIAAIDWTSQDPKNCWAVRRRPYIGAREIRHGHWVPDPVVRLFNRRSHTFSSAPVHESVTPRGPIRCLPGAMAHHSYEDLAELFRADYHRLKAAEYLKVGRKVPGAFDLSARALWAFFYSLILKRGFLDGPAGVVVALSGAVNAVLGLALAGEGRPAG

SEQ ID NO: 2288 - protein, 273 aa, Bosea sp.
MRPRVPLLSIFIIARDEADRIERTIRAVRALSDDIVVVDSGSTDDTRDLARALGARVISNPWPGYGQQKRFAEEQCRHDWMLNLDADEVVPPDLATEIAALFSGSGPQADAYELRIAEIFPGEPAPHRFAYALAPVRLYRKDKGRYSPSPVHDRVDLAPGARIARLKGIVHHYSVRSLGEQMAKLNSYSDAQAEDLDKRDVSLSVFRLAVEFPANFIKAYIGRRHALRGVYGFMTAMNYAFYRYLRVAKHWEKRLQRRAPGATDPAARNPSDV

SEQ ID NO: 2289 - protein, 281 aa, Solimonas variicoloris
MPLPAESPPPCPPPRARRSLSVMIICCNEADRIRACLESVAGWADEIVVFDSGSRDGTVDIVRRYTDQVYVTDWPGYGPQRNRALQQCRGDWVFSLDADERVTPALRAEIDRALADPQLPYTMLKMPWRTWFFGAPLRFGRYTSPQGKLFRREGARYRDHQVHESLLMPSRVDGILKSPLDHHSWRDYRHAQEKHLQYACLLAAQKHAAGQRGSMGMATLRFFTDFLQQYVLRLCLLDGWRGFLISVILAQYAFHKYAALYTLQDRAPRRLTAGAASLPGD

SEQ ID NO: 2290 - protein, 271 aa, Unknown
  Description of Unknown: Rhizobiales bacterium sequence
MPPLSIFIIAQNEADRIGRTIEAAQTLSDDIVVVDSGSTDGTQALAEARGARVIFNAWPGYGQQKRFAEEQCRHDWLLNLDADEVVPPDLAAEIAALFANGPPPKDAYKLRIAEIFPGEGAPHRFAYALAPVRLYRRSKGRYSASPVHDRVDLAPDAQVGRLRGTVHHFSVRSLGEQMDKLNAYSDAQADDLDARGGTLSVFRLVAEFPANFLKAYIGRRHALRGIYGFMTAMNYAFYRYLRVAKHWERRLQRRASAQAAPPPANHDGRDG

SEQ ID NO: 2291 - protein, 266 aa, Blastochloris sp.
MSEAMPAAIPVSIFLIACNEADRLGRTLQAVQGLTDDIVLVDSGSTDDTPRIAESFGARVVHNPWPGYGPQKRFAESLCRHRWVLNIDADEVMPPDLVAELRALFAGGEPPCDAYEIAIAEVFPVETAPHPWAYSLAPVRLYRTDRGRYSDSPVHDRVVLAEGARVGRLKGRIHHFSVRSLGEQIAKLNAYTDQQADDLDRRGVKLPVWRLFTEFPAAFLKAYVGRRHFVRGLYGVMTAANYAFFRYLRLAKHLERRMIRQARGEQ

SEQ ID NO: 2292 - protein, 261 aa, Beijerinckia sp.
MAGSPPSWSPPDASIRTRVSCCIIAFNEADRIARTIESVRGLVDEVIVVDSGSTDGTQALAEGFGARVVHRDWEGYGPQKRFAEEQARNDFVLNLDADEWLSEELRAELRAILVQERMPAASFRMRMTMVYPHHERPHIMADSHNYIRLYDRTKTRFAASMVHDTVEPTADVIQLKAPAYHQSFRSIAHLVRKEIGYYELQKREKTKNKALLVLRVFTEIPWQFCKFYFIRGHIFGGFYGFILSVAVAFMRWTRILVLLGY

SEQ ID NO: 2293 - protein, 277 aa, Unknown
  Description of Unknown: Chloroflexi bacterium sequence
MFDRRRVCRASRRVSLVGATVTISAAIIAQDAERHIRACLVCLRFADEIVVVDGGSLDRTAENARALGARVLVRPFDNYALQRQFALENSHSDWVFFVDHDERVSAGLAAEIRTVIARDGPDSPVGYWVPRRNYIAGRWTRGGGWSPDRQLRLVRRDRSRYDLDRPVHELVHLDGRDGVLACAIVHYNYDDYGQFLCKQARYALLEAERRRSTGETPSARRLITSPLREGWRRLVIEGGARDGIHGVWLALGMAWYAFQVEARIRAYSVRVSSARRS

SEQ ID NO: 2294 - protein, 263 aa, Pseudoxanthomonas indica
MPVSACIITFNEADRIGDCLASLAFCDELVVVDSHSTDATVAIAEAAGARVLQRPFDGFRSQKQFAVEQARHDWVLCLDADERVDATLRASIEQARDGGFAQAAGYRFARLSDYFGRFLRHGNAYPDRVLRLFDRRRGGWRGKREVHEAASVDGAVVTLAGDLIHYPYRSLEQQLLKTQRYARMMAEHDFARGKRATLGKLILAPAWRFWRGYLLRGGFRDGWHGLVYAYVRANYVRQKTIMLWLLQNGQPVATPPPAQPRQG

SEQ ID NO: 2295 - protein, 255 aa, Unknown
  Description of Unknown: Marinobacterium georgiense sequence
MTDTTLPISVTIIAQDEADRIGMAIESVRNWVDEVVVVDSGSTDGTQEIAASLGARVVHHDWPGYGLQKRFAEDQARNDWIFNIDADERILPELQAEIVAMFTQAPDADGYFIAIHDRLYCTDRLSAYTPYKPVRLYRKSKGRYSTSPVHDRVQMEAGAKTAALKGRMAHDSLKSFHHRIEKMNEYTEAQAKDLLARGRKPSTFRILTEFWTAFIVGYFFRGYWRGGLMGYIYAVNFAYSRFLRQIKLYESERKK

SEQ ID NO: 2296 - protein, 250 aa, Unknown
  Description of Unknown: Acidobacteria bacterium sequence
MTPISAVLIAQNEEHKVQAAIDSVRFCDDVVLVDSGSLDHTREVAEKAGARVIVNAPWPGFVAQRDFAVRAARHDWVLALDADERVSPGLRGEIEALRARGFDCPGYRMSRVALYLGRWIRATDWYPDPQIRLFDRTQGGWEGALVHESVRVRGRVGSLAGELEHHPYADISDHLRKIDLYTNLWARQALMSGRRAGPFEMAASSLWAFFRNYLLKGGFMLGSAGLTISTLNAYYTYVKLAKLEELARSR

SEQ ID NO: 2297 - protein, 264 aa, Microvirga guangxiensis
MLPLSVFIIAKNEADRIGATIRAVRDLTDDLVVIDSGSTDGTQAVAEELGARVIFNPWPGYGPQKRFGEDQCRHEWILNLDADEELSPALCEEIKALFANGEPPRQAYGIRIAETYPGEAAPHPLAYRLSPVRLYRKDAGRYSSSLVHDRVDLKPGTSTGTLKGLVHHRSIRSLGDQIAKLNLYTDQLAHDLEVRGVSIPTWRVYFEFPAAFIKAYFGRLHFLRGTYGFLIAMNYAIWRHLRLAKHYEKKRVNALAKANKAKGA

SEQ ID NO: 2298 - protein, 260 aa, Desulfococcus sp.
MKIDIRDLMSRPTIGVAIIAKNEADRIGRLLSSVSFADDVVVVDSGSTDSTRDVCLEHGARVVEREWAGYAAQKQFAMEQLNTGWILSMDADEEVPDRLAGEIVDAVSNADEDVGGFSMPRLSRYLGRWIRHGGWYPDRKVRLVRHGKGRWLGNGLHERLEVDGRVVPLSNHMLHYVYRNIADQVGTINRFSDTEAAARGARSGWFVFAGVAHAAGKFFECYIWKLGLLDGIPGLVIAMNSAFYVFLRHAKCWELGRDVS

SEQ ID NO: 2299 - protein, 259 aa, Zobellella denitrificans
MNQRPTLAAVLIVKNEADNLADCLATLDWVDEIVVMDSGSTDRTREVAEAAGARFFENTDWPGFGRQRQLAQDRVQSDWVLWIDADERVTPELRTSIEAVLARPTDDTVYAISRLSWVFGRFIRHCGWYPDRVLRLYPRALTGYNDALVHEKVELKPGINTARLRGDLLHYTYRDLEHYLVKSAGYAAAWARQRAERGKKGSLAQGLLHGVGCFLKMYLLKAGFLDGRQGLLLCLLSAHSTFVKYADLWVRTETSGPRE

SEQ ID NO: 2300 - protein, 255 aa, Halomonas salina
MTPISGIIITLNEADNVTDCIASLQRVCDEVIVVDSGSQDDTVALAEAAGARVIHQPYLGDGPQKAFAVPQAAHDWILALDADERLDDDAVAAIQGLALDDPQQAFRFRRRNFAGRHWIRAAGFYPDPVTRLYNRTTSGYLPKKAHSSVQAPSVTDLDAHLRHFTYRDLSHWISRIDALSSRDAWAMKERGKRPSAVRPALHAATATFRKLILKGGLFQGADGFTVAMTTAFHAYMKYAKLNELYENERAEQNER

SEQ ID NO: 2301 - protein, 265 aa, Cupriavidus taiwanensis
MKVSAVIITRNEAHNIGPCLESVSWCEEAIIVDWASTDDTVAIARAAGATVIQAEDWPGFGPQKNRAVQAASGDWILSLDADERVTPALRDEILHHLQRNPAQALALPRLSAFCGTFVRHAGWYPDYVTRVFRNGRGRFTDDLVHEHLKVDDPVTRLREPLVHYSYRTLSDVLRKIDSYSSAGAQQAYARGKRSSVASAAGHGLWAFVRTYLLKRGFLDGSAGFGVALMNAQASYYKYAKLAQLHAAAAAANHAAHQPAHNQRAR

SEQ ID NO: 2302 - protein, 269 aa, Pseudoxanthomonas sp.
MSSTSAHDPRPRISACIIAFNEADRIGDCLDSLAFCDECVVVDSGSTDTTLQIAQAKGARVLQRAFDGYRSQKDFAVQSASHDWVLCLDADERVDEALRLAILAARDRGFADAAGYRFNRLSDYFGKFLRHGNAYPDRVLRLFDRCRGGWRGTREIHEAASVDGALQTLAGDLVHFPYRSLEQQLAKTQRYALMMAQHEFARGKRASFGKLVVSPAWRFWRGYVFRLGFLDGWRGLVYAYVRANYVRQKAIMLWLLQHGQPVQDPPRKS

SEQ ID NO: 2303 - protein, 414 aa, Sulfobacillus thermosulfidooxidans
MRCVVAMIARNEEETIGQCIESVKPWVDGIIVGDTGSTDNTRRIAREKGAVVIDIPWTDDFSAARNAVLDSVVTDWVLVMDADEELPPGQGQILRELLTRPTSECYDVQILSPIGNGATINTAWVTRLFRLYPHIRYKGAIHEQISQSFINAGMVPANSKLQLWHWGYMDRVWREKNKTARNRHLLLNQVKDHPDDSYSWWQLAVSELNEENWNGAKAALEQARQHNMIAGLAPLIEYVDAKVAWGEQDFRRAIVATQRAESLASQWADPIWLRGEMHRALNNWAAAEIAYHQALKLGFQPESALTHEAGAGTYRSWYGLGATYLSRNEQRRAFATFAVAWQKYPYDVMLWNGICMGFRGQLASDAALELLEIIPNVAELRTKHLGPPRNNWEWVMWKVWADKGLCPPPFLQVS

SEQ ID NO: 2304 - protein, 259 aa, Unknown
  Description of Unknown: Hydrogenophilales bacterium 17-64-65 sequence
MTTRLPISVFIIAQDETDRIRLTINSVKEWVDEIIVIDSGSRDDTVAVSEALGARVVFNAWRGYGPQKVFGEGLCRNDWLLNLDADEEITPELGAEIRALFQSGLPGAAAYTLPILPLYPFQERGHRWTAFHHPIRLYRKTFAGFKDSPVHDSVVVHEGRVGHLKGMVNHRSFRSLSHHVDKANFASTARAQDLFQKGRNPSALSLLLIPLLAFFKSYILRREFVNGIDGIVVSHMYAFQRFIRLAKARELHRLARRGK

SEQ ID NO: 2305 - protein, 252 aa, Segetibacter sp.
MLPVSVVIICKNEADIIGRTIHSVQALTDDVVVVDSGSTDGTIAVIEAAGATLVRSEWEGFGPTKNKGIAAARHNWILSIDADEQPDQTLIDSLHQVNLSDTHAVYNLKFKTYLGRKLVRYGEWGTDAHIRFFNRSTIRWNEATVHEQLVLPPGTSRKTLNGFIHHYSMKDLADYTTKMTQYALLSGEHYYQSGKRAGWIKRYLSPAFSFYRNYLFKLGFLDGREGYLIARVTAYYTMLKYARLDELNRKTP

SEQ ID NO: 2306 - protein, 277 aa, Kandeliimicrobium roseum
MSISTLIMTLNEEENIGRCLASLGWCDDIVVLDSFSTDRTVEIARAAGARVVQHRYESELDQRMFGLTQVEFRHPWVYTPDADEVTPDDLRDEMLAIAADPDRPEAIFQARYKNMFMGRWIRRSSLYPTWITRMVRPEFVRFERKVHSRCVSDRPTGRLKSHFIHYSFNKGLSAWYDKHNRYSSVEAALATSKGRHPPIDWGGLVSSEGADRRAAIKAIAARMPFRPTLRFVYMYLLRGGFLDGWAGYTYCRMIASYELMIEIKTAERLRRDAGLPI

SEQ ID NO: 2307 - protein, 715 aa, Motilibacter peucedani
MKRSPASVVVVAQHGPEGRARADFLARALRPSLGVRDELVVVADGEPGMSEIAAARLDDAQDLAARRLSGARRAKHAVTVLVCADCLPPSHAIDPLVVAVAAGSVAAGPLHDLGVGRQCVTAPVKALASPQALRDWARVWRDEHRGETRTVPALGEGVIAVRTDALLADGGLPGLGERLGAVGTLTVVADSVWHHRGTRGCGLAPRRAPLLSAVYIVKDEEELLPSSLAALEGVADEVVVYDTGSTDRTVEIARAAGARVVLGYWDEHFGDARNRALSHAFGDWHLQVDADEVLEVGDVALFRRALQEATTEALAIDVENITGNGMGTPQTGLVRRLARRDEGWFAGRLHEEVLHREGRGPVQGALRGVTLVHSGYLAARTEERDKAGRNLRLASLGLADAVPEGLTKGTALANLARSQRFAGDNEGVLRTAALAEGESFPPINWRELCHAAAVAAASLGRFDVAHEWLDKLTASMTDPVGSYEIAAEVLLAEGRYEDVLDVVSRMPVEGKDENNRVVRRDGALTFEIAALSRLGRAPEAAWRVVEVVRTGSMNISLERVLALFEAEPAALDAYVAALHDSMVMLTLAESRWVRPERADALLEAMWRAGRARSAVLAAATVVAPRLTVLRALEWAARLRGAGVSDCALVALARDTGRSPRDRVLAAALVIEAFGDDRTMPDLVAAAELIPDAEADAVGAELRTVAPRVAAQLLAA

SEQ ID NO: 2308 - protein, 268 aa, Bosea sp.
MPPLSIFIIARDEADRIARTIAAVRALSDDIVVIDSGSTDGTQAIAESLGARVIFNPWPGYGPQKRFAEDQCRHDWLLNLDADEVVPPDLAAEIASLFANGEPAADAFELRIAEIFPGEPAPHRLAYALAPVRLYRKDKGRYSPSPVHDRVDLVAGARVARLKGTVHHFSVRSLGEQMAKLNGYSDAQADDLDKRGITLSVFRLVAEFPANFIKAYIGRRHALRGVYGFMTAMNYAFYRYLRVAKHWERRLQRRTDAAAPPQQKSDEN

SEQ ID NO: 2309 - protein, 345 aa, Sphingomonas sp.
MSRKPVIAAVLIVRDEARCIARCLDSVRPHVDRILVLDTGSTDGTPLLAAQCGAQVHHLPWPNDFSAARNHALDLVDADWNLVLDADEWIVSGGEQLRRWCRAPRLGQLCVHSAMEGTATGAERRNWLTRLLPRGVRYQGRVHEQPVSPLPRARIELHIRHDGYLAGQLARKRDRNPPLLRRDLRDRPGDPYLLYQLAKDAEIGGDLVEACAHYAAALEASPLEANWRHALVVRQLHCLGRTDRMDTALALADAEMAHYPESPDLFFVLGNLLHDRAQTDPVQALDQWLPLAIGAWERCLAIGERPDLEGSLQGCGSHLVRHNLETARTQMRLLGMQQELARLVA

SEQ ID NO: 2310 - protein, 262 aa, Unknown
  Description of Unknown: Candidatus Sulfotelmatobacter kueseliae sequence
MTISVAIAAMDEEANIGRTLASVRWADEIVLVDSGSRDRTCEIAREHGARVIAEPWRGYVAQKQYAIELCTKDWILLLDADEEVSPGLAEEIRAAIADPNAASGYRLPRKNLFLGRWMRHGGFYPDPKLRLFRRGQGFVTGHDPHDRCELMPGVPQDAPQRTRQFKNALVHYTYPNLTLYIAHMNRYSSLGAQLAVSKGHRSFSFINIALRPLATFMYNYFFRLGFLDGREGLLLHMYHALYVSWKYAKAWELSRNNRTQPD

SEQ ID NO: 2311 - protein, 265 aa, Microvirga aerophila
MLPLSVFIIAKNEADRIGETIRAVRDLTDDLIVIDSGSTDGTQAIAEELGARVIFNEWPGYGPQKRFGEDQCRHPWLLNVDADEVVPPKLAVEIRALFAGGEPQRQAYQIGIAEIFPGEAAPHPLAYTLWPVRLYRKDHGRYSPSLVHDRVDLQPGTRIGKLKAVIHHRSVRSLGDQLAKLNRYSDQQAVDLEIRRVSIPTWRVFFELPAAFIKAYIGRRHALRGTYGFLTAMNYAISRHLRLAKHYEKKRLNALKNGASRKDRS

SEQ ID NO: 2312 - protein, 355 aa, Flavonifractor sp.
MDTLSLCLIVRDEEDVLARCLESAAGLYDELIIVDTGSTDATVDIARRFTEHVHFFPWRDDFAAARNFSFQQATMSYCMWLDADDVLLPADREAFLALKRDVLPGPDVVMAPYHAGLDEKGAPLLTYCRERIVRNAPHLRWEGAVHECIAPVGEVIYTDAAVTHQKLRPGDPDRNLRILEGVLSRGRNLSPREQFYYGRELAAHGRFEEAVKVLEDFLTVGWGWKENNIEACRNLAQCYLALERPRHARRALLESLAFDGPRAEVCCDLGKLLLDQGDYVRAAAWYQEALKHPCDPRSGAFCLPDCHGFLPCIQLCLCCHHLGQRAEAEAWNRRAGTYRPDHPAYRYNLDFFART

SEQ ID NO: 2313 - protein, 280 aa, Leptospira kemamanensis
MTSIPISCAIITLNEADNLSRTLKAISFVDEIVIVDSGSTDDTVEIAKSFGAKVYHRPFENYADQKNFAITKTKHDWVFAIDADEVVSPKLKEEILDLFSKNNLKTKGFLVPRLTFYLGKWIRFGGYYPNYQIRLFQKSEGQFSGGLVHERVKLNGKPSKLKNPLFHYSYKNISDHLKFIDRYSSLFAEEEYRKGKRSSIFWAFMKGCFKGFYMYWIRLGILDGKQGFVLALLGFYYNFLKYLKLYEKSNSIPSFFVMVDSVHNVESKKSTKKNSDQIHV

SEQ ID NO: 2314 - protein, 572 aa, Unknown
  Description of Unknown: Clostridia bacterium sequence
MPACGLPIPRPRPWTATRLPSLCPSTSSSTPALPTLPSLMVRPSPLTPGSRLPYNQVTRGKPIRKGSLATFPGRVRRIIMEEIAPGVSLCMIVRDEEENLPRCLDSVAGLVDEIVLVDTGSADHTVSLARSYGARVFRLEWPENFAMARNFSLDQATRQWIFCLDADEELAPAGRASFRPLLAREGVEGYLSTILNLVDNPAGEREILRHSSLRLFRNRPGYRFRGPLHEEILTSIRESSPQAVIAASPVEIIHHGYTSPAKAARNKAGRNLGILRQALAGNPGDLFLQYNLGLEYWQLGDFPAAARWLGQVYAGCGREWPHAAALTRNYAICLLELGDPATAVAVLEQGAARFPAYTDLFYLLAVAHRRLGQPEKAVELASRCLELGEPPAGYVSTWGVGGHKACMLAGEMLEELEDYEQAARAYTVALQRHPQYVPALFGLVRVLGRLYDAQGCVSYLEQYFDFSTARAVEVLLEALATARMNEAGLLVARKAVRLWPENQRLRLLLARALMLREREVLAAARGRFRGVPVLEREWYGAALALERLEALISGRKRTGGEAECPPPPSACA

SEQ ID NO: 2315 - protein, 469 aa, Unknown
  Description of Unknown: Verrucomicrobia bacterium sequence
MNRKTVSLCLIARDEEASIGMAIKSVLALVDEVIVVDTGSKDNTRIIAEGYGARVLDVTWEDDFSLARNACLAEALSDWILVLDADEFLQPVRPVEFQRLLHDPQVAGYRLRMASSLEEEAGRNSTMIRLFRNDPAIRYSYPIYEQISESLNWWAEKEGLQVKDTNLTIVHEGGQQAAQVQKRQRNQRILHKAMAEFPIEPYFPYKMGCAGIQTLDEEVLPTAGLTVALGHLHTAWLRMESRDPKHLQTQRWLPDLAIKSSSGLLALDRVEEARNLIQKVGKHFPNDPRVILQTAAAEIRYLELHCDDMNPQTSRKMESDIQFRLQELLDRAPESDGFAIDRRILDLYPLRYLGELALLGGHVSEAVGYFEQALSLDPDYSFAWLGMAECSRFAGDPKRALKLYLRTITENEWNHRGWMRGCDLMKEMEFQDNAASWWRRVTTQFPEHPALKQTDHQAPEILRPLNPVG

SEQ ID NO: 2316 - protein, 342 aa, Butyrivibrio sp.
MVTVSLCMIVKDEEDKLATCLDCVKDLVDEMIIVDTGSTDKTVEIAESYGAKVFKFAWTGDFSDARNFSFRQATCEYIYAADADETIDEENRERFKQLKEDIDDLDIDVVQMYYCNQLSHNTVYNYDRELRPKLFRRVRSFVWQDPIHETIQLDPVVCNSEVEIQHNPTEDHGERDLAAFRRAVDMGSYISKRLHNLYARELYMVGTNEDFILAKKFFSDSIIDTGRDLDQIKEASCVLTHIAVIEDDVLGVLKYALKDVTTIASSEMCYELGEFYRKRGDIDEAIVWYFNAAYETSPILDVHHGGDMPMQKLAECYRELGNLEQAEDYEKEAARWEPPKPE

SEQ ID NO: 2317 - protein, 278 aa, Paenibacillus sp.
MAARRASEDAHRISVVIIAQDDETRIASAIVSCKPFADEIVVIDGGSKDGTKTVAEQLGCRVYENAWPGYAKQRMFGSRKASFDWIFVIDTDEVADARLIQSICERKRHLTDDGKAYAVDRIGDFMGRWMGRKEPLVRLYNRKRVQFRDTLVHEIPDVEAAQVVKLQGELLHYGFRSIGDHIRRFNRYTDLEAEGLVAAGKPFRLLRLLFRPPARFLHKYFWQGLYRKGVPGLAVAVFWGLYEFLACLKHYELLRIRTKTKPQEETLKEGKAYAGAIH

SEQ ID NO: 2318 - protein, 294 aa, Paenibacillus sp.
MNETKYKTCKSISVVIIAQDEERRIVAAIRSCLPFADEIIVVDGGSRDATREVASALGCRILLNPWPGYAKQRNFGADAAKYDWVFFLDTDEFVDEALAASLLEWKSAIDDGGHAYAVYRRGNFLGKWLERGETMTRLYNRRVVRIRDTLVHEEPDIPHRGVRTLAGVLWHDGFRSIEDHVIRFNKYTELEARKAFYEKKQTFRLLPLLWRPPARFVQQYVLHGLYRKGLAGLTVAVMWVFYEYLRHIKLYELTRQQESVKLSDQTAKEAEGETTRQRDASVEVDAAAVLGKEW

SEQ ID NO: 2319 - protein, 254 aa, Lysobacter sp.
MPEPLPLSGVVITLNEADRIERCLASMREVCDEVIVLDSGSTDGTIEIARGLGARVEHRDWDGFARQKNAAIERSRNEWVLLLDADEWLESPSLTGLRALFAGDLESADCWLLQRRTHFLGHTMRAGSFAHEPVHRLFRRELRHGDVPVHEYLDVKCWRVRMSDIALEHDTARSEDEYWGKLQRYARLWAEARVSRGRAPSPWRGAAAGAAYTLKNMLLRGGFIDGRAGWRFHRLHARYSMLKYRLLRELVRAG

SEQ ID NO: 2320 - protein, 252 aa, Unknown
  Description of Unknown: Planctomycetes bacterium sequence
MSGCVIAYQEEDRIGDCVRSLAFCDEVVVIDSGSKDRTREIAAELGARVIDNAPFPGHREQKQFAIEQAKYDYVFCLDADERATPALQKQIVALAARTLDAAAYEMPRQNHYLGRIVRRGLFWPDRKIRLFDRRRAKWGGTNPHDHVEVQDESPVVRLAEAIEHLSFRDFAHHVRTARSFSLIAARALAAKGRHCNPFDLLVRPPAVFVKSLLVKRGFLDGWRGFVIAAMAAYTDWLKYWQLFRLPRDGGVS

SEQ ID NO: 2321 - protein, 261 aa, Bosea sp.
MPPLSIFIIALNEADRIGDTIAAVRVLSDDIVLVDSGSTDGTQAIAEKLGARVIFNPWPGYGQQKRFAEEQCRHDWLLNLDADEVVPADLAAEISALFAAGPPPADAYKLRIAEIFPGERAPHRFAYALAPVRLYRRTKGRYSSSPVHDRVDLAPDARIGRLKGTVHHFSVRSLGEQMEKLNSYSDAQADDLDARGATVSVFRLIVEFPANFIKAYIGRRHALRGVYGFMTAMNYAFYRYLRVAKHWERRLQRRDRSRKDS

SEQ ID NO: 2322 - protein, 271 aa, Unknown
  Description of Unknown: Xanthomonadaceae bacterium P sequence
MPPATPRTGGDGAVTPISACIIAFNEADRIGDCIASLAFCDEVVVVDSHSTDATVAISTELGARVIQRPFDGFRSQKQFAIEQAAHDWVLCLDADERIGDALRTAIEAERARGFDGAAGYRFARLSEYFGRFLRHGNAYPDRVLRLFDRRRGGWRGKREVHEAASVDGAVRTLSGDLIHYPYRSLEAQLQKTQRYALMMAEHDFARGKRATLAKLVLSPAWRFWRGYVLRGGFLDGWHGLVYAYVRANYVRQKTIMLWLLQNGRAITTSKS

SEQ ID NO: 2323 - protein, 256 aa, Halomonas ventosae
MTPITGIIITLDEAENIADCIASLRPVCDEIIVVDSGSRDDTVAIAEREGASVIHQPYLGDGPQKAFAVPRARNDWILALDADERLEEDAVAAIRALALEDPDMAYRFKRRNFAGHHWIRAAGFYPDPVTRLYNRTTSGYLPKKAHSSVQAPQVLDTGGHIRHFTYRDLSHWIIRIDQLSSRDAWAMKQRGKGPSRYRPTWHALSALLRKLILKGGLFQGADGMTVAVTTAFHAYMKYAKLNELHERERSDHSESA

SEQ ID NO: 2324 - protein, 275 aa, Lysobacter enzymogenes
MDTPAPNDAARPRLSACIIAFDEADRIVDCLASLAFCDEIVVVDSHSADATVALAQAAGARVLQRRFDGFRSQKQFAVEQAAHDWVLCLDADERVSDELRASILAARDRGFDAAAGYRFARLSDYFGRFLRHGNAYPDRVLRLFDRRRGGWRGQREVHEAASVDGAVATLRGDLIHYPYRSLQQQLAKTERYARMMAEHEHARGKRATLAKLVLAPAWRFWRGYLLRGGFRDGWHGLVYAYVRANYVRQKTIMLWMLGNGQPVVTPERGAGDGTP

SEQ ID NO: 2325 - protein, 503 aa, Desulfosporosinus orientis
MDTKETVCLCMIVKDEEECILSAINSALDLIDELIVIDTGSSDCTPQLALEAGAKLFPFRWAEDFSLARNFALKQASSDWILILDADEVLDTINSKTFCSLLSNREVEGYFIRIKSILDSTMRVSNDEVVRLFRNKQDYRFEGAIHEQIAPSILRTNQGRGLASSPITISHYGYLKEHLDSKDKFLRNTAILKQELRQNPDNPFWHYCLGLEYYQQSFVYEGLNHLNNALKRMTGQEGYFEDVLLNTALGYLHLGENRTIISFITKALSMYPNQGDFYYLLGLAHLQESHYSQGVMNLEKSLSVGSMTLATHGQINCLLGDTHQSSGDFPRAHDFYQRALASAPASIYPLRQFVSLIQKGYPIETFLKQILMLESWPSEALWRELLTKHRNSDLKFCLLFLLLTLYRTINATTLCRKELLNILLQLPDSSKKTLHQFHSDSEVKLGGIYLMLALKEIQFRMILLVNDLDNDYFKGIESLSSLTQIGIHVLSYLSDTSLDSIIP

SEQ ID NO: 2326 - protein, 244 aa, Unknown
  Description of Unknown: Acidobacteria bacterium sequence
MPGITATIITFNEEDRIAEAMASLACCDEIIVVDSGSTDRTLEIAAAQGARVITHAWEGYSNQKNFAAGQSRHDWILSLDADERLSMELADEIVQWKKEQNTFAAFSMPRRAFYLGRWINHSGWYPDRKLRLYDRRRCLWKGDFVHERVEVDGSVGRLGGDLLHFPYRSWDDHLARVEKYTELAAEAARLNGRRGSVLKMLVAPPVAFIKGFIVHAGFFDGWRGLAIAYMAARYVFMREFRILR

SEQ ID NO: 2327 - protein, 683 aa, Wenzhouxiangella marina
MNLTEARSGSPPAWLQAGAAVVVFLALALGLVVPKLAGAGFLLLGLTAIVWLSIAKQWRPGDLVPIERLLCMAIVLFVVAWLLGWGINGLDPAGLEAVTRIARLLLIIPILLFIRQLDTIESAWWRGLTLGAIIAGAYAWWSFLSGQVGPFGERVVGTTNPLYFGGLSLAFALMLLPRLRDVSLPVSVRLLAVLALLLAISASALSGSRGAWVVLPLLLLIYLFTLGRSQPPVWRFGVPLAFMAIATAFLFSPASPMSERAMSGLDDLSALVRGEQAEGTIGRRMALWELAGEVIAEHPLSGSGPGAYPRRVTEAIAEGRIPEDFEDYEHPHNEYLSAWIQAGPLGLFALVLMFGIALRRHGRVWQTGLKRTRYLGWSGLAGLSTIAIMALSESLFERNIGIVWYGLIVALSAGLVHARRRVELSAPDSRRRHTISVIVICKDQAGEIDRCLGSVAGWADEIIVLDSGSSDDTVERCRRYTDQVHETDWPGFGLQKQRALDLARCDWVLSMDADEALSETLRREIDRVLAEDAPDHEGYRLCWVTHAFGQRLSFGHWARAPLRLFRRELGHFTPVAVHEKVVLEPGARIGFLEAPLDHYVYRDLAHARQKLSRYASLQARERYERGKRVRLAMTPLLRAGFNLLDNLILRTAFLDGRGGWTMSWLYTRYTYEKYRQLLELSRG

SEQ ID NO: 2328 - protein, 367 aa, Roseateles terrae
MSTRWRTCLVVIARNEAAHIGRLLDSVRPWLDDMLVLDTGSTDDTAVRAAQAGARVAHAPWPDDFAQARNTALDLANADWHLVLDADEWLISGGEALEALRQTAPDFVGTVALEDHFDDGVAHTRLSRLLPGDVRYAGRIHEQPVHQRPVYAVPLHIGHDGYLSARLRDKAGRNRRLLEAAIADQPASAYLWYQLGKDCSVYNNYAEAEDAFANCAGLLPSDAWPMCNAEDGAAGAHPAPATAPAWWPDLVARRLFGLKRLGRHADGVVFADGQLAICESSPDVFFALGDLLLDWAAEDPGQADVLLPMMEDAWRRCLLLGEQPDQPGAVAGRGSYLAAHNLALVLEGTGRAEEAQALREQFPAPRS

SEQ ID NO: 2329 - protein, 254 aa, Unknown
  Description of Unknown: Acidobacteria bacterium sequence
MVPLSAVLITQDEARHLPGALDSVRFCDEIVVVDCGSRDESRAIAEAAGARVVVHEPWPGFVAQRNFAAEAARHDWVLAVDADERVSPPLRAEIEARRAAGFDHDGYRIPRVARYLGRWIRGTDWYPDPQLRLWDRRKGRWEGALVHESVKVRGRVGRLRNDLLHLTYDDISDHLRTIDSYTTLWARQAYAEGRRTGPLEAVAACGWAFFRNYAIRRGVLLGAAGITVSTLNAYYTYVKLAKLLELQQGVVPPS

SEQ ID NO: 2330 - protein, 270 aa, Unknown
  Description of Unknown: Xanthomonadaceae bacterium sequence
MDNSLSNPGHPRPRLSACIITFNEADRIADCLASVAFCDEVVVVDSGSGDDTTAIAERLGARVLVRSFDGYRSQKAFAAAQASHDWILSLDADERISEDLRVAIERARDAGFAGASGYRFARLSWYFGKFLHHGNAYPDRGLRLFDRRRGGWQGQREVHEAASVDGPVLGLEGDVIHFPYRSLEQQLAKTQKYARMMAEHDHARGKRASLLKLVLSPAWRFWRGYVLRLGFLDGWQGLVYAYVRANYVRQKSIMLLMLERGQPLVDPPRE

SEQ ID NO: 2331 - protein, 266 aa, Hirschia baltica
MNKLPLSVFIIARDEADRILPVIRSVIDWVEEVFVIDSGSTDDTVEVSRNAGADVVFNEWAGYGPQKVFGETLCSQKWLLNIDADEEVSDSLRREITSMFEGGQEPPLAAYQIPILICFPFDKGPRPFAPSNDPIRLYNREKAGFKSELVHDSVVLKPNEVSGKLKHHINHRCFRSHHHAIEKINRYSSMQAEDMIKKGRKPSVLRLLTEPMTAFLKSMFLRRYVLFGVNGFTESVIYAFARFIRLAKAREAWKQHEANQSPRMHD

SEQ ID NO: 2332 - protein, 641 aa, Ferrimicrobium acidiphilum
MPQDRIVIVALLANEDMRRNAKKYLATVTPASFPVILLVEGQELEARDRQRLDNAQHAALLAPAASITKGWLDELLVIAEQHPDSVVVPGSPNVNGPQRLILEEKQSVRYLKDQGPYAVNIRKHFANITQPIHYATDLVACSRGAWVCEALDTGGTSSREAFSALYRDRPLLLAQGAAVFSSEIKSQLIPGAPMASPLVSLCMIVKDEEEVIADALDSARGLADEVIVYDTGSTDDTVAIATRHGARVIQGQWRDDFAWARNQTLQYATGMWILWIDADERVRGDKEALRVRLEDPLAPFESYSIRIENVTGGGLTSFNHYANRVFRRKDCFWRGALHETIWYRDELRTCHAVPAPEMYLEHFGYLDNTMIDKKKADRNIRISEGNQSAASPEEAAMHEARSLMMANRLEEAIALVETQVIDGDSRAMRRLGVLALGSWYRTVGRYDDAEIAIERYEGEGYDPSFAHKERAQLAFEQKDYAKALAYADLVTETVVDYDGLTVSPDGLIGLKARCLVKLDRPDEASRLVIEGLARGVMDIHLNELIELMNQGQVPMSELADALPNDKEQLIIAQVLQIDPSIADDILVELHALRPDDRTLLAAASLVARHLNDERRHYWLGVLAECGLEGSLGSSNADDMSA

SEQ ID NO: 2333 - protein, 286 aa, Unknown
  Description of Unknown: Methylobacterium sp. BK227 sequence
MSRAPAGAAAPRPLPGPDGPLPLSVFIIAHNEVDRIGATLRAVRGLTDDLVVVDSGSTDGTQALAESLGARVLHHPWPGYGPQKRFAEEQCRHVWLLNLDADEVVPPELAREIQGLWAAGEPRRPAWRIGIAEIFPGEGRPHPLAYMLTPVRLYRKDKGRYAASPVHDRVALEPGVKPGRLRGVIHHFSVRSLGDQLDKLNRYSDQQADDLESRGVVIPTWRVFVELPGNFLKAYLGRRHFVRGTYGFLTAMNYAISRHLRVAKHVERRRVAAARQDRVDPPDPTF

SEQ ID NO: 2334 - protein, 255 aa, Fulvimonas soli
MNRVPLSACIITFNEADRIDDCLASLAFCDEVVVVDSGSTDGTRERAAARGARVLERPFDGFRSQKAYAVAQARHDWVLCLDADERVGAELRASIEAARAAGFAGAAGYRFNRLSEYFGAYLRHGNAYPDRVLRLFDRRRGGWRGGREIHEAASVDGPVAWLRGDLEHHPYRSLSEQLAKQERYAQMMAEHLHAQGRRATLGKILLNPWWRFVRGYVLRGGFLDGWRGLVYALVRVEYVRRKFVKLWLLQHGLRP

SEQ ID NO: 2335 - protein, 250 aa, Unknown
  Description of Unknown: Chloroflexi bacterium sequence
MKTSPLLTCAILARNVAEHIGPCIDSCRFADEIIVFDTASSDGTQDRARAAGARVIDTPFVNFSQARNFALEHSTGEWVLFVDADERVTPELAAEVRDVIRRQDVAGWWVPRYNHIVGHVMKGAGWYPDYQLRLLRRGRAHYDPRREVHEVAIVDGAEGHLSHHLIHYNYDSWQQFHEKQRRYTAYEAATLRHQGVTFHPRHLFVRPLQAFWRRFVVWHGYRDGWHGLRLSLIMAWYEGLKYWWFWRGGP

SEQ ID NO: 2336 - protein, 259 aa, Albimonas pacifica
MPPPLSAFLIVKDEAARLPRTLAALEGLADQVVVVDSGSSDETVEIARAAGAEVFHRDWTGYGAQKRFAEDRCRHDWLLNVDADEVVTPELAAEIRATLAADPAPAAYVLRILNVYPGAERPRPLANDYAVVRLYHRSVGRYRDHPLFDRVEVEGPARRLRAPIHHFPFLDWHGLVAKENAYSSFQAEAAKPRKLWKLRLRLMVEGPFVFLKSWLARGHVLGGWNGFVFSVVIAFARFMRVAKMIEREEARRRERAQGG

SEQ ID NO: 2337 - protein, 269 aa, Labrys okinawensis
MSPPASPSGLPGPPPLSVFIIAFNEADRIGATIEAVRGLTDDLVVVDSGSTDGTQTIAEKLGARVIHNSWPGYGPQKRFAETQCRHNWILNIDADEVVSPQLSAEIRALFAGGEPKADGYEINIAEVFPGEREPHPWGYTLAPVRLYRFDRGRYAESTVHDRVHFSGQPRIARLKGRIHHYSIRSLGDEIAKLNAYTEQQAEDLDKRGKTLGSWRILTEFPLNFLKAYIVRRHFVRGLYGIATATNYAYFRFLRLAKHMERRRLRKLRG

SEQ ID NO: 2338 - protein, 244 aa, Unknown
  Description of Unknown: Acidobacteria bacterium sequence
MPGITAAIITFNEEDRIAEVIASLACCDEILVVDSGSTDRTREIAVAEGARVITRAWAGYSKQKNFAAEQARHDWILSIDADERLSVELADEIVRWKKVKQAFAAFSMPRRAFYLGQWIDHSGWYPDRKVRLCDRRRCRWEGDGVHEQMKVNGTVGRFAGDLLHFPYRSWDDHLARIEKYTELAAVAARSSGRRGSVLKMLVAPPAAFIKGFLLNAGFFDGWRGLAIAYMAARYVFLREFRILR

SEQ ID NO: 2339 - protein, 248 aa, Unknown
  Description of Unknown: Bacteroidetes bacterium sequence
MSTALSILYLSFNEEDVFGQSLESVESIADEIVVIDSGSSDSTVQIAERAGAHVYHRPLKNWGEQRNWGLKKCKHPWILVVDCDEVLTTELIESLKEWKQSEHDEQQPYSFKRVHFFKGKRMNFSGLQNDYVVRLLPKGVKYEELNVHEKVRSSSKRLKGNILHYTYKNAAHWEQKFRTYAKRQALDYEKEVGRIGPYYLNVKPSWRFFKHYIIKGGIFDGSRGFEYALWMYRAVKWRYIEVNKLRIK

SEQ ID NO: 2340 - protein, 252 aa, Luteibacter sp.
MPISLCVIAQNEADRIVACLASADFCDDMVVVDGGSLDATVALAEAACARVIHRPFDGFRTQKDFAVAAARNDWVLCLDADEWVDPSLRAAILARFARGTGDTAAFRIVRRNRFLGKVMKHGNAGSDRVVRLFDRRTAGWHGAREIHESVVVKGRTEAIDGWLDHDPYRSLSAMLAKQERYAHLMAEEAFAKRKRTGLAQIVLSPAFRFLKGYVFRGGFLDGWRGLIYALLRVEYVRRKYVKQYLLQKGFKP

SEQ ID NO: 2341 - protein, 261 aa, Methylosarcina lacus
MLTVVILTQNEQANLPGCLAAIPERYPVVIVDSGSTDDTLEIATQRGCRIYSNPWPGFAEQRNFAINRCDIGTPWLLFVDADEIYPQAFYDWFESEMAGSDAVDVLMVPSILYLRGKRLSHAPGYPIYHPRLVRRETTRFVQNHTGHGEAVVNSCRIGYSDIPYDHYFYHGEIIEWMHKHVGKAAQEVQLKPTQDALMTTRGRLSVLLGRSWFRIIARFLYHYVFRGGFMDGAAGLEFALMFTWYEATIYMQAKAGVQTRG

SEQ ID NO: 2342 - protein, 259 aa, Asticcacaulis taihuensis
MDAIEPTPLSCCIIARNEGDRIGDCIRAVQGLVSEVVVIDSGSTDDTVAVAEKLGARVIHHDWPGYGPQKRYSEDCASYDWILNLDADEIVTPALFNEIRALMAAGPKLNAYRFRIRNVYPGKTKPRLWADYHNYVRLYDRRVVRFRESLVHDTVDTKAEPVGQLHGAVMHFSARSYEHIRAKLDSYTNLQAKVLKKPAWAIWLRLPFEYPFVFLRYFIFRAHFTGGWDGLYSSHLAAEARLNRLRKILSAQKAVKDAA

SEQ ID NO: 2343 - protein, 713 aa, Paenibacillus catalpae
MLLGVHIIVRNEEDMLSECLDSIRGIADELIVVDTGSTDGTVDIALRYGARVINAEWKDDFSFVRNLALEHARTVWVLVLDADERLKGDGQALRLELRKAASSAYRLRMEHLLDASNTSCSMSSEAVRLFRADRGYRYHGEIHEQLVRISETVNGTIMMDIDSPLCPGSQHLVHVGYMPDVLQRKSKAERNLRVISRQLTRRPNDPFCLYNHGVTLCQLGKAGEAAEAFGKSLDYTPLSAPYRPTLVRDYATVLLALSRPAEAAELLKGETLRYPDYPDLFMLLGNSFAATGMMLEAKAAYEAAIESGARPHSYISENGAGSYQAELRLAAVLQRIGEAEAVQMRYESLLGRMPGWDDALSAWADYLHQLGIPDQDIRQKLSSYAGEEGAEQHKLLARILSRIGAYSAALPLWREVIQAAANTNAAAPAQLTFSDMRWFADCLIGTGQYMEAASQIRTWLQAVKPYAEAEPRKKTIRLGMAWALCRWNEGQRISREELAVVLGGSSQLARETELFNNWLPMTHETRNKIAKEQELASAVRWLDAAVGHGMLRLAHKLAGGIYGLRPHFETLLYDHGYVEAAAELMLDRFEKDGKLTGEQSFRLGELLYLKKLRSEALSLFESVAGSGNSGAYAERALLGASAACLQLAIEALQPDEYSGSRNWDGSWSEPDRMKLQEALLRVEWMGWQTNWNGRQRRRVNGGAAEADFLMHDR

SEQ ID NO: 2344 - protein, 261 aa, Unknown
  Description of Unknown: bacterium A52C2 sequence
MPASPSADPSPVAGLSVFLIAKNEADRIGAVLAAVRGITDDLVVIDSGSTDDTVAVAERFGARVIHNDWVGFGPQKRFGEEQCRHDWLLNLDADEVPSLELLAEIRALFAPGEPQARFFRFRIKHVYPGDTKPRLWADYHNYVRLYDRRVGRFRDSLVYDEVVTGTQPVGQLHQHALHYSIRSFEHMAEKLRAYSTLTLSEKKKKRRFAAARLPLEFPMQFFKYYVLRRHFSGGSKGFRFSLLYAQAKHNRIKAFLHAPRS

SEQ ID NO: 2345 - protein, 340 aa, Caulobacter mirabilis
MIVRDEARCIARCLESVRPHVDEMIVLDTGSVDDTAAIAASLGARVERFDWIDDFSAARNAALDLSDADWNLILDADDRLVGGAATLADLGRTPFIGELRIENTFEGASGAETAVSWALRLLPRGVRYEGRVHEQPVGGALPHRRLDVSISHDGYEAAQRARKAGRNEALLRAELATAPDDTYLLFQLGRELQAAERWAEAADYLARAYNGSSQTDRFRHALVVRTLFTLKSAGRHDEALAVTEMEFERWPHSPDFFFAVGDLYLDWGLHNPDRAVKEALPLVEYCWLRCLEIGEQPDLEGSVRGRGSWLAANNLAVFYGTLKLTDKAAEYERLAAALKQ

SEQ ID NO: 2346 - protein, 270 aa, Stenotrophomonas koreensis
MSSSTAPIERPRISACIITFNEADRIADCLASLHFCDELIVVDSFSSDDTVAIAQAAGARVLQRAFTGFRNQKDFAVGQARHDWVLCLDADERISPALCQAILAARDAGFAGHAGYRFARLSEYFGKFLRHGNAYPDRVMRLFDRRRGGWRGAREIHEAASVDGAVGTLHGDLIHYPYRSLMQQLAKTQRYAQMMAEHEYARGKRATLAKLVLAPAWRFWRGLLLRGGWRDGWHGLVYAYVRANYVRQKTIMLWMLHNGAAVSDPVKPPR

SEQ ID NO: 2347 - protein, 326 aa, Unknown
  Description of Unknown: Myxococcales bacterium sequence
MGEPPPTISVCMIVKNEEDLLPQALASVKGFADELIVVDTGSTDGTVAIAEAAKAKVYHHPWEHDFARHRNQSLDYAGGDWLFVLDADETLTEQGAAALKQAALDPAIDVISIPVVSPAAGGERESSHNSVRMFRRRTGIRYAGAVHNEVDHRGRATFVPARLIHHGYNLSRARMRAKFERTAGLLRREMERDPADPKWPHYLAVSLHTENFFAEARTEARRSLDLCAGEPAALSRWLPNYYVIASAELALGDLAQAERACREALAVNSDYLDAWAVLTSVAFKRDDLALLDEAAGRFRMLVEAYRQDPRRFGHTPLHTLAQLPQV

SEQ ID NO: 2348 - protein, 338 aa, Unknown
  Description of Unknown: Chitinophagaceae bacterium sequence
MAPLRPRRRLGGRRALHALDGAPAPRPQHSPQLSVVRPKLRRGLQLFIRYWAGGAIRGVRVRVRYLVVVEMADTRNQPGRMMQATFSIVIVCKNEEASIGRTLGSVRGVTDDIVVYDSGSTDGTGAVVEGAGITPRRGPWLGFGATRRAATALAKHDWVLCVDADESLTEDLRNELRHFTPQPGTAYAVRLRNHLGARYIRWGAWGADRRIRLFNRTGCNWSDAPIHEKVTLPPGTEVVHLKGTMHHRTAASIADYRRKLDAYARLTAEHYHREGKEATFVRRHLSPLYTFFKNYVLKLGFLEGRAGWQISVATARYTHKKYAWLWEMSHPEPESSVS

SEQ ID NO: 2349 - protein, 254 aa, Unknown
  Description of Unknown: Alphaproteobacteria bacterium PA1 sequence
MSLPLSIFVIAKNEVDRIGPTLESVTGLSDDIVVIDSGSTDGTQELAERLGARVIFNPWPGYGLQKQFGEDQCRHDWMLNIDADEVVTAELVASIRAAIGVSDVQPCGYETDIIEMFPGEAKPHAWAFRLSPVRLYHKQVGRYSPSPVHDRVDLVKGTPVRRLQGVIEHRSIRSLGHELIKLNAYADMQADDLDKKGRKIGAVRLVLEFPLAFLKAYIARRHFVRGLYGFMTAMNYAFYRYLRLAKYWERRLGR

SEQ ID NO: 2350 - protein, 264 aa, Nitrincola lacisaponensis
MTSTQLPVSVTLITLNEADRIADAILSVRDWVSEVVVIDSGSTDDTVQVAEALGARVLYNPWPGYGQQKRFAEDQATEDWILNIDADERILPELQQELQQLFQQPDRLAEGYHVAIHDRLYLTDRLSSYTPYNPVRLYRKSCGRYSDSPVHDRVIMQDGASTGQLKGRIAHDSLRSFSHRLDKMNAYTDAQARDMLNKGRKPSRIRMVIDFWISFISGYCFRGYWRGGLMGYIYAMNFAYSRFLRQIKLYELHQQAQNERADKS

SEQ ID NO: 2351 - protein, 263 aa, Sulfuritortus calidifontis
MPDKLPISVFIIAKNEADRIPVAIRSVLDWVDEVIVIDSGSEDATVTVSEALGARVVFNAWRGYGPQKVFGEGLCRNRWLLNIDADEEISPELAAEIRELFARGEPACVAYTLPILPLYPFQDRGHPWTAFHHPVRLYRKDKAGFKDALVHDSVVVREGRVGRLEGMVIHRSFRSLAHHVEKVNGYSSAQAEDMVAKGRNPSLLALLLTPAFAFFKQYVLRREFVNGIDGIVVSHMYAFQRFIRLAKARELNRLRRKAGGEDK

SEQ ID NO: 2352 - protein, 341 aa, Butyrivibrio sp.
MVTISLCMIVKNEEDCLKRCLDSLKGIVDEMVVVDTGSTDRTKEIAKECGAKVMDFAWTGDFSDARNFAFSQAACDYIYSADADEELDEENRKRFMQLKSDLSELDIDIVQMYYCNQLEFRTVYNFDRELRPKLFKRVRHFVWEDPIHEQVILDPVICNSEVEIIHRPKENHAGRDLESFRRAIDQGRRLSTRLHGMYARELFMAGTDDDFIKAKKFFTESALDNSRGLDEIKQSSCVLAHVAVLEDDPAALLKYSLKDAITEMSSEMCYELGDYYFGKRDIDEAIVWYYNAAYECSSILDIKKSGSLPRLALARCYRELGNEEQARDYEREASEVEENKD

SEQ ID NO: 2353 - protein, 254 aa, Unknown
  Description of Unknown: Bacteroidetes bacterium sequence
MPKLSAVIITQNEEQNIGRCIDSLKGVADDIVVVDSGSTDNTEAICKEKGARFFYNKWEGYIEQKNFANDLAEHKYILSVDADEALSGQLRDSILEAKESLKADGYEMNRLTNYCGTWIRHGGWYPDRKLRLFHRDKLEWGGEKIHEAMVMKEPNARIDILSGDLLHYSYYNISQHIAQANHFTNMTAELAVEKGKRSGMIKIIFSPAVKFIRDYIFKLGFLDGYYGYIVCRISAQATFMKYSKIRQIRKEQKA

SEQ ID NO: 2354 - protein, 343 aa, Sphingomonas sp.
MPQGGLAAVLIVRDEARCIVRCLDSVRPWVDRIVVLDTGSSDDTPALAAACGALVHHTDWTHDFSAARNRALDLADADWAMILDADEWIESGGEHLRPWCSAPPRLGTVCIHSGYDPVGAVATGAPPASNRSWITRLLPRGVRYRGRVHEQPVSPLPRARIDLHIGHDGYFDTQMAGKIGRNAPLLLRELGERPDDPYLHYQLGTDAESRHDHATACDRYATALALTPPAANWRHELVVRYLHCLGEAGRIDAALTLAEAEMPVWAESPDFFFVLGDLLLERAMADPSRAVGQWLPLAGSAWERCLAIGERPDLEGSVQGRGSHLAAHNLALLRSQLAMLGSA

SEQ ID NO: 2355 - protein, 421 aa, Selenomonas ruminantium
MIKISACVIVKNEEKNMPAWLHCVQNIADECIVVDTGSTDATVRLAKEAGARVYELTWQDDFSYAKNYALDKATGDWIIFLDADEFFPDEEFGLVRELISKYHGRKEVAGIFTQRIEVDVDNDYEALGSSRQIRIFRNSPFIRYVGKIHETLQNTGKRKQTMMYDNTLHIYHTGYSQKLIQSKVDRNLEQLLAERKRRGPEPMDAYYLADCYYAKGMYHEALQYADEAIKSPIEAGGLMNRPYAIREQSLIYLEADEQDIVQAMEQGQEAFPTLAEFALLLAAYYWDKQDYLLAERYNRQGLECYQHNKERNTLDYRITDHAETLLPNAWWRAGELYRWRGQEDKAGTAYRKGLALQPQHEKLRRSLEKLSGAKRALPDCKEAEKMIRRVSILYRWAAAERQGIEAIYPGALAQLLPEVQS

SEQ ID NO: 2356 - protein, 266 aa, Unknown
  Description of Unknown: Methylobacterium aquaticum sequence
MVAPLPLSIFLIARNEADRLGATLAAVRDLTDDLIVVDSGSTDGTQALAASFGARVIERDWPGYGPQKRFAEEQCRHVWMLNLDADEVVPPELATEIRRLFSAGEPPHPAYAIGIAEVFPGEIRPHRLAYTLWPVRLYRRDRGRYSPSPVHDRVDLDPGVTVGRLRAVIHHFSVRSLGDQLDKLNRYSDQQADDLEARGVRIPTWRLFVELPGNFLKAYFGRRHCVRGAYGFLTAMNYAISRHLRVAKHYERRIGGRTGPSGRRDG

SEQ ID NO: 2357 - protein, 260 aa, Unknown
  Description of Unknown: Betaproteobacteria bacterium UKL13-2 sequence
MDEPRPTVAHPARIALSVCIIAKDAASQIGDCIDSVGFADEVLVVDSGSVDATRAIAEVRGCRVIEQAWLGFGKQKQFAVAAARNDWVLCLDIDERVTPALEASIRKVVANGTIHAFKMPRRNRFLGRWLAHGEGYPDWSLRLFHRQYAGWSNDPVHEAVITTESIGHLQGDLLHDSAEDVATYLQKQNRYSTLHAEALYAQGVRAGYAKLVLSPLARFIKFYLLRRGFLDGGPGFAHVTVGCFAAFAKYAKLIELDKKL

SEQ ID NO: 2358 - protein, 245 aa, Unknown
  Description of Unknown: Deltaproteobacteria bacterium sequence
MTRLSATIIAQDEERDVPGCIESLQGFCDEILVVDGGSRDHTRELAARLGARVLERPFDDFARQHEFARTEARGEWVLSIDADERASPELRTAAFGAAAAYALPFKNHFRGVWLRHGGFWPDRHVRLFRRDACRYDPRRTVHEKLIVTGPIARLDAPILHYTYDSLADCLAKMERYGEQAARMLHAQGARAGAWDVAFRPLWRFVRGYLLRLGFLDGAPGAAMAWARAYEAFRRYALLWELSRFS

SEQ ID NO: 2359 - protein, 269 aa, Unknown
  Description of Unknown: Acidobacteriaceae bacterium KBS 89 sequence
MPRSTLSVAIITLNEEDNLARTLNSVRFADEIVVVDSGSTDRTVEIARSLGAKVFSEAWKGFALQKNSAIDKCTGTWVLSLDADEELTDELQAEIGKMLETDAQRSPQVDGYRLRLRHVFLGRWMRYGGYYPDLKLRLFRRVTGSGQAHFTDRPVHESVAVVGRVETMKNDFLHHGYPNLEIYLEHMNRYSTLGARIIADKGKTSPSWPAFCWNVALVPKLTFVWNYVFRLGFLDGREGLLLHLYHSAYISWKYAKAWQIGGVKGREKP

SEQ ID NO: 2360 - protein, 246 aa, Unknown
  Description of Unknown: uncultured bacterium sequence
MISTTIITLNEEDKIGRTIKNLKGLADEIIVVDSGSADKTVAIAESLGAKVFFREFDNFAAQKNWAVSKAKGDWVLAVDADEEIPISLAEEIKEAVKSDRYAGYLISRKNFILGKEIKYSRWSPDTHIWLWKKDSGKWMGDVHEELVVDGKVGLLKGSKIHHSHNTVSSFMKTNNLYSTLEALSLHKQNVRFSFGRMFWAAFFEFFIRFFYKWGFLDGKEGFVLAYIMGIYKLTVWIKLWELEQKR

SEQ ID NO: 2361 - protein, 266 aa, Pseudoxanthomonas sp.
MSLTSPHDPRPRISACIITFNEADRIGECLDSLAFCDECVVVDSHSTDATVAIAQARGARVLLRDFEGYRSQKDFAVRSAAHDWVLCLDADERVDAKLRAAIEAAREGGFAGAAGYRFNRLSDYFGRFLRHGNAYPDRVLRLFDRRRGGWRGQREIHEAASVEGPVRTLAGDLIHYPYRSLEQQLAKTQRYAQMMAEHEFARGKRASLAKLVVSPAWRFWRGYVFRLGFLDGWRGLVYAYVRANYVRQKAIMLWLLQHGQPLVKQK

SEQ ID NO: 2362 - protein, 254 aa, Unknown
  Description of Unknown: Acidobacteria bacterium sequence
MVPISAVLITQDEARHLPAALDSVRFCEEIVVVDCGSRDGTRRIAEAAGARVIVHEPWPGFVAQRNFAAQSARHDWLLAVDADERVSPGLRQEIQGRRAAGFTHAGYRIPRVARYLGRWIRGTDWYPDPQLRLWDRRRGRWEGALIHESVKVSGSVGRLRHELEHLTYEDIADHLRTIDSYTTLWARQAFAEGRRTGPLEAVAACAWAFFRNYVLRRGALLGSAGLTVSTLNATYTYVKLAKLLELQQGVVPGR

SEQ ID NO: 2363 - protein, 249 aa, Unknown
  Description of Unknown: Chitinophagaceae bacterium sequence
MQKISVVIICKNEAAVLGATLKSFSGLTDDIIVYDNGSTDDTKKMAEQYGAILMEGMWEGFGKTKNNAIASAKYDWILCNDADEAFDEVAKEELLNLDLADETIVYEFRFKNFLGNKWIRFGEWGSDKHIRLFNRNKVRWNEAAVHESLIFPNNYKKKLLKGFILHKTSATSFEFETKMRKYAKLSAEKYLRQGEKTSWLKIVLSPTFSFIKNYFFKVGFLDGKEGYQCARINALYTFLKYWELKNLHR

SEQ ID NO: 2364 - protein, 339 aa, Kineosphaera limosa
MNASSLVVIARDEERCLARALESAAPYVDELLVLDTGSTDATVEIALGCGARVEHFPWCDDFAAARNRALELASHPLRLVLDADEWVESGGEALARWGAVNPGRVGWVTRRDLVPDSSRAGVGPSVSVERLVRVLPSDVRYEGSIHEQPVHPDPAVASGLVLGHDGYLPAANTAKRGRNERLLRRALAGGFDPYLSYQLAKELEVQERYHEAVESYLVALERTPHEAAWRHPLVVRTLHLLTRTERFDEGVALFESERTRWSRSPDLFFAAGDLFLQMTATRKRDAGVLIELARTCWAQCLEIGDRPDLVGSVSGRGGALAQYNLDVVSGVTIGRGGVQ

SEQ ID NO: 2365 - protein, 251 aa, Unknown
  Description of Unknown: Planctomycetes bacterium sequence
MPSRSVVPVSVALIVRDEADRIGPALASVAWADEVVVLDSGSTDQTCAIAAASGARVVVEPWRGYGAMKNRAAEVCQHDRILSLDADERVDPDLAASIQALPADAPAAAWRVRRRNHVAGRAIRHWPWAWDRQIRVYDRRRARFVAAAVHESVCADGPVADLPGILDHLTYRDWQDGVDRNRRYAELWASAERAQARPSRWVDRKIRPAVAFWRHLLIRGHLLSGRDGWRWSQLTAEYVRWKYELLAEPQG

SEQ ID NO: 2366 - protein, 309 aa, Unknown
  Description of Unknown: Acidobacteria bacterium sequence
MLHSAFLTPHFAFCILHSAFCIPHSAFRISFRPPPPHPAPSRSLHSAFCILCILHFVKLPFVPKLSVTIITRDEAANIGPALESVAWADEILVVDSGSTDDTVALARRHTERVFVRDWPGFPAQKNWAGEQACHDWILSIDADERVSPALAAEIRALLASEPGPRGFRIPRVSHYLGRWLRSTDWYPDYQLRLYDRRVARWGGTHVHEGVEVPGPVGRLRHELQHLPYRDMSHHLRTIDRYTTLSATQMYEAGRRVSAPALVLRPAAAFVRNYVLRGGWRDGSVGLVVSGLNSYYVFLKFAKLWELGRK

SEQ ID NO: 2367 - protein, 253 aa, Unknown
  Description of Unknown: Chloroflexi bacterium sequence
MLSVVVLTLNEAKHLRACLESVRAFADEMLVFDSGSSDATIPIAREAGARTETRKFDNYAAQRNAALGAARGDWIFFIDADERADAAVGEEIRTETARVDSSGADEVLFWIPRRNFIFGKWIQHTGWSPDYQPRVLKKGRAHFDPLRPVHELVLAQGRELYLTQPLIHYNYETVAQFRSKQERYTRFEAREMFEQGVHPRLRSFVSMPVREFVRRFVTLRGYRDGLHGLLLSALMGYYAFRRQVWLAQMWRNV

SEQ ID NO: 2368 - protein, 255 aa, Halomonas elongata
MTPITGIIITLNEADNVADCIASLQRVCEEVIVVDSGSKDDTVSLAEAAGARVIHQSYLGDGPQKAFAVPQAQHDWILALDADERLDDDAVTAIQGLTLDDPRQAYRFRRRNFAGNHWIRAAGFYPDPVTRLYNRTTSGYLPKKAHSSVQAPSVVDLDVHIRHFTYRDLSHWITRIDQLSSRDAWAMKERGKPPSRYRPVLHALSATLRKLILKGGIFQGPDGFTVAMTTAFHAYMKYAKLNELHENERANSDDA

SEQ ID NO: 2369 - protein, 261 aa, Cohaesibacter gelatinilyticus
MDTQLPVSAFIIAKDEEDRILKAINSVKDWVDEVIVVDSGSTDRTVEIAKGAGAIVFFNEWDGYGNQKRFAEDQCRNDWLLNIDADEAVTPKLAQEMISLFTPAPEDDIYKVYIVDVFPHEKTAKDWAFGYWQYRLYNKGKGRFSESPVHDTVRPKEDVKLAKLSGRVDHYSQRSIQFSVEKLNRYSDMQVADMIKRGRSVSSWRLLTEFPLAFFKSYFARKAFLYGWWGVVVSVNYAFSRFIRIAKFYQHQLIEASKARN

SEQ ID NO: 2370 - protein, 358 aa, Clostridium sp.
MIVRDEEDVLGRCLDSVAGVADEVVVVDTGSKDRTRQIALEKGARVYDFPWCDDFAAARNFALEKGRMEYLFWLDADDVLLPADREALIALKGELDRSVDMVMLRYNTAFDQAGRPTFSFYRERLWRRDRGFRFEGAVHEAVTPRGRVIRREIAVTHQKLHRRDPERNLRIFEKEAAKGPLSPRQQFYFARELCYAGRLEEGERVLTAFLESGQGWVENQVSACRELARCLERQGQPERALRALFWSFAFDRPRAEVCCDIAGRFFDRGLWQRAMYWYRRALEIPFDPASGGFTEPDCYDFLPHIQLCVCYDHLGNWRRAEEENELAARSKPDHPSVQQNRAYFRARRQRETGTGKGG

SEQ ID NO: 2371 - protein, 288 aa, Unknown
  Description of Unknown: Methylobacterium sp. V23 sequence
MDPHSDPHSDPTAPIPLTVLIRTLNEADRIAAAIRSALPLHCEILVIDAGSTDATVSIAEALGARVVVNPWTGFGPQRRFGEALCRHDHVFSVDADEILTPEIVREIRGIFQRPAIPPLMIVRKAMVLPHHARPSPWAFCTENIYLYDRRVARTTDNPNWDKLAITTDAKPVTIRSVVWHHTFRDWNHAIAKSNYVGQLAADTQPIGSRFETGLRLVFEYPLNFLKFYVLRRFFLAGLDGFVMASVLAYGRFIRIAKMHEATRGQPSTGLPFLRRAKRPPADTRAGSG

SEQ ID NO: 2372 - protein, 339 aa, Butyrivibrio sp.
MVTISLCMIVKDEEDCLGRCLDSLKDLVDEMIIVDTGSTDRTKEIAKSYGAKVLDYEWKWDFADARNFAFAQATCDYIYSADADEELDEENQKRFRALKDDLCEFDIDIVQMYYCNQLSFRTVYNYDRELRPKLFKRVRPFIWEDPIHEQVCIDPVICNSEIEIIHRPKENHAGRDLHSFRRAINQGRRISKRLHNLYARELLMGGTPEDFIKSKDFFLRSALDNNRSLDEIKEACCILTHIGVLENDPLLILKYALKDAITEMSSEMCYELGEFYFGQGDVDEAIVWYYNAAYECESILDIKRSGTMPRLALAKCYRALGNEEQALDYEREAAELDEA

SEQ ID NO: 2373 - protein, 252 aa, Unknown
  Description of Unknown: Candidatus Fermentibacter daniensis sequence
MGLSVAIIALDEEDDLPGCLASVGFADEIVLVDSGSRDATASIAERAGARVLERPFDDFSSQKQFACDSTTCDWILVLDADERVSPCFGEAFSEALSSGEAAAYRIERRTSYLGRVLRFGPWSSDRPLRLFRRGSASFGAETVHESLRADCPAPVLRGAWIEHRPYCDVREHMEKMARYASLWAVQERARGRRATVLDILFRPQWRFFRGAVLQLGLLDGMPGLAASVSSAVYAYWKYLALYELSGRGTAPR

SEQ ID NO: 2374 - protein, 260 aa, Asticcacaulis sp.
MNHGTPTPLSCCIIAKNEGDRIGDCIRAVQGLVSEVVVVDSGSTDDTIAVAEGLGARVVHHDWPGYGPQKRYSEDCAANDWILNLDADEIVTPELFSEIKALMASGPSLNAYRFKIKNVYPGQKKPRLWADYHNYVRLYDRRVVRFRESQVHDTVDTRSEPVGQLKGAVMHYSARSYDHIRAKLDSYTNLQAKVLKKPAWTIWLRLPFEYPFVFIRYFFFRCHFTGGWDGIYSSHLAAEARAKRLLKILAAQKNADLTAR

SEQ ID NO: 2375 - protein, 536 aa, Unknown
  Description of Unknown: Chloroflexi bacterium sequence
MPRASSMGEAKRRAAGGSPRAAERLTLCMIVKNEAESIGRCIASVRGVADRVIVVDTGSTDGTPTIAERLGARVIHRNWRDDFSHARNESLNAARTPWVIVLDADEELAPGAAQPLRELVANDPAGPTLVFATVSSVDDAGGTQQTISPRIASNLPGLRYQRPVHEEWLWVGEGQLRQQVLPTIRIHHYGYTAAERTRQGKWDRNLRMLFDELAAKPGDLVTLFYLGQEYAAHGRLSDAIAVYEARLASMCAAFPPLVATHAVYGYVGALISAGLSARARAVSTEWARKVDSPTMWMQAANAALQDGDVEAAESLARTAHQSRGPAFGIDLLPRSQVVAAACVILGDAATARGNAVAGERLYRQALDTQADSTHALVRVAESTARGGDVEGARQILNDALAIRPRDPNMTICASRIDRAAGDLQAALDRLANFVADVPYLTSTRLELAETLIAGGENAIAADVLSAALDTPQLASSSAEFRANYFARYGDALTATGKLVEAVTAYQMAVDARLAAGPIPSSAGDRIGHVALAAATG

SEQ ID NO: 2376 - protein, 229 aa, Clostridium sp.
MIVKNEEEVLGRCLDSVAGFPDEILVTDTGSTDGTKAAAMERGARVFDFPWRDDFAAARNFSFSQGRGTYLFWMDADDVVRPDQRRKLLDLKERLGRADCLPDVVMMKYAAAFRRDGSLAAAFYRERLIRRGTGAVWKGRVHETVKPFGIIWKEDIWIEHRKMRIRDPERNLRILESMRKNGEEFGPREQYYYEMERAFARRCREAALENGQLLTQPRNERFVNGRYLW

SEQ ID NO: 2377 - protein, 301 aa, Frankia sp.
MLTALILTRDEERHIARAIESVKACADKIIVVDSGSTDRTVEIAVENGAEVLRNEWTNYATQFNWALDQLDSSPEWILRLDADEIVSEQLLAEIVATLPELGPEIAGLTVNRRMSFMGRVIRHGGLFPVQVLRIFRRNEGRCEDRWMDEHVIVKGGVRHLKGELLDDNLNSLTWWTNKHNSYASREVIDLLNLQYKFRPHDTVASLSGGEAGLKRWLKENIYTHLPGGARAFIYFVFRYVLRGGFLDGREGLAFHFLQGLWYRFLVDAKLLEVRRLIQREGVTPEDALKRVTGFDVAKRAA

SEQ ID NO: 2378 - protein, 467 aa, Hydrogenibacillus schlegelii
MRPTISLAMIARDEAASIGRAIRSAAPIVDEVVVGDTGSTDGTPAVARAHGARVIAVPWQDDFAAARNAVLEAVRGTWVFVLDADEGVVSVDRPALEAMLERPDVFGGVVEIRHHLGARPGAMLATDAVLRLFRRDPRIRYRGRIHEDVTPSITALPGARIVRAPVVLEHFGYLEPAVAAKRKNERNLALVLRAIADAGDDPRLWYALGTEWFQRGDVVRAAAALERAFRMAPPAAGYGPDLAMKLLFSLRQAGRLEEALRLTGEVLARYPGSPELWALAAELLLSAGRPAAALRAVRAAREAEAAHRSAESVGGWSAGRMVGSGTFVSDVLAGQAWEALGRPSCALRHYLRAVRENPRFLPAWGRFAAFGVRMGRVGPLVRAIRRYRDRWAPEDGIPSAILAACRTAAGTDPAAYAAIRQALGKALGEPAEAPEEPTPKGNRGFAEGKGGATVGEKAIMRAWDEDG

SEQ ID NO: 2379 - protein, 256 aa, Unknown
  Description of Unknown: bacterium HR11 sequence
MDWRDISVVMITLDEAERLPKMLNALPPDVGEIVVVDGGSTDGTPDVARQRGARVWVRPFTSFVEQKNWALARATRPWVLHLDADEVPSQDLLDEIAALDPPPDVHGYWVARRNFFWGKWVRHGGWWPDYKLRLFRRTSGRFVARGRRVHERVEVEGRTAYLRGYLIHETYRDLDDVQRKLRLYTTLSARDLYELGVRSRWWHRWVLPAWAFAYTWLLRGAWRDGRPGLWVAFLQAQTAWWKYWKLWELQRAGGWG

SEQ ID NO: 2380 - protein, 262 aa, Labrenzia sp.
MTDCLPLSVFIIARDEADRISRAIESVTGWADEVIVIDSGSTDNTVAVAESLGARVIHNDWPGYGPQKRFGEDQCRNDWLLNLDADEEVTPELRAEIQAKFADGSYRDADGWRVMIRDLYAHESAPAPWAYGYHQIRLYDRRKGRFSTSSVHDTVRPEEGATIASLKGIMAHRSIRSLDFQVAKYNRYSGMQVEDMRARGRKLPRWRLLSEFPVSFLKAYFVRRYLKYGWWGFILSVNYAHARFLRVAKAYEAELLEKRAGR

SEQ ID NO: 2381 - protein, 253 aa, Unknown
  Description of Unknown: Candidatus Schmidhempelia bombi sequence
MVNKISAVIITLNEEKNIGRCLSSLQGVADEIIVVDSGSTDDTQHIAMQYGAQFIVQPWQGYGKQKNIAAEKAKYEFILSLDADEALSEQLRSTLIAIKNQPMADAYQFNRLTNYCGQWIRHCGWYPDKKIRLWRKGMASWTTPRIHETIKLAGGVNAKPIQGDLLHYTYYTIAEHIAVANKYTTLVAQEYADRGKKPTLIKLFLSPIFGFLRDYFLRLGLLDGYYGFVICLVAAFSTFLKYAKLKQLLQEEK

SEQ ID NO: 2382 - protein, 268 aa, Marinobacter sp.
MKLPLSVYYITQDEELRLPESLAKLSGWVDEIIVVDSGSTDRTREIAEAAGARFVHNDWRGFARQKSFAESLCKHDWVLNLDADEVLSDEAVESLKAVFSSPIAKDVAGFSLIWVTRPPISGHPFRHDKHHRLLRCYHRDRAGFSSEEHSIHDRPEPYEGKVIALRGDVCHMTLLSLQQLEQKYCKMSSDQASHLVAKGRRITNFRLVIEFPLKFLRYYLLHKQILNGWFGFCVSIVSANRNFMRLAKAREIQLMKELKKSQPSRHSR

SEQ ID NO: 2383 - protein, 464 aa, Unknown
  Description of Unknown: bacterium CG17_big_fil_post_rev_8_21_14_2_50_64_8 sequence
MKRKTVSLCIIVRDEEANIGATIKSVLALVDEVIVADTGSRDNTSIIAEGYGARVVDVPWEDDFAAVRNRALATACGDWILVLDADEFLQSIRPVEFQRLLHDPSAAAYRVAVTDEEGRLLNRVPNCVRLFRNHPLLRFTYPLRDDLEAGLAAYCRETGHRVLESELVVVNEGQTPQRTSAARERDQRILRLARDSQPQEPFFAYLSGIQGLSLLDDEVLPTAGIKSSLEDLDQAWRLAVSWRGDVASAPAWLPELGCRLVSGRLAVGHTESARKIADELVSLYPHLPSVLLQSVAADLAHLVEIREARGSLEFRQCVARIDSLLDRISAQRIHAAASAVDNRRQALYPLHYRGRLALLEGMVSEAVTWFERALDLDPSYSFAWLGMAECCEFASDRKRALKLYLRTAAACPDNYRAWLQGSRLMRRMDCPGNAVTWWNRFCRSFPEHPAVKEPACEDADCQTC

SEQ ID NO: 2384 - protein, 344 aa, Butyrivibrio sp.
MVTISLCMIVKNEESCIGKCLDSLKGIVDEMIVVDTGSTDKTVEIAKEKGAKVYHFAWTGDFSEARNYSFSLAKGDYIYAADADEELDEENRERFLKLKEDIGELNVDIVQMFYSNQLAFRTVYNYDKELRPKLFRRVRNFVWVDPVHEQVSLEPVVCDSDIEIIHRPRENHAGRDLASFRKAINDGRKISRRLLGMYARELFMAGTDDDFLQAEDFFKKAALDNGRTIDEVKEACCVLAHVAVLKKDADQLLKFSLKDAITDMSSEMCYELGDFYFNKKDIDEAIVWYYNAAYESKSILDLKKNLELPRLALAKCYRELGNDEQADDYEREANDILNDLSSLS

SEQ ID NO: 2385 - protein, 258 aa, Nitrincola sp.
MEKLPISVIIITLNEADRITAAIRSVIDWVDEVVLIDSGSQDNTVELASELGARVMYNAWPGYGQQKRFAEEQAHNDWLLNLDADERVTESLRSEIAKHFEQPQKLADGYQIAIHDIIYPTEELNPNTPYKPVRLYRKSKGRYSDSPVHDRVIMQPDSQVEKLHGKIAHASIRSFAHRVEKMNAYSDAQVQDMVDKGRKPSVARILLEFWLSFIKRYFFKGYWRKGLIGYIYAINYAYSRFLRQIKLYEYYKNNQKNK

SEQ ID NO: 2386 - protein, 303 aa, Unknown
  Description of Unknown: Candidatus Gottesmanbacteria bacterium GW2011_GWA2_43_14 sequence
MISAVVHTLNEENNITRCLSSLSFADEIIVVDMGSKDGTVARVKETGARVYHHPYTGFVEPARNFALNKARGDWILVADADEEVPRPLSLLLAEIAGKNESAVNFYRIPRKNLVFGKWIKHAGWWPDYQIRFFRKGTISWIDKLHGVPITTGEGRELPQQEESALIHYHYQTVEQFLERMNRYSTIQAKEMYLSNRKFSLDMLMLNPANEFVRRFFLYEGYRDGLHGLSLSLLQALSETVVALKLWELSNFQQEAVNLDSFAKLADKESRLRKYWLYNELLKKKPGILRELIYRFMRKVASYA

SEQ ID NO: 2387 - protein, 272 aa, Stenotrophomonas sp.
MSSTTAPTERPRISACIIAFNEADRIGDCLASLAFCDEIVVVDSHSTDATVAIARAAGATVLQRAFDGFRSQKAFCVEQASHDWVLCLDADERVSDDLRAAILAAQSDGFTGHHGYRFARLSEYFGKFLRHGNAYPDRVLRLFDRRHGGWRGKREIHEAASVDGRVGVLRGDLIHYPYRSLEQQLSKTQRYARMMAEHEFARGKRATLAKLVLAPAWRFWRGLLLRGGFRDGWHGLVYAYVRANYVRQKTIMLWMLQHGQPVSDPPRRSDAA

SEQ ID NO: 2388 - protein, 370 aa, Nocardioides sp.
MANRARPKRRYPISVAMIVRDEEAVIGRCLASLQGLVEEIVVVDTGSTDRTIEIARSYGATIHHFDWIDDFGAARAYSLEQTTHPWRLCIDADEWIADRDAARELLDQVGQATPDFLGLVDVLQADEDGRIDDATLPVEIGRLLPRHVSFTGRVHEQPTPEIPAQRLHLLLGHSGYSAAALEAKEGRNLALLTAAVTADPTNAYLWYQLGSEFSARDRYEEALPHLVEAFNLTHPASPDVPGPEPRPWWHRLTLRLMIALTALGRHDESTAVGEMEAGRWSASADFQVVYGRAIRALAVSLPDEHAGVAEQLVLASLELWRGAVELGDRPEYAGVLAQRATVAAALLVADDYETLGRPEEAQRYRALVPA

SEQ ID NO: 2389 - protein, 264 aa, Unknown
  Description of Unknown: Acidobacteria bacterium sequence
MRPGRYTAAVTPLSAVLITCDEERNLPRALESVKFCDEVVVLDGGSRDRTRDLAAAAGARVETSIPWPGFVQQRNRALAAASHDWVLAIDADERVTAELRDEIRAEAARGFAHAGYRIPRLAFYLGRWIRGTDWWPDPQLRLFDRRRGRWEGNLIHESVRVDGSVGRLRARMEHFSYDDISDHLATIDRYTTLWAEQAAQEGRRSGPLDPAFAASWAFFRNYVVRGGVLLGEAGLTVSALNSYYTYVKLAKLRERLDGAGPPRT

SEQ ID NO: 2390 - protein, 271 aa, Unknown
  Description of Unknown: Gemmatimonadetes bacterium sequence
MRTSRCSPSNVPINIGNMASPAPLTVVIPTLNEASQIGDCVRGLSWTSEVIVVDAGSKDGTVASARAAGARVLDAAEPGIAAQRNAGIAAAKNEWVFALDADERIGPALATELAGVVIAPRHEAYRVKRRNVFHGEVLRRGHWGHDWVLRLFRRERRFGGKAAHPGLQLPATAAPAIGALTNELDHTPYRDLGHHLDKIVLYGRLGAAELAAKGRRASFSDVALRPAFRFWRDYILHGSILDGRLGVIHAGMSAASVFFKYAFLWERQRSG

SEQ ID NO: 2391 - protein, 303 aa, Thioclava atlantica
MLTVVILTRDEERHIARAIGSVTGIAERIFVADSGSTDRTVTIAEALGAEVRFNPWRNYATQFNWALDQLPQDTEWVLRLDADEIVTPELAREIGAQLAGLGADIDGAWVSRRMTFLGRPIRWGGVFPVRVLRLFRHGRGRCEDRWMDEHVLVSGPTADFSGEIVDDNLNSLTWWTAKHNAYASREVVDLLNLRYRFMTHETVADLRGGKQAEVKRWIKEHLYARLPGGSRAFIYFVYRYFIRLGFLDGREGTAFHVMQGFWYRFLVDAKLFEVERHMQRHGSDAPAAIKAVLGIDVTPDRNR

SEQ ID NO: 2392 - protein, 271 aa, Bosea lathyri
MPPISIFIIARDEADRIGRTIMAARGLSDDIIVVDSGSTDGTQAVAEQLGARVVFNAWPGYGPQKRFAEDLCRHDWMLNLDADEVLPSDLAAEIAALFEGNGPGADAYKLRIAEIFPGEQAPHRFAYALAPVRLYRKAKGRYSPSPVHDRVDLDPDARIGRLKGTVHHYSVRSLGEQMEKLNAYSDAQADDLDQRGVTVSAFRLVVEFPANFIKAYFGRRHGLRGVYGFMTAMNYAFYRYLRVAKHWERRLQRRSPPKAALPPANRESRDV

SEQ ID NO: 2393 - protein, 254 aa, Unknown
  Description of Unknown: Deltaproteobacteria bacterium HGW-Deltaproteobacteria-1 sequence
MALEKPKISVAIIAQDEADRIGNLLKSLSFADEIVVVDSGSTDGTQDICREAGARVISNAWPGYVAQKQFALEAANDEWILCLDADEEVPAELATEMCEAVSAAGMDTCGFSMPRLSRYLGRWIRHGGWYPDRKVRLVRRGRGKWQGVNPHDKLVVEGGVKHLTNPMLHYVYRGISDQVVTMNRFSEIYAGQGHPLGGWFVAAGLVHAFGKFLECYLWKLGFLDGVPGLVIAVNSAEYVFLKHAKRWEKSLPRK

SEQ ID NO: 2394 - protein, 264 aa, Marinobacter nitratireducens
MKLPVSVYYITQNEEVRLPESLDKVADWADEIIVVDSGSTDRTREIAEAAGARFVHNDWQGFSVQKAFAASLCRNDWVLDLDADEVLSNELVENIKACFAHPISDDVAGFRMRWVLSQPDPRHPFRHDKSKKILRLYNRTRAAIQPERDSNDDRPRVRDGKVLELKGDVLHRTLISLEQMEKKYCQLSSEQARHLVAKGRRISSARLFVEFPLKFLKYYLIHRQILNGWFGLSVAITAANRNFMRLAKARELQMLEQLEKDARS

SEQ ID NO: 2395 - protein, 265 aa, Bosea sp.
MPPLSIFIIARDEADRIGRTIAAVRSLSDDIVVVDSGSTDGTQAVAAELGARVITNPWPGYGPQKRFAEEQCRHRWLLNLDADEVAPPELVNEIAALFATGEPAEDAYKLRIAEVFPGEGAPHRFAYALTPVRLYRSDKGRYSPSPVHDRVELQPGVRVGRLKGTIHHYSVRSLGEQIAKLNSYSDAQADDLDQRGATLSALRLALEFPGNFLKAYIGRRHALRGVYGFMTAMNYAFYRYLRVAKHWERRLQRRGERHEGGHDGR

SEQ ID NO: 2396 - protein, 278 aa, Marinobacter santoriniensis
MTRKLPLSVYYITLNEEERLPESLASVRGWVDEIIVVDSGSSDCTVDIAEQFGARVVYREWEGFASQKAYAASLCRNDWVLDLDADEVLSDELAANIRSLFSRPVSSDIAGFRMRWVLSQPDPRHPFRHDKTKKILRLYNRKKAVINAVADSNDDRPKVLDGEVRDLKGDVLHRTLISLEQMEKKYCQLSSEQARFLEATGRHISSGRLFVEFPLKFLKYYLLHRQILNGWFGLSVSITAANRNFMRLAKAKERQMLAEFARQDRASEVSVPPDQAAR

SEQ ID NO: 2397 - protein, 739 aa, Lautropia sp.
MLLVNVAHGLLALYLLTLLAVPKVQTPLVALTCLLAIIGGQWLKAPPLGRRLREGWAMAVPLVGYATLFAVQIEMGWLRWRDWDQVLICALGLGVLLSNLPARGPAVHRWLLPAAALGAVGALGLASWQYFQLGIPRPHGHLGAGVVGSGALKYGDLSAVLALFSLQLVLRGPQVWRRVLGGVGFMAGLGAVALTQARGALLGVALALAVLGLLWWLRRRAQSLAGTESGRNGREGRRPWWRQRQAVLAAVLGVVVLAGATDYMGARFADIGPQYERFQAGDNNSEVGQRLALWGIALRAARHAPFTGVGFDGFGAETQRQRDTGELARDALVLYQGPHNEYLAGLSAAGIPGLIVIVLFFWAPLVVGCRRFLRGQQTETALMLVLFTASYAAFTMTDSLLDRQISLLAYVLLASWLMSASGPAAAAADFVGMGRPKGGAGNIAPNVAAVSAGTVTTADGLSVPGGLSVAIIACNEAHRIARCLQSVAFADQVVVLDSGSTDDTVAIARGLGADVEVTPDWPGFGPQKNRALARCRYRWVLSIDADEQVSDALAAEILRVLREAPAEATVAGYWLRRSSRYCGQVIRHGLWGNDRVLRLFERQRGRFTDARVHESLVCDGETRVLEGILVHDSVDSPEDARSKARRYAFLGAEALRARGRGGALQGGVHAGWSFVRGYLLRAGFLDGRFGLTLARLNAAGTFWKYHWAALPEAKWEQLRASLSASEPNASFVPNARSSP

SEQ ID NO: 2398 - protein, 489 aa, Unknown
  Description of Unknown: bacterium DOLZORAL124_64_63 sequence
MVARNWNPTRQPREPALSRPDLSLCMIFRDEETMLPDFIASVEGLWDELIAIDTGSTDRSAELLRTAGAQVRKFTWRDDFAAARNASLEPATGRWILFLDADERPTPELRNQIRALLRDPAAGAATLVMRNEWPDGTVRRSHLLRLFRNDPAIRFRHRIHEDVHDAIHDYLPRHGLTLRHLPGTVHHLGYTREVARNRDKKERDLALLRLSLQEDPRDFYCWFKVMEIARFWGDEPLWEETATQVVELLAGLTAQESTRLRAHRFSGELVALAAARLPGDDTARLAWLEQASTHAGGRTDAHPALEMRRGLLLENLGRLEEAAEAFTRALDQSRARGDQELRPRLALCRLALARGDLPQAVDQIAAAVALNPHDPEARLAALSLGRNLVGNGVVDAAAHILEPLATADPEAAIGYLVCCLCLDKPVDLQVDVTAQQAEILLKTWVRRLWESRQVPRLEAFATASGSIAGLFPWLPSFLAAETARLQTPA

SEQ ID NO: 2399 - protein, 257 aa, Ralstonia sp.
MSASNRATLAVIIVAKNEAADIGDCIRSVRDWADDVIVFDSGSTDGTQDICRELGARVFETDWPGYGEQSNRALREARTDWVLSLDADERISPELRAEMIAVLESGSSHTVYSMPRSSSFCGRFMKHSGWWPDRIRRFFKREQVTFFDAPVHSHLVFQGTVGDFRAPIIHYSIPDLRAALDKANDYSTAGAAAAYAKGKRASLGSAIGHGLWAFIRTYIIQRGFLDGAEGFMLAVSNAEGTYYRYIKLMMLHRHGKR

SEQ ID NO: 2400 - protein, 374 aa, Paenibacillus sp.
MTDNIRLSLCMIVKDEAKRIADCLQSARQLVDEIVVVDTGSTDDTPAICESLGARVLSYPWHDSFCDARNFGLAQAGGEWAMWLDADERLNPAEHTLIRQALDDPIFDVISLSIINYYGDNLEQVNVNHAHIMPQARLFRLGRGIRFAGDIHETVTLPPDYDTSRIKKLDASVHHYGYMEPIIREKAKHERNTSLLLKQVEQPDHNPWFDYHLAAEYYRVSSWQTALDYVNRSILGFLQNGSLPPSLLYKLKYDTLLRCGSIRSAWPGILRAIQLYPDYVDLHFYKGIILMHMDMAAEALAVFEHCLELGEQPTSYLRLKGLGSFYALHYIGRCLERLGRQAEAQLYYAKSGLEPEDIFSVVAAAADMPDSSSD

SEQ ID NO: 2401 - protein, 362 aa, Paenibacillus contaminans
MITISLCMIVKNAEDTIGDCLASVRGLVDEIVVLDTGSTDSTESIVRSYTDRIYRFAWIDDFAAARNESFRYASCSHILWLDADDVLLEEDRGKLLELKQTLSPDVDSVTMIYHYAFDEYGRVTVSLRRNRLIKRENGFRWHGAVHEYLAVSGKIEDSGIVVTHKRRHRQGGRNLAIFERKLENGETLTSRDRFYYANELTDNRHYEKAAAIYRELIEKNDGWSEDLLTSCGRLADICEAEGDDEEALRWALHSFAYDIPRAEFCCRLGYRFLQENRLTQAVYWYKLATELRKPEQSWGFFNDACWTWLPHIQLCICYYRLGDYPEAYRHNEKARAYRPDDPAVLSNKALLEGAFPHVFPPS

SEQ ID NO: 2402 - protein, 277 aa, Unknown
  Description of Unknown: Phyllobacterium endophyticum sequence
MSISVLIMTLNEEDSLPACLASLTWCDDIVVLDSYSTDRTLEIAKAAGARIFQHKYETETKQRMYGLKEIEFKHKWVYMPDADEITPDDLRDEMLAIAADPDRPEAMFSARYKNMFMGRWIKHSSLYPTWITRLCRPERIQYERECHSRPVGDGPTGRLKSHFVHYSFNKGMTAWFDKHNRYSGFEARESLQILRSKKIPWTSFFSATPEARRRALKELSYRVPFRPAARFAYMYFLRGGFLDGWQGYHYCRLIASYEYMIVIKMRELQRRELGLSV

SEQ ID NO: 2403 - protein, 253 aa, Unknown
  Description of Unknown: Xanthomonadaceae bacterium NML93-0831 sequence
MSIPAPAVPLPISGVVITKNEGDRIGRCLDSMRGLCAELIVVDSGSTDDTVAVATAHGARVVHQDWLGYAAQKTFANTLAAHAWLLLLDADEWLSPGTEAKIRVLFAQGRVESADAWLLTRRNWFLGHRLRGGEPMERLVRAGWRYLPSQVHERPDLEGKTIATLDADFEHDTSRSHAEHVAKLSKYAALWAGQRRDAGKRANALDGPLHAAAYLLKQYLLRGAWLDGAPGWRFHRAQAAYVLEKYRRLRAMS

SEQ ID NO: 2404 - protein, 495 aa, Desulfosporosinus sp.
MMTKDTVSLCMIVKDEEDSVLAAIESVRDLIDELIVVDTGSKDKTPLVALEAGAKIFTFNWTMNFSAARNFALQQASSNWVLVLDADEVLEPINSETFMTLLSDNQVEGYYFRIKSVLDSMANESFDQVVRLFRNKQDYQFEGAIHEQIAPSILKANNGCGLASVPFTILHYGYQKDRLEIKEKFNRNSQIILQELKSTPDNPFLLYCLGLEYYQQNSILKGLNYLTESLTLLTGNEGYFEDVLLNIALGYLRLEKTLELNDFTNKVLSMFPNQADFLYLRGLAYLQNENFLHASADFEQSLCLETNTLATLYQVSCLLGDAYQSSGKFPLAQDAYNRALGFKPCSSYPLQQLIGLIRKGYPVTSLLNRSLVFKNWPNFKSWHIGLNSLINIGIEPHLLMLFLTLHRTINTVSYSPDELSPFIKYILKITPGQKSYSSLDTIQNVSSLALRLVLNEILINCMALMKNMEHDNFKLITKMNKTIEQAISILCFRSI

SEQ ID NO: 2405 - protein, 265 aa, Salinarimonas rosea
MPPLPLSIFLIVKDEADRIGATLDAVAGLAAEVVVVDSGSTDGTRAIAEAKGARVVHHDFAGYGPQKRFAEEQCSHPWLLNLDADEVVPAEMVAHIRALFAAGEPDKDAYTTRIAEVFPGEEDVHPLAYALAPVRLYRRDKGRYSASIVHDRVDLAPGARVGALHGTIRHRSVRSLGDQIAKLNAYSDRQADDLEARGATIPTWRVFVEFPAAFLKAYVVRRHAVRGVYGFLTAMNYAIARHLRIAKHIERRRLAGRRDEARPDG

SEQ ID NO: 2406 - protein, 251 aa, Unknown
  Description of Unknown: alpha proteobacterium MED-G09 sequence
MNEKLPISCFIIALNEADRIDKTIKSVKDLVDEVIVIDSGSNDGTQKLAEDLGCKVFYNEWNGFGPQKRFGEECSKNKWLLNLDADEYLSHEISNEIRDLFRANLEANFFSMRVIPIYPNWTKPRFLSAYHLCVRLYNIDYGRFSNSKVHDSVETNSQKVITLINPVFHKSVRSFKHLIIKENNYIKMQASTLKKSNKFILFFRLLVEFPLAFIKYYLIRRHFTGYFTGFFTAVILAFFRWKRIILFLKTK

SEQ ID NO: 2407 - protein, 272 aa, Unknown
  Description of Unknown: Flavobacteriales bacterium sequence
MEPNAGISVVIIAYNEANKIGDCIDSVIGIANEILVVDSFSTDDTPIIARGKGARVIQHAFEGHIQQKNWAKDQASFDWVLSLDADEYLSAELQERLTLAIANGLTFGKVKGYAFSRLNHLANQPIRGCGWYPDTKLRLWDRRCGCWSGRNPHDKFVLEKGYALGSISGDILHFTYADLTAVKQQALKFGKIGGQALKHEFTNHPGYFIQRRGLDFYLLFKLLTAGFARFIRNYLLKGGWKFGYNGLLICFWQSVEVSYKYGFALFGKVSNK

SEQ ID NO: 2408 - protein, 271 aa, Luteimonas mephitis
MNASSRPRPAISACIIAFNEADRIGDCLASLSFCDEIVVVDSFSTDGTADIARAAGARVLQRRFDGFRSQKAFAVEQARHDWVLCVDADERVGDTLRGSIEAARRAGFDDAAGYRFARLDHYFGRFLRHGNAYPDRVLRLFDRRRGGWRGSREVHEAASVDGPVRTLAGDLVHFPYRSFEQQLAKTQRYARMMAEHDFARGKRASLGKLVVSPAWRFWRGYLLRGGFRDGWHGLVYAYVRANYVRQKTIMLWLLQNGQPLATPAPPAASND

SEQ ID NO: 2409 - protein, 257 aa, Paenibacillus sp.
MARQLRLLVGTRISKPKQVPMPYRHLFFIRSQGESTLSQPISACIMTKNEQDNIGACIDSVKPYVKEIIIVDTGSEDDTVKIAISKNVRVHQMEWKNDFSIVRNEMIKIATQPIILMIDADERVLPNQEESFRDTCNLLFDDHDKIGRVTILNEQENKETLKSSISRIFKNSSSFSYAGAIHEQIQSESSNTTYFQSGITLEHKGYLNSSLIAKDKYERNLSLLFNELKNARNGSYINFQIGRTYYVMGENKKLLII

SEQ ID NO: 2410 - protein, 296 aa, Yoonia tamlensis
MTALTVIILAKDESLHIARAIGSVAAIASRIIVVDSGSTDDTVHLAQQAGAEVLHHPWINHATQFNWALAQIAGAPGWVLRLDADEFVTPQLAEQISAGLPDVAGIYVNRHVHFMGQPVRWGGVFPVRVLRLSRNGAGRCENRWMDEHIIVDGPTAMLAGAIVDDNRRSLDWWVAKHNQYASREAIDILNQIYQFAPRETIGQLRGGQQAAIKRWIKENIYARLPGGARAGAYFFYRYVLCLGFLDGRQGRAFHVLQGFWYRYLVDAKLAEVRRHMAAHDCTPQDAILSVLGIDLG

SEQ ID NO: 2411 - protein, 270 aa, Thiomonas sp.
MSTNTATAVSAILITRNEAHNLPACLAGLAWCDEIVVLDSGSTDETVEIARRAGARVQTSSDWPGFGPQKNRVLELARCDWVLSVDADERVTPELAAEIRATIAGADPCNAYAIARLSSYCGQFMRHGGWYPDRVVRLFKRGTARFSDDIVHESVQTHGRVGRLREDLLHISYRSFEDVLDKMNHYSTAGASKAAARGRSSNLLSAWLHSRWAFIRAYILRLGFLDGRLGYVLACSIAHETWYRYVKLWHRPHENLLKDTLDAAPRTERR

SEQ ID NO: 2412 - protein, 251 aa, Kangiella spongicola
MSKIPVSVFIVAQDEEQHIGRVLDSCQAFDEIIVVDSGSTDQTKSIAQSKGAKVIHHDWPGYAKQKQYAKDLCQHEWVLNLDADEELTPQFIDEVKQFVSAEHDYVALKCRRNDLFIGKFFSTLTRLPTNTRFFKKDKVAYRVEDLVHEGPDIHGKTKQTSVAFNHYGYADIAQLTDKYNKYSSLKAKEKYLKGKKASALKLLLIYPLEFIRNYLVYRYCFSGLRGFIFSHLAAYYALSKEAKLYEFNKSS

SEQ ID NO: 2413 - protein, 510 aa, Kineococcus xinjiangensis
MHGDEVFISGSYIVKDEEELLGGSLDALRPFVDELVVYDTGSTDATRDVARAHGARVVEGYWDDDFGAARNRALEHCAGEWVVIVDADEVARGNPRALRRRLRLTPADALSVMQVSHTWQGAGVGLSVWSVRVFRRARCRWEGAIHERVVGRWGELSGEQTTDLELDHSGYTPVRTRERNKGGRNLRVAERELADALARGASDTWRFLINVARSGQLEGDPSRSLEALALVDRAAVAPQQGILAGHTALGIAVANADMALGLDWLASMAQWGESPDVLRAMEGQLAMATGDLQRAEALLRPYVESGDQGGVVLTDLSFTDSLIDCLWLQDRHEESVELLLDHLATGKSHIAAAVVLARVHESRTDSRRLVDALPESLVLPYVGQLQATGFAYGEPFFEAMWDAGRARTAVLVAISGLGGSLPFEKALLWSLRMREAGLGEHCPLWRILRSTERDDRTRIMCGAALVEIGEEAALPLLEPLLARVDDDAAGALVEELRQFAPGFTAALIAG

SEQ ID NO: 2414 - protein, 250 aa, Paraburkholderia sacchari
MVVAMNEAHDIRDCLESVRGLAMETIVFDSGSTDGTPDICRELGARVFETDWPGDGPQKNRALAEARGDWVICLDADERLSPELRTEIATLLAQGSTHAAFSTPRRSSFCGRFMKHSGWWPDRIVRLFRRGSARFTDVRTHTHLEIDGTTGRFDGPFIHISMPDLHEALDKTNVYSTEGALTMAEAGKRSSLAKALGKGFWAFFRTWVLRAGFLDGAEGLMLAINNAETTYYRYVKLALLTRDGKVAKKR

SEQ ID NO: 2415 - protein, 261 aa, Labrenzia sp.
MTNRLPLSAFIIARNEADRISRPIRSVIDWVDEVIVIDSGSTDDTIAVAEKLGARIVHKDWQGYGPQKRCGEDQCRNDWLLNLDADEEVTEDLATEIRAKFSDNSYRDADGWRIMIRDMYAHETEPAPWAYGYNQIRLYDRRKGRFSDSSVHDTVRPVDGATIANLSGIMAHRSIRSLDFQVGKYNRYSGMQVEDMRTRGRKLPRSRLLTEFPVSFFKAYFVRKYRKYGWWGFILSMNYAHARFLRIAKAYEAELLAGKQR

SEQ ID NO: 2416 - protein, 274 aa, Unknown
  Description of Unknown: Planctomycetes bacterium sequence
MNSVSTTNTGELSLERLPAPPLPITALIITLNGATHLGRVLSSVAFCHERLVIDSGSTDNTICLAEAAGARVLHQPFLGYGPQKQAGVELAIHDWILSLDDDEVLDAEAIAAIKRLDFSDPSACWSLRRRTFIGNHEIFYGPWRNDRVVRLFNRHTAAFKPLWVHEEVAYQTPPKRLPGSIQHFSYDHLSDVIARSVSYAPLKAEIMQEKGERVHFWKLPVRGLATFVRCYFLQGGWRDGARGFVIALSRVIDSTLPRAILLEAEGVKAKRRTP

SEQ ID NO: 2417 - protein, 268 aa, Unknown
  Description of Unknown: uncultured Pleomorphomonas sp. sequence
MVLPIEGISMSPLPLSVFVICKDEADRLELVLEALAGLTDDLVIVDSGSTDGTLDIARRYTTRVHHRDWTGFGEQKVYAEGLCKYDWVLNLDADEVLLDEVKASIRAVFALPEEARAAAYSLRIRHVSRLAPSLRPGFFNPTNVTPRLYDRRRAGFKSSAVHDKVEIRDGGKPVTLKGDVAHISMKSFAHMWDKIRSYSELSARDWAEKGRNPSVARLIADPVWFFVKNYFIRRLFAVGAEGFVIAISLSAGRALRIAMTWEERRKGA

SEQ ID NO: 2418 - protein, 267 aa, Chelatococcus asaccharovorans
MSTTRRTLPLSVFIIARNEGDRIAATLRALRDLTDDLIVVDSGSTDDTVAVAERLGARVIHNDWPGYGPQKRFAEEQCRHPWLLNVDADEVVPADLAAEIAALFARGEPDADAFRIRIAEIFPGEGKPHPLAYALSPVRLYRSDKGRYSPSPVHDRVQLVAGARVKRLKGTIHHFSVRSLGDQLAKLNSYTDALADDLDARGEKVSTLRLFVEFPAAFLKAYIGRRHAIRGLYGFMTAMNFAFYRYLRIAKHVERRLVSRARDEGRL

SEQ ID NO: 2419 - protein, 714 aa, Paenibacillus sp.
MLLGVHIIVRNEEDMLPECLDSIRGIADELIVVDTGSTDGTVDIALRYGARVIKAEWKDNFSSARNLALEHARTIWVLVLDADERLKGDSQSLRQGLRKAASPAYRLRMEHLLDGSNTGRSMTSEAVRLFRADRGYVYHGEIHEQLVRVRETEDGAVLKDVDGPLCAGDSHIAHIGYMPDVLQRKSKAERNLRVISRQLTKRPNDPFCLYNYGVTLCQLGKAEEAAVAFDKALGYTPLSAPYRPTLVRDYATTLLALSRNGEAAELLRGETLRYPDYPDLYLLQGNSLSAAGMLLEAKAAYEAAIEAGSRPHSYISENGAGSYQAQLRLASVLQRTGEAEAALLAYEALLGAKPGWEEALLALADYLQQLGVPDQEIRQKLSSFTGNDVADPHKLMARVLSRIGANSMALPLWREVVQSTSVSTAGAPMPEQLPWCDIRGFADCLIGTGQYAEAASQIRSWLQAAQPSADAEPSYEILQLGMDWALCRWNDGLQISREELAAVLGGGRLAHEAEHLNGWLPAAQGPQNKIAKEQELAAAARWLDTAVSRGMLRLAHRLAGGFYGLRPYFETLLYDHGYVDAAAEQMLDRFEKEGRLTGEQSFRLGELLYLKKLHNEALSLFDSSAESDKSGVYAERARLGAAAACLQLAIEALQPDEYSGTRNWDGSWSEPDRMKLQEALLRVEWMSWQTSWNGRQRRRVNGGTAEADFLMYDR

SEQ ID NO: 2420 - protein, 272 aa, Unknown
  Description of Unknown: Gemmatimonadales bacterium sequence
MQTALLDTGVGARPSEGHRISACLIVMNEADRIGDCLASLDFCDEIVVVDSHSTDATRELAAAAGARVIERDWAGHRAQKQFAVEQATHNWILALDADERLSAELRKEIMDLRETNFMGADGWSMPRLSHHLGRWIRHGSWYPNRQLRLFDRRHGQWGGRDPHDRWETQGSVGRLHGDLLHFPYRSFDEHLQTLAGYASISAARMHEEGLRANVFDLVFRPPLRFLRGFIFKRGFLLGWRGLILALLDAQSAWLKYTRLMLLARDQDQDSQL

SEQ ID NO: 2421 - protein, 783 aa, Unknown
  Description of Unknown: Clostridia bacterium 62_21 sequence
MKAGTISLCLIARNEGENIGRCIESAGDFVDEIVVVDTGSADDTVEIARALGARVIEAEWKGDFGAARNVSLDHAGGEWIFFLDCDEELAPESGPELRRVIQNTRYEAFFVLVTNPTETGIELTFPSIRLFRNRKCFRFTGRIHEQIVNSIVQHCGQHCIGETRITVIHRGYDTRFANIRAKILRNLAILNTYRDDEKDGFFYYNLGTEYLRLGERKKALEHFVIALGLTKPTQTYGPILVKRAMTTLMELHRYRDAVRQLRYYQGIYTEFSDLVLLEAVCHLNCGRYSAARSRLEDYLAMPPPPMWYPTEKVWHGSSAQEFLDRVRGLSIGEGRPSLSVCIIGRDEAGLVGRSIQSVNEIAREVIFVDTGSTDGSAAVAYQMGASVYHCPWDDDFAAARNFAIGKAGSEWILVLDADEVLPDESRKGIIDLLRNPRHEGYVLKICTFLDRRLSPANCQVKGACRLFRNKRYRYRGAVFEDVTRSIVTSGGALTPVDIAIHHLHCLAEDETIARKRKWKAAAIARGLAGRPRKLAYARGVEAFYARDFALAADQFARAGNIGGAHRSDFYYFYALSLVNLKQYFLAVGLLDEGVRLFPDYTDLFYLKAIGHFMQGETDRAEALLCRCLAMGDAPWEKYVASPGAGSFLALCTLGTIYAQKGDINNALAMFVRAAGMPGAYEEALERITFVCRRLSVPPEHFLEKHGMRNSRSLSTASRALTKMGRFGESLRYLDLAGRLVAQEPPPRDFGHILQALDFLLAGFSRHIARGLPENSPLRSQLVI

SEQ ID NO: 2422 - protein, 258 aa, Unknown
  Description of Unknown: alpha proteobacterium AAP38 sequence
MSGKLPLSVFIIALNEADRIGPVILSVRDWVDEVLVVDSGSSDGTPELARSLGARVIHHDWPGYGPQKRFAEEQCRHDWLLNLDADEVPEPALEPAVRALFAAGQPVLQGYRIRTVMTLAGQKRPHRFAPRHNYVRLYDRRHGRFADSATHDAVEMHSGRVGALSPIIAHYSIRHHGDLIAKLNRYSTAQAEEIVARGKGRRYGAFRAMTEFPVNLVRYFFLKGYWVFGLYGLELAAIIAFFRFARIAKVREILRRPS

SEQ ID NO: 2423 - protein, 252 aa, Unknown
  Description of Unknown: Bacteroidetes bacterium sequence
MKIKISAVIITFNEERNIGRCLDSLQGVADEIIVVDSFSSDATEEIVKSKGATFISHKFEGHIEQKNWAIRQAQYPHVLSLDADEALDEHLRKAINTVKENWQGEGYYLNRLTNYCGKWIRHGLWYPDRKLRLWDSRKGAWGGQNPHDTYILEEGSRSQHLSGHLLHYSFYTFEEHLKQIKKFTDISSAAAFKNGKRSSWLKIVVSPSLKFVRAYIFKLGFLDGKAGWTIARWSAYATYLKYTKLKALNHGQ

SEQ ID NO: 2424 - protein, 271 aa, Marinobacter pelagius
MKLPLSVYYITQNEEKRLPESLEQVHDWADEVIVVDSGSTDNTVAIARSFGARVVHRPWEGFASQKAYAASLCRNEWVLDLDADEVLSGQLVANIKALFSAPLPEGVAGYRMRWVLSQPIPGHPFRHDKTKKILRLYNRSRAAIHAEKDSNDDRPRVLSGKVLDLKGDVLHRTLMSLEQMERKYCQLSSEQARYMAARGRKISSGRLFVEFPLKFLKYYLIHRQILNGWFGLSVSITAANRNFMRLAKAKEIQMLAELEASGKSDAQSSGA

SEQ ID NO: 2425 - protein, 278 aa, Unknown
  Description of Unknown: Candidatus Fermentibacteria bacterium sequence
MLPDLLRTYGFFSWQLFQVAQRTLLCYFASMKLSLAVIALNEEDRLASCLDSVPFASEKVVVDSGSTDSTASVAEKCGARVLKRKFTTFSEQKQFALDNCTGDWVLVLDADEALSSELALEIQKLVKKNSQIAYRLHRRVRYMGRLLKYGPWKGESVLRLFPGGSSEYDSSSVHERLVPSVPVVLVRNGWIEHRTYRSLSEQFETTGRYASLWAEQKSAAGVRSSILKIALRAKWRFFSAYFLQLGFLEGYSGFMASVMAAVSVFIKWSILREKQCGR

SEQ ID NO: 2426 - protein, 252 aa, Luteibacter yeojuensis
MAREPLSVVVTTFNNADTIGACLASVAFADEVVVLDSGSTDATRAIAEAASARVHVQPFAGYSAQKQAAIDLATHRWVLLLDSDETLPADAAARVRDALVEPTVAGYEMLRREWVFWRWQPARARLNHYVRLFDRGRARMSGHEVHESVVVDGPVRRLAAVIDHHGERDIEGRVDKANHYSTLQVRDRHTREPGALRLRMVAYPTVAFFRYYFLRGHWRGGWAGFIAARVHAFYAFLKYAKLYERRVSRRRG

SEQ ID NO: 2427 - protein, 279 aa, Unknown
  Description of Unknown: Methylosinus sequence
MSFLDHVAVLVLTLDEAPNIGRALEALRDFPEIVVLDSGSRDDTLRIVAAFPNARIAQRSFDTHANQWNYGLFRCGIERPFVLALDADHIVPPALVEEIAHLSPSSATCGFRARFRYCVFGEGLSGALYPPSIVLFRRERCHYIQSGHTQRLVIDGAVVELVGVIDHDDRKPLARWFGSQQKYAALEARHLLGTPRDRLRLSDRIRRLGWLSPWLIGLYTLVVKRCALDGWRGWFYVLQRVLAETLIALEIIDRRRRVEATVIGQERRGVGAASAKKGR

SEQ ID NO: 2428 - protein, 249 aa, Herpetosiphon geysericola
MLLSVAIIARDEERHIGAALASIANVADEIVVLLDPRTSDRTAELCTQAGARVIAAPFESFPAQRNRALAECKGQWVLFLDADERVTPSLQHEIRQLLPSQPSHAGYWIPRFNRYWGRALRGGGWYPDRQLRLLQRAKAQYDPSRLVHELVILAGSEGQLSQHLEHINIESWAELREKQQRYAQAEAATLYRNGVRVKPQNYVLQPLRAIWRRYVTWGGYRDGFLGMLLALVMGWYEFKMYLALAKHWG

SEQ ID NO: 2429 - protein, 262 aa, Marinobacter pelagius
MKLPISVYYITLNEEQRLPESLERVRGWVDEIVVVDSGSTDRTKEIAEAAGALVVHRDWEGFALQKSFAESLCRNEWVLNLDADEVLSHKLVESIKARFSTPVPSDIAGFSFRWVIRPPMPGHPFRHDKTHVLLRLYNKKRASFVSERHSIHDRPEPHTGRVEKLKGDVYHMTLISLEQLEKKYCKMSSDQALHLVARGRRISSVRLFSEFPLKFLRYYFLHRQVLNGWFGLSVAITAANRNFMRLAKAKEMQMLRDLGTGE

SEQ ID NO: 2430 - protein, 305 aa, Streptomyces sp.
MHPLPIVVVIPTKNEAENITSTVRSVAGHFRAVVVVDSDSTDDTRALAAKAGAEVVPYSWDGGYPKKKQWCLEHVHTGTDWLLFLDGDETPSAQLLAELRRIFAVPAGRTLRPAAFDIPLGYWFAGRRLRHGYTIVKRALLDRTRCRFPEPDDLAAPGMGEQEGHYQPLADPVHTLKGTIEHQDLDPVRTWFDRHNRYSDWEAWLAGHPLVREQIRQAKTRQGQLFHRAPFKPLVSFGYAYLYKRGFLDGRAGLDYALAMSFYRWQIGLKAREYGQRPDLATGPGPGSDPGAAVSAAPAAGRAPR

SEQ ID NO: 2431 - protein, 256 aa, Asticcacaulis sp.
MTNHTSLSICIICKNEADRIVACLNAVAGLSDDVVVVDSGSTDDTVQKAEAWGGRVFFNPWSGYGPQKRFSEDQARYDWILNLDADEVITPSLRDEIRALMQSDPALPAYRVKIMTIYPGKERPRLWADFNNYVRLYDRRRVRFANSPVHDTVDTGPYPVGQLTGQVLHFSARSYEHIRQKLAAYTDLQSRTLHKRRWVIAVRLPFEYMFVFLRYYLARRHFTGGWDGIVSSHLAAESRFSRLIKMWRVGGASQLS

SEQ ID NO: 2432 - protein, 264 aa, Luteibacter sp.
MRAEPLSVVVTTFDNADTIGACLASVAFADDIVVLDSGSTDATREIARRHGARVEVQPFAGYSAQKQAAIDLAAHRWVLLLDSDESLPADAAPRLRAALAAPRAAGFVLLRREWVFWRWQADRARMNHYVRLFDRTRARMSGHEVHESVVVDGPVERLDVVIDHYGERDIEGRVDKANRYSSLQVRDRDARKPRLLRTRMVFYPAVAFARYYFWRGHWRAGWAGFVAARVHAFYAFLKYAKLYESQRSGGEGERRPPDAERGDD

SEQ ID NO: 2433 - protein, 340 aa, Butyrivibrio sp.
MITISLCMIVKNEEESLGRCLESLKGIVDEMIVVDTGSEDRTVEIAKEYGAKVYDFKWTGDFSEARNYSFSLATCDYIYSADADEELDEDNRQRFIQLKKDIEELDIDIVQMYYCNQLSFRTVYNYDRELRPKLFKRVRSFKWEDPIHEQVAIDPVICNSEVEIIHRPKENHASRDLSSFRKAVESGRRISKRLHGMYARELFMAGTDDDFIKAKDFFAEAVKDSTRSVDEVKEASCVLAHIAVLEKDAEALLKYSLKDAATEMCSEMCCELGEYYFGKDDYDEAIVWFYNAAYECASILDIKTSKEIPRLALAKCYKALGNEEQAADYEKEAAEIEKGE

SEQ ID NO: 2434 - protein, 334 aa, Unknown
  Description of Unknown: Rhodomicrobium sequence
MALPPGRGASAISWPSRVSGEGRVCRAEKTPIPHRKPDFSCQTRHSEGKRKGVAQHFAGRVMSKHDLAPARAEERPAGAGRDAATPISCYIRTLNEERRIGEVIRAALQVADEVVLIDSGSKDATLAIAAAEGARVVHQPWLGNGRQKRAGEDAARHDWVLDLDADEVVSPELAAEIRALFAAGPRHRMYELTLITVPPFGEPWWNFKHAERIKLYDKRHIRIPDHAAYDQFEIPPGERPGKLRGPLMHYAFTGIEHVMTKLNRASSVRARELKLKPLWLVVLRILFGFPTYFFKAYIVNGLIRGGVYGFAYACALAFGRWLRDVKMYERHMRR

SEQ ID NO: 2435 - protein, 259 aa, Nesiotobacter exalbescens
MCTQQKIPVSVFIIAKDEEDRICDAIDSVKEWVEEVIVIDSGSSDQTVKVAEEAGAQVVFNEWPGYGLQKRFGEDCCKNKWLLNIDADERISATLANEIQDVFRRGPDADIYKVHIVDVFPHEKTAKAWAYGYWQYRLYNREHGRFSDSSVHDTVRPEKSATIRKLKGKVDHRSQRSIAFTVDKLNRYSDMQVEDMQRRGRSMSRIRLLTEFPIAFLKSYFIRRAFLYGWWGLVIAHNYAYSRFVRVAKYYETGIVSRD

SEQ ID NO: 2436 - protein, 303 aa, Unknown
  Description of Unknown: Acidobacteria bacterium sequence
MPATGGVVRDPARFLSSAVAGRIAVVICAQDEELNLRICLQSLNFADALFVVDGGSTDATVEIAEDLGAKVFRHRWPGYAMQKNWALDNLPITADWVLFMDADERVTSALAQEILAVVASTSGNHAGYYIARRMIFMGHWLRHTYWYPDFNLRLFRLGSGRFEDRLVHERVVLDGTAGYLRNDLIHEDHRPISDYVLRLNRYSTLEAQEMLGMREANARLRVASSFRGDWAARRRALKERVWYRMPFRAVVRFIWTMTVRLGFLDGRPGFIFTVLACWNEWLATAKLYEMRVSASEAGHTESK

SEQ ID NO: 2437 - protein, 262 aa, Halomonas xianhensis
MAPITGVVITLDEADNIEACLASLARVCDELIVVDSGSRDATRELAERAGARVIAQPYLGDGPQKNVGPAQANHRWVLSLDADERLTDEAVQAIRGLDLATTTRAGFALRRRNFIGSRWVKTCGWYPDYCIRLYDRERTGFSDSRQHASVTTREVTRLEADIDHYSFANLSELFTKASGRFSTRAAKIMYLKGKRANALSPFVHGANAFVRKYVFQRGFLSGIDGVSVALSAAVNAYLKYAKLLEYQRDRKVRDAEDFDRVW

SEQ ID NO: 2438 - protein, 258 aa, Unknown
  Description of Unknown: Hydrogenophilales bacterium 28-61-23 sequence
MEKLPLSVFIIAKNEADRIPIVIRAVRDWVDEVIVIDSGSEDDTVAVSESLGARVLFNAWRGYGPQKVFAEQQCRNLWLLNLDADEEISPELGREMRALFTGRAPPCVAYTLPILPLYPFQDSGHPWTAFHHPVRLYRKDMAGFKDELVHDSVVVHEGRIGHLKGMVIHRSFRSLAHHVDKVNSYSSAQAEVLAARGRNPGLLALLLTPILAFFKQFILRREFVNGVDGIVVSYMYAFQRFIRLAKTRERQRLSRRKN

SEQ ID NO: 2439 - protein, 286 aa, Tistlia consotensis
MTLSVVILTLDAEATLGRTLDSVAGLADEVFCVDSGSRDRTAEIARAAGATVVEHPFEHYGAQRNWAIDNLPLTGDWELHLDADERLTPELAIEIRGLLDGAPAALAGCYLPRLVHFHGQPLRHGGMYPIWHLRLFRRGRGRCEDRLYDQHFYVEGPTERLSAPMIDDMRGSFAVWKARHRRWARLEAEQLRRGAGPRPGVIAGRFGGSPVERKRALRRLYEGLPPLVRPFLLFAYRFLLRGGFRDGWWGWRFYWHQTLCFRLLIDWYLVKLRLERDPIRPARPGR

SEQ ID NO: 2440 - protein, 259 aa, Morganella morganii
MTDKKRLSVVMISKNNADVIGDCLNSVQGLADEIIVLDSGSQDDTLTIARNAGAQVYENREWPGFGRQRQIAQQYATGDYILMLDTDERVTPELKQSVKQVLTAPQKNTVYRFARRNLFLGRFMKHSGWYPDHVLRLYPREQYQYNSNAVHESLETQGANVITLKGDVLHLTCRDLPEFQQKQLRYAADWAKARHLAGKRCSFLSVLTHTAGAFCKTWLLRAGFLDGRQGLILAFVNAQYTFNKYATLWSVSNNDESAS

SEQ ID NO: 2441 - protein, 492 aa, Selenomonas sp.
MKISACVIVKNEAENLPRWLTSMRSFADEMIVVDTGSTDQSVAIARAGGARVLRFDWINDFSAAKNFALDAAMGDWIVFPDADEYFTEESNPRVRPLLEEYDAHPYLDGFIVHLVNIDVDTGALLGTSAEVQRIFRRAPHIRFVGSIHEHIENLSGDTARQMMIAPGLTLYHTGYSPRIIKGKSQRDLELLLARRARGECARLDEYHLMDCYYTLEDYPQAAHYARLARDSADRPVGSENRPHAVLLQSLILMGASDAEIREAYDAARAALPEKADYPLIYGTYAWDQSYIMTACAAYAEGIHLHEEHYREGDFSAVLLPTAYMRLGEAALLRNAREEAILSAEHALRLNPRHAPLLAAFLRIMAAVGADDAAMIEILNGIYDREADAAFLASVLAGADVPLAALYYDRRSTAKFPPRRRLLLAGDANAAAASLIEEMECAAAVGAACGVTLSPEQQSALAMLLPRSCTEVLAAPEAQRMLRRVARLAEVRQ

SEQ ID NO: 2442 - protein, 262 aa, Labrenzia aggregata
MTDRLPLSVFIIARDEADRIARPIESVIGWVDEVIVIDSGSTDETVAVAEQLGARVIRNDWPGYGPQKRFGEDQCRNDWLLNLDADEEVTPGLAAEIKAKFADGSYADADGWRIMIRDLYAHETAPAPWAYGYHQIRLYDRRKGRFSASTVHDTVRPEEGARISNLSGIMAHRSIRSLDFQVGKYNRYSGMQVDDMRARGRKLPKSRLLTEFPVSFFKAYFVRKYRKYGWWGFILAMNYAHARFLRVAKAYEAELLDRTKTD

SEQ ID NO: 2443 - protein, 251 aa, Unknown
  Description of Unknown: Lewinellaceae bacterium SD302 sequence
MIKLSVVIITLNEAENLPRCLASVEGLADEILVVDSLSTDDTVKIAAAAGARVIEQAFLGHREQKAFAIENAANNCVLSLDADEALSDELKESIGAAKQNWTHDGYYVNRLNRLNGIWIRHGGWYPDRKMRLFDRRKYRMGGTNPHDRFDPTPASRTTRLAGDLLHYTNDDLDSRIVTINKFSSIAAQAFFDEGKRGNWWRVLVKPTGRFVSEFWLKSGWRDGYYGYYIAKTSAQYVWLREMKLLRLGKAS

SEQ ID NO: 2444 - protein, 264 aa, Marinobacter hydrocarbonoclasticus
MKLPLSVYYITQDEELRLPESLAKVSGWVDEIIVVDSGSTDRTREIAEAAGARFVHNDWQGFACQKAFAASLCRNEWVLDLDADEVLSDELVANIQALFSKPVDPDIAGFRMRWVLSQPDPRHPFRHDKSKKILRLYNRKKAEIEPEKDSNNDRPQVKAGRVVELKGDVLHRTLISLEQMERKYCQLSTEQARFLAAKGRRISSARLFAEFPVKFLKYYLLHRQILNGWFGLSVSITAANRNFMRLAKAREMQMLSEFEKENTR

SEQ ID NO: 2445 - protein, 632 aa, Quadrisphaera sp.
MAQSTVVVTDTSSPRALQQTLGFVVRTVPGTTEVVVVSPRSLKLDGALARRVRRVRVRGRSEVQDAALAEVRTDRLTAVLGAGCHLSPTWWADAEDAAHGRPTAVTDLGEGAARVLVHPVGVIPTARRPVPVSASLIVKDEEEVIGECLAALARFVDEVVVYDTGSTDATVALARAAGARVVEGHWDDDFGAARNRSLAHCTHDWVLCVDADEVVTGDPAALRALLARTSANVVRAVVVSTAHRGTAVGAETVSSRVYRRSEVMWSGSLHEQLVARPGHRLVLAPEQAPVRLLHSGYQVTTMHERGKAERNLRIARAAAEALAPGDPRAADVWGDCGRSLVQAGMLDEAVDAFENVLQLGAGPHTSVIAGRSAVLTLLQLQRYDDAERWIAALEGAESSGALALWRARVALGRGDLPGARSALRDAVSGTDPWGVRFDPATATTTAVLIDVEAGDHEAAERTLRHQIATAPDHVHLRLLVQHASETGRPLAGYLAGCPASLVERSLREAVLMDGDTADRWLTALHETRPADLGPIVAGCVVAARHTLEARLRWSVVAREAGITDPCPLRLHATDEQAPPASRCLAWAVLADACGEEDARAEWLALLPAVPDDELPLLGALLEELAPGLLVAT

SEQ ID NO: 2446 - protein, 631 aa, Fonticella tunisiensis
MKYFTMPIDNDIGLSIKTDSPNIPYKGVWGMSISLCMIAKDEEENIGRALESIKDVVDEMIVVDTGSTDSTVKIAESYGAKVYYFEWNNNFSDARNFSLEKASGDWILIMDADDEFVREDAQKLIDLTKKDGVDAYFMETLSFVGDRPGYDIVMNLNVRLIKNKKEYRFLGTVHEQIACNIMAVNKDARIETARIKFYHYGYLNKTVSEKNKRRRNIELLEKSLELEKDNKFLFFCMGNEYLALKDFSKALEYYMKTYENFNPDTGYSPHLLARMAICFDELEMYDKEMEIINLGLGIYENFTDLEFLKACLYHRQNKFTLAIKSFKRCIEMGEPPSNLALMAGVGSFKACCALSEIYLDMKDYDEAYKCCIEALKLNPGYTPCLYIIAEALFKKYERNMDIDYIKSALEDLFGGRLDGRACMALSNVFYKQRKYDIAYEYITKAEKLMGQSPEILYYKGTCLFYLKNFNKAIECYKKIKSGEFYQRAINKLFLSHILTNNTRRAARLLSKDKEIIGNKTVLVYKTFKEIMEGKNCKPVSADKDESREYLSIILDLLNILLKISEFDIFEKALQFLNLIESDEVLLGLAKLYYVNGFYQMAYNELIRSIKIFDRIDAEGIEMMRNILAGTV

SEQ ID NO: 2447 - protein, 705 aa, Unknown
  Description of Unknown: Gammaproteobacteria bacterium HGW-Gammaproteobacteria-8 sequence
MSVLRRRVRAAGLNVKASDPGAVPVPRGVQPIPETNWLARLAALLLLLALALGLVVPKIAGGVYLLLGLIGIIWLEPGLLRRRWQLDGHDRLLSFVALLFVAVWLIAWLVHGLDAVGQDDVGRILRLLLVVPIYLFLRKVDGLERAWWSGLTLGALIAGGYAIWFSVLGEPGEWYMRVGGPTNPIYFGGVVLAFSMMLLPRLTDSELRPALRVLVGIAILFGLVASALSGSRGAWLALPLLLVLYLLTLGSRQPPMKRYGIPLAVLAAGALLTLIPGIPLGQRVADAIASMSGNIGMLSEEDTLAIRWQLWSLALDTIGQQHWLGGGPGAFRAALEQAVLEGRLAERYLEFHHPHNQYLSVLLIAGLPGLITLLLLFGVPAWRFVTLWRSRWERTRMIGWSGLAAVAVLAVMCISESIFQRNSGVIWFALFTATASALVQVLQRREIAQRLEPRLHSLSVIIISRDEADRIGKALASVVDWADEIIVLDSGSTDATVEIAQQYTDRVEVTDWPGFGIQKQRALDRATCDWVLSLDADEIVSEALKDEIQLVLSRPQPRFSGYRLPWMTRAFDQDLHFGRWARAPLRLVRRDAARFTEVSVHEKLVLTDGSRRTGRLEGALFHDVFRDAAHAREKLARYARLQAEARHAQGKRATPIGAWLRAAANLFDNLILRGAFLDGLAGWKMSRLHAAYTLAKYRELARLGR

SEQ ID NO: 2448 - protein, 256 aa, Alteromonas sp.
MIPCSVFIVAQDEANNIERVLRSVSDFAQVLVVDSGSTDNTVALAEAMGAEVIHQDWLGYAGQKQFALSLCQQDWVLNLDADEALTPECIAVIKQTIIRNDIAALRFARNDIFMNQLPNKWMKKPNNLRLYRRQLAHFDTSEQVHESAIVEGKEIRTQVAFTHFGYNRIDALVAKNNLYSSFRAEDKFARNKRPSLIKLALVLPFTFLQKYFLQGRITNGKRGLILATIDAFYAFLKEAKLWEKYLVDSDPNKKSK

SEQ ID NO: 2449 - protein, 259 aa, Desulfosarcina cetonica
MNTDAHGRAVSVAIVAKDEAGRIGACLDSLGFADEVVVVVDDRSRDDTLAIAEAHGCRTLSMAWMGYGRQKQFAVDACTHDWVLILDADERVPPETGDRIRRLIDESAPPAAAYGFLRRNIFHGRWFKRCGWWPDRVLRLVDRRQGRFSDDMVHEQWICDGPVERLDAILEHYSFPTYADLIEKMQNYSTLAARQMEADGRQAAWWSPILHGLWMFFRSYVLELGVLEGFDGFVISLTNAGGSFMKYAKLRERRLCKLS

SEQ ID NO: 2450 - protein, 264 aa, Chelatococcus sp.
MSLPLSIFVIAHNEADRIGRTLEAVRHLTDDLVVVDSGSTDATVAVAEAHGARVVFNPWPGYGPQKRFAEDQCRHPWLFNIDADEVVPPDLAAEIAALFAAGDPAADAYETRIAEIFPGEAAPHRLAYALAPVRLYRRSMGRYSDSTVHDRVVLAPGARVRRLKGTIHHFSVRSLGDQLAKLNSYTDAQADNLEERGERVSMLRLYLEFPAAFIKAYFGRRHFVRGVYGFMTAMNFAFYRYLRVAKHIERRLLAEAAAKGRLTK

SEQ ID NO: 2451 - protein, 263 aa, Unknown
  Description of Unknown: secondary endosymbiont of Ctenarytaina eucalypti sequence
MSQRKRLSVVIITRNEAEVLTDCLESVSWADEIVVLDAGSTDATRYIAAQAGGRVFQTTTTAADWPNFGIQRRLAQSYASSEYILMLDADERVTLPLRLAIQAVLLHPDPEVVYNCARCNLFLGRFMHHGGWYPDRVVRLYPRKRYQYNALPVHESLETNSASIVTLAGDLQHLTCRDLPDFQRKQLLYAETWARERYRQGRKCSILAIITHTYGAFLKTWLLKTGFLDGKHGWLLAMVNAQYTFNKYTTLWALNKAMRGPDL

SEQ ID NO: 2452 - protein, 289 aa, Unknown
  Description of Unknown: unclassified Marinobacter sequence
MIILLLPKSQLKPQHKSADKLPVSVYYITQNEEARLPESLAKVTGWADEVIVVDSGSTDKTQTIAESAGARFVHNHWQGFASQKAFAASLCRNDWVLDLDADEVLSDALVNNIKERFSTSIADDIAGFQMRWVLSQPYPEHPFRYDRPKKILRLYRRSKAAIKPEKDSNNDRPQVREGRVAFLKGDVLHRTLITLGQMEEKYLQLSSEQARFLAAKGRRISSLRLFGEFPLKFLKYYLLRRQFMNGWFGLSLSIIAANRNFMRLAKAKELQVLAQIERRKSAEAAANKE

SEQ ID NO: 2453 - protein, 275 aa, Luteimonas arsenica
MPKPVPLSATVITFNEADRLGDCLASLAFCDEIVVVDSGSTDATRDLAAAAGARVLVRPFDGFRSQKQYAVAQATHDWVLCVDADERVTPALAASIQAARAGGFEGAAGYRFARCSAYFRRFLRHGNAYPDRKLRLFDRRRGGWRGEREIHETASVDGPVRTLAGDLLHLPFRSFEHQLAKGRQYAQMMAEHAHARGQRASWTKLVLAPWWRFWRGWLLRGGFRDGWAGLVYAYVTADTARQKTVRLWLLQRGLSGPSAPSSPARDGSAGPGTGR

SEQ ID NO: 2454 - protein, 277 aa, Nostoc punctiforme
MNSDINAVILTRNEICNLNRCIDSLQWCEEIIVVDSGSTDGTIQLAESLGAKVFIHIPLPPFKISEQRNWALKNCNLKSEWVLFIDADEVVPSNLATEIQRICSISNQQYNAYELPARYLFWDKWLKLTQGYPNWHSRLLKLGEVTFTGGVWEHFASDAKVGRINIPYDHYANSKGFGDWLERHDRYSSWDAQNVVEFLETGKASALGTERKLKLRLLAAKLWFLRPLVRFIQMYFLRLGFLEGITGLIFCLLYTMYEFMIVIKIIELRRKKSGLPL

SEQ ID NO: 2455 - protein, 267 aa, Unknown
  Description of Unknown: Candidatus Nitrospira nitrosa sequence
MLKISAYIIAYNEAGKIADAVNSVLWADEIVVADSNSTDGTDRIARELGARVVQIPFEGFGHLRNRAVQACTHDWVLSIDTDEQCTSEVRDEVLAILSGTPAHDAYLVPRRNYFMGRWIKHSGWYPNFRQPQLFRKGAMKYAESPVHEGYELLTSKPVGRLEQAIWQVPFRDFEEVVKKANRYSSLGALKLADRRVSMGAALGHGVWSFLKHYLAKRGFLDGWPGFVIAFGNFEGTFYRYAKRFEQQELWPLPTHAPLRRPGDSHSK

SEQ ID NO: 2456 - protein, 252 aa, Burkholderia singularis
MALIALNASARLAQCLDALSFADDVVVIDGGSTDGTAAIARAHGARVIVQTDWPGFGPQKNRAIAELSTDWILSIDTDEVVSPELAASIRAALAAPAASVYALDRLSSFCGAWVRHSGWYPDWVPRLFRRGAARFSDDLVHERLIFDGAPARLPGKLFHYSYENFETVLRKIDSYSTAGARQRHAAGRRGSLAQALARGAWAFVRTYVLQRGFLDGRTGLMLAVSNAEGTYYRYLKLMLMHDAPSVPREDRP

SEQ ID NO: 2457 - protein, 264 aa, Nitrospira sp.
MSVSILILTLNEEANLPECVQSVRWSDDIVVLDSFSNDQTVKIAEEMGARVVQRRFDNWSTHQNWALEHIPFKHPWVFYLDADERMTEELKAELISIAHDPNRTAVAYYCGRRNMFMGRWIRHAMPPGMIMRLFRPSHVRFERLVNPVPVIAGPYGYLSGMLVHYNFSKGISEWIEKHNRYSQLEALEGMKLIHQPSEAQPGIFSADRALRRRALKNLSFRLPWRPFLKFLYLYLWHCVLQSFYEYMIVVKMRELERREEGLPI

SEQ ID NO: 2458 - protein, 257 aa, Unknown
  Description of Unknown: Bacteroidetes bacterium 4484_249 sequence
MPKISVVIITLNEEANIGRCIDSVEDVADEIVVVDSYSTDKTEEIAKTKGAKFILNKFEDYVKQHEFANTQASYDLILSLDADEALSDDLRESIINVKKYWKHDGYSMNRKTNYCGKWINHSGWYPDIKLRLYDRRKGKWTGQKIHERFSLFEGSTKGHMKGDLLHYSFNSITQHVNQANKFTDLTAQAAFENGKKSSMFKIIFNPVLKFIRDYFFNLGFLDGYYGFVVCQISANATFLKYVKLKQLNKSSKTLQTH

SEQ ID NO: 2459 - protein, 249 aa, Marinobacter mobilis
MKLSAVLIAKNAGPDFKRCLDSLQFADEIVVLDSGSTDDTVRLAEEAGATVVSSEGWPGFGPQRQRAQNHAQGEWVFWVDTDEVVSEELAQSVLKAVSAAPANTVFQLNRLSWFFGRFIRHSGWYPDRIVRLYRRAEYGYDDALVHEKVACEGAHVETLAGDLLHYTATDFSDYMSKSVRYSDAWAEGRARKGKKASLGSAVSHSVGAFLRKYLLQLGFLDGRHGFLLAVFTAHYVFNKYAALWIRSRR

SEQ ID NO: 2460 - protein, 247 aa, Unknown
  Description of Unknown: candidate division Zixibacteria bacterium sequence
MPTLSVILITNNEANNIRRALDSVKFADEIIINDSGSTDGTIEIAQSYGCSIIQSEFVGFGIAKQTALNAAKSDWVLSIDADEEIDQPLATAIVQAIKNADYSGYHLNRKSQFLGRWILHSGWYPDYLPRLFRRDRGRFTSDSVHEQIQIDGDLGKLEGHILHYTDPDIEHYLQKLNRYTTLSADGLQRQGRRFKTLDILIKPPATFIKMYLLKGGFRDGIQGLMLALLSSFHVLCKYAKLWERQRR

SEQ ID NO: 2461 - protein, 331 aa, Unknown
  Description of Unknown: Alphaproteobacteria bacterium HGW- Alphaproteobacteria-5 sequence
MTDATASGVSSGTAAPARVSWKSGSVPIAVVMISLNEAHNMAAVLENLKGFAHEVFLVDSYSSDETVDIALSHGVYVVQRKFKGFGDQWNFALRELPVSAPWTMKLDPDERLTGALKQSIGEIIERKDADAFNVRRRLWFMGQPLPVTQVILRGWKTGTCRFSDVLVNEHPLVDGRIVATKGDLEHHDSPDLHHWFDKQNRYSTAEALSAYNGHPLAASPRLFGSKLERRMWLKNHFSKLPMRFALLYAYNLLATGAWRAGQGGRAWARSRVEIHRAIELKLIEMRKLGYAYSPPLPNTAKAHPGALQADRLRAAGNTGDVYERSAPAHEE

SEQ ID NO: 2462 - protein, 245 aa, Unknown
  Description of Unknown: Flavobacterium sp. LB2P30 sequence
MTTLSVILPTYNEASYIEDAVKSVEFADEIIVIDSFSTDGTKEKAIAMGCKVLERKFDNFSSQKNHAISYATGDWVLFIDADERVSQKLKLEILSVIQKGEHLGYKIQFPHFYMNRFLYHKVDKVVRLVKNDSISFSGDVHEKLLFKGSVGTLKNFMIHYTYKGLFHLLQKKDSYAWFQANTAFKKEKKATYFHLFFKPFYRFFSSYFLKRGFMDGIPGLALASINAYGVFSRYAKIILIEKGLK

SEQ ID NO: 2463 - protein, 275 aa, Polycyclovorans algicola
MAEQYRDAPSSRAGGDHARPSGASTVNRPGLSAYVLTFNSERYLQSILAQLNRFADEVVVLDSGSADATQAIAASAGARFVTHPFSDFRTQRGVAEQACSHDYIFFCDCDKRPDDVLVAAIRAVRTAGLDQAAYDVQRHWQAYGQPVRVVYPIVSPDRVPRLYDRRRCHWAPDKRVHEGLLVDGPRRLLAGRLVHLTFETQAEVDEKLARYTDLAALGLLDRCQRKGQSPRWAAIRHGVQAWTFSPLGAVIKSYLRRGGWRDGRVGLRLMIYALR

SEQ ID NO: 2464 - protein, 285 aa, Unknown
  Description of Unknown: Bacteroidetes bacterium sequence
MISVLILTKNEEQDLPGCLESVSWCDDIHVFDSYSTDNTVEIAMNAGARVTQRQFDNWAEHQNWGLKNIPFKYDWVFYIDADERISAGLKEALLNFDTATTGAVAYEIQRRDFAWNGNWLKNSQISPFYLRLFRPEKMRYERLVNPISVANGPVKRLPGYLDHYPFSKGFRAWWSRHLSYADMEAMMRMKDKDNNTTFSFKKAIWSRDFSERRYHQKGLFYKVPGRPFIKWLYMVIGRKAFLDGMTGITYATLQAIYEYFIVLKTKELQTSNGHIKKRQQQTAVL

SEQ ID NO: 2465 - protein, 257 aa, Polynucleobacter acidiphobus
MPTLSVILITRNEEANLGDCLTSLDGLADQIVVVDTQSTDKTLEIAKAYGALISSPEDWPGFGPQKNRALDLANSDWVLSLDADERLTPELRAEIKSVLNQPQANCYAIPRLSWYCGRFMRHSGWTPDYVDRLFKRGTARFSSDLVHERLIPQGQVLKLKHQMLHYSFMNAEQVRAKMERYSTDSAQQAFAKGKTGSPIKAVLHGAWSFVRTYFLRAGFLDGPQGFSLACSNAQGTYYRYMKLWRLQQMARAQNQKG

SEQ ID NO: 2466 - protein, 272 aa, Unknown
  Description of Unknown: Candidatus Pacebacteria bacterium CG_4_10_14_0_8_um_filter_42_ 14 sequence
MNKITISALIIAKNEAAMIQRCIATLRWCDEVLVLDDGSTDNTVELAEQTGARVISFKHKSFARLRNEALKHCKTDWLIYVDADERVSPKLAREILVHLETASVSALTLKRENVFYGATFQHGGWSPDLVTKVFKRSSLKEWTGDVHESPNYEGEAGYLQVPLLHLTHRSVRDGLLKSAEWTRVEARLLVASELGKISFLTILRKGVMEFLRRGFFWKGYKDGEQGLIEALTQGINKMLVYMQVWELQQKPSIPESYEKIEKDIADAWKSEL

SEQ ID NO: 2467 - protein, 256 aa, Unknown
  Description of Unknown: Betaproteobacteria bacterium sequence
MSAKLPLSLVVITRDAAADIADCVASASFAADVLVVDSGSRDDTVELARRSGARVIEREWTGFGPQKQFATTEAANDWVLCIDADERVSPELAASIAALFAAGSPRACAYAIPRRNRFLGCWLAHGEGYPDWTIRLFDRRRARWSDDVVHERVIANGPVKRLAGDLMHASAESLDAYIAKQNRYTSLQAAALYANGSKAGAMHLALSPLARFVRFYVLKLGFLDGAAGFAHIAIGAFASFLKYAKLRALDAEARSR

SEQ ID NO: 2468 - protein, 272 aa, Terriglobus sp.
MISVMVLTLNEEHDLPGCLESVAWSDDVWVFDSLSTDRTTAIAEVSGARVIQRKFDNWAAHQNWAMENIPFKHPWVFYIDADERMTEGLREAIHQAVSAAGGHVAFEVERRDFLNGTWLKHVQLSAWYTRLFQPSKMHYERLVNPVSVVDGTTGRIAGYLDHFPFSKGVTYWIQRHNDYSTKEAQQLMLNQADAPAFRLRDAFFASDFQTRRKQQKQLFYRLPGRPILKFILIYFAKRGFLDGSAGLTYALLQSIYEYFIVLKTRELRQHPQ

SEQ ID NO: 2469 - protein, 252 aa, Bordetella avium
MTLSVIIITKNEAANIRGCLESVAFADEFIVVDSGSTDNTVELARDFGARVSITPDWPGFGVQKNRALDLATGDWVLSIDADERLTPELAQAIRTAMASPQATAYEMPRLSWFCGRFIRHSGWWPDYVLRLWKRGTARFTDAAVHERVVPHDGQVFRLAPHLEHYPYPDLDTLVTKANRYSSDAAAMMYAKGRRANVFTALGHSFWTFVRIYLIRRGFLDGRHGLVLAVTAAAGSFFRYAKLMFKSEPEPPK

SEQ ID NO: 2470 - protein, 245 aa, Ferrovum sp.
MSLSVIIIAKNESHAIEDCLESVSFADEIILIDGGSTDDTVEKAKALGATVHVNSHWQGFGFQKNLALHHATKNWVLSIDADERVTPELKNAIQRAMAEHQFDVYRLPRSSSYCGHFMRHGGWWPDYVVRLFKRGVAEFSADRVHERIETDKPIGTLRHPLIHLTYETLEEVIDKTNHYSTLGAEMLFDKGRRGGLGVASLKALWAFLRTYILRAGFLDGGYGFLLAVSNAQTTFYRYAKLWLKR

SEQ ID NO: 2471 - protein, 262 aa, Unknown
  Description of Unknown: Candidatus Glomeribacter gigasporarum BEG34 sequence
MPGKLRLSVIIITLNEAHHITECIDSIKSIASEIIVLDCGSEDETQALARAHGARVMQNTGWPGFGPQKNRALARAQFAWILSLDADERATPALCAEIARAVRNEGYTAYAIPRRTQFCGRWVRHSGWTPDDVVQLFRRGQARFSEHAVHEHVRVEGSIGHLTQPLEHYSYRSQREVNEKVQRYARAGAQELHRAGIRGGFCKALLHGGWAWWRTFIWRLGFLDGWTGWAIAAMNARTAWLKYKYLGAARGAAPTSAAVRNS

SEQ ID NO: 2472 - protein, 248 aa, Pseudolabrys sp.
MPRLSVIVIAKNEAANIGACLDSVAFADERIVVDDNSSDDTRAVAEAAGARVIVRALDGFGAQKNFALAQASGDWVFSIDADERVTPALAAEIAQAIGQGAADGYELPRLSSFCGRQMRHSGWYPDYVLRLFRRGSARFSDDAVHERVICDGKVARLANDLLHAPVMRLEDALSRMDRYSTAGAAMFTTRGKRVSFSSGITHGLWSFFRTYVLRGGFRDGREGFLLAVANAEGTYYRYMKAWLAGRKS

SEQ ID NO: 2473 - protein, 351 aa, Bacteroides pectinophilus
MIVKNEEAVLARCLDSLNGLMDEIIIVDTGSTDSTKDIAGLYTDKVYDYEWTDDFAAARNFSFSLATMDYIYAPDADEVLDDINRMRFEQLKAALLPEVEIVQMKYHTVTGFDTVLNSKTEYRPKLFRRLRTFTWIDPIHETVRTSPVVYDSDIEILHMPQSMHSKRDFSIFLKAYKRDGMLSPRICNMYARELIKGGDENDFKDALPVFLQLYECTESEDARKEYACVLAHAYRLMHEPDFFFKYALKDMVTSACSEMCYEIGLYYEAAADYNEAVVWFINAYSETDSILDIHTGGDLALTHLVSCYDNIINTLEASDGDYDYELIAAYRTERDQYKSALDNWTLPNELA

SEQ ID NO: 2474 - protein, 299 aa, Unknown
  Description of Unknown: Verrucomicrobia bacterium sequence
MSEQSGARVPLSVLVPVKNEAANLRDCLASVAFAQEIVVVDSASTDDTQAAAEAAGARIVQFVWNGKFPRKKNWALESIRWQHEWVLIVDADERVTPELEREISQAIRRTDVDGFYLNRRFWFLGGWINHCGYFPSWNLRLFRHRLGRYERIEIDDNIASGDNEVHEHVLLKGRAEYLPAPMEHYAFPNIATFVEKHNRYSTWEAAASAKVHQRTGGKTLRATPLGTPVERKRWLKKLAIRVPCRPSLRFLYHYVWKQGFRDGYRGWVLCRLLAWYERMIVLKEREMKNRSCNSNAVPC

SEQ ID NO: 2475 - protein, 409 aa, Rhodoferax antarcticus
MLPVTSASEPACRKTDKSGNDTSSKGPCVAFKARNCPLRSRSACTMDEIFWVEVACPLKGAMLMGTCVRPTPETSTRNWANAWLSKPKNKRRANVNPDAMTNPRLSKSRRNPRLVPNAQGDRPNIEKKVTTAMENLDGLKGPNIMENGSMKKVTLSVIIAAKNEGAQIGECINSVSFADEVLVLDSGSTDDTATRARKAGANVHTTDWPGYGPQQQRGINLATSDWVLSLDADERITEHLHDEIQAAICRPDFDGYFLPRHSSLCGVFIEHGGWRPDYTLRLVRRPLAGFTDHFLHAHMTVNGKAGHLKSPIVHYSYRTLDDLLEKMNRYSKGAAIDSFTRGGSSSLTKALAKGIWAFVRTYFVRQGFRDGHIGLVLAIYNAQTTYYKYLRLWMMTNDKLKETPKKFFK

SEQ ID NO: 2476 - protein, 264 aa, Desulfomonile tiedjei
MTQSPDSQQPLLSVAVIAKNEADRIRALLDSVKFADEVLVVDSGSTDETVELCRSLGARVIHQDWMGYAAQKQFAMDSASGQWVLSLDADEAISPESANEITAAIRSCGHEVHGFSLPRLSRYLNRWIRHGGWYPDRKIRLVQKGFGTWTGDGLHEKLEVSGIINKLQCPILHYVYRDISDQIDTINRFSTVHADHRRPAGPIHILFGLFHAAGKFLECAIWKLGILDGIPGFIIAVNSSFYVFLKHAKAWEKSLPDTNAHSKE

SEQ ID NO: 2477 - protein, 288 aa, Paraburkholderia silvatlantica
MSDLPLSSCASSTQSTRAPSTKRATLSVIVVAMNEAHDIRDCLESVRGLAMETIVFDSGSSDGTPDICRSLGARVFETDWPGDGPQKNRALDVATGDWVLCLDADERVGDELRREIEQLLEHGTTHAAYSTPRRSSFCGRFMRHSGWWPDRIERLFRRGSARFTDVRTHTRLVIEGTIGRLDGPIIHIAVGELHEALDKANSYSTSGALTMAENGKRSTLGKAIGKGLWAFIRTYVIQRGFLDGAEGFMLSVTNAEGTYYRYAKLALMTRAMQASKSRGGAEQPGQSR

SEQ ID NO: 2478 - protein, 262 aa, Mesorhizobium sp.
  MOD_RES (253)..(253): Any amino acid
MPKLSVIVITLNEEACIERCLGSVGFADEFVVVDNNSTDRTREIARDMGAKVIVTEDWPGFGVQKNRALAAATGDWVLSLDADEWVAPPLAREIEHAIANPRGCAGFEIPRRSRFCGRVVRHGSWSSDRVLRLFRRDAGRFTDYPVHEKVVLKGRVSRLAQTMEHDCITDLDDAHRKIWMYAQASAKQIGDMGKRGSTTKALLHSAWAYLYSYIIRFGILDGSVGLLVAGYCASYTYRKWAAAPSETGASVSXRDTPAVKMN

SEQ ID NO: 2479 - protein, 256 aa, Leptospira neocaledonica
MLPISACIITLNEEDNIERCLSSLDFVNEIIVLDSGSKDRTETIAKQKGAKVVLRKFDDYVSQKNHVISLAVSPWILTLDADEELSPGLKEEIKNLFKNGEPEEDGFLIPRLTMYMGKWIRHGGWYPNYRARLFLRSKGKFVGGKVHEAVELSGKRKKLKHPVFHYSYENLFDHVTFINRYSELAAAEKFGKGKRSGLVLALLEAGYKSFWMYFVRLGFLDGRRGLILAIMGFYYNFLKYTKVFEMSLAEKQKTDN

SEQ ID NO: 2480 - protein, 265 aa, Luteibacter sp.
MAREPLSVVVTTFNSAATIGACLASVRFADDIVVLDSGSTDETRDIAASHGARVSIQPFAGYSAQKQAAIDLAIHRWVLLLDSDEALPAIAAERVRAALVTPDVAGFEMLRREWVFWRWQPGRARLNHYVRLFDRTRAGMSGHEVHESVLVRGPVRRLDAVIDHYGERDIDGRVDKANRYSTLQVRDRQTREPRMLRLRMVVYPAIAFARYYFWRGHWRGGWAGFIAARVHAFYAFLKYAKLYERRVSGGQRQDHGAFESERPED

SEQ ID NO: 2481 - protein, 253 aa, Neisseria elongata
MASDISVLILARNEEANIRECIESCTFAGEVIVIDDFSTDDTEKIAEACGARVIRRAMDGDWGGQQTFAVEQARCGWIFFIDADERCTPEAAEEIARTVEKGEKAAYWLRRQNRFRHNKAVHGVLRPDYVCRLMPAEGVRVEGYVHPAILHPYADKKLQHFLLHYTYDNWDQYFNKFNKYTKLSAEKYKDAGKPVGFWKDIVLRPIWAFIKVYIFDRGFLDGKMGWILSVNHYFYTMTKYVKLYTLYKSDGKL

SEQ ID NO: 2482 - protein, 275 aa, Humibacter sp.
MRLPISVLVQTKNEAAGIRQCLASLEDFDEVIVVDSLSTDGTADLARMMGASVVDFKWNGEYPKKKQWQLDNVSTRNRWVLFLDADESPSPQLISWLATAFASERLNVAAFDIRLDYVFSGRTLRHGHRVVKRALVDRNRVRFPEVDDLGAPGMGELEGHYQPNVRGKVGAAGGRILHNDLDPVRTWFDRHNRYSDWESYLRTRIMSRKAVAQSRSIQGRIFERVPFKPMAFFLWSYVVRAGFRDGRAGLDYAIALSMYYWQIELKVRERKRTGG

SEQ ID NO: 2483 - protein, 436 aa, Austwickia chelonae
MKRRRKGHQKSSGQSLIDVAMIVKNEEAHIADCLRSVKALRPLLGRICVYDTGSTDRTVELARAEGAIVREGYWDDDFSRARNESLAMTSAIWVLWIDADERLVVDIERLAVVLRMTAQAPRLEAGWLINKMADDPGGAVQARALRILRNKAATFVGRVHERPMRVEDGCPLQPFTLPERIIHLVHHGYTSETIEGKLHRNLALAENYVERLRAGQPTDEELSTALLDRGRTHAGLGRRAEAEADLEEVLTLQAHSAVRAEAACRLAEFQLMDDHPDEALGFLKAIETGAEENSHVRWLRGRALHAKQEFAEALEIIRSVDRPTTPQGYMAPWREVLLLRMELAARQGHTEEALSAGLALATRHGGAHVVAGLMIALWGKKEASQLAVLLAQASQDYDADVEAAFANHSESGRLVAQEYRSHWGRPANATPTGRTT

SEQ ID NO: 2484 - protein, 260 aa, Bdellovibrio exovorus
MKGCDIKNVSEQKIKIPITVTLIALNEERNIQRALSSVQWAEDIVVYDSGSTDNTIEIAKKMGARVVQGEWLGFGPSKRMAVQNAHCDWILSLDCDEEVDMALQQEIQKRLPDLNPKVAYKVPRLSYHMKRWIRHGGWYPDYQIRLFNRKFANWNEAKIHEKVEASSYEKFVSHLNHYVFLNVADQVRTNNKYSSLQAQEMWDRGKRFSLFHFLTKPYVKFVECYFWKLGLLDGWAGYVIARNAAYSVYLKWVKLKELEG

SEQ ID NO: 2485 - protein, 262 aa, Marinomonas sp.
MTEKLQKNTISAVLIVKNESKNLDMCLNSLNGWVDEIVILDSGSTDDTQKIASKYTQQFHQKLDWQGFGLQRQAAQKLIKTDYILWIDADEVVTETLKNSILTALKQNQKKTAYSINRKSWVFGRFIEHSGWYPDRVTRLYRADEANYSDDLVHEKVLLNNDVRLLPLEGDLIHYTYDDLQHYLVKSASYAKLSADQKEQQGKTSSLSKASLHAFACFVKMYLIKRGFLDGKQGFLLAILSAHSTFVKYADLWIRSQPKPHN

SEQ ID NO: 2486 - protein, 286 aa, Unknown
  Description of Unknown: Verrucomicrobia bacterium IMCC26134 sequence
MIKVPVSILIPIKNEAGNLPRCLAAVAWADEIIVVDSHSTDDSAGIAQAAGATLVQFDFNGTWPKKKNWSLETVPFRHEWVFILDADEVLPPGAETELRSIVENPGHPVDGYWINRRFMFMGKWLRHAYYPNWNLRLFRHKRGRYEKITDAPTASGDNEVHEHVIVRGTTGRLRTEMDHYAFPSVEVFVEKHNRYSNWEARVEVDGLLSNKSLQNRDVGWRRRLKSWTQKLPFRPWLRFSYVYFWQRGFLDGREGYYFARLHGMYELMTVAKTYELRKQPSPSRPR

SEQ ID NO: 2487 - protein, 264 aa, Unknown
  Description of Unknown: Candidatus Macondimonas diazotrophica sequence
MTVSAERPLPLSVAIIARNEEARLPRCLESVSGLAAEIVVLDSGSADATVAVAERFGARVEITDWPGFTVQKNRALVACHQPWVLSLDADEAVSPALADAIRALFAAGDPPRTGYFINRRNRYLGVWLRHAWTPEWRLRLVARDQARWTGGRVHEQLTVTGPTGRLAGDLLHESYDRLDDHLHRTIAYARLGAEDLIARGKPFRAYKLLLSPLGRLMRILLLQQSWRDGWRGVLIAASSMLAAFAKHAFVLEHHLRNTERNRRP

SEQ ID NO: 2488 - protein, 255 aa, Unknown
  Description of Unknown: Deltaproteobacteria bacterium sequence
MPKPITATIITLNEEANIEGVIASAARLCDEVIVVDSASTDRTVELAEAAGARVFVQPYLGDGPQKNYGVKFAKNDWIFSIDADERFEDDAVEALLALDLERAEADAYAVRRKTFIGDRWIKLWYPDWVTRLYDRRVCAYEDSIGHASVKGGRVKKVPCDLLHYSYRDYSDIVKRVDKFAARGAKQVLARGGMITPAAPLLHGISRFLKQYLIRGGVLQGVDGLNVSVISAFGAYMKYAMALEARRSGAATERKP

SEQ ID NO: 2489 - protein, 373 aa, Paenibacillus sp.
MITISLCMIVRNEESSLQRCLDSIKGLVDELVIVDTGSTDNTKAIAANNGAIVYDFEWIDDFGAARNFAFSKATQEYILWLDADDVVDPKDHAAFKQLKEMLSVSRHIDSVTMPYVLTTNEKGEAIFSLRRNRLVRREAGFIWHGAVHEYLAVGGQIYNSEIAIYHKKDKEYTDRNLRIYEKRLAAGEEFSARDLYYFGNELKDHARYKEALDFYEKFLQTKQGWYEDCIQACLKMEGCHHELQNENDRLPALFRSFEYDKPHSDICCQIGEILLQREMIHPAIYWFEQATQLVIPSDQLTMTQASFWTWVPHLKLCLCYDQLGQTERACYHNEIAMSFYADHPSMLHNQSYFQKILGDRYESIRASARGPVQ

SEQ ID NO: 2490 - protein, 297 aa, Roseinatronobacter thiooxidans
MTVTVVILTLNEARHIERALRSVAPFATRCVVVDSGSTDDTAERAVAWGAQVLTHPFVNQAQQFNWALDQLPEDTGWVFRLDADEVVSPKLAAEIVARLYDLPNDVAGLTVPRRIAFLGRPIRYGGVFPVHIVRLMRHGRGRSEERWMDEHIRVDGSVEALAGELLDNNLNPLGCWIDKHNRYASREALEMLLAERRGQDGSAAEMGRQAATKRWIKSNLYGRLPIGLRALTYFLYRYLLRGGFRDGYPGLAFHVLQGFWYRFLVDAKLYEARQHLSEHNGNLAATARAVLDLDIDD

SEQ ID NO: 2491 - protein, 279 aa, Klenkia soli
MQSIGIIILALNEEEAIRTCIESAKLLTSNVTVLDSGSKDQTGRIAVAAGAQVVQFRWNGAYPKKKQWSLDNLYLDTDWVLLMDADERLSPALASEIKEVLAGSPVSAFEIPVQYHWRGEVLRHGQTVYKRTMLRRGACKFPEIDDLDAPGSTEVEGHYQPLVRGAIGRLQSRLIHDDPDPIHDWFARHNRYSDWEAFIQIRPEVRAATRAAKSSQGRIFDRMPLKPVVIFIYNYFIKQGFRDGRPGFEFAFSLMFYHAQIQMKIREAAAKSQEQYRSN

SEQ ID NO: 2492 - protein, 249 aa, Catalinimonas alkaloidigena
MPPISAVIITYNEERNIARCLDSLQGVADEIVVVDSFSTDRTEEICRARGVRFLQHAFEGHIEQKNFAAAQARYPHVLSLDADEALDPTLQRSILAVKADWQHTGYQMNRLTNYCGHWVRHGGWYPDRKLRLWNRQFGQWGGTNPHDELRLTPEHSVGHLAGDLLHYSYYSLHDHVRQVNYFTDIMAQSQQHKGGSLLKVLLSPWVKFIKSYFFQAGFLDGYYGLVIAIISAHATFLKYAKIRELRKNR

SEQ ID NO: 2493 - protein, 279 aa, Unknown
  Description of Unknown: Gemmatimonadetes bacterium sequence
MAGLATRTQPRIALTVVVPTLNEGAQIGDAINALPFADEVIVADGGSTDDTVAIARARGATVIERAGVTIAAQRNAAIARARNEWVFALDADERITDALWQELREVVAAPAHRVYRVRRMNSFLGRERRRGRWGRDWQVRLFTRERRFVPDRVHERLEPAPDAGSLRASLGHVPYRDLRHHLEKMIVYARWGAEQLHARGRRATLWELAFRPAWRFVRDYVVYASWLDGAFGFLTSALAAYSCFVKYAYLWELGRLRRESTATRPSAPSEVDRRQAAGG

SEQ ID NO: 2494 - protein, 257 aa, Derxia lacustris
MPTLSVVIAARNEAANIADAVRSAAFADEVLVLDSGSTDATADLARAAGARVLATDWPGYGPQQNRAIDAATGDWIYSLDADERITPALATEIRAAIAAGRFEVFDVPRRSLFVKRFMKHSGWWPDRTRRLFKRGSARFTTHVIHANLATDKPVGHLAAPMTHYSYRDLASVLEKMNRYSSGSAVDLHERGKRGSLGGAIRHGLWAFARTYVFKLGFLDGAEGFMVAVVNAETSYYKHLKLREIQRAGQPLIDEPGP

SEQ ID NO: 2495 - protein, 268 aa, Enterobacillus tribolii
MERARLSVVMIAKNEAELIADCLRSADWADEIIVLDSGSTDDTVAIAERHGAKVFTHTQWEGFGKQRQQAQRYASGDYIFMIDADERITPPLRQAIESVLENPQPHRVYSCARRNLFLTRFMRHSGWYPDRVIRLYANAGYHYNDNLVHESLDYRDATVCRLDGDLLHLTCRDFFVFQRKQLGYAEEWSRQRFQAGKRCGLFSATAHGLGAFLKTWVLRAGFLDGKPGLLLAFVNAQYTFNKYAALWALARQQKAKHHDDESHLSGHL

SEQ ID NO: 2496 - protein, 303 aa, Nitrospira sp.
MARIHVSCRHDSGQRNGGHHGGTGGSTGTSIAKSLAEDFVGEPACKPTVACLVITKNEERNIVDCLESAQWANELIVIDAESGDKTVELARACGANVFVRPWPGFGLQKNFGMAQTSADWILILDADERVTEELRGEVRGCIEGWRPGASVAYRIPRRNFFYGAWVRGGGVYPDYQVRLFRRGIAQYNDVAVHENLIVDGEIGTLVGHLDHYTERRIKDHFKKFGHYTTLAAQEKAKKVRTVGWSDLVFRPLVVWAKTYLLKQGYRDGVNGLIVCLFASMYTFVKYAKLWDTTRQDASHQDAR

SEQ ID NO: 2497 - protein, 267 aa, Salinicola salarius
MAAITGVVITLNEADNIEACLASLKRVCDELIVVDSGSRDDTVARAEAFGASVIHQPYLGDGPQKNVGPRAASHRWVLSLDADERLTDDAVAAIQALDLDAESNGEGNHDAYALRRRNFIGSRWIRHCGWYPDYCIRLFDRDRTGFSESRQHASVQATHPRRLDADLEHYSFANLGELFGKASGRFSNRAAKIMYLKGKRANAFSPFLHGANAFVRKYVFQRGFLGGLDGVSVALSAAINAYLKYAKLLEFQRDAKVRDAEDFDRIW

SEQ ID NO: 2498 - protein, 274 aa, Leptospira idonii
MLGKSKRKLSVAIITFNEEKNIQACIDSVKNICDEIIVLDSFSTDKTKEIATKETLVRFYEGPFHGHVEQKNKAIGYCSNEWILSLDADERADDVLQKSILEFLESETEEVDGFQIARLTFHLGRWIYHSGWYPQRRYRLFRKEKAVWVGENPHDFIELKDPKKGKILKGDILHYSFADFSHQITTINQFSSIVANTRYAKGHSFSLLKSILKPIGKFIEIYLMKRGFLDGVPGLYIALASSFSTFLKYAKIYELDKKYIERPSNIRKDYGTKK

SEQ ID NO: 2499 - protein, 286 aa, Unknown
  Description of Unknown: Planctomycetes bacterium sequence
MTQKLTALIPCKNERRNIRPCIESVRPIADEVLVADSGSTDGTLDIVREMGGCRVIEREYVHSANFKNWAIPKAQHPWVLIVDADERVTPQLAAELRSVLAEPQAGIDGYWIGRKNHFLGYHIAHCGWESDDVLRLFRRDVGRYRERWVHAEIELDSTRVRRLKHPFEHFTSWSSDDYWRKMNRYASWGALNMRDEGRRPSLLSMVFRAPMRFLQLYFLRLGFLDGMPGFHVCAYTAFYTFMKQARLWELEHALAQPDPEADLLPFSGESQAARRTAERSESLRAA

SEQ ID NO: 2500 - protein, 327 aa, Unknown
  Description of Unknown: Gammaproteobacteria bacterium HGW-Gammaproteobacteria-4 sequence
MALAWRGTQVGSKRVVLEPTHQPTRPVGSTPAAFEPTCDAKASNIHHYIVLRARCFGVFMAVIDAERSLPISGVVIAKNEADRIERCVRSLLGLCAEVVVLDSGSTDDTVARARAAGARVEHQEWLGFSSQKNVAIARAAQPWVLLLDADEWLVPSGARRVRALFAARPDGNASIERADIWRLRRRTRFLGRSLRHGGWGSEAVERLFRSDCRYLPARVHESLDRRGKRVLRLPARIEHDTARNRAEYETKLDGYAELFARQRHAQGVRGFWIDAWLHAGAYWLKNYWLRGGFLDGRAGAIYHYLHSRYVFRKYRTLWRLRDTPIEP

SEQ ID NO: 2501 - protein, 246 aa, Hahella ganghwensis
MPKLSVTIITLNEAKRIRECIASVSFADEVLVVDSGSSDDTTEIARAAGARVIEEPWRGFGPQKQFAVDQAQNDWVLCLDADERPSPELAAEICQIMQQPMFKAYTMPRCNTFLGRWLRHGEGYPDLSLRLFDRRNAVWSKDPVHEKVETESEIGQLKADLMHFSEDGINAYLAKQNRYTSLQAEQMHTRGKDFSVGQMIFSPLFRFFKFYILRRGFQDGIPGLIHILIGCMNSFLKYAKLYELKR

SEQ ID NO: 2502 - protein, 260 aa, Unknown
  Description of Unknown: marine gamma proteobacterium HTCC2080 sequence
MPRRKISCFLIVCNEADRLEASLRPLAGWVDQLIVLDSGSTDGSVEIAQRYSDDVYQTDWPGFGPQRNRALAYCKHDWVMTIDADEVMTEELKAEIDTVLSKPNLTANFIRLPWHTFLFGKPLKYGRYSTPQGKLFLKTGAKFKDRQVHETLIMPKRQTITLKSPLLHYSWRDYQHVSEKHLRYGVLGAQDKAKNNKKASIVYAFFRSITDFLQQYILRLGFLDGQRGLLMAVILSQYAFHKYAALWTMTDDISKQSGNH

SEQ ID NO: 2503 - protein, 316 aa, Pseudohaliea rubra
MTLTVIILTKNEARHIQRAIDSVATVADSILVIDSGSTDDTIAISERLGADVIHNPWRNYATQFNFALDHLPEETDWVLRLDADEIVTPDLAREIEATLHKLGPEAKGVYVSRRMHFLGRRIRRGGVFPIRVLRLFRHGAGRCEDRWMDEHILVDGATADLSGEIIDDNLNSLTWWTEKHNSYASREVVDLLNLEYGFMAHETVADLSGGQQAGVKRWLKERIYARLPGGFRAFVYFIYRYVVRLGFLDGKEGTAFHVLQGFWYRYLVDAKLHEVRLYMQRNDVDAGRAIRDVLGIDVESSANTNEQNSRQEAQHS

SEQ ID NO: 2504 - protein, 252 aa, Neisseria elongata
MASDISVLILARNEEANIRECIESCTFAGEVIVIDDFSTDDTEKIAEACGARVIRRAMDGDWGGQQTFAVEQARCGWIFFIDADERCTPELCGEIMQAVADGTQYGYWVKRINHFQHKLVRYGPLSPDWVCRLMPKDGSRVEGFVHPKIIHGCRDKKLKAPMLHYTYETWEQYLDKMNRYSTLSAEKYRNEGKRIHTFADIWLRPWFAFFKMYFLKLGFLDGAMGYILAKNYANYTMNKYVKLKYLQDSRKK

SEQ ID NO: 2505 - protein, 281 aa, Unknown
  Description of Unknown: Microbacterium hominis sequence
MTRISKISVVVLTKNEEAGLGNTLDRLTAFDDLIVVDSHSDDRTVEIATAHGARVVEFDWNGRYPKKKQWALENAGAVNHWVLLLDADEFPSPALVRELGELESSLDVSGHAAYDINLLYRFGGRYLRHGHVVTKRSLLDVRHARFPEVNDLEAPGIREVEGHYQPESDGTVGKLKGRIVHDDRDPVSSWFARHNRYSDWEAHLRTAPAARREIASKRTTKGRIFDAVPFKPALFFAYAYVAKAGFLDGRAGFDYAMALSMYYWQIGVKHRELLRGDADAR

SEQ ID NO: 2506 - protein, 311 aa, Burkholderia multivorans
MSRGAARGARPPGILPVGPAPKMAQHYSRTAPSRPAADAAGTMRAGRYTAAHVFFAFPTIFMAEPTLGVALIALNASARLAQCLDALTFADDIVVIDGGSTDDTVAIAQAHGARVIVERDWPGFGPQKNRALDALDTDWILSLDTDEVVSPELAQSIRDAIRTPAADVYALDRLSSFCGRWIHHSGWYPDWVPRLFRRGTARFSDDLVHERLVFDTPAQRLSGKLMHYSYEDFETVVRKLDAYSTAGARQRRAAGQRGGFGKALARGAWAFVRTYVLRRGFLDGRAGFMIAVFNAETVYYRFLKLGHPPAR

SEQ ID NO: 2507 - protein, 223 aa, Xanthomonas citri
MRGLCAELLVVDSGSTDDTVAVATAHGARVVHQDWLGYAAQKTFANTLATHDWLLLLDADEWLSPGTADTIRALFADGRVEQADAWLLTRRNWFLGHRLRGGEPMERLVRAGWRYLPSQVHERPDLAGKTVRALAADFEHDTSRSHAEHVAKLSRYAQLWARQRFDAGKRAGALDGPLHAAAYLLKQYLLRGAWLDGAAGWRFHRAQAGYVLEKYRRLRALAP

SEQ ID NO: 2508 - protein, 257 aa, Rhizobacter sp.
MSLSVTLITHNEGANIVDCLKSVAFADEWVVVDSGSTDNTRELAESLGARVVRSDGWPGFGPQKNKALALATGDWVLSLDADERVSPELAARIQAVVAGQGGAALGFELSRLSRFCGQWMHHGDWYPDRVLRLFRRDSGRFTDDQVHERVVVDGPTARLQGHLLHETMPSLDDAIDKMNRYSRGRAIDKVRGGKRGGLGAALSHGVWAFLRSYVMRRGFLDGKLGFVLAMYIAEGTYYRYLKMGILSGQLGHSIEPS

SEQ ID NO: 2509 - protein, 366 aa, Streptacidiphilus jiangxiensis
MARVSLSMIVKDEAASIADVLADASAFCDELVVADTGSTDGTQELARAAGARVVDVPWTDDFAAARNASLDACTGEWIVWLDADDRVPPASQEAFTRVLAVLADDDVDVLVSPYHCAFDDHGAPTFTTLRERVLRRDAGLRWGGAIHEVVDITSARTRDEPELVVEHRRTEAQAAQDEGRNLRILEKLYADGDRSPRTLYYRANELRDSARHEEAAAAYTEVLALDQPAWERYFALMSRAECLQTLGRHAEAEASAVLAVLLDPTRPEAWMVAGMIPYERGDWARAVPFFSAASVAQARPSGGFVRGRDYAWAPWDYLSVCLGNSGRHEEALAAGVRSLRGNPQADRVRENIGWFVSQLPSSGAAD

SEQ ID NO: 2510 - protein, 361 aa, Ralstonia insidiosa
MQSTPTKLALVVIARNEATCIERCLLSAKPFVDRMVVLDTGSTDDTIAIAQACGAHVSQMTWQNDFSAARNAALEAANADWNLILDADEWLESGGEHLRALSNAKPVLGILCIKNDTDASDATSQLIAWLPRLLPRGVRYVGRIHEQPVSSLPAERLSIVLRHDGYTAAKMQKKGERNTQLLLDELKHRPDDPYVLFQLGKEIELHQEDYARATDYYARAFALAPQDAPYRRGLALRYLYSLGKSDRLDEAMAHADTSIHAWPDFPDLCFALGLVLVDAAVKHPEHANTQWLPLAEQAFCRCLEIGDQAGMDGSVVGRGSFLAAQQLATVYQMQANVLARKSEQYLALSKQMQGAPAPREG

SEQ ID NO: 2511 - protein, 410 aa, Unknown
  Description of Unknown: Candidatus Rokubacteria bacterium sequence
MRARRASDLRRSQRRELPRSPVARPASRAQASSAGGVLLSACLIVKNEEQFLDRCLLSLEGLVDEIVVVDTGSTDRTREIAAARGARLHDFPWRDDFAAARNHGLDLARGEWILYIDADERVRPASVSRLRTQLADPWHVAHYVLLHPRPGFTPYWEMRLFRNDPRIRFRGIIHENIWPGIHAYRAARGGRIGRSELVLDHEGYERDQEVKHRRNLPLLRKALKEDPGKVFSWCHLATIYASLGKDRRAEKAWKAGLAVVRKRPRSRSGEDTLPYLGLIQWRLARGRDTRRLLAEALERFPHNHQLHWLRGITLMRAGRPGEALPFFERLVACGRTGEIDRFLAYDARLFDVFAYDSLATCHFKLGHYAESRGYFELAAKHDPEKLEYRLKRALCARLEGSSTDGSPGGR

SEQ ID NO: 2512 - protein, 290 aa, Thioflavicoccus mobilis
MRTEGPPLTVVMISLNEQHNMEAVLDNLQGWAQEVFLVDSYSSDRTVDIALQYGAHVVQRRFRGFGDQWNFCLEKLPITSPWTMKLDPDERLSDDLKSALVETIEAGKAAGISMERRLWFMGKPLPVRQTLVRAWRTGRCRFTDVAVNEHPIVDGPIVHVPGEIEHHDSPDMEHWLEKQNRYTTAEAIIAHQQSPLADSPLLFGTALQRRMWLKRNFARLPLRFSLLFLYNWLGKGAWRAGWVGYAWARLRSDVMRMIEYKCREMEITGRVPRARYYGPGRADPRVKQFD

SEQ ID NO: 2513 - protein, 259 aa, Unknown
  Description of Unknown: Verrucomicrobia bacterium sequence
MSEQADARVPLSVLVPVKNEAANLRDCLASVSFAEEIVVVDSASTDGTQAIAEATGARVVQFVWNGNFPRKKNWALENIPWQNEWVLIVDADERVTPELEREVKEAIRRTDVDGFYLNRRFWFLSGWINHCGYFPSWNLRLFRHRLGRYEQIEIDDNLVSGDNEVHEHVLLNGGAEYLTAPMEHYAFPDIATFVEKHNRYSTWEAAASGKLHERAGEKTLRASPLGTAVERKRWLKKLTARAPFRPSLRFLYHYVWKQG

SEQ ID NO: 2514 - protein, 489 aa, Lucifera butyrica
MTTGISLCMIVKNETDTLAACLDSVKGLVNEIILVDTGSTDQTVELARSFGATVFSCPWQGDFAAARNFSLAQASGNWLLVLDADETLAPGSPAILLQEIRQPGVEGFYIPIRNFIADGHTYVADQAVRLFRNKPAYRFTGAIHEQVAGSIQDTNHGQGLAVSQATILHRGYLAAVIQRKEKQARNITLLKSALASAPSDPFLLYSLAAEYMQAEDFNQAENLLHQSLSHMHGTEGFGAPALYALLFCLYQNKKWEELSRLLADALRSNPENANLFFFRGLLAAASNDAPAALADFATAARQGADTVPRHYIATLCGNLCLALEDWPQAANWFLLAWQEQPRSPYVLEQFLFLNRQESVQINWEELASSYPGEPEEPLANPRLVWANWLLSILRFSAGATSAAACLDRKSGLPVPGGASLPPEWRYLTLVAAEIHGILLLCNNHPAYKPVCLTAKIRHTAIAGLEILSRLDSSDPKTLSELPPKERSSL

SEQ ID NO: 2515 - protein, 255 aa, Thermocrinis ruber
MGLSVLILTKNEEKNIKRAIESVKDIADEIVVLDSGSTDRTVEIAKSLGAKVFFHEWDGYPQQLNRGIGLCSEDWVLVLDADEEVSEELRNSISKAISSHTAEVYMVCRKTYYLGKFLEHTWYPEWRVRLFKKGLVRFEGDLHEQAVFKGKAHKLKGDLYHYSYENLYHQYEKTLKYAKIMAEAYHKKGRKFRFYNLLFNPLWSFFKVYFLQRGFLDGVRGFLVAFSSFFYTFLKYMFLLELELKEKYKENLWKR

SEQ ID NO: 2516 - protein, 255 aa, Unknown
  Description of Unknown: Bacteroidetes bacterium sequence
MEKLSVVIITFNEEHAIGRCIDSVKSIADEIIVLDSYSTDRTVEIAIEKGARVTRQKFAGYIEQKNDALALASFPFVLSLDADEAVDEQLGQSISQIKSSFPSPAYTMNRCTNYCGQFIRHGSWYPDKKLRLFDKRIARWGGINPHDKVIMDKAAQAIHLKGDILHFSYRSVDEHVQQNNRFSTISAAAIYGLGKRTNLFKIVINPFWAFLQSYFVRAGFLDGFYGFVIAINIAHLTFLKHVKLYLLQKPPEIVS

SEQ ID NO: 2517 - protein, 252 aa, Frateuria sp.
MPISACIITFNEADRIDDCLASLAFCDEVVVVDSGSADDTRERAQARGARVLVRPFDGFRSQKAFAVEQASHDWVLCLDADERVDATLRASIEAARAQDFAGAAGYRFNRLSEYFGAYLRHGNAYPDRVLRLFDRRRGGWRGRREIHEAVSVDGPVKRLRGDLQHHPYRSLAEQLAKQERYAQMMAEHLYAQGKRATLRQILLNPCWRFVRGYVLRGGFLDGWRGLLYALVRIEYVRRKFLKLWLMQHGQRP

SEQ ID NO: 2518 - protein, 342 aa, Butyrivibrio sp.
MVTISLCMIVKNEEACLGTCLKSLQGIVDEMIVVDTGSTDRTKEIARENGATVYDFEWTGDFSDARNYSFSLAKCDYIYAADADEELDEDNRKRFLKLKGDIDELNIDIVQMYYCNQLAFNTVYNYDRELRPKLFKRIRTFKWVDPIHEMVSLDPVICNSDVEIIHRPRENHAGRDLASFRKAISEGRAISNRLHGMYARELFLAGTDDDFIKAKEFFAASVKDNNRSIDEVKQACCVVAHAAVIEDDAETLLKYTLKDAITDMSSEMCYDLGDYYYKKRDLDEAVIWYFNAAYECTSILDIKKSRELPRLALARCYRELGNEEQARDYEREAQQVADNYIE

SEQ ID NO: 2519 - protein, 252 aa, Bordetella pseudohinzii
MTLSVIIITKNEAANILGCLESVAFADEFIVVDSGSTDNTVALARDFGARVEVTPDWPGFGPQKNRALDLATGDWVLSIDADERVTPELAQAIRGAMEDPRADAWEMPRLSWFCGRFIRHSGWWPDYVLRLWKRGAARFTDAAVHERVVPDSGRSARLGPHLLHYPYPDFDALITKINRYSSDAAAMMHAKGRRANVFTALGHSFWTFVRIYLIRRGFLDGRHGLVLAVTAAAGSFFRYAKLMLKSEPEPPK

SEQ ID NO: 2520 - protein, 259 aa, Bacillus sp.
MTGREPLSVVVTTHDNAATLDACLRSVSWVDEIVVLDSGSTDATLAIAAHYGARTHTQPFAGYSAQKQAAIDLASHRWVLLLDSDESLAAEAIPLLQQTLVMPTHAGYQLWRREWQFWRWQSMRSRLNHYVRLFDRQRARMSGHEVHESVLVDGTVGVLDAVIDHYGEADIAGRTAKANRYSTLQLVDLAPRRVSWLRLRMVAYPTVAFLRYYVLRGHWRSGWAGFIAARIHAFYAFLKYAKLYELRRRERPEAGRLDQ

SEQ ID NO: 2521 - protein, 256 aa, Unknown
  Description of Unknown: Chitinophagaceae bacterium sequence
MQLSVIIITFNEENNIQRCLNSVRGIADEVVVVDSGSKDNTKTVCRQMAAKVYDHPFRSYGLQKEFATRLTAFDHILSLDADEELSEELRDSISRVKLHWEKDCYSCHRITNFCGQWILHGEWFPDKVIRLFDRRKAKWIGNIHEKIVPYDRHNMGDLRGELLHYSYHSLNHFRIKSEKYAAMSARELYRQGVYPGFYHFYIKPAYRFLSAFLLRRGFMDGNAGYHIARLTADRVYMKYEKLKQMHEQKEDPSADI

SEQ ID NO: 2522 - protein, 298 aa, Unknown
  Description of Unknown: Zetaproteobacteria bacterium CG12_big_fil_rev_8_21_14_0_65_54_ 13 sequence
MHGVLLPVIRPNRLVYAIWTRRNKPVPVSILLLTLNEEQNLPACLDAISWCDDIVVMDSFSSDRTVELATKAGARVEQRKFDSFAGQRNFALQHIEFKHEWVFHLDADEIFTEALFEEMEKAIRNPCFDAYNIPSKMMFMGKWLRYSGMYPSYQVRLTRRPVFQFKMVGHGQRADIAVEKIGTLHEPYLHYSFSKGLDDWFERHNRYSADEARASLAHRLNEQVNWAGLFARDADQRRLAIKGLVFRLPFRPFFRFIYMFFLRFGFLDGMAGLTYCYLVTTYEFMISCKIREIQTLEK

SEQ ID NO: 2523 - protein, 277 aa, Mucilaginibacter paludis
MLDLTIAIPVRNEEVNLPGCLSAIGQGFVAEIVIIDSGSTDRTKAIANEFGAKVIDFVWDGKFPKKRNWFLRNHCPKTKWVLFLDADEYLTEAFKVELAAALNNSGDQVGYWLNYTIYFLGKQLRGGYPLRKLALFKVGAGEYERIDEQQWSKMDMEVHEHPILEGEIGVISSKIDHRDYRGVSHYVIKHDEYATWESERFLKFYNDPAIVKNFTWKQRLKYKLMGSIFIGPLYFLGSFFLLGGFRDGARGLAFAILKMAYFTQVYCKLKEKMQPQN

SEQ ID NO: 2524 - protein, 280 aa, Arthrobacter sp.
MTEVMGANMERSDIAVVILTLNESETIEHAISSVGWSDDVFVVDSGSTDGTVEKASKLGAKVLVHRQDGPFLITEQRNWAVKNLPTEKPWVLFLDADELSTPEFVQAILDEINSNTRIDGLYAAPAFMYHGVWLRRCSGFPNWHPRAVRRGSGLRFTGGVWEEFTQGYPLSNVQVPYVHNTNAKGLTDWLEKHDRYAKWEANMISEGVGRKSERRSLLRRLRYSLGALRKYFALIYLAIVRGGLLDGPEARSYLKRMFIYELLIDEHYREMTHLRRGKGL

SEQ ID NO: 2525 - protein, 264 aa, Paraburkholderia sp.
MNSPQTASASVQRASLGVAIIALNAQPRLAQCLEALRFADDIVVIDGGSADETVAIARALGARVVVEPDWPGFGRQKNRAVAALDTDWILSIDTDEVVTPELAASIRQAIDSPRAEVYSLDRLSSFCGHWVRHSGWYPDWVPRLFKRGAARFSDDLVHERLVFDGRIERLAGHLLHYSYDDFETVLRKVDAYSSAGARQRHAAGKRGGFARAVLRGFWAFVRTYLLRGGILDGRSGFMIAVFNAETVYYRFLKLHLARQGDRKH

SEQ ID NO: 2526 - protein, 261 aa, Unknown
  Description of Unknown: Photobacterium aquae sequence
MSTEKPTLAVALIVKNEADNLQQCLASVAGWVDEIVVLDSGSTDNTEAVARQYTDKFFVNADWPGFGPQRRLAQSYVESDYILWLDADERVTPELRASIEQVLAAPQANTVYSIARLSWVFGRYIRHCGWYPDRVNRLYPTKLTQYNEDLVHEKVELGDGITVSPLEGDLLHFTYNDLNHYLVKSAGYAKAWADQREKRGKKSSLGQGLLHAVGCFLKMYVLKAGFLDGKQGLLLSILSAHSTFVKYADLWIRTNTDPRTP

SEQ ID NO: 2527 - protein, 286 aa, Unknown
  Description of Unknown: Opitutae bacterium Tous-C1TDCM sequence
MSAACPISILIPARNERANLRACLESCRFAAEVVVVDSGSTDGTPDIAREFGATVVDFKWDGRFPKKKNWALAHVPWRHEWVFILDADERITPELAEELRRTVAAPEHDGYFVNRRFWFIDGWLKHSGYYPSWNIRFFRHRLGRFEQFSGADASGSGDNEVHEHVVFTGKLGRLRHDMDHFAFPTIDIWVEKHNRYANWEARLLASPAGADAANTAPLDPSLARKRRLKVLAARLPFRPTLRFFYHYVLRRGFLDGYRGFVFCRLMGFYEFLSTAKAAELRRSGRA

SEQ ID NO: 2528 - protein, 356 aa, Cohnella sp.
MKTISLVMIVLNESDKLKRCLESVHDIVDEMIVVDTGSSDNSKEIALSYRAKVYDFTWTQSFADARNFALSHSTSDWNLTLDADEYISNDCALAIRTFINRKDVEIGRIKKVNKVMHKDGESYENSYTSRLFPAGIKYSGRIHEQIDSDLPRVKIDVEVQHDGYFEIKKSDRNIPILQMELRDHPNSSYYLYQLAKEYNGLGNFAEANSLYKKAYRLISRREIYAPNLIVDYIYNIVAGGLYEEGIEVIQEKQQFIHDYPDYHFACGVFYLEYILSDVAKNAHLLNKIEESYLKCIEIGETEKYDSVIGTGSFVAYYNLGTYYEVVGNIKSAEACYRKSAEYDYQPALSRLQLLSL

SEQ ID NO: 2529 - protein, 299 aa, Sphingorhabdus sp.
MTLTVVILTKNEERHITRALASVSGIADRCVVVDSGSTDHTVELAVAHGAEVMKNPWVNYATQLNWGLDQLPHDTEWVLRLDADEIVTPELLTEITQKLRELGPQIEGVYVSRRMTFLRRPINWGGVFPVRVLRIFRYGKGRCENRWMDEHIQVEGATAEFDGEIIDDNLNSLSWWTEKHNSYASREVVDVLNLEYGFMPHETIANLQSGQQAGVKRWLKEKVYARLPGGLRAFVYFFYRYIVRLGFLDGSEGAAFHVLQGFWYRYLVDAKLFEVKKYMERTGSDVVTAIDHVLGIKVQ

SEQ ID NO: 2530 - protein, 257 aa, Unknown
  Description of Unknown: SAR324 cluster bacterium sequence
MRPKISATIITLNEEKNIEACIQSLQWVDEIIVVDSLSTDRTKEIALSLGAKVVDQKFLGHVKQKQLAVDHCQNDWVLSLDADERMTATLKESILQLFETTDPGQLLHGYTVGRRSYHLGRWIMHGGWFPDRKARLFNRKHGHWAGVDPHDGIVVEGASGDLPGSLDHYVFKDLAHNIHTNNFYSSISADILYQEGKASSFLKLLFKPPGKFIETYIIKAGFLDGLPGFIISVGAAYSMFLKYAKLWEHHCRRDKED

SEQ ID NO: 2531 - protein, 258 aa, Oceanimonas baumannii
MSRPTLAAVLIVKNEAENLADCLATLDWVDEIVVMDSGSTDATQAVAEAAGARFFVNAQWPGFGPQRRLAQSKVNSDWVLWVDADERVTPELRASIEEVLAAPAENTVYSMARLSWVFGRFIRHCGWYPDRVLRLYPKALTGYNDALVHEKVETGPGIRTVPLRGDLLHYTYRDLQHYLVKSAGYASAWAEQRQRRGKKSSLLQGLLHGVGCFVKMYIVKAGFLDGKQGLLLSLLSAHSTFVKYADLWIRTETAPPKS

SEQ ID NO: 2532 - protein, 270 aa, Paraburkholderia sp.
MSDIAKPDAISVIVIVKNEAHDIRACLASVQGWVDEIVVLDSGSTDGTQAICREFGATVVETDWPGFGPQKQRALETARGPWILSLDADERVPTALRDEILASVKANAADLFQLPRRSNYCGQWIRHSGWSPDYVTRLFRRDAARFSNDLVHERVLYSPDSRIAALREPLLHYSFRDFSDVLGKIDSYSTYGATQGAVRGKRGSLGKALMHGFWTFVRTWIIQRGFLDGKMGLVLAISNAEGTYYRYLKLMLLDTKQPAAAAPGDRASGR

SEQ ID NO: 2533 - protein, 258 aa, Unknown
  Description of Unknown: Photobacterium rosenbergii sequence
MKKHTLSVILITKNEADRVEACLQSVAPIADEIIVLDSGSTDETVDICRRYTDNVTETDWPGFGKQKQRALEKASCDWVLSIDADEALDGTMQQALTALLGQDVIEHTAYRLPWGVTLYGKTLRYGRSARSVLRLFKREGSQYTLDEVHETVIPATGSTGVMKGYLLHYTHRDYGHGLDKAAKYAWLGSQKYHRKGKKSHGLFLALLRAIWTFFLIYIIRRGFLDGSVGFIVAMTYAQVNFNKYVGLWLMEQDDKVKE

SEQ ID NO: 2534 - protein, 257 aa, Acidihalobacter ferrooxidans
MAREACSAVLVTLNEAARLPACLDTLRFADEILVVDSGSTDDTVAIAERYGARVIHQPWLGYGPQKHYAVEQAAHDWVLCIDADERLTPELRASIEEALTHDRAKACRLTRRNRFLGRWLRHGEGYPDYVVRLFHRAHAQWSDDDVHETVLTDETPLITLHGDLLHESETSVGAYLDKQNRYTDLQAAALFAQGKRAGVAKLLLSPLVRFIKFYVIRLGFLDGLPGLVHILIGCFNSFVKYVKLIQMHRQQTKGTPP

SEQ ID NO: 2535 - protein, 255 aa, Shewanella halifaxensis
MKKHSLSVILITKNEADRVEACLKSVVDLADEIIVLDSGSTDDTVQICQKYTSNISITDWPGFGKQKQRALDKATGDWVLSIDADEALDEEMKLALIKLLSQDNIKETSFRLPWGVTLYGTTLKHGRSARAVLRLFKREGARYTLDEVHETVIPAAGETGKLDGLLLHYTHRDYGHGLYKAGQYAWLGSQKYARKGKHSKGLAAALLRGFWTFFHIYFIRRGFLDGSVGFIVAMTYAQVNFNKYVGLWLIEHKRS

SEQ ID NO: 2536 - protein, 259 aa, Unknown
  Description of Unknown: Sodalis endosymbiont of Henestaris halophilus sequence
MSQRKRLSVVLITLNEAKLLRACLESVSWAYEIIVLDAGSSDETCHIAAQAGARVFQSTDWQGFGIQRLRAQAYANGDYILMLDADERVTPPLKRAIQAVLRQPDAKAVYSFARRNLFLGRFMRHSGWYPDRVVRLYARKHHRYNAQPVHESLEKGECGIIPLTGNLEHLTCYHLPTFQRKQLEYAESWAQEKHRKGYKCSMCTIISHTYCAFIKTWLLRAGFLDGKHGWLLAVVNAQYTFNKYATLWALHHVVKGNYH

SEQ ID NO: 2537 - protein, 248 aa, Frateuria aurantia
MSEPISVVITSFNSAATLDACLASVGWAEQRLVLDSGSTDASPAIAAHHRADFHRQAFAGYARQKQAAVDLARYDWVLLLDSDEALPVGSETLIRAALATGHARGYQLWRREWILWRWQSPRSRLNHYVRLFDRRHARLSDLQVHETVQVEGDVSRLAVVLDHLGQPDIAQRVDKANRYSSLQLGDLRQRRDTGVCWRLCLYSSVAFWRYYLWRGHWREGWAGYVSARIHAFYAFLKYAKLYEADRRD

SEQ ID NO: 2538 - protein, 284 aa, Nibricoccus aquaticus
MTAPPASDPMFSIVILTLNEEQNLPATLASIRDCDDIVVLDSGSTDRTHQIARAAGARVVVNRFENFGQQRNFAHTDIPFHHDWVFHLDADEQFTPELFAECVRLSSENPPALDGFFVAPRMIFRDRWIPRCTDFPAYQARFAHAKRFRFIQTGHGQREAPDMRLGKIQANYLHNLSAQSESELLDKHLRYARQEAAAFLARATDPAPLNRRIRSADPLIRRRALKELSHHFPARGFLRFLYQYIARRGFLDGAPGFAYCRIMAKYEHWVSQEIHRQRRARAST

SEQ ID NO: 2539 - protein, 261 aa, Vibrio ostreicida
MSMPTIAVALIVKNEAQHLKACLDTVYEWVDEIVILDSGSTDQTEDIARSYTDKFFVNAEWPGFGQQRRLAQSHVTSDYVLWLDADERVTPELKLSILSAMKENKPETVYQAARLSWVFGRYIRHCGWYPDRVLRLYPTQLTQYNDALVHEKVEVAPQMEVKTLQGDLIHFTYNDINHYLVKSAGYAKAWAEQREKKGKKSSLSQGILHALGCFLKMYVFKAGFLDGRQGFLLSVLSAHSTFVKYADLWVRTETAKMPDTY

SEQ ID NO: 2540 - protein, 268 aa, Unknown
  Description of Unknown: Rhodobacteraceae bacterium D4M1 sequence
MVHSPAGKAPLSCYIRTLNEERRIADVVRAALRVADEVIVVDSGSTDRTLELAAAEGARIVHQPFLGQGFQKRVGEEAARHDWLLDLDADEVVPPALAAEISALFEAGAPEGPVYALPMIICPPDGPAWEGFSISWRNKLYDRRSLRMPEHKRYDQLELPQGVTPRRLANPIHHFAFRDVANLVAKMNGSSSRGAEGSRRKGRGVLALRILFGMPAYMFQHVVLRGRWRGGLYGVSIGTVLAWGRWLRDVKMYELHRREQWRRRTPPE

SEQ ID NO: 2541 - protein, 257 aa, Paenalcaligenes hominis
MLSVIIITKNEEAHIVACLESVQFADEIIVLDSGSTDKTCELATAHGAQVHHTTDWPGFGVQKNRALALATHEWVLSIDADERVPEALAAEIQSVLRAPQANAYSVARLSCFAGRWIRHSGWWPDRLVRLFKRDAGRFKDVRVHESVVVEGLVAELRGHLLHYPYDSLETLITKTNFYSTAAALSLYEKGKHIPIAGIALKAFWTFIRIYVLRRGFLDGRAGFILAGVAASGSFFRYSKLWLLNRKTNWQPKPPPGE

SEQ ID NO: 2542 - protein, 295 aa, Bordetella sp.
MIKSTNTTGSSLAVVLITLNEGHNLRRCLDQIIGWASEIYVLDSYSSDDTVDIALEYGATVYQRRFRGFGDQWNFALRTFPITSAWIMKLDPDEIVTDELKASISTITDSSDSPDAIKLRLQLYFMGKSLPVFLEMTRVWRTGSCNFSGVDVNEHLLVQGKIAIAGGIIEHRDSPNLDHWIRKQNKYTTAEAKSQYEQKSLSVEPKLFGSALERRMWIKRNFWKVPGRYKLLFLYHYLYLGTWRAGRVGWIWSHLRTEVYRTWEYKKYEMDLLGGPGVDIPSAIGQPDPRAQQFD

SEQ ID NO: 2543 - protein, 346 aa, Unknown
  Description of Unknown: Anaerolineae bacterium UTCFX5 sequence
MAGRVRAEGRRNAPRRPKYVQNPPAERDQSVDEPHAAVRQVLSEVESRAGVEADRRGHGAQGESRARPRTAICLRDGALHSNRNAMTRLTAVILTFNEEANIADCLASVAFADARVVFDSGSTDRTAEIAREAGASVIQRPFDNYANQRNAALESVAGSSAWVLFVDADERVTPALAAAVRRAVDQGDAYAGWRIARHNYIFGKLTLGAGWYPDYQTRLLRCGAAHYDPERKVHEVVLLDGPLGTIDEPFVHINYTRFDQFVAKQQRYTAYEAGILYEQGVRPKLRNFILQPLRHFRWRFITLKGYRDGLHGLRLSALMAWYELRKYQLLAALWRDHDRRSASDPQ

SEQ ID NO: 2544 - protein, 250 aa, Achromobacter spanius
MKLSVIIITKNEAANIAACLKSVSFADEFIVVDSGSTDGTVELAQALGARVEVTADWPGFGPQKNRALDLATGDWVLSIDADERVTPELAREIQDVLANPRADAYEIARLSNFCGKDIRHSGWWPDYVLRLFKRGTARFTDAAVHERVVPAQGQPLKLQGYFNHYPYDNLDALINKVNRYSSDAAAMMYAKGRRTSVFGALGHGFWTFVRIYLIRRGFLDGRHGLVLAVTAAAGSFFRYSKLMFLAEKQK

SEQ ID NO: 2545 - protein, 253 aa, Unknown
  Description of Unknown: Alteromonadaceae sequence
MMSTPISVFLITCNEQETLPAVLRSVSMFAEIIVVDSGSQDRTTAIAQEFGAKVIHQPWLGFARQKAFAMQACTHNWCFNIDGDEVVPEAVAKSIQQQVDANEANGLRVYFEDFFMGQPMHRSSHKRSIVRVFKQDKTRYPQDRLVHENVTVDGPTQKVPGTIIHYGYDDVATYMEKQNRYSSLSAQEKFNRQKPYSLAKLMLVFPLMFFKEYVLRKQFLSGARGLVHATIDAMYAFLKEAKLYELHRRQKHK

SEQ ID NO: 2546 - protein, 301 aa, Unknown
  Description of Unknown: Proteobacteria sequence
MTLLSVVILTKNEELHIERALDSVQGIADRVFVIDSGSSDRTVELATARGATVLHKPWVNYATQFNWALDQLPQDTQWVLRLDADEIVTPSLAQEIDAKLHQLPGDVDAVYVGRRMNFLGERVRFGGLFPIRIIRLFRHGRGRCENRWMDEHILVQGATAQFAGEIIDDNRNSLTWWTEKHNAYASREVVDLLNLEHGFMASETVADLKGGQQAGIKRWLKEKVYARLPAQLRASLYFFYRFVLRLGFLDTSGGRAFHILQGFWYRYLVDAKLQEVRKHMRDTHKDAKTAIRDVLGIDLQR

SEQ ID NO: 2547 - protein, 258 aa, Pantoea sp.
MSQRQRLSVVMIARNEAELLPDALASVAWADEIILLDSGSSDATAEIARAQGAQVYEALPWAGYGKQRQRAQAFATGEMILMLDADERVTLALRRSIEQVLRQPPSATVYSLSRSNFFLGRFMRHSGWYPDRVMRLYPRHLSYNDNLVHESLETQGAPVVTLPGDLAHLTCRDLITFQRKQMNYAEAWAQERFQRGKRCGLFAIFSHTLGAFAKTLLLRAGFLDGKQGWILAVVNAQYTFNKYAALWALHHTSAQGRV

SEQ ID NO: 2548 - protein, 252 aa, Unknown
  Description of Unknown: Caldilineae bacterium sequence
MAERRPISVVIITLNEARNLPDCIASVDWADEILVVDSGSTDGTVALAEKLGARVIHQEWLGFGRQKQFATEQATHDWVLNLDADERVSTELARSIRAVLSASKSAAAYQCNFRHRLLGRALRHGEAWPDPHVRLYDRRRAHWADVPIHEHVLVDGSIESLPGWIEHCTADSIAEMIDKINRYTDIQAEQMLGRGIRARLAGFLFRPFWRFFRAYVLRLGFLDGAAGLLHAGQAALTTFLKYAKALELQQRQ

SEQ ID NO: 2549 - protein, 271 aa, Paraburkholderia nodosa
MNDSAKPDAISVIVIVKNEAHDIRDCLASVHGWVDEIVVLDSGSTDGTQAICREFGATVVETDWPGFGPQKQRALDAARGPWILSLDADERISALLRDEILASVKTSGADLFRVPRQSNYCGKWIRHSGWSPDYVTRLFRRDAARFSNDLVHERVIAAPEARVGTLAQALIHYSFRDFSEVLGKIDSYSTYGATQGAARGKRGGLRKALLHGFWSFVRSWIIQRGFLDGKMGFVLAISNAEGTYYRYLKLMLLETQQSAAAKARDAAPESR

SEQ ID NO: 2550 - protein, 258 aa, Unknown
  Description of Unknown: Enterobacterales bacterium CwR94 sequence
MMAQQRLSVVMIAKNAEALLPACLDSIDWADEIILLDSGSADKTCELAAARGVKVYQSTDWPGFGKQRQAAQHYATGDMILMIDTDERVTPALRHSIERVLATPTANTVYSIARRNLFLGRFMRHSGWYPDRVIRLYPAHYHYNDNLVHESLDVQGAQVVPLQGDLKHLTCRDFGDFQRKQFTYAEAWAQERFLRGKKTSIAAIFGHTFGAFLKTLVLRAGVLDGKQGWILSVVSAQYTFNKYAALWALHRIKAQEES

SEQ ID NO: 2551 - protein, 272 aa, Chitinophaga skermanii
MNMPMQFTPVPISCYILTLNSQKHLQTVIDSVKTAVDEIVILDSGSKDDTEKIAAANGCRFLYRKFDNYRDQRKYGVDACTHDWVFSLDCDEVASPEFAQHLISLKDTLNDTIGNLPADEVVYVIMRDWYAFGRKVHALFPVVSPDYPIRLFNKKKVHYTEKSNIVHEEPQGYQLKKTLQGRVHHYTFETKAELYKKLDAYSSFDAQMKLIKGWRSNPFKAWFSPIKYWIKFYVFYGNWKDGKTGLLLAKYGYDYKRLTYSKLKKLQSQKQP

SEQ ID NO: 2552 - protein, 268 aa, Unknown
  Description of Unknown: Gammaproteobacteria bacterium HGW-Gammaproteobacteria-2 sequence
MGVTGTERPLPISGVVIAKNEADRIERCVRSLIGLCAEVVVLDSGSSDDTVARALAAGARVEHQEWLGFSSQKNVAVSRATQPWVLLLDADEWLVPSGARRVRELFERRPDGNALIERADIWRLLRRTRFLGRSLRHGGWGNEAVERLFRVNCRYLPARVHESLDRRGKKVLRLPARIEHDTARNQAEYEAKLDSYAELFARQRHAQGIRGYWIDAWLHAGAYWLKNYWFRAGFLDGRAGAIYHYLHSRYVFRKYRRLWQLRDAAIEP

SEQ ID NO: 2553 - protein, 279 aa, Methylocaldum marinum
MSVSILILTFNEEVNLPACLESVAWSDDIVVFDSFSTDATVGVARAAGARVFQRAFDDYGSQREAARVGVEYKYPWVLALDADERVDDELREEILRLVSSPSSGDHAAYRIRRKDHFMGQWIKHSTLYPSWFIRFYRPETIRYEARAVHEYPQINGTVGELSGHLVHHSFNKGLGEWFTKHVRYAQLEATENLRHMDDSSVDWRGLVSVDPVRRRRALKSLSFRLPCRPLFRFVYMYLLRRGILDGYPGFTYCCLISVYEYLIVLNIKEQRRRTQGVPF

SEQ ID NO: 2554 - protein, 271 aa, Unknown
  Description of Unknown: Candidatus Rokubacteria bacterium sequence
MNLVNRIPGSVCILARNSGATLRRALESVRDFDDVVIADGGSTDDTCRIAREFGARIVPQDPACLDGSGRIRDYACARNGAVRHARHDWVLYIDSDESVSAGLVEEIRGIVARGSEKWAYRVPVRIILDGREIRGSSNYPGWQTRLFRRSSGLSFVKPVHERLDITVHDPRVEECRNPWFVHWTRDYTRHYLRHNMKYIGMQAAHSAHAPLVSVLRANLVVAAKVIAKTGINYVRCRGRDTLPLSAEAGRAAVPLILCILSVRERLRRRTQ

SEQ ID NO: 2555 - protein, 372 aa, Anaeromassilibacillus sp.
MITISLCMIVKNEEDVLERCLRSAEGVADEIIIADTGSTDQTKEIALRCGAKVYDFVWKDDFAAARNFAFSKATCDYLFWLDADDVVPEQTRRGLLLLREKLDPSVDMVMLPYHTAFDAAGRPTLIFYRERLLRRAKGFRWEGEVHEVIPPSGRRISLPLPIEHRKLKAPETGRNLRIFEGLLKKGKSLTPRQQLYYARELVGAGRDPEAAVWLKRFLDERGGWLEDNIRACLDLAACRERLGDWEGALNAVFSSFVFDSPRAEACCAAGGLLQSRGDYRRAAYWYRTAIDCPPPDNRFGFYNPDFAGFFPLMQLCVCFDRLGETETAYDYHKRAQALKPEDPAVLYNERYFEGLGFPKAQQPPCQKAEKPV

SEQ ID NO: 2556 - protein, 253 aa, Unknown
  Description of Unknown: Muribaculaceae bacterium sequence
MPRHISVTIITHNEADRIEACLKSVAAVADEIIVVDSFSTDFTADICRRYGCRVVSRSFEGYGQQRQYATSLTSHPYVLSIDADEVLSPALIASILKEKEQGFNHRVYSIPRLNFFCGQPVRHCGWYPDYQVRLFDKRYANWNMHSVDERVVFPPGLQPCRLDGDILHYRCSTTSQYTRVRLRQAALAAGQIAQKSSFISPITPVVKGICAYIDMYVGQQAFLDGPEGRAISRISFLSTYTAWRIARKHRHKA

SEQ ID NO: 2557 - protein, 253 aa, Unknown
  Description of Unknown: Candidatus Thermofonsia Clade 2 bacterium sequence
MKLVAIILAHNEAEHIQDCIASLLWTDEVVVFESGSTDDTVALAKAAGATVITHPFEHFAAQRNAALQAVDADWVLFVDADERVTPELAKEIQSTLQNPSYMGYNIPRHNYIFGKLTRHTGWYPDYQLRLLKRDSAHYDPNIRVHEVVILADNASAGYLQNPLIHYNYRDLAQFIRKQRYYAKLDAEIWYHQGIRPKPRNFILQPLRAFKRRFITWQGYKDGWHGFRLSVLMAWNEWDKYWQLWKLTRQRDTR

SEQ ID NO: 2558 - protein, 287 aa, Xylella taiwanensis
MRIEREDHTPQSEAAVLLPMSLVVMTYNEAANIARCLDSVPFVSEKLVVDCGSADDTVAIARAHGARVIEQPWLGFGPQRNFASGQAAYDWILVLDADEFLSDTLRAECLRRLPALLAEDRLAAIWLRRSTWYMGAPMRWYRPMVGERLARLYHRDRARWSEVRVHESLRFDAPSAEFMAPFNHLHNPTLVHKYLKVLRYAELKALDWHSKAQAARMWQAPLVFVAAFLKDYVLRLAMLDGWRGFVVAQTAASYALYKRMRYYEMLRNPDSIQQAHAHLCKHRLEHE

SEQ ID NO: 2559 - protein, 261 aa, Unknown
  Description of Unknown: Sinobacteraceae bacterium sequence
MSLPLSVTVITLNEERNLERCLASVQALAAEIVVVDSGSTDATQAIAERFGARFVFNAWPGNVAQNAYATALCTHPWVLSLDADEALTPELAAEIRHVLTEGFEGVDGFMLTRRTQYLGAWMWHVWYPERRLRLVRRDAARWVGPDPHGRVEVAGRTQRLKHDFLHYTYRDLDDQYRKLLSYAHSSARERYAQGKRMSPVKLLLSPWFRFLRDLILKGAWRDGWRGVLIAWAGAFSSFLKQAYLYELEHEAQRHDAPHQRK

SEQ ID NO: 2560 - protein, 272 aa, Unknown
  Description of Unknown: Halomonadaceae bacterium R4HLG17 sequence
MSTQAAPDAAKPAITGVVITLNEAHNIEACLASLSRVCSELIVVDSGSTDDTRERAERAGARVIEQPYLGDGPQKNVGPGQASHRWVLSLDADERLTDEAVKIISALDLNADNHDAYALRRRNFIGSRWVKRCGWYPDYCIRLFDRERTAFSDSRQHASVQAKNPKRLDADLEHYSFANLGELFTKASGRFSNRAAKIMYLKGKRASALSPLTHGANAFVRKYVFQGGFTAGVDGLSVALSAAVNAYLKYAKLLEFQRDAKVRDAENFDKVW

SEQ ID NO: 2561 - protein, 369 aa, Ralstonia pickettii
MSKHAKHRAKPARGSLALVVIARDEAACIERCLMSAKRHVDRMIVLDTGSTDDTVAIAKACGAQVHHFTWVDDFSAARNAALDAANADWNLVLDADEWIESGTDELRDACTFGPLLGVVCIRSGFEVSGKVEQSNSWIARLLPRGVRYKGRIHEQPDADLQRVRLPLVIGHDGYLDVKLDKKRGRNHTLLQLELAARPDDPYVLYQLGKDFQINQGDAAQAATHYRRAVATAPKQSPYRHDLCICLLACLSQTGQLDEAITLAGEWMDEWSGSPDYFYLLGHLMFEAAAKHPAEAEKQWLPMAENAFLKCLEIGEQPKLDAAVFGRGSFAAAKYLALTYRALADTLAIKSNQYSDLARQMQERSAVAAA

SEQ ID NO: 2562 - protein, 361 aa, Unknown
  Description of Unknown: Aquabacterium olei sequence
MYRTALVLIARNEAHCIERCLNSLRPWVDQMIVLDTGSEDDTPARAAAAGAEVHHFQWVDDFSAARNAALAHSQADWNIVVDADEWLDSGGEALAGLRQQHPDFVGALFVNSSFDTSTSGVSAHAGSWISRVLPRGIQYEGLIHEQPRHALPVVRLPVTLGHDGYERAAMDHKGNRNALILQRALQSEPDNAYLLYQAGKDHEVHDRFEAAHAAYVQAWARCDPGAPWRHDLLIRHLFVMKQVGALADALALAEQEMPYWMHSADFFFTLGDLLLSQAVAAPSEASVILPVIESSWQRCLELGDTLDLEGSVAGRGSHLAAHNLMVFHESLGQAEPAAYYRDLAERLKSTNAVSSHSSGRR

SEQ ID NO: 2563 - protein, 277 aa, Unknown
  Description of Unknown: Alphaproteobacteria bacterium sequence
MPVSVVILTFNSEATIAATLASAATVSDDIHVVDSGSTDRTLELVRAAGATLVQHPFESYGAQRNWAIDTLALKHGWQLHLDADERLSDALVAEITALAATNFAGPAVGYFIPRLVHFLGAPIRHGGMYPIYHMRLFQTGRGRCEARRYDQHFLVDGPTAQLTQPMIDDIRMSLSEWTVRHNRWSDAEADESRLGTDPGALVKADAKGNPVEQKRALRSRYNAAPKFWRALGLFLYRYIIRGGFRDGVPGLIFFVLQTFWFRFLVDAKLWERENAGG

SEQ ID NO: 2564 - protein, 259 aa, Unknown
  Description of Unknown: Rhodocyclaceae bacterium SHINM1 sequence
MSEKLPLSLVLITCNAASRLRDVLASVPFASEIILVDSGSTDETAAIAVEFGAQVVHHPWAGFGPQKAHAVSLASNDWVLCLDADEALSPRLATSIQRAFSKGLPDYPVYRFARCNVFMGRPLKHGEGYPDYNTRLFRKDAARWSDDIVHEHVLSDLPPRTLEGDLLHYSADDLKAYLDKQNRYTSLAAERAMARGESAPLARMLLSPVTRFLKFWLVRGGWQDGLPGFVHIAIGCQNSFMKYVKLRELRRQAGLSDQE

SEQ ID NO: 2565 - protein, 273 aa, Unknown
  Description of Unknown: Opitutaceae bacterium EW11 sequence
MFSVVILTLNEERNLPGCLSSAFSASDDVVVLDSGSTDRTKELARGAGARVAVHAFENFGAQRNHADHAIEYRHPWVFHLDADERFTPELIAECQARSEENPADVDGFWVAPKMYFRNRWIRHCTDFPAYQARFVSPQRFQFVQFGHGQREHPEMRMAKIRANYLHDLSADGDDALLEKHRRYAREEAEQALRSSTTEQLRLSALFASDALVRRRALKTLSHRLPARGSLRFLYQYGLRGGFLDGRPGFAYCRLLARYEKWVADEIRRQRHSK

SEQ ID NO: 2566 - protein, 257 aa, Bdellovibrio bacteriovorus
MLSGVTKLPISLVIITLNEEANIERCIRSAPFVSDVVVVDSFSSDATPEIAKACGARVFQEAWRGFGPQKAFATEQATQPWILSLDADEALSPELAAEIQSKFSELDPKAGYMIPRRSFHLGRWIYHGGWYPDLQLRLFNKDHSQWNAAAVHEKVEVQKVLQLKNDILHWVFKDLSHQVITNDRYSSLGAAELESRGQRFSIFKLLFKPFGKFVECYIMKAGFRDGVPGLIIAMGAAYSLFLKFAKMWEKEHVRKNS

SEQ ID NO: 2567 - protein, 303 aa, Unknown
  Description of Unknown: Acidobacteria bacterium sequence
MPERPTVPVTVIVLTKNEAANIDACLDAVRDWATAIFVVDSGSTDDTRERARRAGAEVVVHPFETHSAQWQWALDHLPIPTEWVLALDADQRVTPELREAVAAALAGPEAGRYDGFFVNRRQVFRGRWIRYGGYYPKYLLKLFRRSAVTLDARELVDHHFHVRGTTTRLRGDLVEDNRNEAAIGAWVDKHNRYARLQAIQELRERREGGSRGRFFGSPDERVNWLKARWRRLPLFVRPCLYFIYRYVIRLGFLDGREGFVFHVLQAFWYRLLVDINISELAGEAGSDRDPVAEEGRREAQVRA

SEQ ID NO: 2568 - protein, 277 aa, Streptomyces sp.
MTRLPIVVAIPTKNEAANIATTVRSAIGHFAAVVVVDSDSTDDTRALAKAEGAEVVPYTWDGRYPKKKQWCLEHVRPDLPWLLFLDGDETPSAELLLELRRIFLDGREVRPAAFDIPLRYWFAGRRLRHGYTIVKRALLDRTRTRFPEPDDLAAPGMGEQEGHYQPLAEPVFRLRAPIEHLDLDPVRTWFERHNRYSDWEAWLELHPEVREQIRAAKTRQGQVFHRAPFKPLLSFGYSYLFRLGFLDGRAGLDYALAMSFYRWQIGLKTREARQDTG

SEQ ID NO: 2569 - protein, 290 aa, Phycisphaera mikurensis
MVPVSVVLLTHNEAGTLPAALASCRWCDDVAVVDSGSTDETRSLAEATGARVFTNPFESFGRQRNWAIDHAEPRHKWVFHLDADEEFTPALVEEIRRFVASPDADTVDGLHVAHKLMLHRQWLRYAGGYPVFQMRFFHADRMRFIDHGHGQRERPGGRIGRLGEPYLHHAFAKGMEAWLAKHNGYARREAEQARRAVEGEAAGLAALLSSDGVRRRRAVKSLFQRLPARPTLRWLIVLVLQRGVFDGRAGWTYASMLRVYEQMILLHARALADGEGTSPPPDDATAGADS

SEQ ID NO: 2570 - protein, 245 aa, Trinickia caryophylli
MIAFNSAARLAQCLEAVAFADEVVLVDGGSHDATVAIARAHGARVIEAPDWPGFGPQKNRALAALSTDWVLSIDTDEVVTPELARAIVEAIGSAHANIYALDRLSSFCGTWVRHSGWYPDWVPRLFRRDAARFSDDLVHERLVFEGPAARLAGKLLHYSYEDFETVLRKLDAYSSAGAQQRLAAGKSAGFAQALWRGAWAFVRTYVLRLGFLDGRTGFMIAVFNAQTVYYRFLKLAWATRRGDRH

SEQ ID NO: 2571 - protein, 314 aa, Unknown
  Description of Unknown: Chloroflexi bacterium sequence
MTDTRIHRSRRDRTLDRTAAGRSRGAAGRRRIGLSRGPPLVLGRDRQRLRRDVRRSAAQEGEDVVEKKSPTLTVVILTLNEERNISECVASARDADEVIVVDSGSTDHTQELAAAAGAKVVEHAMTNFAEQRNYANTLAKCDWVLHLDADERITPELLQEIRSVTATGEEDGFNVPTLNIIFGAPLRHGGWYPSYHVRLQRRGRAGWGKDVHETAVVTGSLGRLRNPIVHHSHPDVSAFILKLDRYTGMEAAQVGGSRLSLALRAVLEPGPYFVYKYFVQQGFRDGWRGLSIALLLAFYRCVGYLKALELRSRA

SEQ ID NO: 2572 - protein, 278 aa, Streptomyces avicenniae
MTRLPIVVAIPTKNEAANITGAVRSVAAHVEAVVVVDSDSTDDTRALAKAEGAEVVPYTWDGKYPKKKQWILDHVRTDTDWVLFLDGDETVGGELLAELRRIFLDGRQVRPAAFDIPLGYWFAGRRLRHGHTIVKRALVDRSRVRFPEPDDLAAPGMGEQEGHYQPLADPVFRLRAPIEHRDLDPVGTWFERHNRYADWEAWLETHPEAREEIRTAKTRQGQLFHRAPLKPLLSFGWAYVARRGFLDGRAGLDYALAMSFYRWQIGVRAREMRRDTDT

SEQ ID NO: 2573 - protein, 640 aa, Desulfotomaculum reducens
MGNRISLCMIVKNEEGNIRRCLASVTGVVNEIIVVDTGSTDNTCKIAREMGARIYSFEWNNNFSDARNFSLAKATGDWILFLDADEELAGESREVLVKYVADEQVEGYFIKIINYLGKEGWTETCPDLVFRLFKNRSQYRFRGAIHEQIADVILEKNKQATYRIAEDIIIIHYGYLDSQIDQKDKKNRNLHIIQKEMVENPGNYLLKYHYGVELYRAERYGEAAEVLIQAANNTDSSTIYFPKLLRYIVLAYHSGGQPAKALDVIRQGLQLFPNYADLHYYGGLSLLQLKHYHKAVELFLQAVALPEQPPQYASFAGVRGFRSLYHLGEIAEVFLNYEEALRYYLESLRDNPGFQPALERIIKILKPRENPEYTRECLEKVLDFSSPQATLILSNIFFQQGAYKLTLEFLERLIRMGNSSAEILFRKSFCLIQERRFLEALRILNEYTADSYIYPLAKFNQILCFWVQGKKRKVRSLVQEIRTLEPAEDTESILRLLLRSQEKRKYVHRIFLGKDAVTLLLDIVGRLLYLSELTRVEELFSRVDPKCLGDRMLDIIRLYHEHGYYEKTVELLQEYIEANQNGEAHFLLAETHRELGDFIEADHHYRYAIELDPSQPRYYISQSKLYEDRSEKIKGEVPLE

SEQ ID NO: 2574 - protein, 254 aa, Hahella chejuensis
MSPDPKLLSVTIITLNESARIKACIESIAFADEIVVIDSGSDDDTREIAKSLGARVIEKSWLGYGRQKQFAVEQAANDWVLCLDADERVTPELAKEIREVMQNPAYSGYVMPRRNRFMGRWLRYGEGYPDLSLRLFDRSKGRWSDDPIHEKVVLESEAGRLSGDLLHFSEDGVAAYLEKQNRYTTLQAHELKRRGKKFSHAQLIFSPLFRFIKFYFLKRGFLDGAPGLIHIVVGCMNSFFKYAKLRELGLNEDR

SEQ ID NO: 2575 - protein, 262 aa, Salinicola sp.
MANITGVVITLNEADNIEACLASLGRVCQELIVVDSGSRDATVALAEACGARVISQPYLGDGPQKNVGPAAASHRWVLSLDADERLTDAAVTTIGALDLENTPHDAFALRRRNFIGSRWVKRCGWYPDYCLRLYDRQRCAFADSRQHSSVQASQPYRLDADLEHYSFANLGEMFGKASGRFSNRAAKIMYLKGKRANAGSPALHGANAFMRKYVFQGGFLAGLDGLSVALSSGVNAYLKYAKLLELQRDARVRDAEDFDKIW

SEQ ID NO: 2576 - protein, 253 aa, Unknown
  Description of Unknown: Bacteroidetes bacterium MED- G21 sequence
MNVSNKITGIIPTFNEENHIEAAIDSLNFTDEIIVLDSFSTDTTVERAKSKGAKILQRKFDNFSSQKNFAIENASHSWIFLLDADERVSNELQKEVLEIISKPSKYSAYWIFRSNFFMKRRIKYSGWQNDKVIRLFIKEKSHYNGKLVHEEIQTQGEIGWLKNKLDHFTYKGFNSYIQKKNHYAQLQAKELAEKGLKPGVFHLLIKPLYRFINHYFLRRGFLDGTEGLFIAIFSAYSIFARYVNLWLLNRGLK

SEQ ID NO: 2577 - protein, 262 aa, Burkholderia pseudomallei
MTEPTLGVALIARNAAARLAQCLDALSFVDDIVVIENGSSDDTVAIARAHGARVITTDDWPGFGIQKNRAVDALSTDWVLSIDTDEIVSPELANAIRAAIRAPLADVYEIDRLSSFCGRWIRHGGWYPDWLPRLFKRGAARFSNDLVHERLVFEAPSARLPGKLFHYSYEDFETVLRKLDTYSSAGAQQRLAAGQRGGLGKAILRGTWAFARTYLLRLGFLDGKAGFMIAVFNAETVYYRFLKLDHAGLRRETPRSTRDSVN

SEQ ID NO: 2578 - protein, 351 aa, Castellaniella defragrans
MNPPTIALVMIVKNGAATLARCLSSVQGHIDELIVLDTGSTDDTVAVARRFGARVHHFDWVDDFSAARNAALDHSAADWNLILDADNWLESGHEQLRRLGSAPFLGQVAILNRFVQGGEVRQATEWTTRVLPKGVRYVGRIHEQAANPGNLPRKRLDIRVGHDGYMPEGLEAKKGRNEALLRVALAEVPEDPYLLYQLGKELALYDRHEEAADHFSRAVSLCARDQSFRYDLIMRALYCLKRAGRLEQAILLAEEEFPYWQDSPDYFFCVADVFLDWAIRHPAEAESQFLPIVESSWLKCLEIGERPDLSESVAGRGSYLAAQNLAVLYENTGRAALAAEYRKKAGEMREG

SEQ ID NO: 2579 - protein, 336 aa, Sphingomonas parapaucimobilis
MLPPAPRIAATLIVRNEERCLARCLESVAPFVDRMVVLDTGSTDRTVAIAQAAGAEVHHLPWPDDFAEARNHVLACADADWNLMLDADEWISAGGEQLRRWCAGPPRLGSVCIENETDGSAQPTRSWIPRLLPRGTCYEGRIHEQVVSSLPITPTPIHVGHDGYLAAQKAGKIDRNYQLLQRELAEQPDNPYLMFQFGMEAQARRDLPTACDYLKRALATAPREAGWRHPLVTSAMTLMAYMGRRDEALALADAEFPHWQHSPDYFCVLGDILFDQALAEPAQAIGHWLPLAQAAWERCLAIGERPDLDGSVAGRGSYLAQQSLDIVRSQLATLAA

SEQ ID NO: 2580 - protein, 295 aa, Unknown
  Description of Unknown: Rhizobiales bacterium sequence
MTVSALIMTFNEEMNLPACLESLAWCDDIVVLDSFSADRTVEIAKAAGARVYTHAYDTEDRQRMYGLTEIKFKHGWVYTPDADEVTPPDLRDEMLAIAADPDRPEVFFKARYKNMFMGRWIRHASLYPTWITRLVRPDRVRFERSVHSRASGGPGGELQAHFVHYSFNKGLEAWYAKHNRYSSVEADLSAARLLERSIDWGGIFSTEPERRRRALKSLSYNMPFRPSLRFFYMYVLRRGFLDGKPGYLYCRLLAAYEFMIVVKMEEQRSRQNAQPARPSVQQRTLDAKEPERRMV

SEQ ID NO: 2581 - protein, 259 aa, Oceanisphaera arctica
MSSRPTLAAVLIVKNEAENLADCLATLDWVDEIVVLDSGSTDTTREVAEAAGARFFVNDHWPGFGKQRQIAQAHVQSDWILWVDADERVTPELKTSIEAILAKPTTNTVYSVARLSWVFGRFIRHCGWYPDRVLRLYPKALTGYNDALVHEKVTLKKGIKTKKLKGDLLHYTYRDLEHYLVKSAGYAAAWAEQRQQRGKKGSLCQGLLHGVGCFMKMYLLKAGFLDGRQGLLLSLLSAHSTFVKYADLWIKTETRGPRA

SEQ ID NO: 2582 - protein, 337 aa, Motilibacter peucedani
MLSVVLIVRDEAAALPGALRSLEPLRDAGLLDAVRVHDTGSTDATRELAGAWGAQVASGPWTGDFAAARNAALEGVSSGWVLSIDADERVEADVDALRALLTAGRADAYAVSIRNDADSGAWTHRAERLFRPAVARWEGRVHERLVARTGAGLPVADVPAGVLHLDHTGYATGEVRAAKSVRNVALAQADLDALAATPHPDPARVAQVLLDLGRSLVGADRLQEAVDAFEALRSLAPGTPQALQGTDAFARLLLGAGMDSVVLHLVGELRAGGAPRAYCDWLEAQALAQLGQVERAHDLLQGVDEVVDTAGRRHPQAQLDELRSLLRSLRARVPQPR

SEQ ID NO: 2583 - protein, 407 aa, Unknown
  Description of Unknown: Armatimonadetes bacterium sequence
MPTQVSESPDLPRLPSACSIVFRRMKNTLSLCLLVRNESANVGKAIESFEGYVDEVVVVDTGSDDDTREVALSHGARVLDFPWRDDFAAVRNFLFSHARCDWIFHLDADETLLPGSREEIRNLVGRPEVQGAYVLRQDLFSADDPSQFTEMLQLRLFRSGELPQQVGRCHPHFEPPLEDVARTSGRQVVLSNVWLRHTGYVAELKPTKLERSARLLELELQDRPGQFYYQVELAMTLLQLGSDRATAALHQACVSLRPHLAAPTAPSHQAALLFEILLQIQDHNLPGGWSKDQVRELSARWFPNSAPLTWLRASYEFREGRFESARATLEHLEAMADNESYDKTTSFHPSILGPELHLNLGVCYARLGKLNEAIACFERLRNTQFADFAEQNLAAIRDLQRQFESEA

SEQ ID NO: 2584 - protein, 266 aa, Unknown
  Description of Unknown: Cytophagales bacterium sequence
MNTTTNLSLSVVLITLNAERTLSQTLTSVSSLADEIVLIDSGSTDDTLTTAKTFGCRVFHRLFDGFGPQKKFAIEQATHDWVLLLDADEALDPKLQQAIRETLTHAPDSHAAFSLPRSLVFMGRPMLHGGENHRPVVRLFNRQHTHMTNALVHETLMTSGPVTSLKGTLWHDSYGSLHDYIGKMNQYTSLNARQSERVGRRPGPLDVSVRFVFKFLKVYFVKGSILDGLPGFVWAFFSAVYPVLKYTKLYEQQVGQGYSPSPAMSY

SEQ ID NO: 2585 - protein, 258 aa, Ferrimonas sp.
MNHHHRPRLACALITKNAGPRFAEVLASVDWVDEIVILDSGSSDDTIEVAERAGAKVFQSEDWPGFGPQRQRAQQHVSADWVLWLDTDEVVTPELRQSIEAVISSEPDPSIAYEVNRLSDFFGRFIRRSGWYPDSVVRLHATNRYHYNDALVHERIEVPKGKLKSLSGDLLHYTSDDYRGYMAKSLQYADAWAEARHAKGKRTSVAGIIGRSFWCFLRKYLLQLGFLEGRHGLLLALQSSHYVFNKYFGLWVRQNKLK

SEQ ID NO: 2586 - protein, 304 aa, Unknown
  Description of Unknown: Candidatus Roizmanbacteria bacterium CG11_big_fil_rev_8_21_14_0 _20_37_16 sequence
MKKLSLALATYNEELNIVDCIKSCKGLVDEVVVVDGSSTDNTASLALTEGATVIRTQNLPMFHINKQKAIEACASEWILQLDADERVTPELAAEVRQIIQMTNEEINKYQENLKEKKLFERHQKLVMKHVTCNTQHKKQDKENVTCYMLHATCKYNAFFIPRLNYFLGGYLRSGGVYPDGVIRLIRKGKAYLPCRSVHELIEVEGRTGWLANPLIHKDSPTFQRYLERNSRYIDYLVEELKAESLKLKAKNKGFQLSTFSFRLLQGIDWIIIKPIVTFFSLLIRHKGILDGWRGVVFAFFSAIR

SEQ ID NO: 2587 - protein, 258 aa, Unknown
  Description of Unknown: Xanthomonadaceae bacterium AQ6-296 sequence
MSTGLNRSGLSACVITYNEADRIEACIASLAFCDEIIVVDSHSTDATRALAAAAAARVIERDWPGYRSQKQFAVETATHDWVLCLDADERISDDLRDEIIALRESGFLGASGWKFPRCTEYFGRYLRHGNGYPDRVLRLFDRRTGAWAGREIHEHVEVQGAVARLRGELLHNAYRNLADQLRRLENYACLMAQHMHAKGRRAHWWNLLLNPGWRFFRGYIFRGGFLDGWRGLILAYIEANYVRQKFIKLWLLNHDEKI

SEQ ID NO: 2588 - protein, 253 aa, Marinoscillum furvescens
MDTPLSVVVITHNEELRLEACLQSVAGLSDELIVVDSFSTDDTKNIALRHGAIVFEHAYKGQVEQKQFALTKTSHQHVLALDADEQLTEELIQSIAREKKQGFPAGVYEMNRITYYAGTWIKHGGWYPDWKLRLWNKSKAKWGGRNPHDQVFPKEIKEVKRLQGHLLHYGFETIAEHKQRITNYAEIGAEALYAEGKSSSILRGVLSALIKGIRDYIFRGGFRDGKSGWLIAWYSMKGKYLKYKKLYELNKRQ

SEQ ID NO: 2589 - protein, 300 aa, Robbsia andropogonis
MEVPASAPERSTLGVALITRNAARHLAACLDAIDFADDIVLLDQSSTDDTVDIARTRGARVITAPDWPGFGVQKNRAIALLATDWILLLDADEIVSETLRASLQQHCQSVHSTMEVPDNAPPVVYALDRVSSFCGQWIQHSGWRPDVIPRVFRRGNACFSDDRVHERLLYDAPVRTLDGELLHFSYDNVDTVLRKIDQYAAEGARQRFERAPGARPPSIGKAWWRAVWAFTRTYLLKRGFLDGGAGLTIAVMNAQTVFYRFLRLREQLIAVRSPVHPDASGIDPSAESMPKLKDDKKSMS

SEQ ID NO: 2590 - protein, 330 aa, Blastomonas sp.
MIVRNEARCIARCLDSVRPWVDKMVVLDTGSTDNTIELARQAGADVYEMEWPGSFAEARNRSLELADADWNLVIDADEWIESGGELLRSWCQTPHRLGVVCQRSAFELAGVKGAQPEGQHWITRILPRNVRFEGRVHEQAASTLPRVRVDLYLGHDGYLDAQLDTKRDRNGSLLLLDLEDSPGDPYILYQLGKETEVRREFAAASEYFRQSLAATPADANWLHCLSTRYLYCLGQVGDFDTAFAFADQFMMRWEKSPDFFFVLGNLALDKGMTDPANALDEWIPLAVSAWERCLEIGDQPLLEGSVHGRGSHLARTNLDAIRSQLPGLAA

SEQ ID NO: 2591 - protein, 261 aa, Unknown
  Description of Unknown: Acidobacteria bacterium sequence
MIVALNQISAVIICCNEEAKIEGALKSLQGIADETVIVDSGSHDRTIDICRHYTDRIFQKHWEGYRRQKQYATDQARYDWTLSLDADEVVSPELHSELTQWRCAPPEHHAGYFLPRKTYFMGRWIEHTSWYPDWQLRLFRRSAGRWEGGHVHESFKVSGTAGRLRGHLYHYTYSNLSEFVQQLDNFSSLAAADLFDRGVHARLFHIVANPPLVFLKNYILRRGFRDGAQGLVVSILSSASTLFKYLKLWELQHRQREKGKQ

SEQ ID NO: 2592 - protein, 273 aa, Unknown
  Description of Unknown: Acidobacterium capsulatum ATCC 51196 sequence
MSSQQDIPPDTPRKDTLSVAIITQNEEANLARTLGSVRFADEVIVVDSGSTDRTVAIAQEAGCRVFTEPWQGFARQKNLAIEKCSSTWILSLDADEELSPALQQEILALLKSSPRNMAFRLRRRNLFLGRWMRHGGYYPDAKLRLFRRAGMQGEAPLRFAERAVHETIAYDGPSETLRHDLIHHAYPTLHGYLEHMNRYSTLGAQVAVKKGKTIQPWWAFLGNVVLVPIFTFLWNYIFRGGFLDGREGFLLHAYHSLYTSWKYAKAWEMTRKA

SEQ ID NO: 2593 - protein, 329 aa, Desulfocurvibacter africanus
MISVLILTLDEEANLPACLDSVRFSDDLHVLDSGSSDRTADIARARGARVTQRPMDDWASQLNFAMRELPFRHPWVFMIDADERASPDLVQAMLKAVGVSRPAERFAESEAHLSPLQFANKHRGSRGASAPGGWGLGRAKPFPIPERDAQPTGDIAAFSIRRRDFFLDGRELRRVQATPRYVRLFRPERVSFSRLVNPVTHVHGPVGRLDGDLLHYPFSKGLAQWIARHNSYSTLEARQELEQEARDGSRISLRGLLHPDLGERRRQQKLLLARLPMRSLARFLALYAARGGFLDGRAGLAYALLQAWYEYMIVLKKREMLAFAKRRGE

SEQ ID NO: 2594 - protein, 281 aa, Unknown
  Description of Unknown: Planctomycetes bacterium sequence
MPKIPVSVLIPCRNEEANIRYAIEGVMNWADDVIVLDSGSTDATLDIVRQYPVRLVEHPWEGFAKQWNWALRNIDFKHEWLLMMAADCYPHKNLPDAIASAVRRNRYDGYYIRYRYVFMGKWLRHAAGYPQWFLTFFKHRLAHYEEREVHEHPIVDGKVGYLAADIWHHDRKPLREFFLRHAKYAEMEAREQFRIHTGRKKRTYTLLDLFKPGRVNRAIKENIWTRIPLLIRPFMRFLWLLMFRAAWLDGMPGIYYCFHSFCYHMQVSMHLRELLREGRRR

SEQ ID NO: 2595 - protein, 269 aa, Burkholderia dabaoshanensis
MSNQHPEPNDSGVSRPNRATLSVIIVAMNEAHDIRDCLESVRGLAMETIVFDSGSTDGTPALCRELGARVFETDWPGDGPQKNRALAQATGDWVLCLDADERVGDELRREIERLLDQGATHAAFSTPRRSSFCGQFMKHSGWWPDRIVRLFRRGSARFTDVRTHTHPVIDGTTGTFNGPIVHIAIGDLHEALDKANSYSTSGALTMAEGGKRSSLGKAIGKGIWAFLRTYVLRRGFLDGRMGFMLAVANAEGTYYRYAKLALLNDRHAS

SEQ ID NO: 2596 - protein, 249 aa, Unknown
  Description of Unknown: Phascolarctobacterium faecium sequence
MRKIAAVILSKNEEKNIQAVIENARNSVDEIIVIDSGSTDRTVEIARQCGAKVFFRQWDNDFSAQRNFALDKTDADYILYLDADERMSDELCQEVKKIADGEELRQYSFMRKIKAFGFEYRYGIFAPDEVVRIFPRKNICWENKVHERPVCKLPKIKLHGIVKHYTYDSWQQWLDKAGQYTTIWAKDSYRKGKRASAGSAFGHGMYGFLRAYIIKLGFLDGWAGMYSSLQHLFYTLMKYWKLYELGHKK

SEQ ID NO: 2597 - protein, 266 aa, Unknown
  Description of Unknown: Parcubacteria group bacterium GW2011_GWA2_47_16 sequence
MNTHKISCTVGILTFNSEATLKAALESVNGFAEIIICDGGSTDETLSLARAYGARVIVQAPEFKSEDNKVIDFSGVRNQMLSVASHKWFFSLDSDELMTEALQTEIETLISSGHPAAAFWVPRKYTLNGEIVDCAATYPARQMRFFHRDAVKGFVKTIHEKIEVKSGASVFKLRNFMLVPFNPDPTFHRRKWQHYIELEAARHGRISFWGWLGSSAENFKISFLYALRYVRNLIFCRGSRMPWRLEWERHVYHINTCRRFWKLIGK

SEQ ID NO: 2598 - protein, 293 aa, Brucella sp.
MTVSVLIMTLNEEANLPACLASLDWCDDIVVLDSFSTDRTVEIARAAGARIYQRAYDTEDCQRMYGLTEIGFRHTWVYTPDADEITPPDLRDEMLVIAADPDRPEVFFKARYKNMFMGRWIRHASLYPTWITRLVRPDRVHFERSVHSRASGGPGGELQAHFIHYSFNKGLAAWYDKHNRYSSVEADLAASKRLERHIDWGGLLSGEPERRRRTLKSLSYNLPFRPSLRFLYMYILRGGFLDGKPGYLYCRLLAAYEFMIVVKTEEHRRKQSAMPQAPARHPLDAEEPERHMV

SEQ ID NO: 2599 - protein, 248 aa, Gallionella capsiferriformans
MLSVVIIAKNEAANIGACIQSVAWADEIIVVDSGSTDDTVSIAREMGARVYLHADWPGFGPQKNRALSYASCAWIFSIDADERVTPELRAELEQAMRDAAADGYYCPRLSQFCGTFIHHCGWYPDYVLRLFKRAAGQFSDSLVHESVLLTGKTAKLHSPLLHYSYLTTDDVERKVAHYSTAAAQQMFEGGKGSSLAGAVLSGGWAFIRTYVIRLGVLDGAAGWRIAHMNARTTYLKYRKLAALHSAAR

SEQ ID NO: 2600 - protein, 276 aa, Burkholderia sp.
MTYGFSVLILTKNEEADLPGCLKSIDGVDDIWVLDSISEDSTVQIANAFGAHVVAREFDGFAAQRNHALRNFGFRHEWLLILDADERPSPELMDELRRFVSDAPDEIGAARMRRRDYFLGRWLKHAQISPYFIRFVRPSRVHYEREVNEVLIVDGDIHELAGPLDHFPFSKGMAHWIGKHNVYSSMEAGELLRRRQADFSVIKALFDRDFNVRRFHQKALFYRMPCRPLFKFFYMMAVRRSFLDGRAGWHYTFLQCVYEYLISVKAVELHRADRRR

SEQ ID NO: 2601 - protein, 345 aa, Massilia sp.
MIRLALVMIVRDEAARIARCLDSARALVDDIVVLDTGSRDDTAAIARFHGARVFAFDWCDDFSAARNAALDYSSADWNLVLDADEWIAAGSERTTLDAFMESGACIGVLPVTSEFDSQGRVESAVQWLPRLLPRGVRYCGRIHEQPVTDLPRRRIGLSLRHDGYRRDALERKHGRNDALLRRALLDAPDDSYLRYQLGKNEEVYGAHEAALEHYLAALLCCGEEAYRHDLVVRTLFCLKKAGRHADAVALAEGEGSRWEASPDFYFVLGDVLLDWAAATPEQASELLPVAEGCWQRCLELGERADLDGAVAGRGSYLAAHNLTVLYENLGMDEEALRYRVLAARP

SEQ ID NO: 2602 - protein, 265 aa, Aeromonas molluscorum
MEQQEAVTLAVALTTFNSMRCLPMVLDSVQGLAQRIVIVDSGSTDGTREYAAEHGCIVIERPWPGPLKQKVFAMEQCAPAKWMLLLDSDESLEPELRSDMERVLQEDDPSISAWEFQRKIWFLGGWLHHMYQPEWRLRLVRSDQWRMEGKMDLYHDKLVTDGKVGKLKGICRHDSYADIKDAVMRAQRYAERAVGREMKGGRWYDFAWCIVDVLWRHGIRQRAFLDGKRGLIMLGITMASKLIRQAYFCQQRLQPPKKDWENPVV

SEQ ID NO: 2603 - protein, 381 aa, Cohnella abietis
MFLLPTLSLCMIVKNEEANIERCLTSVKPFADELIVVDTGSTDRTIELCQAAGAQVYTFEWNNNFADARNYSLDQATGDWILWMDADEVLDGSAAADWKEQLAAETDSVLNVHLINYIGEETNPNETFHIAHTRLFRNRIGLRFLYHIHETLNVEEVFINDHALSRIKLHDGLTIHHYGYLQEYTTAKKKNERNLVMLLHELTVENNNPWTEYHLASEYYRLGKFEQAYEFVNLSIARFLKNDKLPPSLLYKLKYSCLISVGSVEGIPSAIDKAIKLYPDYVDLYFFKGVALYISKLYTLALDVFEQCLLMGEDNINHLTLRGSGSFHAWYYKGGCLEKLGKTELAINAYKEALSLYPNYTHAQEALDSLTMPLKQLEKKG

SEQ ID NO: 2604 - protein, 267 aa, Paraburkholderia sp.
MPPTPSDSSGRPTLGVAIIALNAQARLAQCLEALSFADEIVVVDAGSVDATVTLAQAHGARVIAEPQWPGFGPQKNRAVAALDTDWILSIDTDEIVTPELAASIREALRAPRTDIYAVDRLSSFCGHWVRHSGWYPDWIPRLFKRGTARFSDDLVHERLVFDGPTERLTGKLLHYSYEDFETVVRKLDAYSSAGARQRFEAGKRGGGLGRALARGFWAFVRTYFLKLGFLDGQAGFMIATFNAQTVYYRFLKLGLAAKQQTQAHSPR

SEQ ID NO: 2605 - protein, 254 aa, Ferrimonas futtsuensis
MSRSVRLACAMITKNAGPRFAQVLESVNWVDEIVILDSGSTDNTLELAQQAGAKVFHSSDWPGFGPQRQRAQTHVTADWILWLDTDEVVTPQLRTAIEAVLVDPDPQLAYRVNRLSDFFGRFIRRSGWYPDAVVRLHARDSYRYNDAMVHEAVAVPKEKVRALKGDLLHYTSDDFQGYMGKSLNYATAWAQARHAKGKRTSVAGIIGSSLWCFIRKYLLQLGCLEGRHGLLLALQSSHYVFNKYFALWVMQNRR

SEQ ID NO: 2606 - protein, 249 aa, Castellaniella sp.
MKLSVIVITRNEAAHIVDCLDSVAFADEIIVLDSGSTDATCELARAHGARVEVNAEWPGFGPQKNRALDLATGDWVLSLDADERVPPELGEEIRRVLTRPTAEGYRMARLSNFCGRWMRHSGWWPDRVLRLFRRQAGRFTDDVVHEHVEVDGRVATLSGHLLHYPYASLEAFIDKINRYSSEAALKAHAHGRRTTLVGPFGHAAWTFLRHYGLRRGFLDGWQGLVLAGMAATGSFYRYAKLYWLGRRSR

SEQ ID NO: 2607 - protein, 253 aa, Unknown
  Description of Unknown: Hydrogenophilales bacterium CG18_big_fil_WC_8_21_14_2_50_58_ 12 sequence
MQQKTPLSVVIIALNTAGQIEACLKSAAFADEIVVVDSGSRDDTLEIALKYGARVLHQDWLGFGRQKQFAVEQAGHDWVLCLDADERVSDPLRASIVEALQAPRFHAYRMPRCNRFMGRWLRHGEGYPDRSLRLFDRRVAHWSEDAVHEKVLAPSPVGSLRGDLLHQSQESLAAYLEKQNRYTNLQAEELCRRGKQASLGRLVTSPLLRFVKFYFLRLGFLDGVPGLAHISIGCFNSFVKYAKLHELNKKGKS

SEQ ID NO: 2608 - protein, 254 aa, Unknown
  Description of Unknown: Acidobacteria bacterium sequence
MTLSIVLITYNEEANLPRTLESFAPLVRDGQGEIVIVDSGSTDRTLEIARAHGAKVFVEPWKGFAAQKNSAMDKASGDWVLQLDADEALEPELTEEIAGMLRGQPAMSGYWIPRKNFFLGRWVKHGGFYPDPKLRLVRRGAGRFVEYGAHPTIKVEGSTGRFSHALLHHAYPTLRGYIDHMNSYSSMGAEIAAKRGQSRFSVLNIVARPVLTFIYNYFFRLGFLDGREGLLLHLYHSAYVSWKYAKAWELGRSK

SEQ ID NO: 2609 - protein, 293 aa, Mesorhizobium sp.
MSMAKTASTEGSETLSSTGGIPVTVVIPVKNEELNLERCLKALSRFADVVVVDSGSTDRTQEIAIRAGAKVIDFRWDGRYPKKRNWVLINHALPNEWVLFLDADEFVDHRFCDEMAAAVASGRHAGYWLNYTNYFLGRRLGYGVPQKKLALFRVSSGLYERIQEDSWSKLDMEVHEHPTIRGSVGEIRAPIEHNDFRGIDKFLDRHRDYARWEARRFLLLERQSDLDGRSLTTRQRFKYRSLERWWYPWFYFLYAYIVRLGFFDGAAGFQYAFYKAWYFLTIRLMIRELRKCG

SEQ ID NO: 2610 - protein, 282 aa, Arthrobacter sp.
MRKIPASILIQTKNEEASIERCLAALGDFDEIIVVDSNSTDRTAELAAAGGATVINFTWNGAYPQKKQWQLEHAPTRHPWILFLDADEFPSKELIEEIAVIVSDPLERRVAFDIPISYHFAGKVLKHGHRVVKRSLLKRGFNRYEDTGLVNLPVMTELEVHYQPEATGEVGRTSGLLAHHDLDPVRTWFDRHNKYSDWEAYIHADPAMRRSVRSSKSLQGQRFDVVPFKPFAFWVYSYIVRAGFLDGRAGLDYAVALASYYWQIGLKTRELQQNGRRLAEHA

SEQ ID NO: 2611 - protein, 256 aa, Unknown
  Description of Unknown: magneto-ovoid bacterium MO-1 sequence
MRRLPISGVIITLNEAHRLEACLATLQFCQEILVVDSGSNDQTVAVAEASGARVVVQSWLGYGAQKQFAIDQAQNDWVLCLDADEQLEEALQQEIIERFSQGSPEPGVAFEMPRRNRFMGRWLNHGEGYPDPNLRLFNRQQGRWSQDPVHEHVTVDGTVERLRGAIRHQSEESLEHYLAKQNRYTTLQAKRLVAQGKKVGLTKLLISPLLRFLKFYLLRLGFLDGLPGLVHISIGCMNSHLKYAKAWAMQQRAAEK

SEQ ID NO: 2612 - protein, 381 aa, Streptomyces hainanensis
MTVSLCLIVRNETAYLRGCVESARPFVDQIVIVDTGSTDDTIAMGWELADAFCEVPFDGDFSAARNEALVRADGDWILFLDADERVIASEGKKLLEFIDSVDEQVLGARLLRYNFFATGTFYTGRELKLFRNDGRIAYRRKINESVAASIAEAGGTVTPAPVVMNHFGHCRPIADREAKAYRYLSLMEDQLREKPQDALLVGYKALIKRTLGHFEEAAELSDRSLALDDASPIVWLFRGHVLRSLGKDGEALEAYQKGLDVDPGNAALHNMAGVELMVLGQHADAGACFTRARECDPQSLHTDINQGLLAQAAGDWHAAIACFQRAGDANPGFYHEEWAGRVERDPYRAFYAETPLGYAGLGYHLGYCRERANGSLPSSGR

SEQ ID NO: 2613 - protein, 253 aa, Polynucleobacter campilacus
MPTLSVILITRNEEANLDDCLASLDGIAQQIVVVDTASSDCTLEIAQNYGAVTASPPDWPGFGPQKNRALDLATGDWVLSLDADERLTPALRAEIQIAIHHSAQVDCFAIPRLSWYCGRFIRHSGWSPDYVDRLFKHGTARFSDDLVHERLIPNGQVAKLENPILHFSFMNYSQVLQKIDRYSTASAEQAFAKGKTSSPLKAVLHGFWAFFRTYIIRAGFLDGAQGFALAISNGQGTYYRYIKLWHLNQDSRK

SEQ ID NO: 2614 - protein, 276 aa, Unknown
  Description of Unknown: Nitrospira cf. moscoviensis SBR1015 sequence
MSVSILVLTLNEENNLPACMASMGRFDDVVVLDSFSSDGTVKIAEEGGARVMQRRFDNWAAHQNWALEHITFKHPWVFYIDADERMTDELAAEIQAIAEDPTRSEVAFYCGRRNMFMGKWIKHAMPPGSIMRFFKPPCIRFERLVNPTPVINGPHGYLQGQLLHYNFSKGLTEWIEKHNKYSLMEAMQGLKERAAGFSDGGSVLSRDPAVRRKALKALSFRMPLRPLLKFLYLYIVNRGFLDGRAGLTYCVLQSIYEYMIVIKMQELQRRENGLPI

SEQ ID NO: 2615 - protein, 263 aa, Unknown
  Description of Unknown: Candidatus Eisenbacteria bacterium sequence
MTSAAEIRPAGRPPVSAILVVRDEAASIERCLDSLGWVDEVVVLDSGSRDGTQEICRRRGCRVIETPWRGFGAMKKLAAESATHDWIFSIDADEVVSAPLRDRLLRILEHGPEVRGYRVRFRTYYLGREIRHCGWANEHHLRFFDRRFGNYTDRPLHEAVQMGDPKLELAEAIEHFTYPTVASHLEKINAYSDLAAARLFEQGRRISLLGAGMRGVLKFFTMYVAQRGFLDGKEGLILSSISAFGVYCKYLKLWELSRWKRSS

SEQ ID NO: 2616 - protein, 278 aa, Fibrella sp.
MLPITVLILTLNEEVNLPHCLQSLSGWAAAVFVLDSGSTDRTTELAAARGATVFHRPFDHYAAQRHYAIHALPITTDWVLFLDADEYATDALKEQISLVVRQPTAHNGFFIPFRFIFMNRWIRHGGYYPTYILRLFRRSAVQRIDREMDEQITVSGTTGYLNEPFVHHDRKPVRFWYEKHARYTQFQVADLLKSARQKTLRWADAHTQRDRKRWVKEHVWGHVPVLLRPFLYFFYRYVLLLGFLDGRAGFIYHFSHACLYQFMIATVYIEASSRPPSR

SEQ ID NO: 2617 - protein, 259 aa, Endozoicomonas elysicola
MPQANSLSVVLIAKNSAVTLESSLKSVQWADEIVLLDGGSTDDTVDIAIRNGAKVYQHTDWQGYGKQRQIAQQYATSDYVFMLDTDEQVTDELKASIQVVLSEAQQMNKAYTCARRNWFLGRYMMHCGWYPDRVIRLYLNKERTYNSNLVHESVDISGADVVDLDGDLLHRTCDDYMQFQQKQLVYARSWAEERFLKGKRKGLGSAFSHALGAFIKTYFLRRGFLDGAHGLLLSLVVTQYTFNKYAALWALGKTRKQTD

SEQ ID NO: 2618 - protein, 263 aa, Methylomonas koyamae
MLTVVILACNEAANLPRCLAAIPERYPIVVVDSGSRDDTVAIAERRGCRVFHNPWPGFAEQRNFALQQCAIETPWVLFVDADEIYPPLFYQQFDAEWATSRDMDVLMVPSVLHLRGKRLKYAPGYPIYHPRLVRRETVGFVRNHTGHGEAVLASSRVATADIAYQHYFYHGEIVAWMHKHVGKAAQEIELQPTAGALMTARGRISVWLGRCWLRIPARFAYHYLLRGGFLDGAAGLEFALMFTWYEATIYLQAKAGCWAEPSA

SEQ ID NO: 2619 - protein, 284 aa, Chthoniobacter flavus
MNKVPVSFLIPAKNEAANLPRCLESIAWADEIWVVDSQSTDGTPAIAEASGARVVQFHFNGSWPKKRNWALENIAFKHEWVFLIDADETLPPEAAEELRAIVTGTGDCVAYQIDRRFWFLGQWLNHAYRPNWIMRFFQHRKARYAKLTAAAISHADHEIHEPMIVDGKIGRLRAEMAHYAFPTIESFVEKHNVYSNWEAHVTLSEEQRAPTHDFGWRQRLKRWSRRLPCRPLLRFLFVYVWQRGFLDGRAGYYFARLHAEYEFLSVAKTYELRLRQNEDSRLGH

SEQ ID NO: 2620 - protein, 254 aa, Burkholderia multivorans
MAEPTLGVAIIARDAARRLAQCLGALSFADDIVVLDGGSTDDTVAIARAHGARVISAPDWPGFGPQKNRAVDALSTDWVLSIDTDEVVSDELALSIRAALRAPQADVYAIDRLSAFCGHWVRHSGWYPDWIPRLFRRGAARFSDDLVHERLVFAGPADRLDGKLFHYSYDDIDSVLRKLDAYSSAGARQRRAAGERASIGKAIRRGLWAFVRTYVLRRGFLDGRAGFMIAVFNAETVYYRFLKLAHDDTRALDR

SEQ ID NO: 2621 - protein, 257 aa, Asticcacaulis excentricus
MSSPPKLSACIITKNEADRLANCLRAIEGLVDEMVVVDSGSTDGTPDMARQMGAKVFHNDWVGYGPQKRFSEDCASHDWILNLDADEVVTPHLYQEIKALMARGPDLPAYRFKLRNVYPGKDKPRLWADYHNYVRLYDRRKVRFRDSLVHDTVDTRDEPVGQLHGSATHFSARSYAHIRQKLDSYTNLQAKALKKPAWAIWARLPFEYPFVFTRYFLFRCHFTGGWDGVLSSHLAAEARVKRLLKILKAQKELKAKS

SEQ ID NO: 2622 - protein, 265 aa, Cohaesibacter marisflavi
MQNSNDKISLPVSAFIITLNEEDRIEKAILSVIDWVDEVIVVDSGSTDNTTALAEALGAKVHFNAWPGYGRQKRFGEDLCRNDWLLNIDADEEVTPELRDKICSIFKIGPDVDIYKIEILDVFAHEDKPKKWAYGYWQYRLYNRNKGRFSESTVHDTVRPEKDATIKKLDEKIAHYSIRSVQWAVEKMNRYSDMQRDDIVAKGRHISRWRLVYEFPLSFLKSYILRRSYRYGFWGLVLAHNYAFSRFLRIAKIYEHQLLSDAKKK

SEQ ID NO: 2623 - protein, 657 aa, Unknown
  Description of Unknown: Peptococcaceae bacterium BRH_c4b sequence
MSAKISLCVIAKNEEQNIRRCLDSVKKAVDEIIVVDTGSTDDTASIALACGAKVYHFPWNGNFSDARNASLDHAGGDWVLYLDADEELAGEESRGGLRRAVKDDSVEGYFLKIINYLGAEGHIESHQDVVFRLFRNRREYRFQGAIHEQVAEAIKEKNVSAVFRLAEGVLINHYGYLDSSVDSRDKINRNLGIIAKEMEREPGSRELRFYCGVELYRAGRYIEAARELSVAAEGIDVDTIYLPKLVRYIIMAYQAAGEPEKALRTALGSMDFFPYYADLYYYAGRMYMELKNYVSARDYLLKSVSMPEQPAHYASFNGVRGFRSYYHLGEIMEEFFNSSEALKFYLASFRDNPDFTPALRKIVHLLEPRRNTERARKYLQQFSFCTPRANMLAGELLFRQGAYGIALEYFQKAGENQGATSEPQLWVAACHIQERRYKKSLRILKSFKPGNRLYPRVLMNKILACWLHSDARQVQALAEEMAACGVSEDMKNVAGILAYAPEKGNRLNRLLPGQEGRELLLDIVTRLLGMNETDRALCLLYSLDPASLSGLLLDMARIFHEYDQGVGVINLLKQKTTDSEDGETHFLIAEILREAGKCLEAGLHYRRAGELDPGVSRYYLRQNHLYRHRWEQLLQEARHKYPDDENLKKLGEGVTAH

SEQ ID NO: 2624 - protein, 249 aa, Andreprevotia lacus
MPTLGVALITKNAAAHLAECLHSVAFADRVVVLDSGSSDDTLAIAAAHGAQIGSTADWPGFGPQKNRALALLDTDWILALDADEVVTPELAAAIRAAVTADNGPVHTLRRRSSFCGQWIRHSGWYPDDVPRLFKRGSARYSDDLVHERLLFDGTAPMLAGELLHYSYDSYEQVLAKINQYSTAGAQQRMARGKSSGVAKAALRGGWAFFRTYVLKRGFLDGGAGFAIAVMNAETTYYRFLKLGWLQRQG

SEQ ID NO: 2625 - protein, 533 aa, Unknown
  Description of Unknown: Cardiobacterium sp. sequence
MATLSVVLMVRNEAANLRRCLPRVARVADEIVILDSGSTDDSEAVANWFGARWFVNADWQGYGIQRQRAQALATGDWIFALDADEVPDDTLLAALARIKDETPGDTVYGVRRLDLVFGRFIDHPRWRGKPYWRVYPRRFQFNSNAVHESLLLDGARTRVLPGFLEHHTADTPLFWLEKRFSYADTWAREAHARGKRVSPFGVWLRSLWAFCKQYLADGRFLRGSSGWVYAWLFAQYTFNKYALLCDRNARPQSYADDFQPHAVNARALPLAVPPPGRNPHPLSVVMIVKNEARHLPACLAAVRDLADEIVILDSGSSDNSATIAARFGVRWYENRDWRGFGVQRQRAQALAQGDFVLMLDADEQPDAVLKAAIRAVLQSPPSPDTVYAVSRSNIFCGTAVNARYRDHIPRLYGRAFFQYHPYEVHESLARGAAAVVRLPGDLLHFTSDNLAHFIRKNLRYSHDWAQEKAAGGRKPPSLWALPLRAAVAFCREYFVHRTLFAGRYGFFLAASSAFYNFNKYLMLACLARRERKS

SEQ ID NO: 2626 - protein, 259 aa, Unknown
  Description of Unknown: Sodalis-like symbiont of Philaenus spumarius sequence
MSHRKRLSVVLITLNEAELLPNCLASVSWADEIVVLDAGSIDETRHIAAQAGARVFQSTDWPGFGIQRQRAQAYASGDYILMLDADERVTPPLRQAIQDVLQHPDSNAVYSCTRRNLFLGRFMRHSGWYPDRVVRLYARERYRYNALPVHESLATGDADVVALTGDLQHLTCRDLSAFQCKQLKYAEAWARECYRQGRKCGLFAIIHHTSGAFFKTWLLRAGFLDGRQGWLLAVVNAQYTFNKYATLWALSHAVREPDP

SEQ ID NO: 2627 - protein, 279 aa, Unknown
  Description of Unknown: Parcubacteria bacterium C7867-004 sequence
MEKIPCSVAMLTFNSEKTLRRALESVKDFDDIVLCDGGSTDGTHAIAQEYGARIVPQDAKYLYPEGGLADGGGARNQMMQATKYDWYLWIDSDESVSPELRADVARIASTPLKEGDPLAYRIPIRILIDDRLIKYSSNYPGYQFRFFNKTSGGHLARRAHNRIEFNPGTVIGTLATSWYVYVDSRDIHILGGPWKHYRRVEIEEACKRTFPDFMRYIVWFHFRASAGMFLRALRNYLLHGFRDTMPIEAELARILSPLVLIVNSSICKVGRIFSPKRAL

SEQ ID NO: 2628 - protein, 275 aa, Gloeobacter kilaueensis
MAVSIVILTLNEAADLPGCLESIGWCDDIHLVDSGSCDGTLELAVAAGVRCYEHPFSSFGKQRNWALDHCQFAHEWILFLDADERATPAFARAIEGATAAAGASIAGYYCCWKLMLDGHWLRRTDGFPRWQFRLLRWGRVRFCDFGHGQKEDRVQGQLAYLSEPYLHYAFSKGWGQWLSRHNRYSDLEAAERLRANVSWQELLARDPSVRNKALKPLLSRLPGWPLWRFLIMYVFKLGFLEGRAALTYCIHLAYYEFLIQVKMDELRRGRCLDRT

SEQ ID NO: 2629 - protein, 269 aa, Herbaspirillum sp.
MASSPPEKRTLLSVILITKNEEANIQACLDSVDFANEIIVVDSGSTDQTVDIARKAGAIVIQTPDWPGFGPQKSRALAAATGEWVLSIDADERITPELAAEIRKTIQNPSADAYDISRRSWYCGRFIEHAGWTPDYVTRLFRRGKARFSDNIVHERLIADGPVKRLNGLMLHYSFLDFSQVLQKIDSYSTLSARQAYANGRRATVLDAVLHGFWAFIRTYFLRLGLLDGSHGLALAVSNAEGSYYRYLKIWQLEQAAKKLPSGDAKEGR

SEQ ID NO: 2630 - protein, 354 aa, Laribacter hongkongensis
MPSVSATLIVRNEAARLARCLESVSAHVDEIVVVDTGSTDDTVAIASRFGCRIGHFAWNDDFSAARNAALSLSCTDWNFVIDADEWLVDPATLREAVRHVPDSTGLVCVRSECVLEGLRTHADCWIPRLLPATVRYQGRIHEHPASDLPYFRTRIVLGHDGYLEHPLNAHKKERNLPLLQAELVAYPTNPYLHYQAGKEFEVRDDFATAVHHYLQALPDTAGYPPYTADLVCRLLFCLKKLGRFDQAIPLAEHWQPHLADSADFLFVLGDLLLDYAIAAPADAPAILSVIEAAWLGCLELGTAHHHENSLPARGSFLASHNLSVLYAHTGQPDKAAHYAGLAQKQRQQMHPETA

SEQ ID NO: 2631 - protein, 297 aa, Unknown
  Description of Unknown: Verrucomicrobia bacterium sequence
MSGEDNRRAPLSVLVPVKNEAANLRDCLASVSFADEIVVVDSASTDGTQDLATTAGARVVQFAWNQKFPRKKNWSLQNIPWRHDWVLIIDADERITPELEREIRSAIRRPNLDGFYLNRRFWFLDGWINHCGYFPSWNLRLFRHRKGRYERVEAGSGFNSGDNEVHEHVLLNGRADYLSAPMEHYAFPDITTFIEKHNRYASWEAAVRAQLCRRSGEETLRPNPFGTALQRKRWLKRFTRRAPFRPTLRFFYHYVWRQGFRDGYRGWILCRLLAWYELVSAAKARELTLCGARRESC

SEQ ID NO: 2632 - protein, 283 aa, Unknown
  Description of Unknown: Candidatus Rokubacteria bacterium sequence
MSASHAVPVTAIVLAHNEERNLPACLESMTAWVEELFVVDSGSTDSTVAIARAWGARVVEHPFEHYGAQRNWALASLPITTPWVLNLDADERVTPELRAAIQEATTRSDGSIAGYLVARRTVFMGRWIRHGGHYPVWHLRLFRSGRGRCEDRQYDQHFFVDGRVEKLRGDLIDVFTSDVTTFIRRHLRWAQLEAQEQSTGGEGRIAGRLLGGSPIERRRWFREVYGRLPLFVRPALYFVYRYIIRLGFLDGAEGLVFHLLQAFWYRFLVDAIMYERRLMDRNS

SEQ ID NO: 2633 - protein, 258 aa, Unknown
  Description of Unknown: Acidobacteria bacterium sequence
MNRLSACLITLNEEHNLPRVLNSIQGIAEEIVVVDCGSDDHTLDIAREYGAKVLTHPWSNFGAQKNRAAAAASNDWILSLDADEELSAELREALLRWKWKEPEFAVYEVARRTWYLGAWVWHTRWYPDYQRKLYRRDKAKFEPLLHATPRFEGPVGRLDGDLLHYALPSVEEHIAKVESYTTRIAQDMYAEGRRGWRAAMWLAAPWSWFQNYVLYLGFLDGYRGWLISRMAARGTWLKFKKLGKLVETERRARRVRAP

SEQ ID NO: 2634 - protein, 296 aa, Unknown
  Description of Unknown: Rhodomicrobium sequence
MPRIAPSNPCGYPGAIRAKIAEHPVALPISAFIITKNEEARLARSLAALRPWVDEIVVVDSGSTDRTVDIARSMGARVLHRDWSGYGGQKRFAEQQCRNDWVLNVDADEVVTPELADEIRALFRGRTVPEPGAYRLRILTVYPGDEKPRPFAKDYNIVRLYHRSAGSYRDHPVFDRVVLNHTVPKQLRGPVFHHSYLSFAHIIEKNNQFSSFRSRHSKSRATSYLVPRLGIEFPLNFLKYYIFRRHLTGGWKGYYFSLCHAFMRTSRVAKMLEAGNADAHRTGPALKRARPDVTRA

SEQ ID NO: 2635 - protein, 254 aa, Unknown
  Description of Unknown: Anaerolineales bacterium sequence
MKITAIILTKNEAKRIEPCIRSLDWCDEVVVFDSFSTDGTQALARNLGARVIENPFVNFTQQRNAALALVASDWTFFVDADEVAESALAQEIPEATQNNAIDVWWVPRHNYIFGKLTRGAGYYPDYQLRLLRKGSGVYEREASEIFIHQGKEGYLQGHLIHYNYENVAQFHEKQRTREVFEAKTLHDQGVRMSYKTLLVQPFRHFWWRYITLKGYQDGWHGFRLSLLLAYYFGFRNYLRLGQMRRAGQLPLPPA

SEQ ID NO: 2636 - protein, 257 aa, Unknown
  Description of Unknown: Betaproteobacteria bacterium TMED156 sequence
MILLPISCYIITKNESRKIKKVIESVSGLVNEIIIIDSGSTDKTLSIAKTLGAKVMFNKWDGYGKQKRFGEKVCKNDWVLNLDGDEIVSSDLNQEIRNLFLKEKKDMHNLYLIKRQNIFPFGINPYSYSGDKVIRLYRKSVVRYPDHPTWDKIKKPKNQKTTVLNGVIYHYWMKDFEHQVSKMNKYTTSLANFSPKKSMSSLTLRMVFGFQFDFFKAYLLRHHWLQGRYGFAVSILYAFTRFMRVIKMMEKQLRKNS

SEQ ID NO: 2637 - protein, 272 aa, Unknown
  Description of Unknown: Acidobacteria bacterium sequence
MRVRVTKAIANSFCATTIRMKISATIITFNEESNIEQACESVAWADEVIVVDSESTDSTRTLATSSGARVITNAWPGFAAQKQLAVDEAKHEWVFSLDADERVSDELRATIEALRLEPESGLADGYQIARRSYYQGRWIRGGGWYPDRQLRLFRKTAGHWKKRHIHESVEMEPGARVEALDGDLLHYTVRDAAHHHKMIGERYAPLAARQMFEEGRRTSAVSIATAAPSAFFRSLVLKAGFRDGLAGLSIASFAAHHAFLKHLMLWEMQNKK

SEQ ID NO: 2638 - protein, 268 aa, Paenibacillus durus
MTDSKRLSVVIITQNEEEKIEQAILSCRPFADDIVVVDGGSTDGTVLIAKRLGCTVYHNPWPGYAKQRIFGADHAPSNWIFFIDSDEEVSEELQKSLIGWKKEPENEVKAYTVYRIGDFLGRWMPKGEHLVRLYKKDEVRMKDVLVHEGPDVDPAAVPCLDGTLWHHGYRSIQDHVQRFNKYTDLEARKDYDQGKTFSLIRLLFRPPAKLVYTLFVRKMITKGIAGFSVAFFWMYYEFLKEIKLYELYGREKKREKPVYVIESEKRPV

SEQ ID NO: 2639 - protein, 241 aa, Variovorax sp.
MPRLSVIVITKNEILNLAACLRSVQFADEVVVLDSGSTDGTVELARAMGATVMQSDDWPGYGPQKNRVLDAARGDWIFSIDADEQVTPELAAQLRDAMAAGAFDAYTVNRFSNFCGQYMKHSGWYPDRVLRLFRRGTARFSDDIVHERVVATGAIGRLSGNLLHNSMPHFESVLGKLDRYSTAGASALMGKGVRGSFTRALLHGWWAFVRTYVVRLGFLDGRLGLALAISNAEGTYYRYLK

SEQ ID NO: 2640 - protein, 247 aa, Thermoflexus hugenholtzii
MLAVVILTRNESAFIEACIESVRWADRIVVFDSFSEDDTVARARACGAEVLQHPFENYAAQRNAALEQVEADWIFFVDADERATPELGEEVREAIRDPRYVGWWVPRRNYLFGRLTRGGGWWPDYQLRVLRRGYARYERPVHEIVILQGEAGYLRNPLIHHNYDSPAEFRAKQRAYAWLEAQALRQAGVRPKPYTPWTMMVREFWRRFVRLRGYIDGLHGLRLAWWMARATWETYRLLQDAARVDTG

SEQ ID NO: 2641 - protein, 268 aa, Unknown
  Description of Unknown: Candidatus Omnitrophica bacterium CG07_land_8_20_14_0_80_50 _8 sequence
MTKSQRQTVSAVIMTKNCEALVEGTLKSVAGWVDEIVVIDGFSTDGTLEICRRYTDRIFQNRWDGYRFCTERNLGTSKVSSDWCFHIDPDERASLEFKLAVLKIMEKGTAHSAFEFRKKNFFLGHFMRRGGWYHYSLHFFRKDKAHYEGVIHETLKVDGTIGKLEAAVEHYPFTSIKQFVNRHNGYSTREAQAKFEEAGKLSEAEIQYNLKKKPLKRFLKFFVRKYGFLDGIYGFIFSVLFAWVHFINCAKYWELINTPPPLRGTSPS

SEQ ID NO: 2642 - protein, 253 aa, Polynucleobacter necessarius
MPTLSVILITRNEEANLDDCLASLEGIAQQIVVVDTNSSDRTLEIAKNHGATLSQPPDWPGFGPQKNRALDLATGEWVLSLDADERLTPALKSEILTAIHHSAHVDCFAIPRLSWYCGRFIRHSGWSPDYVDRLFKRGTARFSDDLVHERLIPKGQVAKLENPLLHYSFMNYSQVLQKLDRYSTASAEQAFAKGKSSSPLKAVTHGVWAFIRTYIIRAGFLDGAQGFALAVSNGQGTYYRYIKLWHLNQEANK

SEQ ID NO: 2643 - protein, 277 aa, Streptomyces zhaozhouensis
MSRLPIAVVIPTRNEEANIVSTVRSVIAHFAAVVVVDSDSTDATRELAKAEGAEVVGYTWDGGYPKKKQWCLDRVRTDLDWVLFLDGDETPSGELLAELRRIFLDGRRVRPAAFDIPLGYWFAGRRLRHGHTIVKRALLDRTRARFPEPDDLGAPGMGEQEGHYQPLAYPVYRLRATIEHRDLDPVRTWFERHNRYSDWEAWLERHPEVREQIRRAKTRQGQLFHRAPLKPLLSFGYAYVYRRGFLDGRAGLDYALAMSFYRWQIGLKAREQPPAGS

SEQ ID NO: 2644 - protein, 257 aa, Paraburkholderia sp.
MDSTAAPTVGVALIARNAAARLAQCLAALSFADDIVVIDGGSTDETVSIAQAHGARVIVHTDWPGFGPQKNRAVEALSADWILSIDTDEIVSPELAASIQAAIRAPRAEVYALDRLSSFCGQWVRHSGWYPDWVPRLFKRGAARFSDDLVHECLVFETPAARLEGKLIHYSYEDFETVLRKLDDYSSAGAQQRHAAGKRGGFGKALGRGAWAFIRTYLLRRGFLDGRTGFMIAVFNAETVYYRFLKLDAANRHHDGE

SEQ ID NO: 2645 - protein, 260 aa, Serratia sp.
MSAKLRLSVVLIAKNEASLLEDCLNSVSWADEIILLDSGSSDGTPALARDLGAKVFENTDWQGFGKQRQLAQDYASGEYILMIDADERVTPELRQSIEACLQQPDDSKVYRLGRRNLFMGRFMRHSGWYPDRVCRLYKADKFRYNNDLVHEAVDTGNAKIVDLKGDLLHLTCRDFFAFQRKQMNYAEAWAKQRFQQGKRCSYFSIISHTLAAFLKTWVLRAGFLDGKQGLLIAGVNAQYTFNKYAALWAFSHQLQKSEPQ

SEQ ID NO: 2646 - protein, 268 aa, Acidovorax anthurii
MPADRSGDAAPRPTLTVAVLTLNEGHRIAACLESAAFADQIVVVDSGSTDDTVAEARRLGAEVHVHPDWQGFAVQRNRLLAHATGDYVFFLDADEVMTPGFREELQAIVASNARAVWKIRWRMVAFGHELRHLRTTSAIERLFRRDMLREYIGVVHEEAVLTEPEAPRHVMREPLLHHSRETVRGSLEKLTQYAMLGAAKRASLGKRGGVLRGLASGSSMFVRLYVLRLGFLCGGAGFLYCLFVALEAFFRYAALEYDRARLTESVRR

SEQ ID NO: 2647 - protein, 274 aa, Unknown
  Description of Unknown: Betaproteobacteria bacterium HGW- Betaproteobacteria-3 sequence
MPVSLSPASPAVPLPTLTVAVLTKNEAHRIEHCLRSAAFADQIVVVDSGSTDDTVARARAMGAEVWVHDDWQGFGAQRNRLLAHASSDYVFFLDADEVITPALQEEIRANVRSARRAVWRIQWRMVVFGRELKFFRSQSKVERLFRRDMLREYVGAVHEQAVLHPEPDGAPVPRPLMRARLLHYSRETVRGSLEKMTQYAMLGAAKRAAQGQRGGVLRGLLSAISMFIRLYVFHLGFLCGGAGFVHCVFVSAEGFFRYVALDYDRASLASDIPR

SEQ ID NO: 2648 - protein, 286 aa, Unknown
  Description of Unknown: Verrucomicrobia bacterium sequence
MSESRKVPVSVVVPIRNEAANLKRCLDSVKWADEIFVVDSQSTDGSIAIAEERGAQVVQFQFNGTWPKKKNWALENLPFRHDWVFILDADETLPPEAEQEFAKAITEAGDIAGYWINRHFMFMGKWLRHSYYPNWNLRLFRHSLGRYEKLTETDTQSGDNEVHEHVIVKGPTSRLRCEMDHYAFPTVEVFVEKHNRYSNWEARVAAERKLSGSDARISSSTVGRRRKLKLLSQRLPFRPLLRFLYIYVWQKGFLDGREGYYFARLHAFYEFLSVAKTYELTRTRND

SEQ ID NO: 2649 - protein, 292 aa, Unknown
  Description of Unknown: Candidatus Symbiobacter mobilis sequence
MAWPPGIAPVAVVMISLNEGHNMEAVLDNLKGWAQEVFLVDSYSQDDTVEIALRHGVHVVQRRFRGFGDQWNFALRELPISAPWTMKLDPDERLSANLKANLCAAMRSGKAAGLSMERRLWLMGRELPVHQRLVRAWCTDKCRFTDIAVNEHPIVEGHIEYVAGVMEHHDSPDLDHWLEKQNRYTTAEAVIAFNNSALADTPRLFGSALQRRMWLKKNFYRVPFRYLLLFLYHWLWQGAWRTGWVGYAWARLRADVMRLIEYKVREMRLTGRLPVKRVYGPGRPDPRVPQYD

SEQ ID NO: 2650 - protein, 246 aa, Unknown
  Description of Unknown: Acidobacteria bacterium sequence
MKVTALVITLNEAAHIEACLGSLGWADERLVIDSGSTDGTVAIAERLGATVITRAFDGYSAQKNFGASRAAHDWIVSIDADERVTPELAAEMRAAVAAPGDHAGFRMPRVTWHLGRWIRCTDWYPDNQLRLYDRRRARWNGRKVHESVIADGPVGRLQHELQHYAYRDIAHHLDTINRYTTLAAEEMHARGRRTGIVELLLHPPAAFLRNYILRGGFTAGIPGLIVSAMNSYYVFLKFAKLAALQK

SEQ ID NO: 2651 - protein, 313 aa, Mesorhizobium prunaredense
MTEAAADNPKEIVQWRPGAVPIAVVMISLNEAHHMSAVLDNLEGFASEVFLVDSFSSDATVEIAVSRGVNVVQRRFRNFGDQWNFAVRALPITSPWTMKLDPDERLTDELKSSIASRIEGGKVQGLTLNRRLHFLGRKLPARQKVARVWRTGRCRFSDVVVNEHAIIEGKVETADGELEHHDSPNLHHWYQKQNNYTTAEATSFYEKLALADKPKLFGSSMQRRMLLKKHLRNIPFRYQLLFLHHYFAQGAWRGGRAGYIWARLRVDVFRMIEVKLIEMRRLGTTYRSTPPVLGAPHPRAIQVDGKDRLIASD

SEQ ID NO: 2652 - protein, 293 aa, Yoonia maritima
MTDLTVIILCKDEALHIERAVASVRGIATRVLVVDSGSTDDTVARARDAGAEVLFHPWTTHAQQFNWALDQVKGQGGWVLRLDADEFVTPALADEIAAGLPEVEGLYLRRSMRFLGQDVRYGGVFPIRILRLFRNGAGRAEDRWMDEHIVVNGVTADLKWVIVDDNRKPLDWWINKHNAYASREVIDILNREHSGAAPLANGGAKRWIKDNIYAHLPGGFRAGAYFFYRYVLRLGFLDGPPARSFHVLQGFWYRYLVDAKLAEVRRYMDETGGTPDEAIKAVLGIELQEEPSP

SEQ ID NO: 2653 - protein, 292 aa, Rickettsia prowazekii
MKKISTFIITKNESARIARAINSVKNITDEVIVVDNESTDDTVHIAKTLGAQVIVKPWLGYVGQKSFAESMCVNDWVLNIDADEELSQELQDEIEYIFTSHNQDRYLAYQIKLLIMYRGDQKPRMFAPLNKCTRLYNKKFASFANTINSTTHDSVVFNKDVDFTGKIYLLNGIAYHYSGTSIEQLVNKANFYSSEQAKDLVKQGKKLSNFRLATEMIWCFLKAFFIRRYFVFGFDGFVDSIIFAFARFLRLAKLRELSLKSQNVITSDNYINYCMDFKSLLQQKKRNRYPKK

SEQ ID NO: 2654 - protein, 255 aa, Holophaga foetida
MSVTAILIVKNEAKHLAACLETVKGWVDEIVVYDSGSTDATEEIAASFGARFIRDPDWQGFGKQRQKAQTHVKTGWCLWLDADERITPELKASIQAALASPAPDTVYALPRLTWAYGRFIRHCGWYPDHCLRLYPTAYTTFNAALVHENLERVPGMKVQPLKGDLLHFSYDTLEHHLTKAAKYASAWAEERARKGKRGSLSQALLHGSFRFLRMYVLRAGFMDGKAGLVLSILGGHAVFIKYVSLWMYDQPKRPD

SEQ ID NO: 2655 - protein, 258 aa, Rhizobacter gummiphilus
MMQNPPTLTVVIVAKNEARNISECVASASFANEVIVLDSGSADATAELARQAGARVVATDWPGYGPQVARGFSMATCDWVLSLDADERITPDLAREITVAITSGARQGYRIPRLSEFVGQFIHHSGWRPDYTLRLGVRSVSGFTDHFLHAHMTVEGAIGDLKTPLIHFSYPDLHDVLEKLDRYSTGHAKDMHARGKTANLKKAIVHAAFAFARTYFLRLGFLDGQRGMMLAIYNAEYTYYKYLKLMMLSSPPVRPAIP

SEQ ID NO: 2656 - protein, 354 aa, Unknown
  Description of Unknown: unclassified Dehalobacter sequence
MRKLSLVMIVKNEEKVLARCLDSVKHLVDEMIVADTGSTDDTKKIAHAYGAKVCDYVWEDDFAKARNFALSYAAGDWNLILDADEVLTQGTKERIQRFMEQPEAIGRIKVVSKIRQDHEIRTSSTWVSRLIPKGIYFEGRVHEQIISNLPRVNTEIEVNHDGYYETDKTGRNLRLLLLELDNHPSDPYLLYQTAKQYKLSGQYQTANDYFEKCYQFLGRNAGYRDLVVIDYLYNILATGKLLKGLGMIEKERAQFADYPDFHFVCALFYMELVFSDVDKYIHLFPEIEREYQTCLQLGETDKYSTTTGTGSFLAAYNLGVYYETTGDMTKAKEYYTRAAADGYESASTRMKELK

SEQ ID NO: 2657 - protein, 271 aa, Frateuria aurantia
MQTFPLSLVVMTYNEAHTIARCLDSVPFAAEKLVIDCGSTDDTVAIARACGARVIHQDWLGFGPQRNFAQAQAGHDWILALDADEYLSPALVDEMTAALPALLVSDKAAAWLRRSLIYMGAPMRWYRPAVGDRMARLYHRDRARWRDVRVHESLEFKGPATELKAPFYHLNNRSLLEKQLKVLRYSELKCLDWNDRGKPLRMWQSPWVFVLAFFKDYVLRLGLLDGWRGFAISQTAASYALYKRMRYFEMKHDPDSVATAATALRRHQLDR

SEQ ID NO: 2658 - protein, 256 aa, Polaromonas sp.
MASLSVTVITKNEAHNIEACLRSVMFANQLVVLDSGSTDETVEIARSLGAEVSVSSDWLGFGKQKNRALALASSDWVLSLDADERVTPELQAEILAVLEAPAFDVYAFPRLSSYCGQYMRHSGWYPDRVTRLFRRQSAQFSDDLVHEKVLTSCQVGLLGSQLLHESFKSFEAVLDKVNRYSSAGAQGLLKKGKKASLGKALGHGFWAFIRTYFLRLGFLDGRMGLVLAISNAEGTYYRYLKLWLLQRDARRLSPES

SEQ ID NO: 2659 - protein, 349 aa, Paenibacillus paeoniae
MIVKNEEAVIKRCLDSVKGMVDEIVIVDTGSTDQTIEIARAYGASIHHYTWNHHFGDARNYALQHSTGDWNLVLDADEYIANDCTKAIRELMERGNCIGRVKRIDKFKDKEGVAYAQCYISRLFPAGVRYEGRIHEQVVSDLPRVRLGVEVGHDGYYEASRSDRNIPLLQMEIDAQQNNPYYHYQIAKEYNGIENFEQAHFHLKKAYNGLTKKEMYYSNTVVDYLYAMISSKQLDEGLAVIQSEAARLHDFPDFHFVSGQYYLELILSDTAKYVHLLPRIEQSYLKCLELGETDRYDSVIGTGSFSALHNLGVYHEVTGNTQQAVAYYREAASYGYAPSERRIAALTNM

SEQ ID NO: 2660 - protein, 280 aa, Unknown
  Description of Unknown: Desulfovibrionaceae bacterium sequence
MEPRKSLTAVIITLNGERLFDRCLDSLSFCDRILVVDSFSTDRTEAIARAHGALFIQNPWPGNARQIRFGVDWLAANAPTDWVLFLDCDEICTPELAASIRAAIASPGEVAAFSMPRRTWYFDRFLRHGGSYPDRLFRLFRPEAIRIENSGAHQRFVPEGPGGALDGDLLHYTYSSFRNQLDKLNDYAERGARDLESRGKRGGVAAGLAHGLWRFTAMYFIRLGLLDGRAGFLMAAHTAFYTFLKYVRIAEGSWGAPYDAAKLPPARPARASTQGPDQHP

SEQ ID NO: 2661 - protein, 256 aa, Serratia sp.
MSDRKTLSVVMIAKNEVELLPECLQSVSWAEEIIVLDSGSTDGSVSLAESLGAKVFTHTEWQGFGKQRQKAQSYATQDYILMIDADERVTPELRQSIEQALATTEDNVVYSLGRRNLFLGRFMRHSGWYPDRVNRLYASAHYRYNDDLVHESLNTAGAKIVPLTGDLLHLTCRDFFAFQRKQLHYAEQWAVQRHQAGKRCGYLSILTHTLGAFCKTWLLRAGFLDGKQGLLLAIVNAQYTFNKYAALWALGRNVTQ

SEQ ID NO: 2662 - protein, 256 aa, Aliivibrio fischeri
MTTPTLTVALIVKNEANHLQSCLETVQGWVDEIVILDSGSTDSTEAIARQFTDKFFVNPEWPGFGKQRQLAQQHITSDYVLWLDADERVTPELKTDIQKAISDNKPNVAYKVNRLSDAFGKEIHYSGWSPDWVLRLYRTNEAQYNDALVHEKVVTSDSVRVEKLKGRLLHFTYDNLHHYINKTTGYLKAWTDEREGKKKAGLSTALIHALGCFIKMYIIKRGFLDGRHGFILAWLATHSTFIKYIDLYLREEAKKK

SEQ ID NO: 2663 - protein, 269 aa, Marinobacter sp.
MKLPLSVYYITLNEEQRLPESLEKVRGWVDEIIVVDSGSTDHTREVAEAAGARVVHREWEGFAVQKSFAESLCSNDWVLNLDADEVLSDKLVGSIKKQFSDSIPSDIAGFSFRWKVRPPMPGHPFRHDKTHLLLRLYHTSRAGFVSEKHSIHDRPKPHTGRVVRLKGDVYHKTLISLEQLEKKYCKMSSDQACHLVVKGRNISAIRLYSEFPVKFLRYYFLHRQILNGWFGFSVSITAANRNFMRLAKAKELQMIERLEGKAQGSRQSR

SEQ ID NO: 2664 - protein, 297 aa, Unknown
  Description of Unknown: Verrucomicrobia bacterium sequence
MSEQDNRRAPLSVLVPVKNEAANLRDCLASVSFADEIVVVDSASTDGTQEIATAAGTQVVQFSWNGKFPRKKNWALENFPWRHEWVLIIDADERITSELEKEIRDAIGRDDVDGFYLNRRFWFLHGWINHCGYFPSWNLRLFRHRLGRYERVEINGDACSGDNEVHEHILLDGRAEYLSAPMEHYAFPDIATFIDKHNRYATWEAAARGQLHRRAGQEALRATPFGTALERKRWLKKLAMHAPFRPILRFLYHYLWKQGFRDGYRGWVLCRLLAWYEFVSVVKTREMPRLTTRQRDN

SEQ ID NO: 2665 - protein, 377 aa, Bradyrhizobium sp.
MKLSRSRNGPPSVSATLIVRDESEFIEACLASLSGVVDEIIIVDTGSRDDTIDKARRYPVSVHSFPWRDDFSAARNFAIGQASGDWILYIDADERLELPDSESLRLALQNESKVAWRVRFFPRVGWTAYAELRLFRNDSRIRFRGVIHEGIHAAIGEVSRSDGRDVGLSDITLRHVGYEGSQLHKVSRNVSLLRKYLRDNPDRSYCWWHLGEMLSMTGDEDAAIAAWRRGAEAARNEYRVDAGQTCSLPFVSLLQSLHGRGEPVADLLREALELFPDNLVLQWNLAKLSLERFDDEKALPILKRIAALDPHKFFDPMNSYDTALFAYLAPEALALCHFRAGRFRQAAHWYRRAAQASPEREACETKARLAEARLAQA

SEQ ID NO: 2666 - protein, 300 aa, Unknown
  Description of Unknown: Acidobacteria bacterium sequence
MTISVVLITKDEEANLPNTLESVHPLVRDGKGEIIVVDSGSTDRTLEIARSYGAKIFSEPWKGFAAQKNSAMEKASCDWVLQLDADEALEPELAQEIQLIVEFPSEMDREARQKRIHELVYVFTSRTLRELRAVADEEGKKARDYGAFYQLSGFCIPRKNFFLGRWIKHGGYHPDPKLRLIRRGKGKFEEYGAHPTMKVNGPTGHLRHALIHNAYPTLRGYIDHMNSYSSSGAGIALEKGHRRFSILNIIVRPILTFIYNYFLRLGFLDGREGLLLHLYHSGYVSWKYAKAWELARRNSR

SEQ ID NO: 2667 - protein, 244 aa, Unknown
  Description of Unknown: Chloroflexi bacterium sequence
MLTAIVLTLNEQAHLPECLASLAFADALLVFDSFSSDRTVEIAIAAGARVVQHAFKDYAAQRNAALDAVQSDWVLFVDADERVPAQLAQEVRSAIAQTDRAAWWVPRHNYILGRLTLHAGWFPDYQLRLLRPHCVRYDSSRPVHELAQITGTSAQLAQPLVHLNYATVREFVAKQRVYAELEAAGMRQAGQRAGAHQPLTMALRQFYWRFITLAGWRMGLHGALLALLMAHSQWLSYRNLRRDS

SEQ ID NO: 2668 - protein, 261 aa, Vibrio mangrovi
MIVRQPTLAVALIVKNEAKHLEACLNTVQGWVDEIVVLDSGSTDDTETVARQFTDKFFSNTNWPGFGPQRRLAQSYVESDYVLWLDADERITPELRSSIQNAVRADKPNTIYQISRLSWVFGRFIRHCGWYPDRVLRLYPTQLTQYNDALVHEKVEVTSSMAVETLSGDAIHYTYDDIHHYLVKSAGYAKAWAEQRQQRGKKSSISQGMIHAMGCFLKMYVIKAGFLDGKQGFLLSLLSAHSTFVKYADLWVKTNTTPPKD

SEQ ID NO: 2669 - protein, 284 aa, Unknown
  Description of Unknown: Verrucomicrobia bacterium TMED40 sequence
MTSIRKIPLSLIVPCKNEENNLRYCLESVKWIDEVFIVDSNSEDGTEKIALEFGAKVVQFEYSGGWPKKKNWALENLAFSNDWVLILDADECLPPEAEKEINKIVCDPNPEHDGYWINRRYFFLGKALKHAYFPNWNLRLFKHKLGRYEKITDVDTHSGDNEVHEHVVVQGSTGKLKSIMDHHAFPTIESFVKKHNRYSNWEAIVESSTEDNEDSLQHSQVKGKRRLRRLFRKLPFRPTLRFLYVYLWQGGIFDGWEGYVFARLHAQYEFLSEAKASAILRSRK

SEQ ID NO: 2670 - protein, 276 aa, Rivibacter subsaxonicus
MRLSVVLITKNEARHIEACLASVGFADEWIVVDSGSSDGTQELARRAGARVIETSDWPGFGPQKNRALAAASGDWVFSIDADERASPELAASIRAAMAAAAGPASYKVSRLSSFCGEWIRHGDWYPDDVLRLFRRGSARFSDDLVHEQVLADGPVGRLDGELLHESQPSLESCLDKLNRYTSGRALQLHRAGRSGSLSKAIAHGLWAFLRSYVFKRGFLDGRMGFVVAFSIAEGTYYRYLKIWLLARGPGPASLPPAATTHLSHGTQSPSSASTTA

SEQ ID NO: 2671 - protein, 271 aa, Luteibacter rhizovicinus
MANLPLSLVVITYNEAHTIARCLDSVPFAAEKIVVDSGSTDDTVAIAIAHGARVVHQDWLGFGPQRNFATGQASHDWLLALDADEFLSPELAAELSQALPGIMASDAPAAWLRRRTIYMGRPMRWYRPAVGEKMARLWHRDRARWTDARVHESLRFEGSAPTLRAPFDHVNNPSLAEKQLKVLRYAELKCRDWLDKNKPVRMWQTPFVFALAFIKDYIFRLAFLDGWRGYAIAQTAASYAVYKRMRYYEMRNNPLSRDTAATALHRHGLDR

SEQ ID NO: 2672 - protein, 260 aa, Unknown
  Description of Unknown: Acidobacteria bacterium sequence
MRISATIITLNEEMRLARCLESIQGIADEIIVVDSESVDNTREIAESHGARVFCRQWTNYSDQKNFASRQASHDWILSLDADECLSSSLREALVALKKGNSLAEAYAFRRLAFYLGRWIYHSGWYPDYKTRLYLKEKAHWEGQFVHETLVVDGRISRIEADLLHYTCESVSAHARSVERYTTLAAQDLWTLGRRSTFPILLGSALGAFMKGYLLERGFLDGMQGCLIATFAGYYNFLKYAKLWELERKKPEDRRKLANRK

SEQ ID NO: 2673 - protein, 271 aa, Megasphaera sp.
MEDSVSTLSVLILTKNEEENMTAVIGSARQCTSDIIVVDAGSTDGTVAMSKACGARVIYHEWENDFAKQRNIARDSSTADWILYLDADERIDVKLAEEIRQVVEVDDQSKQYGMKRKSVAFGKKFTYGVLYPDTVMRLFPRQSVVWVNKVHERPDCVLTAKILSGYMEHHTYKNWQQWEKKLCLYTTAWAENAFENGKTISKGGILGHALGGFFKMFMLRRGFLDGWMGTYMCFNHFFYELLKYLKLYELNHEKENRGIIDKTENSDQGDA

SEQ ID NO: 2674 - protein, 303 aa, Beijerinckia mobilis
MRNVAVVVLTYNEEMHLARALESVAPFAKEVFVIDSGSTDQTIAIAKARGARVLYNPFVSQAKQFQWGLDNAPITAEWVMRLDADEIIEPDLAAEIEEKLPKLASDVTGINLKRKHIFLGRWVRHGGRYPLLLLRIWRHGLGRVEDRWMDEHILVTKGRTIAFDGGFADWNLNDMSYFTAKHNRYATREAVEIINQRRNLFLHSENAMTGKNSTQALLKRCIKERIYNHIPFPISATGYFLLRYIFQLGFLDGVEGLSYHFLQGYWYRFLVGVKVLEFERAIAPFKSVDEQRAALARVSGLDL

SEQ ID NO: 2675 - protein, 366 aa, Unknown
  Description of Unknown: Sphingomonadales bacterium sequence
MKHHAQFHRDRKPRASIAAVLIVKDEARCIERCLNSIRPHVDRIVLLDTGSTDGTQMLAANCGAEVHHLPWPNDFSVARNHALDLADADWNLILDADEWILSGGGLLRQWCKGRPRMGKICVHSEVDGSNETEAGSRRNWMTRLLPRGVRYEGRVHEQAISDLPRLRLNLQVGHDGYLEHQLARKRDRNAPLLLADLKERPGDPYILYQLGKDCEMQGDLEGAAIRFGQSLEATAPEANWRHGLVIRQMRALSKTGKRQEALALADVEMPNWEDSPDFYFMVGNLLLDEAIDDPEQAVEQWLPLAAGCWERCLAIGERPDLEGSMQGCGSHLAKHNLTAVHTQMALHSARRELARICDESVIDKDG

SEQ ID NO: 2676 - protein, 270 aa, Unknown
  Description of Unknown: Acidobacteria bacterium sequence
MLLSVVLITFNEEANIARTLQSVAPLVQQGRGEIIVVDSGSTDRTLEIAQSLGARVFSEEWKGFAAQKNSALAKASGEWVLSLDADEELSNELADDIEQVLADSAPGAPQPRSAVAYWIPRRNYFLGRWTRHGGFWPDDKLRLFRRGAAQFKHTPVHETIEVLPPAKGLPIAYGHLPGHLLHYSYPTLSSYIEHMNRYSSLGAEMAAAKGHGAFSFSNIVLRPAATFIYNYFFRLGFLDGKEGLLLHLYHASYVSWKYAKAWERSRDARK

SEQ ID NO: 2677 - protein, 260 aa, Unknown
  Description of Unknown: Chitinophagaceae bacterium sequence
MQALSVIILARNEARTIAAAVESAIQVSNDVIVVDSGSTDATIDLSKAAGARVIAINWPGYGEARNLGALAALHDQILCIDADEVITSALAASINGIAFNPDVIYGFKRRNFLGSREITHGEWGHDQVYRIYNRKYARWNHDKVHEMICFTWGVEAGAGQSSRASKDIIAGSLLHYTTTDLALYSRKLDRYAQLSAEKYFSNGKKASVAKRYLSPVFSFIKNYIVRLGFLDGKNGLQIALLHAGYTRNKYRYLQKLYKQA

SEQ ID NO: 2678 - protein, 252 aa, Unknown
  Description of Unknown: candidate division Zixibacteria bacterium HGW-Zixibacteria-1 sequence
MSKISAVIITKNEEANIERCLKSVDWVDEIIVVDTDSTDKTRRIATEAGARVFQVEWQGFGHAKGFGVEKASHDWILSIDADEEIGERLASEIKGVIASDRAENGFEIPRRTSFLGRWIKYSRWYPDYVLRLFKKNSGRFNDSLVHEKVMIEGSIGRLANPILHYSYPDIDTYFIKFEKYTSLAAQELYNKGKRFHLAALIFKPIASFFRHYVTGLGFLDGVEGFLIAVLSAFGVVTRYVKLRSLEKASRHD

SEQ ID NO: 2679 - protein, 262 aa, Unknown
  Description of Unknown: Photobacterium swingsii sequence
MTTQTPTLAVALIVKNEAQNLQACLDTVKGWVDEIVVLDSGSTDNTQEVALQYTDKFFTNEAWPGFGPQRRLAQSHVESDYVLWLDADERVTPELKASILAAVAAPAKDTVYSIPRLSWVFGRYIKHCGWYPDRVLRLYPTQLTQYDESLVHEKVEVTGTMKTAPLTGDLIHFTYNDLHHYLVKSAGYAKAWADQREARGKKSSISQGLLHAMGCFLKMYVVKAGFLDGKQGFLLSVLSAHSTFIKYADLWIRTSTEPAKEL

SEQ ID NO: 2680 - protein, 258 aa, Erwinia iniecta
MSARQRLSVVMIAKNEAGLLPDCLASVSWADEIILLDSGSSDQTPEIARQHGVKVYQSEEWPGYGLQRQHAQRYATGDMILMIDADERVTDELRASIERVLDCPEPHTVYSIARRNLFLGRFMRHSGWYPDRVTRLYPRDYHYNDNQVHESLDTREAHVVPLRGDLKHLTCRDFSAFQRKQFAYAEAWAKQRHQQGKSCSMFSVFSHTISAFLKTLVLRAGFLDGKQGWLLSVVNAQYTFNKYAALWALNQAADKGSL

SEQ ID NO: 2681 - protein, 258 aa, Pantoea septica
MSARQRLSVVIIAKNEAALLPDCLASVSWADEIILLDAGSSDETAEIARQAGAKVYRAEAWVGFGKQRQRAQRYASGEMILMIDADERVTPTLRASIEAVLTQPPAGTVYSLNRSNLFLGRFMRHSGWYPDRVMRLYPRALSYNDNLVHESLETQGAPVVRLQGDLQHLTCRDLIVFQQKQLAYAAAWAQERHQRGKRCGLFSIFSHTLGAFLKTLLLRAGFLDGKQGWILAVVNAQYTFNKYSALWALNHAADKGRL

SEQ ID NO: 2682 - protein, 374 aa, Unknown
  Description of Unknown: unclassified Ralstonia sequence
MSKHAKHRRTGSTRSEIALVVIARNEAACIERCLLSAKPHVDRMIVLDTGSTDDTVAIAQACGAQVHHFTWVDDFSAARNAALAAANADWNLVLDADEWIESGTEELRDACTFGPLLGVVCIRSEYDLSGHVEHSNSWIARLLPRGVRYKGRIHEQPAANLQRVRLPLVIGHDGYMNAKLDRKRGRNHALLQQELAEHPNDPYILYQLGKDFEINLKDPAQAAAHYQRALTTAPKTAPYRHDLCICLLACLSKTKQLDAAITLAGEWMEEWSGSPDYFYMLGHLMFEAAAQNAAQAEKQWLPMAESAFLKCLEIGEQPKLDAAVFGRGSFAAAKYLALTYRAQADTLAIKANHFSNLARQMQENTASAATPVAA

SEQ ID NO: 2683 - protein, 249 aa, Pusillimonas sp.
MTLSVIIITKNEAAHIGECIDSVSFADEIIVVDSGSTDGTREIAQAKGARVSLTDDWPGFGRQKNRALDLASCAWVLSIDADERVTPELALEIQRELAAPQSDAYKIARLSNFGGRWIRHSGWWPDHVLRLFKRGTARFKDVAVHESVQTTSSVTTLKNHFLHYPYADLETFIAKINHYSSEAAGMMHAKGRRTSVLGATGHAVWTFVRIYLIRRGFLDGKEGFILATMGAAGSFFRYNKLLFLNKQNK

SEQ ID NO: 2684 - protein, 260 aa, Rouxiella badensis
MSAQKRLSVVLIAKNEASLLEDCLKSVSWADEIVLLDSGSSDDTPSLARHLGAKVFENKDWQGFGKQRQIAQDHATGDYILMIDADERVSPELRQSIEACLQQPDANKVYRLGRRNLFLGRFMRHSGWYPDRVNRLYKADKYRYNDDLVHESLNFQGAEIVDLKGDLLHLTCRDFFAFQRKQMNYAEAWAKQRFEQGKRCSYFSIISHTLGAFFKTWILRAGFLDGKQGLILASVNAQYTFNKYAALWAFSHQLQKSEPL

SEQ ID NO: 2685 - protein, 319 aa, Sphingomonas sp.
MTTVAVVILTFNEERHIARALESISSFATQIFIVDSFSTDATVSIAMRHGAKVVSRDFVNYADQFQWGLENLPINAEWTMRLDADEVIDPALAAEINQKLPELTVDAEIGGINFKRRHIFMGRWVRHGGRYPLILTRLWRSGKGRIEDRWMDEHIVVNSGKIVMLENYFSDINLNDLTFFTDKHNKYAVREAIDALNERYNLFPGEFTVTSESASFQASFKRFIKEKIYNNLPFWMGPLLYFVWRYIFQLGFLDGRSGLIYHFLQGFWYRFLVGAKIYEFDRHLRPLVSAAERLTMLEKLTGKNLAPRTRSIEKPAIRL

SEQ ID NO: 2686 - protein, 252 aa, Haemophilus parainfluenzae
MPTISVAMIVKNEAADLAQCLDTVKDWVNEIIIVDSGSTDNTQEIAEQYGAKFYSHPDWPGFGKQRQRAQQYVTSDYVLWLDADERVTPKLQESIQQAVQQDAANTVYDIPRVSEVFGREIRHSGWYPDYVVRLYRTNYAGYNDSLVHEKVVYPENTKVQKLTGDLEHFTYKSIHHYLVKSAGYAKAWADQRQTKGKKATLWQGISHAISCFVKMYILKAGFLDGKQGFLLAVLSAHSTFVKYADLWERNQH

SEQ ID NO: 2687 - protein, 277 aa, Unknown
  Description of Unknown: Phyllobacterium phragmitis sequence
MSISVLIMTLNEEANLPACLASLSWSDDIVILDSFSTDRTVEIAEAAGARVYRRAYDSEDRQRMYGLTEIEFKYPWVYTPDADEITPPDLRDEMLAIARDPTRPEAFFKARYKNMFMGRWIRRSSLYPTWITRLVRPDRVRFERSVHSRCTGDGPTGELKSHFIHYSFNKGLEAWYDKHNRYSSVEADLSSGRRLDRKIDWKSLFSAKSDLRRRGLKALSYRLPFRPTLRFLYMYLLRGGFLDGKPGYFYCRLLSAYEFMIVVKTEEQRQRPRGFAG

SEQ ID NO: 2688 - protein, 251 aa, Ramlibacter tataouinensis
MTRPPRLTVIIITRNESARLRACLESVAFADELVVVDSGSTDDTVAIAQALGANVRQTADWPGFGPQKNRALDMARGEWVLSIDADERVTPRLRASIEAAMVQSRFEAYTVDRRSSYCGQYMRHSGWYPDRLVRLFRRGKARFSGDLVHERLLVDGTAGALEGELLHESFDDFESVLDKVNRYSSDSARALDARGVRGSLGKAVGHGFWAFVRTYLFKRGFLDGRLGFALAVSNAQGAYYRYLKLWLLQRR

SEQ ID NO: 2689 - protein, 250 aa, Unknown
  Description of Unknown: Chitinophagaceae bacterium sequence
MQANLSIVIICKNEADNIERAIGSARGLVRDIVVYDSGSTDNTIEMVEAMGLPVHRGEWLGFGPTRRAATLLAQNDWVFCLDADELLSESLVQELDALRLEPGCAWEVQLRNHLGKRYIRWGAWRNDFRLRLFHRRECNWNDNLIHEKVVPLQPVTIRRLQGGIWHRTARDIRDYRGKMENYARLTAEMYFRKGKRAGLLQRLFSPLLTFVKSYFGKLGFLEGMTGLRLSLATASYTRRKYQYLKSMSQR

SEQ ID NO: 2690 - protein, 252 aa, Sideroxydans lithotrophicus
MPSLSVILITKNEAANIRDCLQSVAWADEIIVVDSASSDDTADIARAMGAQVYVHADWPGFGPQKNRALGYASKDWVFSIDADERVTPELRAELEQAMRTGNAEGYYCPRLSQFCGKFVHHSGWYPDYVLRLFKRGTGRFSDSLVHESVLMDGAAAKLKSPLLHYSYLTTADVERKVEHYSNAAAQQMLQAGKRSSWVGAMLSGGWAFVRTYIIRLGILDGAAGWSIALMNARTTYLKYRKLAVLNSTRISH

SEQ ID NO: 2691 - protein, 258 aa, Unknown
  Description of Unknown: Gammaproteobacteria sequence
MRTRKISCFVIVCNEEDRIERCLQSLSGWVDQLIVLDSGSKDNTVAIAQQYADKVYQTDWPGFGPQRNRALTWCEHDWVLNIDADEVMTDALKAEIDAVLSEPDLQENLFKMPWHTYFFGKLLKHGRYSSPQGKLFLKTGVSFKNRQVHETLLIPNEKSRTLKSAIIHHSWRSYHHAQEKHLKYACLLAEEKYAKGKRSSLAFAVLRFFTDFLQQYLLHLGFLDGWRGFLMAIILGQYGFNKYAALVTLQAEHKAKQQ

SEQ ID NO: 2692 - protein, 250 aa, Fluviicola sp.
MKISATIITLNEERNIERCISSLKGVADEIIVLDSFSKDNTEKICKGLEVTFTQRLWEGYASTKNHLNSLAQYDYILSIDADEALDEELKQAILKVKERTDPEIYSLNRMTNYCGKWIKHSGWYPDVKIRLFPKEGSYWDGEFVHEELVYPMNLQVIQLEGHLSHYSYYDYKDHRARADKYSTLTAMKMYKAGKKASVLKPYFSALARFTSMFFIKLGFLDGWKGFKIAQISAQSNVFKYQELRRLNREE

SEQ ID NO: 2693 - protein, 277 aa, Unknown
  Description of Unknown: Parcubacteria group bacterium GW2011_GWA2_45_14 sequence
MLSAIIITRNEASSIEGCIASLSFADEVIVIDSGSTDQTMLLAKRCGAKVFTHAWAGYGEQKNFGAAKAMGQWLLFIDADEKVSPALDDTITSLINTPAANTYDYYWLRIITIFLHRPLTHLYGNNLRLFKKSAGHWNDAPVHEQVVAGNNQTIKLGDPLSGRLFPPLFHYSHHTSSSYLKKMHHYTTLDANQMYTTGQHRSGRSYQPSILLPYRLFLRQLVKLLFYRRGFLDGLAGYVWCVLSAYYEYDMSKKYVRLSRIEPQIPFNPSSPDKPLS

SEQ ID NO: 2694 - protein, 258 aa, Pantoea vagans
MSARQRLSVVMIAKNEAELLPDCLASVSWADEIIVLDSGSSDDSVEIATQAGAQVYKSDDWQGYGIQRQRAQHYATGDMILMIDADERVSPELRAAIEQVLVAPPSRTVYSLGRSNLFLGRFMRHSGWYPDRVMRLYPRTFHYNDNLVHESLQSDGAPVVALPGDLEHLTCRDLIAFQRKQLAYAEAWATERHQRGKRCGLFSVFSHTLGAFVKTLLLRAGFLDGKQGWILAVVNAQYTFNKYSALWALNHASAKGRV

SEQ ID NO: 2695 - protein, 250 aa, Pusillimonas sp.
MTLSVIIITKNEAAHIADCIASVSFADEIIVVDSGSTDATRDIAAGLGAKVTLTPDWPGFGQQKNRALDLATCDWVLSIDADERVTPELAREIQQVLGQPRADAYKIARLSNFGGRWIRHSGWWPDHVLRLFKRGSARFKDVAVHESVQTSSPVAVLDGHFLHYPYADLETFIAKINHYSSEAAAMMHARGKRTSVLGATGHAVWTFIRIYLIRRGFLDGKEGFILAAMGAAGSFFRYNKLLLLQKKPNK

SEQ ID NO: 2696 - protein, 260 aa, Rhodoferax antarcticus
MKKVTLSVIIAAKNEGAQIGECINSVSFADEVLVLDSGSTDDTATRARKAGANVHTTDWPGYGPQQQRGINLATSDWVLSLDADERITEHLHDEIQAAICRPDFDGYFLPRHSSLCGVFIEHGGWRPDYTLRLVRRPLAGFTDHFLHAHMTVNGKAGHLKSPIVHYSYRTLDDLLEKMNRYSKGAAIDSFTRGGSSSLTKALAKGIWAFVRTYFVRQGFRDGHIGLVLAIYNAQTTYYKYLRLWMMTNDKLKETPKKFFK

SEQ ID NO: 2697 - protein, 435 aa, Unknown
  Description of Unknown: Verrucomicrobia bacterium Tous-C9LFEB sequence
MSLSAVLIVKNEEENLPRCLRSLEGVCQEIVVVDTGSTDGTVALAQQAGARVSFFPWNGNESDARNYSVQQATGDWLLVIDADEELSLELNGELRELMPELMRRPDIRSGSLIWENHFDGNEVNRTRILRLSRREGFRFDGDIHPTGTYQPETHPLRGALHHFGYQWTPERRERKAQHILNHLKPYLQKPHPAFGRWCQYLTALNLIGEETHFLEMWSEVAHYTPEERIASESTPSWLENSANFFRHFACKDDFTSAAFYADEILSAFPRHATSRFYRLQGRVKERRWKEVLTESQQLLEFLAHDPGDNNPTWAALQCPTARAWQWLAERQLENPRAENPPAWLIDPITLPTFLFGNRAPTLPPEAAPEGAELLKALIEAETLDRCHSGAATLRQLSRCLQRWPHLNWFRMGLDKLERGESFRLETLAHRTVHLV

SEQ ID NO: 2698 - protein, 340 aa, Butyrivibrio sp.
MVTISLCMIVKNEENCLEKCLGSLKGLVDEMIVVDTGSTDRTKEIANAFGAKVYDFKWTGDFSEARNFSFSKATCDYIYSADADEELDETNRERFLQMKRDLEELDIDIVQMYYCNQLSFRTVYNFDRELRPKLFKRVRYFTWEDPIHEQVVLDPVIVNSEIEIIHNPGENHSARDLNTFRKAIADGKFLSRRLYGMYARELMMAGTDDDFLKAKSFFEESLKDTHRSLDEIKEGSCILSHIAVIEGDVSALLKYALKDAITEMSSEVCYELGDFYYSQKDYDEAIVWYYNAAYECESILDVKKSKELPRLAIAKCYRALGNSELAEDYEKEALEVQKEE

SEQ ID NO: 2699 - protein, 252 aa, Unknown
  Description of Unknown: Chitinophagaceae bacterium sequence
MIKFSVIILAKNEERTIAAAVASAKQVSDDVLLVDSGSTDRTIPLATAGGARVLSISWPGFGAARNLGAAAAKYEWVFCLDADEVITGELAASLRVWQPDGQVLYGCRRRNFVASHEIRYGEWGHDRVMRLYNRNYWEWNADKVHENVVRKDGGERRRMVLPGALLHYTTTDLDTYRKKLDNYARLSAVKFFEAGKKGTFSKRYLSPVFGFVKNYITRMGFLDGSDGLRIALLHAGYTRKKYRCLDELYKLA

SEQ ID NO: 2700 - protein, 275 aa, Hymenobacter sp.
MNLALDLTIAIPVRNEERNLAGCLEAIGPDLARHIVIIDSGSTDKTVEIARSRGVEVIDFKWDGRFPKKRNWFLQNHTPTTKWVFFLDADEYLTTDFKTELRRTLQDQQANKVGYWLSYTIYFLGEQLKGGYPLRKLALFQVGAGEYERIDEDQWSKLDMEVHEHPVLTGEIGTINSKIDHQDFRGVSHYVLKHNEYAGWEAARFLKTNSAAISNKWTWKQRLKYRLMQSIWIGPAYFCGSFFLLGGFRDGARGLAFAILKMSYFTQVYCKIREK

SEQ ID NO: 2701 - protein, 357 aa, Unknown
  Description of Unknown: Clostridia sequence
MVTISLCMIVKNEEAVLDRCLSSVEAAVDEIIIVDTGSTDMTVPIARAHHASIYTFPWIDDFAAARNFSFAQATMDYILWLDADDVLTEMNRDKLLALKQSLTPSYDMIVMLYHTAFDAAGRPIFSFPRERLLRREAHLQWEGAVHETIPYADHRLMSDIAIEHHKLHANDPERNLRILEKIKAEGLLTLRQQFYYARELADHQRFAEAIIQYEAFLQDPHGWSENQIDACRGLAVCHRQLGHGEAAAESLIRSFLYAPPRGEVCCGLGGYFYERGQWEQAVFWYRLASELPLPNMTGGFVDPDCYGYIPWISLCCCYDKLKDWQQAWSANEKAGALKPEDAAYLYNRRYLSDKKPQ

SEQ ID NO: 2702 - protein, 270 aa, Unknown
  Description of Unknown: Acidobacteria bacterium sequence
MPKLSVTVITRNEAADIGEALQSVAWADELIVVDSGSTDDTVTIAQRFTPHVVVREWPGYVAQKNYAASIASHNWILSLDADERVTPELAREIQHVLAAEPPHAGYRIPRVTWHLGKWIRTTDWYPDHQLRLYDRRAAEWTGRYVHESVSIRRSASVPADGATGRLRGELEHFAYRDVADHLETIDRYTTDAARQMHEAGRRASLWQIAGHPPLAFLRNYLARGGIRDGAAGFIISALNSYYVFLKFAKLWELQRVPSPEPRAPSPEPPE

SEQ ID NO: 2703 - protein, 260 aa, Rouxiella chamberiensis
MSAKKRLSVVLIAKNEASLLEECLVSVSWADEIILLDSGSSDGTRALAQKLGAKVFENADWQGFGQQRQRAQSHASGDYILMIDADERVTPALRQSIEQCLRQPEDNAVYRIGRRNLFLGRFMRHSGWYPDRVNRLYQADKYQYNDDWVHESLNTNGARIIDLKGDLLHLTCRDFFAFQRKQTNYAQAWAKQRHQQGKRCSFFSIISHTLGAFFKTWILRAGFLDGKQGLILAGVNAQYTFNKYAALWAFSHQLQKSEPL

SEQ ID NO: 2704 - protein, 254 aa, Burkholderia sp.
MAEPTLGVALIALNAAARLAECLDALSFADDVVVVDGGSTDSTVEIAKAHGARVIVAADWPGFGPQKNRAVAALDTDWVLSIDTDEIVTPELAASIQAAIRAPRAQVYALDRLSSFCGSWVRHSGWYPDWVPRLFQRESARFSDDLVHERLVFDGPSARLDGQLLHYSYEDFETVLRKLDAYSSAGAAQRREAGKRGGFAKALGRAAWAFARTYLLRRGFLDGRAGFMIAVFNAETVYYRFLKLGHPRPEKAGN

SEQ ID NO: 2705 - protein, 302 aa, Unknown
  Description of Unknown: Candidatus Parcubacteria bacterium sequence
MNLKSGKISVVINTLNEAVLAEQAIRSVSWADEVVICDMHSDDNIKVVAKKLGARVIEHERLDFVEPARNLAIAETTGEWVLVLDPDEEVSDELGVKLKEITEDNKISFVEVPRKNIIFGKWMIASFWWPDYNIRFFKKGKVVWSNEIHRRPQTLGEGIKLPDEERYALIHHHYKSISQFINRMDRYTSVQARELVKNGYRFRWSDVVEKPLNEFLGRFFANQGFKDGLHGLTLSLLQAFSFLIVYLKVWEEKRFKEENLDFKDIVMIGKSAGKDIDYWYKYGNLSKNPLKRLVERVKNKIL

SEQ ID NO: 2706 - protein, 269 aa, Kushneria aurantia
MSSADNAPLPITGVVIAQNEAANITACLASLARLCSELIVVDSGSGDATRELARAAGATVIDQPYLGDGPQKNVGPSHAHHRWVLSLDADERLSDEAVAAIAALDLAATEHDGFALRRRNHIGSRWITSCGWYPDYCLRLYNRERTAFGDSRQHASVQAARPCRLEADIDHYSFANLSELFTKAGGRFSTRAAKIMYLKGKKVNACSPFIHGANAFLRKYLFQRGFTAGVDGLSVALSASLNAYLKYAKLLEYQRDPRVREHEDFDRVW

SEQ ID NO: 2707 - protein, 300 aa, Cupriavidus sp.
MTSISVLILTKNEASDIAGCLESVAAITDDVHVLDSESTDETCSIAAALGAKVTVRPFDNFAAQRNFGLHQLPILNDWVLMLDADERLGQALVEEALALVATCDDSVAAARMGRRDFWLGQHLKHASISPFNIRLVRRSCVHFEREINEVLVVDGNIAELSNPFDHYPFSKGMKHWLNKHNLYSTMEAELIVRNRVGRPAIGKALFSRDPSERRLHQKRIFYRLPARPLIKFFYMLVLRRSFLDGLPGLHYTLLQCIYEYMIVLKTLELRERQAAEEKGLESPTLQASTASRVPKATEPT

SEQ ID NO: 2708 - protein, 245 aa, Unknown
  Description of Unknown: Flavobacterium saliperosum S13 sequence
MSTLSVIIPTYNEVSYIEDAVKSVAFADEIIVIDSFSTDGTKEKAIALGCKVLERKFDNFSSQKNHAIASATGDWVLFLDADERVTQKLKYEILSVIENGKHSGYKICFPHFYMNRFLYHKVDKVTRLVKNNNIHFTGDVHEKLHVEGSIGILKNFMIHYTYKGLFHLLQKKDSYAWFQANTSVKKGKKATYFHLFFKPFYRFFSSYILKRGFMDGVPGLALASINAYGVFSRYVKILLIEKGLK

SEQ ID NO: 2709 - protein, 264 aa, Pyrinomonas methylaliphatogenes
MLFAEVADVKITATIITFNEEENIAAACESVAWADEILVVDAGSSDRTREVARSCGARVIEREWPGFAAQKQFAAEAASHDWIFSLDADERVSPRLRESILSLRHLDEGALADGYRVARRSFYMGRWIRGGGWYPDYQLRLYHRARGRWQGAYVHESVKMVEGARVVILEGEILHYSVRDAAHHHRMIGERYAPLGARQMYEAGQRTSPIKIALAGPAAFLRSFILKGGFRDGLAGYAIARFAAHHAFLKHLLLWEMQRKGESE

SEQ ID NO: 2710 - protein, 259 aa, Unknown
  Description of Unknown: Candidatus Pacebacteria bacterium CG10_big_fil_rev_8_21_14_0_10 _45_6 sequence
MISVVLATHNEAANISRCLDSVKDFADEIIVLDGSSSDDTVTLAKKFAARIISTKNNTNFHINKQQAIDAAAGDLILQLDADEIVDNDLATFIVEQSKRAVTSLAKNEPVAWYIRRKNDFLGKFLRKGGQYPDAVIRLFYRGRAELPQKNVHEQLSVDGRVGMATGHLLHFPYPTLASYLEKFNRYTSFEAERRWKTGERPSISQTITAFTVAVLITFYKLFLRHRGYVDGWRGFLFASLSALHHPVVAIKLWELQERQ

SEQ ID NO: 2711 - protein, 250 aa, Bordetella bronchiseptica
MTLSVIIITKNEAANILACLESVAFADEFIVVDSGSTDNTVELVRDFGARVEVTPDWPGFGPQKNRALDLATGDWVLSIDADERVTPELASEIQAAMAGATADCYEIARLSDFCGRFIRHSGWWPDYVLRLFRRGSARFTDAAVHERVVPAQGQPARLRGHFLHYPYNNFDALIAKVNRYSSDAAAMMHARGKRATVFSALGHGFWTFVRIYLIRRGFLDGRHGLVLAVTAAAGSFFRYAKLMFLSEPRK

SEQ ID NO: 2712 - protein, 256 aa, Bordetella sp.
MNSPTLGVALITKNAAVRLAQCLDALDFADEIVVVDSGSTDATRAIARAHGARVIERPDWPGFGPQKNRALEALATDWILSIDADEVVSPELAASIRATIAAPLADVYAIDRLSSFCGAWIRHGGWYPDWIPRLFKRGAARFSDDLVHERLVFEAPARRLSGKLLHYSYEDLDAVLRKLDAYSSAGARQRAAAGKRAGLGTALARGAWAFVRTWVLRAGFLDGRAGFMIAVFNAETVYYRFLKLAQYAGQDKRQDR

SEQ ID NO: 2713 - protein, 298 aa, Unknown
  Description of Unknown: bacterium sequence
MRNSNRGQPVPPRSTIISCARRSLTLGRSPASLSAACAARRSRRGLESEQITAVVLTKDEAANIGACLRSLPAGMPALVVDAESADATRVLAQDCGARVVVRPWDGFASARRAALALTSTPWVLFIDADERLDDALRASVLAAPAHESVGYELLRTTEFCGRPMRCAGWNDEPVLRLFRREAVRLEARPAAGGSAQLHERWVAEGRVERLRGRLEHRSYPTIADYRRKFARYTAIEAAGISPSLGRALAAAARACVRWAWLYLARGGWRDGWRGAYVCTMSALYPVVVQFRALRGVSR

SEQ ID NO: 2714 - protein, 266 aa, Unknown
  Description of Unknown: Burkholderiales bacterium PBB3 sequence
MSKISVYIIAFNEAEKVAATIESARWADEIIVVDSWSTDSTAEIASQLGARVVQVKFQGFGDLRNQALAACTHDWIFSLDADERCTVEAAQEIRSVVNDPNAVDAYWMPRRNFFMGQWIRHSGWYPNYRQPQLFRKGRMTYEPKQVHEGYVLHSDKPVGHLTQAIWQFPFKNMAEVMHKANRYSSLGAERVAGQPVSMWTAFSHGLWSFVKHYLFKLGFLDGWPGFVIAFGNFEGTFYRYVKAMEIQKGAQWKLPTEVTTYVKPKD

SEQ ID NO: 2715 - protein, 260 aa, Leeia oryzae
MASIPDAPKPLSAVLITKNAGAHLSACLTSLAFCDEIVIVDSGSTDNTEAIATQFGARFIFQEWLGFGPQKQFAVNQARHDWVLCLDADESVSPRLAASIQVALTRSDYAVYRMPRCNRFMGRWLKHGEGYPDYNIRLFDRRQAQWSAHTVHEHVVTRQPVGTLSGDLMHDSADDISVYLDKQNRYTTLQAAALVAQGKVPTVSKMLFSPLLRAFKMLVLKGGWKDGAAGLVHISIGCFNSFIKYAKARELARQKQEHNS

SEQ ID NO: 2716 - protein, 266 aa, Alteromonas indica
MKRRPISCFLIVRNEADRIEACLQGLAGWVDQLIILDSGSTDNTAQLCRQYTDEVYITDWPGYGPQRNRALAKCQHEWVLNLDADENITDDLKAEIDTVLSEPDLDANILRLPWQTYLFGKPLNHGRYSTAQGKLFLNKDGAQFKNSQVHEVLQIANPKVRTLRHPLKHYSWRTYQHLQEKHLKYACILAQEKHARGKTGSLPYAALRFVTDFLQQYVLRGGFLDGKQGFFMAMVLGQYAFHKYAALAALQMQQDADNTPSRETSS

SEQ ID NO: 2717 - protein, 262 aa, Curvibacter sp.
MSQISVYIIAYNEAEKVAATIESVQWADEIIVVDSNSTDGTQDIATRMGARVVQVVFKGFGDLRNQAIAACTHDWIFSVDADERCTPEAAAEVRAIADDPNSLDVWRVPRRNYFMGRWIRHSGWYPNFRQPQLFRKGTMSYDLKPVHEGYVLHSDKPLGTLKNAIWQFPFKNMAEVMHKANRYSSLGAEKVVHKKISMGSALAHGIWSFVKHYIFKLGFLDGWAGFMIALGNFEGTFYRYVKALEMQKGEAWKAPKSSAGKT

SEQ ID NO: 2718 - protein, 298 aa, Unknown
  Description of Unknown: Acidobacteria bacterium sequence
MTISVVLITQNEEANLPMTLESVMPLVREGRGEIIVVDSGSTDRTLEIARSYGAKIFSEPWKGFAAQKNSAMDKATCDWVLQLDADEALEPELAEEICRIVEFPTDMDRKQRKGRIQELAYVFSPRTLKEVHQATQRAGTKTRDYGSFDRLSGFWIPRKNFFLGRWIKHGGFYPDPKLRLVRRGAGKFEEYGAHPTMKVDGPTGRLKHALIHNAYPTLRNYIGHMNSYSSAGAGIALEKGHRSFSFVNILLRPLLTFVYNYFFRLGFLDGRQGLLLHLYHSVYVSWKYAKAWELERKA

SEQ ID NO: 2719 - protein, 256 aa, Alteromonas sp.
MSNPCPLSVYLITFNEAERLDEVLSAVSFAAEIIVVDSGSTDDTIMIAERHGARVIHRNWPGFAKQKAFAMSQCTQPWLLNLDGDEVLSEESAAHIQTVVTGENPSHGAYRLHFEDIFWGRPMSSKAAKRHIVRLFRQGTARYPEDRMVHENVKLEKGTTTGDIKGLVMHYGYGSTELLMNKQNSYSSLKAQQKFNSNKKPSLLKLLLVFPLTFLKTYLFKRHFMSGKRGLTHAYIESMYAFLKEAKLFELTERNK

SEQ ID NO: 2720 - protein, 299 aa, Unknown
  Description of Unknown: Verrucomicrobia bacterium sequence
MNEQSDARAPLSVLVPVKNEAANLRDCLASVSFAEEIVVVDSASTDGTPAIAKAAGARVVQFVWNGNFPRKKNWALENISWQNEWVLIVDADERITPELEREIREAIRRTDVEGFYLNRRFWFLGGWIDHCGYFPSWNLRLFRHRRGRYEQIEINDSALSGDNEVHEHVLLNGRAEYLSAPMEHYAFPDIATFIEKHDRYSTWEAAASGKLYEGESEKTLRAIPFGTAVERKRWLKKLAMKAPFRPSLRFFYHYVLKQGFRDGYRGWVLCRLLAWYERMILLKEREMKNRSCKSSAGPF

SEQ ID NO: 2721 - protein, 249 aa, Bordetella petrii
MTLSVIIITKNEAAHILGCLESVAFADEFIVVDSGSTDNTVELARDFGARVHVTPDWPGFGPQKNRALDLATGDWVLSIDADERVTPELAREIQAAIAAPQADAYEIARLSDFCGRLIRHSGWWPDYVLRLFKRGTARFTDAAVHERVVPERPALKLHGHFLHYPYPDLDALINKVNRYSSDAAAMMHARGKRATVFSALGHGFWTFVRIYLIRRGFLDGRHGLVLAVTAAAGSFFRYAKLSFLSDARK

SEQ ID NO: 2722 - protein, 403 aa, Lautropia mirabilis
MKQTEKAARSRTVPKIVNIRPPGQSPVMPAGGSRMKTIALTMIVKNEARSLARCLDSVAPWVDKMIVLDTGSTDDTIAIARAHGAEVYERRWTNDFAAARNAALAHSDADWNLVLDADEWLTSGGEYLQALRHDSRRAIHNIRIDSDLGSGSNTLISSHRISRILPRGVRYKGRIHEQPAHNLPIIDAAVTARHDGYMQEQLDTKKGRNMALLEKSLAERPEDPYVHFQLGKQYDIQLQYAEALPFYRRARELVQHRTAWYHDLVVRTIECLRHEGRLEEAMIFASDEMPYWEQSADFYFVVGCLLLDQMQKHPEQGESLLPMIEESWLKALAIGERPELAGNVSGRGSFMAAAQLWALFDARKEVEKAARYKDMQKKFYAQYKEAADAGLVSAAALPEQQPA

SEQ ID NO: 2723 - protein, 300 aa, Jhaorihella thermophila
MTLTVVILTKNEARHIRRAIESVAAVADQILVVDSGSTDDTVSLAEGFAAKVIHNPWRNYATQFNFALDHLPDGTDWVLRLDADEIVLPELAEEIAAKLGGLNPDVAGIYVSRRMCFLGRPIRWGGVFPIRVLRLFRAGRGRCEDRWMDEHILVDGPTVDFHGEILDDNLNSLTWWTEKHNAYASREVVDLLNLEYRFMKHETVANLRGGQQAGVKRWLKENIYARLPGGSRAFAYFLYRYVFRLGFLDGREGTAFHVLQGFWYRYLVDAKLHEVRRYMEQNGADPVTAIRDVLGIEPLK

SEQ ID NO: 2724 - protein, 263 aa, Unknown
  Description of Unknown: alpha proteobacterium U9-1i sequence
MPEAPKISCYIRTKNEERMVADVIRAAFQIVDEVVVIDCGSTDKTIALAEAAGARVVNAPWLGGGKQKRIGEDNTRNDWMLDLDADEIVTPELAQEIRDLFSHGDPPCPVYQLTLVTAPPIGEPWWQSSVVTRNRLYDKRVIRARDHAGWDQLEIPSGMKVGKLKAPALHKSFRDLHQLGDKFNRNSSSRAKDTELKSFWYVALRIVFARPFYFFHHYVMRGMWRGGWYGFAVANIAAHGRWLKDAKMMEVYMRKRQDAKQNG

SEQ ID NO: 2725 - protein, 377 aa, Unknown
  Description of Unknown: Nitrospirae bacterium sequence
MRLSGCLLARDEEANLPRCLASLAPVVDEVVVCDTGSRDRTVAIAEAAGARVVHFPWCDDFAAAHNFLHRHATGDWILWIDADEELLPIPRKRLQRLLRAPRALAYLVTRLDLVAADDPESYTEMVLPRLFRRRPELTLVGRCHPEFRHPSLGEVAAREGLAIAPSPVRLRHYGYTAEQRPGKLRRAARLLALELEERPGQLYYQIELGRTLLELGDPSGHRILAEATAEVWRHRHDRRPPTPHVALLFDYLLGPPAPAAGGLPPRAAVAELAARWFPDAAPLLWRRAQIAFEGGDFATAAGLLERLLRLGRDHGYDHAVSFDPAILGDQTRLNLGVCYTRLARLEEAAACFRGLRHSPTCGAAARANLAVVERLRR

SEQ ID NO: 2726 - protein, 327 aa, Unknown
  Description of Unknown: Candidatus Woesearchaeota archaeon CG11_big_fil_rev_8_21_14_0_20 _43_8 sequence
MSTISLCMIVKDEEKHLKDCLDSVKGLVDEIIIVDTGSTDDTKNIAKRSNAKVFDFKWCDDFSKARNESLRHATKEWILVLDADEIIDKDDHDKIKRLIDTDEVAFAFDQWSYIDQKEPKAKKNTNRFSHPFYISHRPVRLFRNNLGIRFMNRVHELVEHSLKEHNLKEVKTNIIIHHFGSLKGSDFINQKAEKYAELILRQLKENPNNPRYNYQAANMYLGKGDKQKALDHFMATARVDPAYKLVHQEIAKLFLSVGKIEKAIEHLNFAMHNSPDNPSPANNLAVLYMRQKRYILAKALLEKYLKKDPKNKALLTNYTILKKLLST

SEQ ID NO: 2727 - protein, 295 aa, Ochrobactrum haematophilum
MTVSVLIMTLNEEVNLPACLASLDWCDDIVVLDSFSTDRTVEIAEAAGARVYQRAYDTEDRQRMYGLTEIAFRHGWVYTPDADEITPPDLRDEMLAIAADPDRPEVFFKARYKNMFMGRWIRHASLYPTWITRLVRPDRVRFERSVHSRASGGPGGELQAHFIHYSFNKGLEAWYAKHNRYSSAEAELSAARLLERRIDWGGILSTEHERRRRALKSLSYHLPFRPSLRFLYMYVLRRGFLDGKPGYLYCRLLAAYEFMIVVKMEEQRSRQIAALPRPAAQPRSLDAKDPERHMA

SEQ ID NO: 2728 - protein, 257 aa, Thiomonas sp.
MASVSAILITKNEIQNLPACLDGLSWCIEIIVVDSGSTDGSVALARHLGARVESRPDWVGFGPQKNRALDLAQGDWVFSIDADERVTPALAEEIQSAVQRADAPDAFSIPRLSSYCGQYMRHGGWYPDRVVRLFRRGQARFSDDIVHESLQVQGRVGQLHNDLIHISYRSLDDVLEKMNRYSSAGAEKLATRGRRASLATALGKSLWAFIRTYLIRRGFLDGRLGFVLACGIAHETWYRYLKLWLAQRPVSDKKLSP

SEQ ID NO: 2729 - protein, 255 aa, Unknown
  Description of Unknown: Acidobacteria bacterium sequence
MKISATIITLNEETQLARCLESIQGIADEIIVVDSESVDKTREIAGSHGARVFCRPWTNYSDQKNFASGQASHDWILSLDADECLSASLHEALVTLKKNNSSAEAYAFRRLAFYLGRWIYHSGWYPDYKTRLYLKDKAHWEGQFVHETLVVMGRISRIEADLLHYPCESVSAHAGSLERYTTLAAQDLWTRGTHSTFPILLGSAVGAFMKSYFLKGGFLDGIQGCLIATFASYYNFLKYAKLWELERKKPEETRK

SEQ ID NO: 2730 - protein, 290 aa, Polaromonas sp.
MPGGSAMLSARQAGPVSLAKSRAVSSLTSLQRHSLASLSVTVITHNEAHNIEACLRSVGFADQVVVLDSGSTDNTVQIARSLGAEVSVSPDWQGFGIQKNRALALATSDWVLSLDADERVTPELQLEILACLRDPAFDVYSFPRLSSYCGQYMRHSGWYPDRVTRLFRRTAARFSEDLVHEKVVAQGPVGQLRAQLLHESFRNFEAVLDKANRYSTAGAQSLLGKGKTASVGKAIGHGLWAFIRTYFLRLGFLDGRMGLVLAVSNAEGTYYRYLKLWLLQRGAKGAPGGR

SEQ ID NO: 2731 - protein, 259 aa, Unknown
  Description of Unknown: Planctomycetes bacterium sequence
MSKISCFILAYNEREKIVDAVSTVLWCDEIVLVDSGSTDGTAEAATALGARVVQVPFEGFGKLRNAALTHMTGDWIFSLDADERCTPEARDAMLRIASDPASASIWNIPRRNWFLGQWIRHSGWYPNFRQPQFFRRGAMTYDLLPVHEGWIPAAGAQVRTLPADIWQFPFTNIAQMVHKANRYSSLGTAKVGNRKGILRGLTHGGLQFFKHLILKRGFLDGRAGFFIAAAYFLQTFLKYAKRIEDGQAPPPSAGAIRRD

SEQ ID NO: 2732 - protein, 256 aa, Unknown
  Description of Unknown: Marinobacterium jannaschii sequence
MISVYLVVKNEEHNIERVLNSVRDFDDIVVVDSGSTDCTMELAGRYTDRLYSREWTGMAEQKEYAKSLCKHDWVLNLDADEELTEDLRLQILEIAARESVSGANIPIQEYFLGQAVHAKTKKNRHIRFFRQSKGAYGKERFHESPLVDGEIVELDGAINHYGEVSVEVKVDKVNRYSSGKALDKFDKGKKSSLLKLLLVMPVTFLKSFFIRRNCYNGRRGFVGSMINAFYAFLKEAKLYELELRQSDLGEKEKTRR

SEQ ID NO: 2733 - protein, 277 aa, Caulobacter sp.
MTKLSVLLCVHNEEQRLPSCLAALSFCDEIIVVADRCSDGTEAIARQYGATVVSGIFPIEGPRKHAGLARCTGDWILELDADEGVSLAFAKEVRETIERSDAADWYQTPIDNYIGDQLVRHGWGGSFGTSSAARLFRRGVKSWKSERVHPGAKLEGAYGGRLKQSLRHMVDEDIGDMFARLSRYTALRALDLADRGKVKSIVDDAFRGVRRFFKCYVSRKGYREGDLGFLISLMAGLYPILSNLRAREILRNRARGAATPPTPLAALPLRRAEAVSQ

SEQ ID NO: 2734 - protein, 253 aa, Catenovulum sp.
MSNTPISVYFVTLNEAATIAQAIQSVQGFAEIIVVDSGSTDGTQQIATNLGAKVVHQDWLGFAKQKQYALSLCQHDWCFNLDGDEVVPDDVARQIQQQVDADNCDALRIYFEDVFMGAAMHPSSHKRSIVRVFKKQNVEYPTNKLVHENVKVNGKVQDVKGCVLHYGYADAETLMAKQNKYSSLGAQEKFNKGKRHSWLKLSLMLPIMFFKEYIVRKRFLSGGRGFVQAVIDTMYAFLKEAKLYELHKTKNKP

SEQ ID NO: 2735 - protein, 336 aa, Unknown
  Description of Unknown: Sphingomonas sequence
MPPSSPRIAATLIVRNEARCIARCLNSVAPWVDKMVVLDTGSTDDTVVIAKAAGAEVHHLPWPDDFAEARNHALACADADWNLMLDADEWISTGGEELRRWCAGPPRLGFVCIENYVDGSPDPTRCWIPRLLPRGVHYEGRIHEQVASSLPRERIPVHVGHDGYLAQQKAKKRDRNQALLLRELAEQPENPYLMFQLGMEAQGQADFQTACDYLGQALARAPRDAGWRHALVVSAIPLMSHAGRLADAIALADAEFGQWPDSPDYFYVLGDVLFDQAVADPAQAVDHWLPMAQGAWERCLTIGERPDLDGSVTGRGSYLAQQSLDIVRSQLATLAA

SEQ ID NO: 2736 - protein, 341 aa, Labilithrix luteola
MAAESFRTLSLCMIVRDEESNIEGCLRSVQGVVDEIVVVDTGSKDRTITIARDFGALVVEEAWTNDFSAPRNRSIELATKDWILVLAADERIAPASGRRMREVVGRTRARGLQVRVRNLMPAGETALFDEVPQTRLFERRTEHRYEGIIHEQIAPSIVRGGGTIAKADLLVVHHGYQQDLVQGDRSRARRNLTLLEKQVELTPRDPYVLYNLGCTYKAVGNLAAARGALEAAEANDHGALDASSRLGLQTRLAQLALASRQDAIAVARARKALAISPSNPVALQVVALGLVALGDRAGALAAFAKLRRSPVVNPSLATDIDRLLARLAPAGPTARAAPLER

SEQ ID NO: 2737 - protein, 315 aa, Rhodospirillum centenum
MDDGLPASELPVVPSTGRLPVTVVIPTRNEERALPATLGTLGAFAEVVVFDSHSTDGTERIARAWGARFHQRVFDNFADHKNWALDNLEFRTDWVLLLDADERIGPDLLAEIAAILHGDRPEVAFAIPRRNVVDGVFLRRAGMYPDYQIRLIRRGRARYERRLVHEHMLADGPVGFLASPLLHEDGKGIRRYLERHVAYAEMEAVEAFIDLHRPAADHGACALPGPMARRRRLKHWSYRHLPLRFLWVFAYVYVARLGLLMGRTGLKYCLLRAFYEFKVDLFLAELRNGASPVAQAYRDLILERLGRCPPDWERR

SEQ ID NO: 2738 - protein, 261 aa, Halomonas muralis
MKISGVVITLNEAECIETCLASMSAVCDELIVVDSGSTDATCRLAEAAGARVIEQPYLGDGPQKNVGPAQATHRWILSIDADERLTDAAIATIQALDLANTGHDGFAFRRRNFIGSRWIKTCGWYPDYCIRLFDRERTAFSNSRQHASVQATQPRRLDADLEHYSFANLGELFSKASGRFSNRAAKIMYLKGKRANSWSPFIHGSNAFVRKYLFQRGFMSGIDGVSVALSAAVNAYLKYAKLLEFQRDAQVRKAEDFERIW

SEQ ID NO: 2739 - protein, 259 aa, Unknown
  Description of Unknown: Candidatus Sodalis pierantonius sequence
MSQRKRLSVVLITRNEAELLPDCLASVSWADEIVVLDAGSSDQTRHIAAQASARVFQSTDWPGFGIQRQRAQAYASGDYILMLDADERVTPPLRRAIQEVLRQPDPEVVYSCARRNLFLGRFMRHSGWYPDRVVRLYARERYRYNALPVHESLETSGAGIVALAGDLQHLTCHDLPAFQRKQLLYAEAWARERHRQGRRCGMLAIISHTYGAFLKTWLLRAGFLDGRQGWLLAVVNAQYTFNKYATLWALNHAERENDL

SEQ ID NO: 2740 - protein, 259 aa, Unknown
  Description of Unknown: Acidobacteria bacterium sequence
MPKLSVTIITLNEAAHIAAAIDSASFADEILVVDSGSSDGTIDIARGKGVRVLARAWTGYVEQKNFAAAQATHDWIFSLDADERIPPALADEIRGILAGDPPYHGYRVPRVTFHLGRWIRTTDFYPDYQTRLYDRRFARWRGRYVHESVSVDGPTGQLKNDLQHYSFADLRDQIKRINHYSTLSAKQMYEAGRRTGPIEILVHPPAAFLRNYVLRRGFLDGTAGLTISLMNAWSVGLKFMKLWELQKNPKSQIPSSKSQ

SEQ ID NO: 2741 - protein, 249 aa, Runella sp.
MLLPLSAVIITVNQEKKIAKTIEALKTLTDDIVVVDSGSKDATRTVAAALGARVFERPWPGYSEQKNFGNDQAKYDWILSVDDDEVVSDELAKSIRAAFASEPKADAFNLPFRTVFAGKLIRFGGWNPEAHIRIFNKKKIHWNTDAVHEGLTIRPEHSVQKLSGYVYHYTVDTLEQFAQKTNRYSTLFAEKGVKAGKKASFVKIYLSPAFRFLVEYVVKLGFLDGYYGWFIAKENARYTYLKYKKLGEG

SEQ ID NO: 2742 - protein, 255 aa, Hydrogenobaculum sp.
MQRRKISFVILTKNEEKNIKRAIDSIKDVADEILVIDSGSTDKTIDIAKSCGAKVIFNEWISYAAQKNFGISKAKNDIVFILDADEELSDELKNSLKDFLSSDYEIGIITRRTFYMGDFLKHIWNDEKLIRVFKKDVCKYSGDLHEKVICNHHKYYELKGYLNHYSFKNLKDQFERTLKYAKTSADIMCKNNKPFHVYNLILNPFWIFFKFFILKAGYKEGTKGLIIAFSGMFYVFMKYAFLYECQKSKEKELWK

SEQ ID NO: 2743 - protein, 260 aa, Unknown
  Description of Unknown: Candidatus Chloroploca sp. Khr17 sequence
MLAVVIIARDEEAYIEACLSSVSGLADEVIVLLDDRTTDRTAERAQQHGARVVCEAWRGFPAQRNRGLELATTPWVLFLDADELVTPALANELRATLQNEPTAAGFRLPRYNRFFGQILQGGGWYPDHQLRLLRRTAAHFDESRLVHEAASLDGAIAATSEHLWHENIVRLDELWHKQSRYALAEAQTLYRQGRIMRWRNLLGAPTREFWRRYGQLGGWRDGPVGFLLCVTMAWHELVTFLLLWSLHNACGIKKREDHVC

SEQ ID NO: 2744 - protein, 301 aa, Unknown
  Description of Unknown: Verrucomicrobia bacterium sequence
MSERSDARAPLSVLVPVKNEAANLRDCLASVSFAEEIVVVDSASTDGTQAIAEAGGARVVQFVWNGSFPRKKNWALENIPWQHEWVLIVDADERVTPDLESEIRKAICRTDVDGFYLNRRFWFLDGWINHCGYFPSWNLRLFRHRLGRYEQIEIHDDILSGDNEVHEHVLLNGRAEYLSAPMEHYAFPAIATFVEKHNRYSTWEAAAAGKLHEREGEKTLRARPFGNAVEGKRWLKKLATRAPFRPSLRFLYHYIWKQGFRDGYRGWVLCRLLAWYERMILLKEREATARARFTSYPTTPG

SEQ ID NO: 2745 - protein, 277 aa, Unknown
  Description of Unknown: Planctomycetes bacterium sequence
MCVSIFIQTLNEEQNLPSCLDSVSWSDDIVVLDSISSDRTEEICRQRGVRFYQRSYDGRGPHQNWAMEHIKFKHPWVFYLDADEHMTPELREEICAIASNPDEENVAYFCGRKNMFRGRWLRHSMPPGHIMRFFKPTNIRFERLVNPTPIIDGKHGYLRNHFIHYNFSKGITEWLDRHNRYSTYEAVEQIRALRDRPVNWKALFSRDANTRRIEAKNISFRMPFRPALKFFLLYFVKLGFLDGRPGLTYCALQALYEYEICLKIEELRRAERGEAPS

SEQ ID NO: 2746 - protein, 324 aa, Unknown
  Description of Unknown: bacterium HR21 sequence
MLPLAVTILARDSAATIARAIRSVQPIARQIVVLDTGSDDDTPSQALRLGAEVYFARWEGDFAAARNLALRHVRMPWVLALDSDEELEGTTLLAQAHLLEDPGIGGIEVQLRSVVSPEARHRFVYSHWAVRLFRSAEGIGYCGRIHEQIRPALEARGWKLVRAPILIWHYGYTPDRVRLKAQRNAELLRRELEHSPADVWLRYHLGMALFELEENEEALEVLRPCSEHPGLQPEQRMWARLRAAQAALRLDRIAEVEQLLARPLPDPELEGLRRFVLAAAVLQQRRFAEALTLLDSPVVQGSPYVPQEELEGIRTALRRLLPAQ

SEQ ID NO: 2747 - protein, 246 aa, Pseudoalteromonas spiralis
MKLSVCIICKNEKDKIERCLESVKWADEIIVLDSGSTDETRAIANKYTDKVFVRDDWQGFGEQRRRAEALATNDWIFAIDCDEVVSERLKEEIITTLAKCNEKNILKLNRLTYFCGQFIRHSGWYPDRIARIYNKKITGYNQNLVHESVVMLDCKPIELKENILHFQHEDIFGYMNKRNHYAHIGAEQMVNKGKKPSLLKASSSAFFAFIRHYFLRRGFLDGKTGFVIAVIQSQYSFNKYLFAYYK

SEQ ID NO: 2748 - protein, 256 aa, Crocinitomix catalasitica
MSTLKKISAVIITYNEEKNIETCLKSLVGIVDEIVVVDSFSTDKTESICLKYGARFIPHKFDGHIEQKNWAREQATCDIVLSLDADEALDETLQKSILSLKVDWQFEGYKMNRLTNYCGKWIRHTGWYPDVKLRLWQKGKGHWTGENPHDEFVLFDKNANIGHLKGDILHYSYHHPDDHDKQIEYFTNIAAKTHVEKGKSTFFMQRYLSAILKFIKCYFIKLGFLDGKEGWIISVKSSYAAYLKYKKINALKKHAK

SEQ ID NO: 2749 - protein, 256 aa, Ramlibacter henchirensis
MPTLSVIVIARNEARNITECVRSASFADEVIVLDSGSSDDTVERARAAGARVGVAADWQGFGVQKNRALALATGEWVFSLDCDERITPQLQQQIRQAIAAPGGHVAFSVNRSSSFCGQYMRHSGWSPDRVVRLFRRDAARFSDDLVHERVVAQGPVGRLPGELLHESMRDLESALVKLDRYSTAGARDLQRRGKRGSLATALGHGVWAFFRTYVLRRGFLDGALGFVLAVSIAEGTYYRYLKLWLLQRTPPVEPPR

SEQ ID NO: 2750 - protein, 261 aa, Methylibium sp.
MSVPNLSVIVITRNEGHQIADCLKSVAFADEWIVVDAGSTDDTREQAAALGARVTRTDDWPGFGLQKNRALALAQGRWVLSLDADERVSDALAAAIRAAVAPGADAADGPAGYQLSRLSRFCGQWMRHGDWYPDRVTRLFLRGRGRFTDDLVHERLDVQGPVGRLAGDLLHETMPTLHDALDKMNRYSSGRALDKVRAGRRGGLGTALAHGAWAFLRGYLLRRGFLDGRLGFVLAVYNAEGTYYRYLKMAFAEAAGTKTTI

SEQ ID NO: 2751 - protein, 264 aa, Unknown
  Description of Unknown: Planctomycetes bacterium sequence
MMPVLLPISAVIITLNGAKHLADTLACVDFCDERLVCDSGSTDATIEIARAAGARVEHQAFLGYGPQKQRAVESASHDWILSLDDDEVLDSEAINAIRTLDLSNPTACWSIRRRTFIGSRELRHGTWRADRVVRLFHRRTAGFTSHIVHERVRGYRLPTLLPGSMMHRSYDTCSDVIARSIQYARLKSEIMRRKKQRVHTWMLPLRACAIFSKSYFLQGGFRDGAAGFIVALSRVIDSTLPRAMLLLGEPACGDDGIATPIKHS

SEQ ID NO: 2752 - protein, 254 aa, Vibrio splendidus
MSKPTLAVALIVKNEEKHLEACLNTVKGWVDEIVLLDSGSSDRTEEIARQYTDKFYTNLEWPGFGKQRQLAQQYVTTDYVLWLDADEQVTPELKQSILKAVAEDKPNTLFQVNRLSAAFGKFIYHSGWSPDWIVRLYRTDYTQYNDSLVHEKVENQNYAIQKLDGRLHHYTYEHLHHYINKTTGYLKAWTDEREGRKSAGLTTALTHAFASFIKMYIIKRGFLDGKHGFILAWLCMHSTFVKYIDLYLREQAKK

SEQ ID NO: 2753 - protein, 265 aa, Paraburkholderia sp.
MTSPPTAPVSAQRPSLGVAIIALNAEARIAQCLDALSFADDIVVVDGGSTDATACIARAHGARIIVAPDWPGFGPQKNRAVAALDTDWILSIDTDEVVTPELAASIRQALDAPVASVYALDRLSNFCGRWVRHSGWYPDWVPRLFKRGAARFSDDLVHERLVFEGRIEKLAGRLLHYSYDDFETVLRKVDAYSSAGARQRLAAGKRGGFARALARGAWAFVRTYVLRGGMLDGQAGFMIALFNAETVYYRFLKLAHAHDGSARSP

SEQ ID NO: 2754 - protein, 256 aa, Unknown
  Description of Unknown: Acidobacteria bacterium sequence
MKISIALITLNEEANLPRTLESVTPLVRDGEGEIIVVDSGSTDRTLEIARSHGAKVFVEPWKGFAAQKNSAMEKATADWVLQLDADEALEPELADEISRELGGADNVIGFWIPRKNFFLGKWIKHGGFYPDPKLRLIRRGAGKFEEYGAHPTIKVNGPTGRLKNALIHNAYPTLRGYIDHMNSYSSSGAEVAIAKGGRGFNLVNIVVRPKLTFIYNYLFRLGFLDGREGFLLHLYHAVYVSWKYAKAWELSRSRRS

SEQ ID NO: 2755 - protein, 253 aa, Pasteurella multocida
MPTLSVAMIVKNESAHLAPCLDTVKGWVDEIVILDSGSTDNTQEIALQYGAKFYQNTDWQGFGKQRQLAQQYVTSDYVLWLDADERVTPELREAIQLAVKQNKDNVVYKIPRLSEVFGRKIRHSGWYPDFVLRLYPTKLTQYNDEPVHEKVCLPAHAVVEKLTGDLEHYTYQDMHHYLVKSAGYAKAWAEKREKAGKRGSLFSALTHAIGCFTKMYIIKAGFLDGKQGLLLAILSAHSTFVKYADLWVRTETK

SEQ ID NO: 2756 - protein, 271 aa, Burkholderia sp.
MRPDSDVQPTTTASPAAPTLGVALIAHNAAGRLAQCLAALAFADEVVVIDGGSTDDTVSIAQAHGARVIAEPDWPGFGPQKNRAVAALSTDWILSIDTDEIVSPELAASILAAISTPGAPGVEVFAVDRLSSFCGQWVRHSGWYPDWVPRLFKRGAARFSDDLVHERLVFEAPAARLTGKLMHYSYEDFETVLRKLDAYSTAGARQRRTAGQRGGFGKALGRGAWAFIRTYLLRRGFLDGRAGFMIAVFNAETVYYRFLKLGLTGQRNDPT

SEQ ID NO: 2757 - protein, 257 aa, Unknown
  Description of Unknown: Ignavibacteriae bacterium HGW-Ignavibacteriae-1 sequence
MNSCQISVALISFNEENRISHTLESVAGLCSEIIIVDSGSTDNTVAIAESFGAKVFVEDWKGFAEQKNSALSKCTKDWVLFLDCDEVLTPELRYEIAGNLCLRQDINGYIINRRSVYCGKIMQYAWQPDKKLRLVRRNSNPKWLGDFVHENLTVDGKTDEMQGEMLHFSYDSMKTHFHKTVEYARLSAENYYETGRTVSFFNLIANPIFAFCNMYLRRGAFMDGKLGLVASFSSMMGTFLKYAMLYEKKIISKSKNK

SEQ ID NO: 2758 - protein, 360 aa, Ralstonia sp.
MSAPSACADLALVVIARNEAASIARCLLSAKPFVDRMVVLDTGSIDDTVAIAQSCGALVSHMAWTNDFSAARNTALQAANADWNLILDADEWLESGGEHLRTLSGAAPSVGVVCVKNDTDATESASQLIAWIPRLLPRGVHYTGRIHEQPVSSLPAARVPIVVRHDGYTAAKMQKKGERNTQLLLDELAHRPDDPYVLYQLGKETELHHEDYTKAVTYYARAFSLAPPDAPYRRNLALRYVYSLGKADRVEEALAQGDVGIQTWPDFPDLCFALGLVLLDAAAKQPDEAGARWLPLAEQVFNRCLEIGDQPEMDGSVIGRGSFLAAQQLAIVYQMQSHALARKSEHYLTLSKQLQDASSQ

SEQ ID NO: 2759 - protein, 257 aa, Photorhabdus temperata
MNERKRLSVVMIAKNSADLIADCLASVSWADEIIVLDSGSSDDTCQIAQAMGAKVFSNIHWPGFGRQRQLAQQYASGDYIFMIDTDERVTPELRVSIEQVLAHADDNKVYSCARRNLFLGRFMQHSGWYPDRVIRLYARNRYQYNDNQVHESLESHGVPIVILKGDLRHLTCRNLIEFQTKQLNYAKAWAKQRHEQGKQCSYFSIFSHTFGAFFKTWLLRAGFLDGKQGLVLAIVNAQYTFNKYVALWEKRLQKGKN

SEQ ID NO: 2760 - protein, 260 aa, Pseudoalteromonas porphyrae
  MOD_RES (242)..(242): Any amino acid
MSESKKNRENKAPISVFIVTLNEAEHIENTLKSVSECAEVIVIDSGSTDGTVEIATELGAKVIYHPWEGYAKQKQIAMEHCSFDWVLNLDGDEELTPSALQVLCNAMEEDKYTAVRLKRIDRFINKFPTGWVKKPNNVRFYKKSDACFNAKKLVHESATVEGKELYAKEYFLHYGYNDIDTLTAKNNTYSSLRAKEKIIQGKRYSILKLLLVFPITFIKEYIFCRFFLFGNRGFIKSMMTAXYAFLKEAKLYEQNKKQKK

SEQ ID NO: 2761 - protein, 256 aa, Dechloromonas aromatica
MPATRQPLSVAIITLNAASQLEDCLKSAGFADEIVVVDSGSTDGTQALAERYGARVIEQAWLGFGPQKQFAVDTASHDWVLCLDADERVSPELQAAIENALQSPPSAAFRFARCNRFLGRYLKYGEGYPDWSLRLFDRRQAGWSDDAVHEKVIANGAVGTLKGDLLHDSAETLAIYLGKQNRYTTLAAEMAAAAGKRASFARLAFSPIIRFIKFYLVRQGFRDGLPGLIHIAIGCFNSFMKYAKLFEKQRSNAALR

SEQ ID NO: 2762 - protein, 267 aa, Simplicispira metamorpha
MPQPASAGVPSPTLTVAVLTHNEARRIEACLRSAAFADRLVVVDSGSTDDTIERARAIGAEVFVHADWQGFAVQRMRQLAYANTDYVFFLDADEVMSSAFQQELQAIVRSGSTAVWQIRWRMVAYGRELRYLRAHTKVARLFRRDQILGWTGVVHEEAVLANPDIPRRVMQTPLLHHARDSVRTSLEKMTQYALLGAAKRAAQGQRGGVLRGLLAGGVMFLRMYVLRLGFLCGGAGFLYCLFIGLEAFFRYAVLFYDRDTLTDRAGR

SEQ ID NO: 2763 - protein, 270 aa, Unknown
  Description of Unknown: Gammaproteobacteria bacterium SG8_31 sequence
MVSLAGQGPVNRISAVVITLNEEHSLSGALDSVAWCDEIVVLDSGSVDGTVEIARSYPNCRVLHQPFLGYGPQKRKAVEAASNDWILSLDADEVLDELLQQSLRAWRESGSPGEAGYYLLRRLCFMGRHFRHGRESRDRVLRLFDRRRGNFNEANIHERVELDGPTGVLSGRLLHYSYRDLDEYFEKFNRYTSVMARQMRQRGRRSSIPSLVLRQPVSFLNYYLVRGNWMNGFPGFVWSLLAATYRTVKYLKLYELQTTAYDSKQDPPVA

SEQ ID NO: 2764 - protein, 289 aa, Salinibacter ruber
MISVLVLTLNEEVNIADCLDSVAWADDLLVLDSGSEDRTVEIARSKGARVLHRDFDDFASQRNYGLEEGGLRHDWVLHLDADERVTPALRDALRDKARGGEQRAYRVPSKLMFQGRWLKHAGMYPTYQVRFGRREALTFTQVGHGQRGALPLDQVGTLDEPLLHYAFSKGIADWVRRHNRYSSDEAEHAQETQLRDVDWSALMTGDAQTRRRALKDLSYALPFRPLLRFLYIYVGRLGLLDGRPGFDYAVLLAFYEYLIGLKRREHEHRERTDAEESADSSLEMEMHEA

SEQ ID NO: 2765 - protein, 268 aa, Neiella marina
MNSSSTAPAVSVFIITLNEIEHIEQAIRSVQHLDEIIVVDSGSTDGTVEAAKALGATVVHQDWLGYAKQKHFAMQLCRNQWCFNLDGDEVVPAAVLGEILALVADDQCDAIRVRFEDFFMGSAMHPKSHKRSIVRVYKKDRIEFPLHKSVHENVKVTGRVAKIKGCIHHYGYDSVAKLLGKQNKYSSLRAAEKYAGGKRSRWLKLLLVMPVIFAKSYFLRRMFLSGWRGFIHAVVEAMYAFLKEAKLLELTRVGSSEKEKSWPNGRLK

SEQ ID NO: 2766 - protein, 301 aa, Unknown
  Description of Unknown: Verrucomicrobia bacterium sequence
MSEQADARVALSVLVPVKNEAANLRDCLAGVSFAEEIVVVDSASTDATQAIAEESGARVVQFGWNGKFPRKKNWALENVRWQHEWVLIVDADERITPELEREIRRAIRRTDVDGFYLNRRFWFLGGWINYCGYFPSWNLRLFRHRLGRYEEIGIDDNILSGDNEVHEHLLLNGRTEYLTAPMEHYAFPDIATFVEKHNRYSTWEAAAFGKLHERAGEKTLRATPFGTAVERKRWLRKLATRVPFRPSLRFLYHYVWKQGFRDGYRGWVLCRLLAWYERMILLKEREMKKRPATGQRDFVKL

SEQ ID NO: 2767 - protein, 257 aa, Unknown
  Description of Unknown: Gammaproteobacteria bacterium sequence
MPGKPPISACIITLNEAANIDLCLDSLTAFCDEIVVVDSGSSDGTRELAAAKGARVIEHAFAGFRTQKDFAVRAAKHDWILFLDADERVTPELRASILESQARGFGDAAGYRFARATEYFGAFLRHGNAYPDRVLRLFDRRCGGFLGDREIHEHVSVDGAVATLAGDLEHHAYRSLADQLSRLERYARMMAEHMRQSGKRAHLYKIALNPFWRFLRGYVLRAGFLDGWRGLIYAYVEANYVRQKFIKLWLLERGCKI

SEQ ID NO: 2768 - protein, 294 aa, Bordetella genomosp.
MNRILVSVVVMTKNEEKNIDKCLRALVDFDEVFVVDSDSTDRTVEMARGLGARVVPFRWNRQYPKKKQWCLENLPFSHDVVLYVDADEVMTPAVAQEIHACLPRFAQGAGGAFVGFDYVFCGKLLSHGHRAYKLALLHRGRARFLDYDDLNVANMWEVEGHYQPQVVGETFALRNRMVHEDHDTLYHYFDKHNRYSDWEANLRVRGLMNDPREANTGSRAFLKRVFAMLPFKGLTIFVHSYLLRFGFLDGKAGLDYAIARAGYYWQIGLKARELRAAMQADELAAEGAATRDAS

SEQ ID NO: 2769 - protein, 364 aa, Ralstonia pickettii
MSEASVQLTSPDLALVVIARNEAASIERCLLSAKPFVSRMVVLDTGSTDDTVAIAEACGARVSHFAWTDDFSAARNAALAAANADWNLVLDADEWLESGGEHLRMLGSTPPSLGVVCVKNDTDAGESSHLIAWIPRLLPRGVRYVGRIHEQPVSSLPAARVPVVIRHDGYTPAKMQHKGERNTRLLLAELEHRPDDPYVLYQLGKETELHREDHATAAQYYARAYDLAPPDAPYRCNLALRYLYCLGKADRMEDAMAHADVSIRAWPDFPDLCFALGLVLVDAAVRHPEDADTRWLPLAEQVFNRCLEIGDRADMDGSVTGRGSFLAAQQLAIVYQMQSRALARKSEQYLAMSKRLQDAPQPLA

SEQ ID NO: 2770 - protein, 354 aa, Brevibacillus nitrificans
MKTVSLALIAKNEEAHIKNCLHSVQNVVDEMIVVDTGSTDNTKQIAVECGAKVYDFPWTNSFADARNYALQQASSDWILVLDADEILEVGSAELIREFITGSPAIGRVNIVSKYLDNGEVRYDCSPISRLFPKGVTYTGRIHEQVISSLPHRMTRITVAHEGYFQTDKTERNLSLLMKELDEEPNNPYLLMQTAREYRNRHDYHTANQFFSRSYQYATKEEGYYPKLIVDYVYNMMKLGQLDEGYIVIQAEEERLAFFPDFHFLLGMFYMDYVLGDIATRVEKLPNIETSFLKCMELGERKELGGVLGAGSFLAAYNLGVYYEVIGDSGKALKYYRLSSDQGYQKAMDRLRLLK

SEQ ID NO: 2771 - protein, 270 aa, Unknown
  Description of Unknown: Rickettsiales bacterium sequence
MVKLSGFIIAKNEATRITKAINSIKNIVEEVIVIDSGSTDDTVKIAEKLGARVVYNEWKGYVLQKSFGESLCKNDWILNIDADEEFTQKLQDEIAGIFAEERQDDCHAYEVNFVVMHRNDKKLRFLAPANRFIRVYNRNYCSFSNVKETTTHDAVMFNKDTPKDSYKLKGAAYHRSGTSITQLVAKANFYSSEQAKDWKKLGRKPSNFRIALELPLCFLKAFFIRRHCVFGFDGFVDSMVFAFARFIRIAKTREIYRNEESEANTGFRKT

SEQ ID NO: 2772 - protein, 252 aa, Unknown
  Description of Unknown: Desulfurobacterium indicum sequence
MESLSVSMIVKNGERYLENVLESIKELADEIVIVDSGSTDKTVEIAKSFGAKVVFREFDNFINQKNYALSLCSKNWVLFLDDDEIVDEQLKEEIKKIKEKGSKYEGFRINRLTNYLGKWIKHAWYPDWHVRLAKKNSCKWKGDEVHETLKINGEIGYLKGNILHYSYPDIKTHVNKINFYTTLYAIGAHKKGKKFSTLKMVSSSIGAFIRRYFIKKGFLDGFEGFVISVMSSYYSFLKYLKLWEIEKRSRKK

SEQ ID NO: 2773 - protein, 280 aa, Streptomyces sp.
MTRLPIVVAIPTKNEAANITGAVRSVIDHFAAVVVVDSDSTDDTRALAKAEGAEVVPYTWDGRYPKKKQWCLEHVHPETDWMLFLDGDETPSGELIAELRRIFHDGRQVRPAAFDIPLGYWFAGRRLRHGYTIVKRALLDRTRARFPEPDDLAAPGMGEQEGHYQPLANPVHRLRATIEHRDLDPVRTWFDRHNRYSDWEAWLERHPDVREQIRTAKTRQGQVFHRAPFKPLLSFGYSYVYRRGFLDGRAGFDYALAMSFYRWQIGVKAREAAAAERPAD

SEQ ID NO: 2774 - protein, 259 aa, Unknown
  Description of Unknown: Pseudomonadales bacterium sequence
MKTLSVTIITLNEADRLRRCLDSVRDLADEIIILDSGSKDATLDIAREYTDQVFSTDWPGFGVQKQRALEKAGCDWVLAIDADEALDAKLQQWLKGFLGKDRGGVSAVKMPWGVVAYGKLLNHGRSARAPLRMVWREGARFTDAEVHEELVPPAGETITSPGRLLHYSHRDYGHALQKNTDYAWLGAQKYFRKGRRCNSLVVALLKSWWTFFQVYILRLGILDGPVGFLMAMAYAQNNFNKYAGLWTLTRAEKQSRSAI

SEQ ID NO: 2775 - protein, 253 aa, Pusillimonas sp.
MTLSVIIITKNESIHIADCIKSVQFADEIIVLDSGSTDNTREIAESLGARVEISADWPGFGPQKNRVLNMATKDWVLSIDADERVTPELAQEIRSTMLNARYDAYKIARLSWFGDRWIRHCGWWPDYVVRLFRRGQAQFTEAAVHEKIVPSTSPGTLRSHFLHYPYANMEVLIDKVNRYSSAAAQMMFEKGRRTSVPGIAGHAFWTFVRIYLIRRGFLDGKEGFILAATAAAGSFFRYSKLRYLQTKRKPHSS

SEQ ID NO: 2776 - protein, 297 aa, Unknown
  Description of Unknown: Verrucomicrobia bacterium sequence
MSERSDAPAPLSVLVPVKNEAVNLRDCLASVSFAQEIVVVDSGSTDGTQAIAEACGARVIQFAWNGKLPRKKNWSLENVSWRHEWVLIIDADERITVELEREIREAIRRTDVDGFYLNRRFWFLDGWINHCGYFPSWNLRLFRHRLGRYEQIEVGNDIPSGDNEVHEHVLLNGRAEYLPTPMEHYAFPDIATFVEKHGRYSSWEAAASRMLHSGDEKSLRSTPFGTGLERKRWLKKATMRAPFRPSLRFLYHYVWKQGFRDGYRGWVLCRLLAQYERMIVSKEREFKKRTAKPTAGL

SEQ ID NO: 2777 - protein, 255 aa, Caballeronia grimmiae
MTHASLGIAIITYNAAARLAQCLDSVSFADDIVVIDGGSTDATVDIAKAHGARVLIRREWPGFGPQKNRALDALSTDWVLSIDADEVVTPELAASIRAAMDNPRADVYAVDRLSSFCGQWIRHSGWYPDWIPRLFKRGCARFSDDLVHERLVVQSGTPVARLEGKLLHYSYEDFETVLRKLDAYSTAGALQRHAAGKRGSLGIAITRGLWAFVRTYVLRRGFLDGRAGFMIAVFNAQTVYYRFVKLARLNEAADQ

SEQ ID NO: 2778 - protein, 347 aa, Unknown
  Description of Unknown: Arsukibacterium sp. MJ3 sequence
MPTYCVALVMIAKNEARSIKRCLQSVAPFVDAMLVLDTGSTDNTVDIAISCGAIVKHFTWCDDFATARNAALSHSTADWNIILDADEWLSSGAETLQQLRQTTANFVGTIEIVSGFVAGNNKQYARSITSRVLPKGVSYRGTIHEQPQHKLPLKALAISVQHDGYEPAQQQEKKQRNMQLLQQALLAQPGDRYLQYKLGVEYEQAGKLVQAQVYFEQALVASSSGLSWRLDLVIRLLFIYKKLKLFTQGLTLAAQEQALSHLSADYSFSLGDFYLDVAINQPQRTAELIPKIEQCWLKCLEIGEVTGVNGAVFGRGSYLAAHNLAVFYQSLGKTAQSQHYFKLASSH

SEQ ID NO: 2779 - protein, 266 aa, Trinickia soli
MASVSARRPTLGVAIIALNAQARIAQCLDAVRFADDVVVIDGGSTDETVSIAQTHGARVIHAPDWPGFGRQKNRAVAALGTDWILSVDTDEVVTPELAASIRQTLEAPRADVYALDRLSNFCGHWVRHSGWYPDWVPRLFKRDAARFSDDLVHERLVFDGRVDKLAGRLLHYSYDDFETVLRKVDAYSSAGARQRLAAGSRGGFARAVGRGLWAFLRTYLLRGGILDGQTGFMIAVFNAETVYYRFLKLSLARSQERNAGAGSGKC

SEQ ID NO: 2780 - protein, 283 aa, Unknown
  Description of Unknown: Burkholderiales bacterium sequence
MTAISVLILTKNEQQDLPGCLDSVSWCDDVHVLDSLSTDDTVALAERAGATVTQRAFDGYASQRNAGLRLPFKHPWVLVVDADERIPAALHQELTAFVESADNTVAAARMRRRDIWWGVWLRHSQISPLYVRLVRPERAHYEREINEVLVVKGPVADLYEAFDHYPFSKGLDHWLTKHNTYSRMEADLILSRSIARPSWKVALLGADFNERRVNQKAIFYRLPARPLIKLLYMLLWRRGLLDGMAGVRYAILQSIYEYLIVLKVKERQQQLMQVSAPAAHRQA

SEQ ID NO: 2781 - protein, 256 aa, Xenorhabdus szentirmaii
MSARKRLSVVMIAKNAADLIADCLLSVGWADEIIVLDSGSTDETCRIASEMGAKVYTNAQWPGFGRQRQLAQSYASGDYIFMIDTDERVTPELKFAIEQVLDNPDDNKVYRCARLNLFMGKFMKHSGWYPDRVIRLYCRERYQYNDNQVHESLDTQGASVVTLKGNLRHLTCRSLMEFQQKQLNYARDWAKHRHEQGKKTHYFSIFSHMLGAFFKTWLLRVGFLDGKQGLLLAIVNAQYTFNKYAALWELTQKKSK

SEQ ID NO: 2782 - protein, 256 aa, Unknown
  Description of Unknown: Marinilabiliales bacterium sequence
MSNPVAISVVIITYNEERNIERCIQSVEGLADEVLVVDSFSKDRSAEIAERMGARVLQHEFEGHIEQKNWAVSQSRNIYILSLDADEMIDKNLCEEILKIKNNWFADGYVFNRLNNYCGKWLKHGGWYPDKKLRLWDSRKGKWTGKNPHDEYVMEEGAAIKHIQGNILHYSFNSIQEHMQQVNYFTDLSARAYYHKGRKASLADVLIRTHWKFFRDYFIRLGFMDGYYGLIVCLISSFATFLKYLKLRELYKKGGT

SEQ ID NO: 2783 - protein, 249 aa, Unknown
  Description of Unknown: Gallionellales bacterium CG_4_9_14_0_8_um_filter_55_61 sequence
MARLSVVIITKNEAANIGDCIKSVSWADEIIVVDSGSADDTVSIAIGLGAQVYEHADWPGFGPQKNRALGYATGHWVFSIDADERVMPELRGEMEQAMREAQADGYYCPRLSQFCGKFIHHSGWYPDYVLRLFKRGAGRFSDSLVHESLLLTGRTAKLTSPLLHYSYLTLDDVERKVAHYSTAAAEQMFQSGKRSSLMSALLSGGWAFLRTYVMRLGVLDGSAGWNIARMNARTTYLKYRKLAALQQSA

SEQ ID NO: 2784 - protein, 295 aa, Unknown
  Description of Unknown: Verrucomicrobia bacterium sequence
MTKVPVSVVIPILNEVRNLPRCLDSVSWADEIFVVDSGSTDGSVAIAENWGARVVQFQFNGIWPKKKNWALENLPFRNEWVFILDADEVLPPTAKDEFHRIVTSSSEGINGYWVNRRFMFMGKWLRHAYYPNWNLRLFRHRFGRFEKLTNVATASGDNEVHEHLVVTGKTDLLHCEMDHYAFPSIEVFVDKHNRYSNWEARVALSPEEEGGVLQMSRVRIRRWLRKTSQKFPCRPLLRFFYIFFWQKGFLDGFEGYYFARLHAIYEFFCVAKTFELKKNAIMEHKGGKGQIVKER

SEQ ID NO: 2785 - protein, 258 aa, Mizugakiibacter sediminis
MSLPAPPRLSACIITRNEADRIDACLDSLAFCDEIVVVDSGSTDGTRERAAAKGARVLERAFDGYRAQKDYAVRQARHDWVLCLDADERVTPALRTAIERARASGFAGAAGYRFARATEYFGAYLRHGNAYPDRVLRLFDRRRGGWRGDREIHEHVTVDGPVRTLAGDLEHHAYRSLADQLGRLERYARLMAEHMHARGRRARLANILLNPFWRFLRGYVLRLGFLDGWRGLVFAYVEANYVRQKFIKLWLLERGQRI

SEQ ID NO: 2786 - protein, 244 aa, Pigmentiphaga sp.
MRLSVIIIARNEARNLADCLESVRFADEIVVVDSGSTDETVDIARSLGARVEVTSDWPGFGPQKNRALALATGDWVLSLDADERVTPELAAAIADTLRAPRHDAYDMPRLSSFCGRFIRHSGWWPDRVLRLFRRGTARFSDDLVHEKVVADGEVGHLAPHLLHYTYPDLDSAIAKMNRYSTDSAQALHARGRRAGMGAAIGHGAWTFVRLYLFKRGFLDGRHGFLLAATAAAGSFYRYAKLSLK

SEQ ID NO: 2787 - protein, 254 aa, Polaromonas sp.
MTLSVIIITKNEEANLQACLESVRFADQWVVVDSGSTDNTCAIASAFGAEVKQTTEWPGFGPQKNLALDLATQDWVLSLDADERIPPELAAEIQRVTQDPAANAFEIPRLTQFCGQWIYHCGWTPDRVLRLFRRGQAEFSNDLVHERVILKSGTLSRLKNQMLHYSYPTPAHYWRKLEQYSLAWAEQARARGKSSSMPRAVISGLMAFVKSYFFRLGILDGSMGFAVCAMQAQAAFGKYFTLYCLNQQNEPKKI

SEQ ID NO: 2788 - protein, 296 aa, Unknown
  Description of Unknown: Candidatus Nitrospira inopinata sequence
MSDCQNWKAGKAPVAVVMIALNEGHNMEAVCRNLEGWAQEVFLVDSYSQDDTVEIALRYGVYVVQRRFRGFGNQWNFALAHLPITAPWTMKLDPDERLSDALKVSLIKAMSENKDDGFLLVRRLHFMGRPLPVRHELLRVWRTGTCRFTDVAVNEYPVVPGRIVRVSGEINHLDSPDLDHWLEKQNRYTTAEAITAYTNASLAAMPKLLGSSLERRMWIKKHYQRLPFRHAIFFLYHWLWLGAWHAGWVGYLWARLRVDYMRFIEYKRREMEITGRLPTKRYYGPGKPDSRVAQFD

SEQ ID NO: 2789 - protein, 276 aa, Unknown
  Description of Unknown: Planctomycetes bacterium SM23_32 sequence
MTARVSIFIQTLNEEQNLPRCLECFGWSDDIVVLDSYSEDGTERIARSFGARWVQHEYRGRAAHQNWAMQSIEFKHPWVYYSDADEVVPAALAEEIVAVTSDDARPEVAYQVRRRDYFMGRWVKHSSQYPVWFTRLFKPARIRWSRKANPVAHVDGPVGRLENDFLHCPFSKGIADWVERHNRYSTYEAEETLRSLSSGDLGPAELLSRDVSRRRQALKRLSFRLPFRPLLRFLYVYVLRGGFLDGLPGFHHSLLISFYEYLTVLKASELKRGGGL

SEQ ID NO: 2790 - protein, 256 aa, Ramlibacter sp.
MPTLSVILIARNESRNIAECVRAAAFADEVIVLDSGSTDDTVDLARAAGAKVSVAADWQGFGVQKNRALALATGDWVLSIDADERITPQLRQRIEQAIASPAGHLAFAVNRRSSFCGQYMHHSGWSPDWVVRLFRREAGRFSNDLVHERVMVDGPVGRLAGELLHESMRDLESSLDKLDRYSTAGARDLQRRGKRGSLAKALGHGLWAFFRTYVLRRGFLDGSLGFVLAVSVAEGTYYRYLKLWLLQRSPPVPPPR

SEQ ID NO: 2791 - protein, 289 aa, Unknown
  Description of Unknown: unclassified Rickettsia sequence
MNKISAFIITKNEAARIERAINSVKNIADEVIVVDSESTDETVAIAESLGAKVIVKPWLGYVGQKSFAEDLCKNDWILNIDADEELSKELQDEIEYIFASQNQDRYLAYQIKLLIMHRNDIRPRIFAPYNKCTRLYNKKFASFANTINSTTHDSVVFNKDVDFANKIYTLNEAAYHYSGTSIEQLVAKANFYSSEQAKDLIKQGKKPSNIRIATEMIWWFFKAFFIRRYFVFGFNGFVDSMIFAFARFLRLAKLRESSLLCHPATRSRDLKKQFVIQDPVAGPQDDNIV

SEQ ID NO: 2792 - protein, 281 aa, Unknown
  Description of Unknown: Flavobacterium sp. sequence
MTSLPITVIILTYNESNNITDCLDSVKGMTDDIILVDSGSTDDTLHKASAYNPSIYHHPFENYSKQRNWAFDNVSTKYEWILNMDADHRLTSEIVAELATWFGKGIPADVNGFMASRRTMFLGRWIKYGGHYPVYHGIIFRKGFGACEDKEYDQHFMIEGKSILLKSDVIDIITDSLTNFIARHNKWATLEANDILNIGSAENKIVPNKNGNMMEKRRYQRMKYYSYPLFWRVFLYFFYRFLLKGGFRDGKPGLIFHFLQGFWFRFLVDSKIYELKKAELK

SEQ ID NO: 2793 - protein, 247 aa, Azospira sp.
MSAVLITLNAARCLEACLESLDFAAEIIVVDSGSSDGTVALAERLGARVIHQPWLGFGPQKHFAVSQAAHDWVFCIDADEQVSPALAAAIRQEMAAPARLAYRVPRCNRFLGRYLRHGEGYPDWNLRLFHRAHARWSDHTVHEFVQTAAEVGSLTGDLLHDSAESLDSYLAKQNRYTTLAAEAAVAAGKRAGYGRLLLSPVFRFIKFYLVRRSFLDGLPGLVHTLIGCSNSFFKYAKMLELQQRAKP

SEQ ID NO: 2794 - protein, 218 aa, Unknown
  Description of Unknown: Verrucomicrobia bacterium sequence
MSEQSGARVPLSVLVPVKNEAANLRDCLASVAFAQEIVVVDSASTDDTQAAAEAAGARIVQFVWNGKFPRKKNWALESIRWQHEWVLIVDADERVTPELEREISQAIRRTDVDGFYLNRRFWFLGGWINHCGYFPSWNLRLFRHRLGRYERIEIDDNIASGDNEVHEHVLLKGRAEYLPAPMEHYAFPNIATFVEKHNRYSTWEAAASAKVHQRTGGK

SEQ ID NO: 2795 - protein, 284 aa, Unknown
  Description of Unknown: Pelagibacterium sp. XYN52 sequence
MSIPPKPKVSVLIQTLNEEANIAACLDCFSWCDDIVVLDSLSTDRTEEIARRYGVRWFERPFDGRASHQNWAMAHIAFKHPWVYYSDADERVPAELAAEIAQVTQEATPSVAAFRVNRRDYFEGRWIPRCTGYPLGIVRLFRPDRIRWERKANPVPIVDGEIGELKSEYHHYPFSKGLSHWVARHNTYSSYEAEETIRSLSAGGFHPRDLISRDRVVRRRALKALSFRLPARPLLKFCYFYVWKGGFLDGGPGLRYCLLQCFYEFLIVLKLRELRRGASEIEDR

SEQ ID NO: 2796 - protein, 287 aa, Halobacillus kuroshimensis
MADLTAIILTKNESKNIEACLDSIKGFAHRIVVVDSGSTDNTVELAKSKGAEVFTNEFQYYAQQFNWGINNTNIESKWILRLDADERFTPELCKVCERIMVKHAEDNVNGITMEAWLYFLGKRLKYGASKKRKLMIFKRGIGRIEDRKRDAHTVLDKGESISVNERFLHYDFKDIKSFINKYNWYATREMHDYLAFKNGSTENIKSDKKIENTRKKKFGIYYKAPRFLRAKLWFIYNYYLRLGFLDGREGYIYHYFECYWYRFLVDTKIYENETMDTEVENLKALQD

SEQ ID NO: 2797 - protein, 277 aa, Rhizobium sp.
MISVCILTLNEERNLPACLAALSWCDDIVVLDSFSTDRTVEIAKEAGARVYQRAYDGEDRQRMFALKGIEYKHTWVFMPDADEITTDELRDEMLAIAADPTRPESFFRIRYKNMFMGRWIKHSSLYPTWMTRFFRPDRIIRFEREEHAIPIGDGPEGRLKEHYLHYSFNNGLRAWYEKHNRYSSSEARETVESLRGGSVSWHKVFSSRSEVRRRGLKELSMRVPFRSQARFMYMYIVRGGFLDGLQGYHYCRLIAAYEYMIVIKTKELQRRERGLPV

SEQ ID NO: 2798 - protein, 274 aa, Unknown
  Description of Unknown: Candidatus Dadabacteria bacterium sequence
MTEAAKKRPSIGAYVYTFNEEANIAACLESVSWCDELVVVDANSTDRTREIAARMGARVIQHDWEGFRQQAQFALEQVRSDWALSLDADERVTPELRAEIEQAITTAPEDVGGFRLPRVTRHLGTYFRHGTLFKMAPRLARTGRCRWVGDNPHCHLEIDGRVLDLRGELLHLRDRNLASALSVYNEYSSQKAAEMWARGRRANAWTIFWRAAGRFLRSFLIKGGFRHGTAGLVAAMEEATYNFYKYAKLWELSLGARDAGSPANRRKPAETQAH

SEQ ID NO: 2799 - protein, 359 aa, Unknown
  Description of Unknown: Burkholderiales bacterium sequence
MICLTLIARNESRCLARCLKSAAPFVDEMLVVDTGSTDDTREIAVACGARIAMFSWQDDFSAARNYALTQTRADWRLVLDADEWIESGGPCLREVADQVGGSFVGEVNIRSAFDDGDAVRYAPSWISRFLPRGLTYEGRIHEQVAHRLPVRRLPLTVGHDGYRRVQQDGKAGRNERLLRMRLQESPGNAYLHFQLGKDLEIQGRFADACAAYQSARNLLHWPPGAPAAAIKLQARYSWLHDLVVRHIYCLKRSRQFEAALTQSQAESAFWHHSPDFHFACGDLLLDFALFEPMRAEQFLPMMEAYWMRCLELGEAPQIEGSVQGRGSFLAAHNLAVLHDLLGNRETADVFRRLEEQRRG

SEQ ID NO: 2800 - protein, 341 aa, Kinneretia asaccharophila
MARLALVVIARDEAAHIERLLRSVAPWVDDMLVLDTGSRDATPALAAACGARVAHFEWCDDFSAARNRALDLAGADWHLVLDADEWLVSGGEVLAALRAQSPDFVGSLALDDHFEGGSSRGRLSRLLPGHVRYAGRIHEQPQHRLPVRALEVQIGHDGYLPERLKAKQGRNLRLLQQDLAQHPEDAYLWYQLGKDAYVYEDYAAAEQAFERAAALPHPEGGWWLDLVPRRLFALKCLKRHAEGLALAEPELQRCGDSPDFFFALGDLLLDFAADSPAHAEALVPMIEDAWQRCLSLGERPDLPGAVAGRGSHLAAHNLALLMDATGRPDQAQALRHAYPAG

SEQ ID NO: 2801 - protein, 255 aa, Unknown
  Description of Unknown: Acidobacteria bacterium sequence
MPRLSVTVITRNEAANIGAALQSVAWADEIVVVDSGSDDDTVAIARGFTPRVEVRAWPGYSAQKNHAASIASHDWILSIDADERVTPELAEEIRALLAREPGRRGYRIPRANWYLGRWIRSTDWYPDYQLRLYDRRAGQWNGRRVHESVTLSSDPGRLRHELQHYSYRDVAHHLSTIDRYTTLAAEQSHTEGRHASMFAVGTHPPFAFLRNYILRGGIRDGLPGLIVSALNAYYVFLKLAKLWDLERGGTRMPTA

SEQ ID NO: 2802 - protein, 263 aa, Unknown
  Description of Unknown: Alcaligenaceae bacterium sequence
MEASASRQSLGLSVIIITKNEATRIADCLASVCFADEVIVLDGFSTDDTASVARAMGAQVHQVADWSGFGLQKNRVLALATQPWVLSLDADERVTPELQAEIIQTLSDPAYDGYRLARLSEFCGKKIHHSGWWPDYVLRLFRRELGAFDDVPVHEQVVLTGRVGKLKACLLHFPFENLDALVVKINRYSGEAAKMMAAQGKRIGVLGLIGHSVWTFIRIYLLKRGFLDGRHGFVLAVTAASGSFLRYSKLMFLNEAREQKKSK

SEQ ID NO: 2803 - protein, 264 aa, Luteibacter rhizovicinus
MAREPLSVVVTTFNNADTIEACLASVHFADDILVLDSGSTDTTRDIAAHAGARVDVKPFAGYSAQKQAAIDLALHRWVLLLDSDEALPAAAAERVCRALESPDVAGFELLRREWVFWRWQSDRARLNHYVRLFDRTRARMSGHEVHESIVVDGPVRRLDAVIDHYGERDIEGRVDKANRYSSLQVHDRRTRTPRHLRLRMVVYPTVAFLRYYLWRGHWRGGWAGFVAARVHAFYAFLKYAKLYELRVSGRLRLGASLRDEGRDE

SEQ ID NO: 2804 - protein, 255 aa, Caballeronia sordidicola
MTRPTLGIALITFNAAARLAQCLEAVSFADEIVVVDGGSTDATIGIAEAHRARVVEARDWPGFGPQKNRALDALTTDWVLSIDADEIVSPELGLAIREALAKPQADVYAVDRLSNFCGHWIYHSGWYPDWIPRLFKRGAARFSDDLVHERLVLSQPGATKTARLQGKLMHYSYEDFETVLRKLDAYSTAGAQQRHAAGKRGSFSTAVLRGAWAFVRTYLLRLGFLDGRAGFMIAVFNAQTVYYRFLKLAQLNQPR

SEQ ID NO: 2805 - protein, 312 aa, Palleronia abyssalis
MAKLTVIILTKNESRHILRAIDSLGGIADRIVVVDSGSTDDTVALAEGAGATVLSNPWVNYATQFNWGIDQLPDDTEWVMRLDADEIVTPELAEEIRAGLADMSDEIDGIYVSRRMCFLGRPIRWGGVFPIRVLRLFRQGRGRIENRWMDEHVLVRGPTRDFRGEIVDDNRNSLTWWTDKHNAYASREEVDLLNLEYGFMPLETVADLRGGQQAGIKRWLKESVYARLPGGLRAFVYFLYRYVVRLGFLDGTEGTAFHVLQGFWYRYLVDMKMFEVKKYMASEKAEATDAIRAVLGIDLTPADETQKGVRHG

SEQ ID NO: 2806 - protein, 341 aa, Butyrivibrio proteoclasticus
MVTVSLCMIVKNEEASLGTCLKSLEGIVDEMIIVDTGSTDRTIEIAKAYGAKVYNFKWTGSFSDARNYAFSLATCDYIYSADADEELDEENRRRFKDLKIDIGELNVDIVQMYYCNQLSFRTVYNYDRELRPKLFKRVRHFIWQDPIHEQVALDPVVSNSEIEIIHRPKESHAGRDLESFRKATAEGYVFSQRLHNMYARELFMAGTADDFLKAKQFFTESVMDNNRGLDEIKEASCVLAHIAVLENDAEALLKYSLKDATTDMSSEMCFELGDYYFAKKDYDEAIVWYFNAAYECKSILDIKKSGSIPRLALARCYRALGNEEQATDFEREASDIENENY

SEQ ID NO: 2807 - protein, 278 aa, Rhizobium sp.
MSISVCILTLNEEENLPACLATLSWCDDIVVIDSYSTDRTVEIARAAGARVYQRAYDGEHTQRLYALKQINYKYPWVYMPDADEITPSELRDEMLAIAADASRPESFFRIRFKNMFMGRWIKHSSLYPSWIPRLFRPDRILGFDREVHLRCNGLGPEGRLNSHFIHYSFNKGMKAWYDKHNRYSSSEAKETAVSLRERRIPWGEVFSSRAEVRRRGLKELSMHVPFRATARFVYMYFLRFGFLDGMQGYHYCRLLAAYEYMIVIKTMELRRRERGLPV

SEQ ID NO: 2808 - protein, 258 aa, Unknown
  Description of Unknown: Acidobacteria bacterium sequence
MTRFSVCTITLNEEQNLPRALTSVQGVADEIVVVDCGSRDRTQEIAREHGAAVFERAWTSYEEQWNFAASCAANEWIFVLAADEEWSPELRAALLEWKQQEPKFPVYEMARKARYLGAWIEHCGWYPDYQRRLYRRGRARFSGIIHEVLRFEGRPGRLGGDLFHYTMNSFAEHEKKVARYTTLAARQMYEAGKRNWRAAMWLATLWTCFSVFVLRGGFLDGYRGWLISRMAARSVWLKFKKLGKLIAAERHRSAVKTS

SEQ ID NO: 2809 - protein, 674 aa, Marinobacter nanhaiticus
MALLFVGLGGALLSSSLIAGSALLLALWGIVALSKGRLNEAGWEKPRELRLIHFGFWFFVLASVISWATSGFSYEGLKTLGAHVPFILFWPLLAALTLARLRASHLFMALAAMALGSGLAITIDNGFNARAWQLLLERPSGLVNPTTFGNLSLLAGMMSFAGALYFSRQNHDKIPQQRRKARVTLCLTAGLVGVIAAGLAQTRSSFVALPVLVLVFVPMLPRKARIPALVAGVIVLILATFSSDRLTQTLDQAGSMSSDRIIQLRFEAWKEAARLFLNSPLTGAGLDGYQQAILEGTSSGRLDVALASCCDDQAHNDVMQILATRGLIGLLAWAFLLGLPIALFGRYLGDRNSQVAHIAVAGLMIPVGYLAFGLTETTLDHALFVTTYLVLVAASAATLFVELDIGCQRQRRVKVSATIITMNEAHNIEHCLRSVRAVADEIIVLDSGSTDGTVELARPLADIVEVTDWPGFGVQKQRALEMASGDWVLSIDADERITEGLAREINDRLADPDADAYKLPWAVTLYGTRLDFGRSGRSPLRLFRREGVRFSDAMVHEKILIPEGRKTRQLRGRMTHYTHRHFGQALEKSAKYAWLGSQEKFRRGKRSRTLAYASFRGLLTFVHVYFLRFGFLDGPVGYLVAITYAQGSFNKYAGLWTLSRTERSASRSGNQAPD

SEQ ID NO: 2810 - protein, 271 aa, Marinobacter hydrocarbonoclasticus
MRVFMMKLPLSVYYITLNEEERLPESLEKVKDWADEIIVVDSGSTDRTCELAEAAGARVVYREWEGFASQKAYAASLCANDWVLDLDADEVLSDTLVRNIKQLFSKPISPDIAGYRMRWVLSSPNPRHPFRHDKSKKILRLYNRKRAAIHAEKHSNDDRPRVHTGKVLELNGDVLHRTLISLEQMERKYTQLSSEQARFLCEKGRRISTPRLMVEFPLKFLKYYLIHRQVLNGWFGFSVSVVAANRNFMRLAKARELQMLEGISRSGGEER

SEQ ID NO: 2811 - protein, 252 aa, Desulfobacter vibrioformis
MKTSTISLAVITKNEAKNIEKMLSSASFVNEVVVVDSGSTDNTQQLCRDMGAVVIEQAWLGFARQKQFAFDRCTSDWILSLDGDEALSAALGAEIQKAVICCDDTVCAFSMPRVSFYLGRWIYHGGWYPDRKIRLIRRSKGRWQGDGLHEKLVVDGEVKPLSNDILHWVYENISHQVKTIDSYSTTHADHAGKRGNWYLIWGLFHMAGKFLECYIWKRGFLDGLAGLVIAVNSTWYIFLKHAKVWEKYIQHG

SEQ ID NO: 2812 - protein, 255 aa, Geobacter thiogenes
MRRSVSAVLIAYNEERRLANCLERLQWADEIIVVDSGSTDTTREIALRYTKRVVEIPWRGFGPQKQAAVELASHDWVFVVDCDELVTPQLADEIIALLGQPEVNAGYDVPRRTFIGAKEIKYCGWYPDRTVRLFDRNKAAFSDSLVHESVVVRGAKGSLQNDLLHYSYANIGDMLPKIGQYSDLWAQQMHAAGKNNRFGALLIKPVAAFLKSYLLKRGILDGFEGLVVAASTAFLTFLKYAKLRELSRKTFVPTI

SEQ ID NO: 2813 - protein, 259 aa, Pantoea alhagi
MTVRQRLSVVMIVKNEAELLPDCLASVSWADEIILLDSGSQDATPAVAEQYGAKVFRSLEWPGYGQQRQRAQAYASGEMILMIDADERVTPELRAEIEQVLQAAPQPDKVYSLGRLNLFLGRFMRHSGWYPDRVVRLYPRTYSYNDHQVHESLETEQAQVVPLAGHLQHLTCRDFCAFQRKQLAYAEAWALQRHQQGKRCGIFSVFSHTLGAFCKTLLLRAGFLDGSQGWLLAVVNAQYTFNKYAALWALGPSTSGDKK

SEQ ID NO: 2814 - protein, 253 aa, Unknown
  Description of Unknown: Monaibacterium marinum sequence
MSRPPISVFLITLNEEARLARTLDAVQGWADQIVVVDSGSTDATVAIAQAAGAQVFQNKFTGYGPQKRFAEGQCIHDWLLNIDADEVVQPDLRDQIDVALTDAPPSLFRTRILNVYPGDDRPRPFADDYNVVRLYHRAAGRYRDHPLFDRVEPDGNPPVQQLAAPIYHYPFVDWSSLLAKLDRLATLQAREAKPKPRWQLLIRLVTEAPVQFLKFWLARRHVFGGWKGFAFAGIAAFGRWLRIVKMLSKTTDR

SEQ ID NO: 2815 - protein, 321 aa, Unknown
  Description of Unknown: Candidatus Melainabacteria bacterium HGW-Melainabacteria-1 sequence
MPAEVHAYHAHLAAAQAAAGSNPLEALTQLWQAFDFYLEPAPLRLACQLLSPWPELAARLRHLTELIYPDQALDSPEPFGLSQAEPPEQVSAPQAEPAQLLPWRNLLWPSRRPSLSVCMIVRNEAPVLATALASIREIADEIIVVDTGSSDETMAIAAAEPKVRLSQLPWRNDFATARNASLDLASGDWILVLDADEELLPTGRQALRELLAYPPLGWQVYICPIEQLLSNGGLFYSWGTRLFRRDAALRFSGALHEMPVKWSWPQWLLAVPVPARLRHSGNLPINYVRQHKSKRAEQLRRLVEDPATYTPFLAYHYAHLL

SEQ ID NO: 2816 - protein, 276 aa, Flaviaesturariibacter sp.
MGFTSTRSYFCGGGSGSHQIRARRTMQANLSIVIICKNEADNIERAISSARGLVRDIVVYDSGSTDDTIAIVEAMGIPVHRGPWLGFGPTRRAATMLAKNDWVFCLDADEALSEALVDELGAFRPEAGNAWQVQLRNHLGKRYIRWGVWRNDFRLRLFHRHECNWNDDLIHEKVVPLQPVHIHRLKGSVEHRTAKNIRDYRGKMENYARLTAEMYFRKGKRAGLLKLLFSPMLTFLKSYFGKMGFLEGLCGLELSMATAAYTAKKYAHLKLLRKGS

SEQ ID NO: 2817 - protein, 249 aa, Rhodoferax koreense
MRLSIALITYNEAARLPACLASVDFADEVVVVDNGSTDGTVALAQSLGARVVQTPDWPGFGVQKNRAVDLCRGDWVFSIDADEQVTPELKAQILSVIAGPSSDCVAYTVNRSSSYCGRYMRHSGWYPDRVLRLFRRGQARFSEAAVHESLQAQGPVGRLEADLLHQSFADFETVLDKVNRYSTASAAALAERGKRGSVPKAVAHGLWAFFRTYVLKRGFLDGQLGLALAVSNAEGTYYRYMKLWLKQRA

SEQ ID NO: 2818 - protein, 264 aa, Verrucomicrobium sp.
MDTPSSLPLSVVLIARNEARNLPTCLDAVAGWVREIVVVVNDCTDGTEEIARRYGARVIPHPWENFREQKNVALAQATQPWILALDADERITPALRGEIVAFLAGADADQSLAAESPRLVTFLGRAIRHGDWYPDRGLRLVRRGQARWTGAHDHCKLVAEGRGPIHRFRSDLDHASFPDLASLVRKTPFHADNFVRTCRERGRRWHLLQAVIRPPWRFFRGYVLKRGFLDGYPGLVVAVAVAYETFIRYARLYESELASSSASE

SEQ ID NO: 2819 - protein, 280 aa, Hyphomonas sp.
MLLTFNEEKNLPSCFSALEWCDDVVVLDSGSTDRTVAIAKSNGARVLERPFDDFAGQRNWGLDNGDFVHEWVLHLDADEITTPEFIASLSKAEPDEGIDAYQIPSKMMLFGRWIKHAGMYPTYQVRLGHRDRLRFKQVGHGQREDLPAERVAIFDTPYLHYSFSHGLFGWLQKHVRYARDEAALIFDIRNGSSQIESGLDATSRRRSAKSKAAKLPVTLRPILRFLYIYFWKQGFRDGRAGFAYALMLSVYEGMTAIFVLEALMGTNAMPKPSKTGSIEK

SEQ ID NO: 2820 - protein, 244 aa, Unknown
  Description of Unknown: Verrucomicrobia bacterium sequence
MSERSDARAPLSVLVPVKNEAASLRDCLASVSFAQEIVVVDSGSTDGTEAIAEAAGAQVIQFAWNGKLPRKKNWALENVPWQHEWVLIIDADERITPKLEHEIREAICRIDVDGFYLNRRFWFLDGWINHCGYFPSWNLRLFRHRLGRYEQIEIGNDIYSGDNEVHEHVLLNGRAEYLSAPMEHYAFPDIATFVEKHNRYSLWEAAAWRKLHSTGEKLLRPTPFGTGIERKRWLKKSMMRAPFR

SEQ ID NO: 2821 - protein, 285 aa, Cobetia marina
MNPSDEAPAVTPTAPPSDGKLRTAVPITGCVITLNEAHNIEDCLRSLAQVCDELIVVDSGSTDATCELARAMGAVVIDQPYLGDGPQKNVGPSHASHRWVLSLDADERLTDGAVSAIRELALDSTPHDGFALRRRNFIGSRWVRHAGWYPDYCLRLYDREKLAFRDSRQHSSVQASHPCELDADLEHYSFANLGELFVKASGRFSNRAAKIMYQKGKRANAFTPFLHASNAFMRKFVFQAGFRDGVDGFSVALSASVNAYLKYAKLLEFQRDAKVREAEDFNKVW

SEQ ID NO: 2822 - protein, 258 aa, Unknown
  Description of Unknown: Planctomycetes bacterium sequence
MTNTDTTLDLCLSVIACDNERTIERTLRSVEGLARRTIVVDSGSTDGTIDICRAGGAEVIAHTWEGHVKQKQFALEQCDTQWVLSLDSDESLDETAVRAVRDAVAGDDPSVAGYQINRRVWYRGRPLRHAWQPEWRTRLVRRDRARWTGFDPHDRLDVEGTVRRIRGNIRHDSFTDFEEFLRSAVTHGLTTARSFHEMGKKGSRFRLMISPPAAVIKQLLLRSAWLDGWPGWLAAYSAGVHAAVKHVRLLELTHRDGE

SEQ ID NO: 2823 - protein, 258 aa, Methylibium sp.
MPDPHSLTVVIVAKNEARNIAECVASASFADEVVVLDSNSSDTTVALARQAGARVVQTDWPGYGPQVARGFALAQSAWVLSLDADERITEALKIEVLAAIRSGAHDGYRIPRLSEFCGQFIHHSGWRPDHTLRLGRRAQSGFTDHFLHAHMTVKGSVGTLSNDLIHFSYPNLHDVLEKLDRYSTGHARDLQAKGRTGGLGKGIVHGLFAFVRTYVLRLGFLDGRHGLMLAIYNAEYTYYKYLKLGHLQNPARRPEFPA

SEQ ID NO: 2824 - protein, 287 aa, Unknown
  Description of Unknown: Chthoniobacterales bacterium sequence
MNSKVPVSVIVPIKNEATNLPRCLEAVQWADEIFVVDSQSTDGSVEIAQAHGANVVQFQFNGTWPKKKNWALENLPFRNEWVFILDADEVLPPKAEAEFASTIANAGDIAGYWINRRFMFMGKWLRHAYYPNWNLRLFRHALGRYEKLTDAATDSGDNEVHEHVVVRGRTARLRVEMDHYAFPSVAVFVEKHNRYSNWEAQVAADTLMSGSAKKIEGVNVGTRRRLKTLFLKMPFRPLLRFLYVYLWQKGFLDGAEGYYFARLHGFYEFLSVVKTRELERQHRRMTT

SEQ ID NO: 2825 - protein, 265 aa, Unknown
  Description of Unknown: Puniceicoccaceae bacterium sequence
MSDKLPITCYIRTLNEERSIAAVIESVADFCSQIIVIDSGSNDQTIAIARSLGAKVIEQPWLGNGFQKRVGEDLAEHDWLLDLDADELVSSELQSNIRSVFEMSETIPYDVFSLKLVTITPIGVIWKHSCLAWRNKLYRKSIYRVPAHKAWDQFKIKDQKKLKKLDGDLYHHSFENFEHLIAKMNRVSSVRSREKRVPNTAVLVLRILFGFPIYFCKKYFYQRMFLTGIYGLVAAILMAAQRWFTDVKMYENILIEREKNLSKKS

SEQ ID NO: 2826 - protein, 259 aa, Desulfospira joergensenii
MISVYIIAFNEQDKIRAAIKSVQWADEIIVADSFSTDKTAKIAESLGARVIQIPFRGFGDLRNRAIEACSNDWIFSLDSDERCTEQVKGEILKIIQAEDSLDAYYIPRKNFFMGKWIRHSGFYPDYRQPQVFRQGVMHFLDDPVHERYEVKSDRPCGYLKNAIHQIPFKSLDEILYKANRYSTLGAKKLAQAGERPGKMKSVGHAVWSFIQHYFLKLGFLDGWPGFIIAFGNFEGTFYKYAKLYEQNCGRTDLDTNPKE

SEQ ID NO: 2827 - protein, 260 aa, Unknown
  Description of Unknown: Acidobacteria bacterium sequence
MNRLTATLITCNEEQNLPRVLDSLADLPDEIVVVDSGSADRTREIALQRGARVLCRAWTGFADQRNFAAAHAAHDWILALDADEELSPELRESLRAWKNRDPAEMAYEFSRLASYLGQWIRHSGWYPDRKVRLYRRDRARFAGVAHDSLVTDGRVGRLAGDLYHHAFRTVAEHTATVNSYSTAGAEEMFAAGRRSWLPAMLLAPPWMLLRRFFLQAGFLDGSRGWRIARMSAKYTFLKYRKLGVLARGGSLKASHRDANP

SEQ ID NO: 2828 - protein, 271 aa, Unknown
  Description of Unknown: Acidobacteria bacterium sequence
MQKTAEAGRTDIRNAGILPVSVVVPVRNEAHNLPRCLEALRDVGEVYVIDSQSTDETVEIARSHGATVVQFHYQGGWPKKRQWAMNSLPFAYEWVLLLDADEVLTSGLREEIGRAVERADVDGYWIALQMRFLGRPLHFSGACFWKMSLFRRGQAHYECRLKDQDASMADMEIHEHLVVPGKTAKLVSPLMHHNVESLSRYIQKHNEYSNWEAKVWLQGDAAELPPSIFGNQAQRRRWLKKKFLALPGSPLFFFLYKYVFRLGFLDGACPA

SEQ ID NO: 2829 - protein, 297 aa, Methylobacter sp.
MLNLTVVVLSFNEEHHIYRCLDSIGGLASRVVIVDSESTDQTREFALNMGAEVYCNPWINYAKQFNWALDHCNIGTEWVMRLDADEVVTPELAVQLREQLASVPTSIAGITINRQIHFMGKWIQHGAIYPIRTLRIWRNGKGRCENRWMDEHILVDGDIHHINADIADINLNNITWWINKHNHYASREAIDLLMGENNQAVDGGNGMNAQARIKRWLKHHIYTHLPLGMRSLLYFLYRYLFRLGFLDGWQGLVFHALQGLWYRFLVDVKVYELRKLMEERGQSLAHVVKDEYGYDIS

SEQ ID NO: 2830 - protein, 270 aa, Unknown
  Description of Unknown: Gammaproteobacteria bacterium SG8_31 sequence
MSHWWERPRVNRLSAVVITLNEERSLPRTLDSVSWCDEIVVLDSGSSDRTVEIAQSYPNCRVVTQPFLGYGLQKRKAVAEASNDWILSVDADEVLDAGLQRSLQAWRLSGSAGSAGYYLLRRLCFMGREFRHGRESRDRVLRLFDRRRGNFTSARIHERVEVEGATETLDGRLLHYTYRDLEEYFDKFNRYTSVMAREMHGRRRRPSTLAMALRPPVTFLQYYFLHGNWLNGFPGYVWSCLAAGYRTVKYLKFYELETAATRPDETHSTD

SEQ ID NO: 2831 - protein, 364 aa, Butyrivibrio sp.
MYPYVFLHVKRPGGGIVVTISVCMIVKNEEACLGRCLDSLKGIADELIVVDTGSTDNTIAIAKEKGATVYNFKWTGDFSDARNYAFSLATCDYIYSADADEELDEENRQRFLKLKEDIDKLGVDIVQMYYSNQLAYRTVYNYDRELRPKLFKRIRKFVWVDPIHEQVMLEPVISDSDIEIIHRPRENHASRDLESFRKAVKDGRKFSRRLLGMYARELFMAGSDEDFIAAKDFFIQATLDNNRTIDEIKEASCVLAHIAVLEKDAEAMLKYTLKDATTEMSSEMCYELGDYYYNKKDLDEAIVWYYNAAYECESILDIRKSMELPRLAIAKCYRDLGNEEQAADYEREANDVINMEKELNDLEK

SEQ ID NO: 2832 - protein, 251 aa, Desulfovibrio ferrophilus
MPEQITAVILTFNGEKWLEQTLSSLDFCDALLVVDSGSTDTTLAIAEAAGAKILHRAWEGTIPQFKFAFEHVKTPWIITLDQDEFLSPELKESVTTALSAPGNTGGYWCPRRSWYLDRFIKHSGWYPDLLLRVFRLDKVEIRGMLPHEEFHPTGATSRLSGDIVHYPYADLSEHLDKINSYTSLAAREMAAKGKRAGVGKALAHAVGKFAKQYLLKQGFRDGRAGLVLAVHSFIYAFQKYMKLVELNRKDS

SEQ ID NO: 2833 - protein, 359 aa, Ruminococcus sp.
MKINLVMIVKNEERSLERCLNGAKPLVDRMIVVDTGSTDRTREIAKEIGAAVYTFTWVDDFSAARNFALDQSDADWNLVLDGDEYLRDSSREKLEKILQSRKGMWLGCITRYDSFRDEEGISVSTAVIPRLLPKGVRYEGMIHEQPSGTYPNYDTFLEADHDGYLYANKGERNLPYLRKAVKDYPKDGYYQFQLASTLRNLKRLEESLPYFRKFYHLIDTEDGCRAGGIVLYLYTLLDLGQGELLDEAWEIISREESSLGGWSDFCFVCGIFYMKRVLSDVKKYIGLLPNIEKCYQTCLKLGEQPKAGGVVGTGSFRAAYNLGAWYEVSGQTELAVRAYRLSLEMGYEPAGERLRAMGF

SEQ ID NO: 2834 - protein, 248 aa, Neptuniibacter sp.
MISIIIITKNEAHNIQSCLDSVAWADEIIVVDSGSEDGTQDICRTTNNCRLIETDWPGFGEQKNRALALATHEWVLSIDADERIGDPLKAEIFSAMEQSHYDGFEIPRRSQYCGRFIDHSGWTPDYVLRLFKRDKAIFSNDKVHERIILNGKTGRLLNPMLHYSYENLEQVLRKVDQYSTLGAEQLYARGKRCGLGTALYKSFWAFIRTYLLRRGFLDGKQGVMLAISNAEATYYKYAKLALMSEKAQ

SEQ ID NO: 2835 - protein, 265 aa, Rhizobacter sp.
MPATPSAPSPEHTLTVVIVAKNEARNIAECVASASFADEIVVLDSGSSDRTAALAAAAGAKVVQTDWPGYGPQVARGFRLATSTWVLSLDADERITDALRTEVLGAIRSPDFDGYRIPRLSEFCGRFIHHSGWRPDHTLRLGRRQLADFTGHFLHAHMTVDGRIGELRADLIHFSYPDIHDVLEKLDRYSTGNARDMAAAGKTAGVGKAVMHGFFAFVRTYVLRLGFLDGSHGLMLAIYNAEYTYYKYIKLMFMKSPPQRPEFPA

SEQ ID NO: 2836 - protein, 525 aa, Marinobacter sp.
MLGLLAIGLAGALIHPAILELAIIAMAVAGLAARRRAGGWDIPRELRLVHFAFWGFVIIVGVATAIAPSPASAAGRAWPLVLLLLFWPLTTGMSAIRLVAADLFTAVAAAGLLTLAASLTITVPREAAQIPILIATLGSWGAWTLFRQGRMKRALACVAGVLAGAASIGLILSPAETAMDHVWTAASLGETGVLQILGWLLLVSIPVSVGLSFATSRHSAARAVAVAALITSALLVTAILSKQAGTTALLLNLLLMAPIMASLFVELDRGDHRARAVRVSATIITRNEADNIEDCLRSVRAVADEIIVLDSGSTDDTVERARALADIVEITDWPGFGIQKQRALEKATGDWVLSIDADERITPALAREINDRLSAPDADAYKLPWAVTIYGTQLDFGRSGRAPLRLFRREGVSFSDALVHERILIPEGRTTKTLRGRMTHFTHRDFGHSLEKSAKYAWLGALEKHRRGKKTRTMLYPTLRGLMTFIQVYFIRLGFLDGAVGYLTAVTYAQVTFNKYAGLWTLGRD

SEQ ID NO: 2837 - protein, 271 aa, Leptolyngbya frigida
MQVSQASPSKSVNAIPLRQLSIVIIAQNEEECIANAIRSCKPFADEIVVVDSGSEDATVQIAHDLGCQVYHNPWSGYSNQRNFGADKAQHDWIFFIDADEVIDNRLSNALLEWKQAPTITANAFSAVRIGDFWDTWLDTRPEYHTRLYNKTVFRIKDVLVHEGPDIKDAPVVKLPGVIWHYGFRDISDLVIRFNRYTDLDAQQAHRTGTRFSLLRLVLKPLAKFVQQYLWYGMFRQGMAGFTLSGLWSFYIFLKEAKLYEIDWKARRQGRK

SEQ ID NO: 2838 - protein, 253 aa, Paraburkholderia caballeronis
MSRATLSVIVVAMNEIHDIRDCIESVRGLASEVIVFDSGSTDGTPDLCRSLGARVFETDWPGDGPQKNRALNEATGDWVLCLDADERAGDALRTEIERLLEAGSPHAAFSTPRRSSFCGRFMNHSGWWPDRIERLFRRGSARFTDVRTHTRLEIDGTLGRFDAPIIHIAIADVSEALEKVNSYSTSGALTMAEQGKRSSIGKAVFKGLWAFFRTYVLRLGFLDGKEGVILAIANAEGTFYRYAKLALLNKTKQ

SEQ ID NO: 2839 - protein, 253 aa, Dethiosulfovibrio salsuginis
MARLSVYMITLNEELRLPIALKALSGIADEIIVVDSGSSDGTVEIAKSFGAKVFFREWDNYSSQKKYAENICSGDWLMNLDADEEVSPALAKEILSAIQLGKHDAYRLRISDIYPGQNKPNPWVRHYKVIRLYRKGVAKMGDTLTWDRVALLDKNAKVGLLKGFILHRSVTSIRQALDKYNSYSEEQAVAASLSGKKYSPWRMVFAINLNFIRYFFIHRRFLHGFWGYIDSVNLSYARFLKFAKSYERDKHAD

SEQ ID NO: 2840 - protein, 255 aa, Lishizhenia tianjinensis
MTKISATIITLNEERNIERCILSLEGVADEIIVLDSFSTDKTEEICRKLGVRFEKRAWEGYSQSKNYLNALASFDYIFSIDADEALSEELKTSILAEKQKGLTGVYAVNRMTNYLGKWIKHSGWYPDVKTRIFPKASSKWVGAYVHEELEVEGNPTPVLLKGDLHHYSYYSFEDHRSRADKYSRLTAQKMNVKGKRASILKPYLSALVRFVGMYFIKLGFLDGKMGFKIAQISALSNIYKYKELRRLNREQNNKS

SEQ ID NO: 2841 - protein, 301 aa, Unknown
  Description of Unknown: Xanthomonadales bacterium CG17_big_fil_post_rev_8_21_14_2_50_64 _11 sequence
MGRMQFQPPEQAARNDVLFRASLAASMSFSGVFMGVKDNEQSLPISGVVIAMNEADRIERCVHSLRGLCAEVLVLDSGSSDDTVARARAAGARVEHQEWLGFSSQKNVAIARASQPWVLLLDADEWLVPSGARRLRELFKTSPAGDVPSERADIWRLLRRTRFLGHSLRRGGWGNEAVERLFRADCRYLPARVHESLDRRGKRVLRLPARIEHDTARSRDGYEAKLDRYAELFARQRHADGVRGFWIDAWLHAGAYWLKNYWLRGGFLDGRAGAIYHYLHGRYVFRKYRLLWRLRDTPIEP

SEQ ID NO: 2842 - protein, 253 aa, Necropsobacter massiliensis
MPTISVAMIVKNEQQDLAQCLDSVKDWVNEIVIVDSGSTDDTEAIALRYGAKFYRHTDWQGFGKQRQRAQQYVSSDYVLWLDADERVSDALRRSIIQAVAENARNTVYQIGRLSEVFGREIRHSGWYPDYVVRLYQTDFARYGDELVHERVHYPASAQVKKLTGDLYHYTYKDVQHYLVKSASYAAAWAQQKAADGKKGSLLQGITHALGCFVKMYILKAGFLDGKQGLLLALLSTHSTFVKYADLWVRTKDR

SEQ ID NO: 2843 - protein, 268 aa, Trinickia sp.
MQPHHDVPPSTTAPSAPTLGVALIAHNAAARLAQCLEALSFADDVVVVDNGSTDNTIAIAQANGARVLVVADWPGFGPQKNRAVAALSTDWILSIDTDEVVSPELAASIRQAIRAPLADVYALDRLSSFCGQWVRHSGWYPDWVPRLFKRGAARFSDDLVHERLVFDTSAARLDGKLMHYSYENFETVLRKLDAYSSAGAKQRHAAGKRGGFGKALGRGAWAFIRTYVLRRGFLDGRAGLMIAVFNAETVYYRFLKLAAMNRQRNNRQ

SEQ ID NO: 2844 - protein, 256 aa, Polaromonas sp.
MASLSVTVITHNEAHNIGACLRSVSFADQVVVLDSGSTDDTVKIARSLGAEVGVSPDWPGFGIQKNRALALASSDWVLSIDADERVTPELQMEILACIKAPSSDVYSFPRLSSYCGQYMRHSGWYPDRVTRLFRRTAARFSDDLVHEKVVSQGPVGQLNSHLLHESFRDFEAVLDKANRYSTAGAQSLLNKGRSGSVGKAIVHGLWAFIRTYFLRLGFLDGKMGLVLAISNAEGTYYRYLKLWLLRRDGKGAPAGQ

SEQ ID NO: 2845 - protein, 255 aa, Unknown
  Description of Unknown: Pectobacterium versatile sequence
MNAHKRLSVVMITKNETELIADCLQSVSWADEIIVVDSGSTDNTVEIAHQYGAKVYQHDDWPGYGKQRQRAQSYASGDYIFMIDADERVTPELRQSIESVLTASDTNTVYSCSRRNFFLGRFMKHSGWYPDKVIRLYANQHYRYNDNSVHESLDYGSATLSHLSGDLLHLTCRDFAVFQQKQLRYASAWAEERHRQGKKCRYLSILTHTASAFLKTWVLRAGFLDGKYGFLLAIINAQYTFNKYAGLWSRNNIKL

SEQ ID NO: 2846 - protein, 261 aa, Vibrio variabilis
MTVTKPTLAVALIVKNESKHLRACLETVQGWVDEIVVLDSGSSDDTKAIAEEMGAQFYTNSDWPGFGRQRQIAQSHVQSDFVFWLDADERVTPELKASILDAVSKNAPTTIYQFARLSWVFGRFIKHCGWYPDKVLRLYPTKLTQYNDSLVHEKVETDTSMTVETLQGDLIHYTYDDIHHYLVKSAGYAKAWAEQREKRGKKSSISQGILHAVACFVKMYIVKAGFLDGKQGLLLCLLSAHSTFVKYADLWVRTSTEPPKG

SEQ ID NO: 2847 - protein, 256 aa, Polaromonas glacialis
MTSLSVIVITKNEAHNIEACLRSVHFADQIVVLDSGSMDETVQLARKLGAEVIVNSQWLGFGVQKNRALALASSDWVLSIDADERLSVELQAEIQEVLAHPVADAYCFPRLSSYCGQYIHHSGWYPDPVTRLFRRGAARFSDDIIHEKLVVKGQVSPLGNRLLHESFPDFETVLDKVDRYSSAGAERLLSMGKSSSFPKALGHGLWAFIRTYFLQRGFLDGWMGLALAISNAEGTYYRYLKLWLLLLDRKASSPSS

SEQ ID NO: 2848 - protein, 671 aa, Marinobacter sp.
MTVSTRILLPALLMAGLGGALLSSSILAGATLLLAIAGCVFIARKSHYKAGWETPKELRLLHFAFWFFVLVSTYSWVLEGFDYEGGKTLGTHARFILFWPLVIALSYIGLRGRTVFYAFGLVSLSAITVLVTSVISQSGTIESFLNGRFGGGINPISFGNLALLGGVLTLISASFFFRSGNKGLAILFTVMGVAAASIALLSETRSNLVALPFLLLACIPLLGTRMRWAGLIFIPIIMALAITSGDRMSQTVQTLLHGGSVDAGIEIRLELWGLAWEMFKQQPWTGVGLGGYTHGIEAAVEMGKAPAILATCCSGHAHSDLFNSAATSGIPGILGWVLLIAIPLAIFGRHLFSAHQPAAHLAAAGTLVSISYFFFGLTEATFNRTLFLTFYLLAIAGISSALFHELSASYVRNRTRKVSATIITMNEEAHIADCLKSARLVADEIIVLDSGSSDRTAEIAKDYADVVEVTDWPGFGIQKQRALEKATGDWVLSLDADERVTPELAREINHHLADPDADAYKLPWAVTIYGKRLDFGRSGRAPLRLFRREGVRFSDALVHERILIPEGRKIKTMRGRLTHYTHRDFGHSLEKSAKYAWLGSLEKHRKGKKTRTMIYPTLRGLLTFVQVYFIRFGFLDGAVGYLTAVTYAQVTFNKYAGLWTLDRPASDARHE

SEQ ID NO: 2849 - protein, 282 aa, Rickettsia helvetica
MNKSLTEKISAFIITKNEAARIARAINSVKNIVDEVIVVDSESTDDTVSIAEKLGAKVIVKPWLGYIGQKSFAESLCVNDWVLNIDADEELSKDLQDEIESIFASKNQDQYLAYQIKLLIIHRNDQKPRMFAPFNKCTRLYNKKFASFANTVNSTTHDSVIFNKDVDFEGKIYLLNEAAYHYSGTSIEQLVTKANFYSSEQAKDLMMQDKKVSNIRIAFEMLWWFFKAFFIRRYFIFGFDGFVDSMIFAFARFLRLAKLRESSLKSKNVIASDYKEHGNLMK

SEQ ID NO: 2850 - protein, 260 aa, Mesorhizobium sp.
MPKLSVIVITLNEEACIERCLRSVDFADEIIVVDSGSTDRTREIAGAMGAKVHVTEDWPGFGVQKGRALAAATGDWVLSLDADEWVDASLAAEIKKAIADPRGCAGFEIPRKSRFCGRVVNHGSWSADYVLRLFRKDAGRFTDYPVHEKVVLRGNLSRLSHPLEHECITDLGDAHRKIRMYAEASAKHIESMGKKGSTTKALLHSAWAYLNGYVIRFGMLDGAVGLLVAGYCASYTYSKWAALPSGSCTDVPETPAIKTN

SEQ ID NO: 2851 - protein, 258 aa, Paraburkholderia megapolitana
MAEPTLGVALIAHNAAARLAQCLAAVSFANDIVVVDGGSTDDTAAIARAHNARVIVAADWPGFGPQKNRALDALATDWVLSIDTDEVLSPELAASIRDAIRNPRAEVYAIDRLSSFCGQWVHHSGWYPDWIPRLFKRGAARFSNDLVHERLVYQTAGQPVVRLDGKLLHYSYEDFEAVLRKLDAYSSAGARQRHAAGQRASFGKALGRGAWAFLRTYLLRRGFLDGRAGFMIALFNAETVYYRFLKLDRLNRERDGRL

SEQ ID NO: 2852 - protein, 365 aa, Unknown
  Description of Unknown: Aquabacterium sp. KMB7 sequence
MSTPQTVAPSYRLALVMIVKNEARGLARCLQSVQGVVDECIVLDTGSTDDTMAIAQAHGARVAHFGWVDDFSAARNAALALSTADWHLVLDGDEWLPSAEESPAGRQAIESLRQLKEQAPTFLGLLEVHSAFDAQGQSASSWLPRVLPGPVRYSGRVHEQPEWQGARQRLPVRVHHDGYLPAQRVSKGTRNQQLLERALQEQPTDAYLHYQLGKDLEVRDQFEPALQAYRQALQLLGPKAGRSPAWRHDLLLRTLFVLQACGHTDEAIALAEPEMAHWTDSPDFYFVLGDVLLTRALAHPETANDLLPMIESCWQQCLALGDGSSLEGHVHGRGSHLAAHNLVVFYESLGMQQQADTYRARAKAP

SEQ ID NO: 2853 - protein, 272 aa, Paraburkholderia sp.
MSNPHPESSDKGESRAARATLSVIVVAMNEAHDIRDCLESVRGLAMETIVFDSGSTDGTPALCRELGARVFETDWPGDGPQKNRALAEATGDWVLCLDADERVGEALRREIERLLDEGSPHAAFSTPRRSSFCGQFMNHSGWWPDRIVRLFRRGSARFTDVRTHTHLVIDGTTGTFDGPIIHIAIGDLQEALDKANSYSTSGALTMAENGKRSSLRKAIGKGLWAFLRTYLLRRGFLDGRRGFMLAVANAEGTYYRYAKLSLLNERQGSSVR

SEQ ID NO: 2854 - protein, 252 aa, Pseudomonas stutzeri
MPTISVAMIVKNEAQDLAQCLETVQGWTDEIVILDSGSTDDTKRIALNYGAKFYENADWPGFGKQRQLAQQYVTSDYVFWLDADERVTPELRESIKQAVQLDSPHTVYELPRVSEVFGREIRHSGWYPDYVVRLYRTDYANYNDSLVHEKVEFPANARIEKLKGDLQHFTYKSIHHYLVKSANYAKAWADQRQAKGKKATLWQGVSHAIGCFVKMYLLKAGFLDGKQGFLLAVLSAHSTLVKYADLWEREQH

SEQ ID NO: 2855 - protein, 254 aa, Unknown
  Description of Unknown: Flavobacteriales bacterium sequence
MSNPIQLSVVIITFNEERNIARCLDAVWGIADDLVVVDSFSTDKTELICKEKGARFVQHKFEGHIEQKNWAITQAKFPYVFSLDADEAPDVNLTAAIKAVKLDWRNDGYKMNRLTNYCGKWIRHCGWYPDTKLRLWDSTKGKWGGINPHDKYELNESAKIGFLKGDILHYSYYSIDEHYKQADKFSSIAATALLAQGKKSSMLLAVMKGAAKFFRNYIIKLGFLDGKYGFVICRISAWETYQKYHKLTKLIKER

SEQ ID NO: 2856 - protein, 254 aa, Sulfurihydrogenibium sp.
MGLSVLILTKNEEKNIERAIESVKPIADEIIVLDSGSTDNTVEIAKTLGAKVFFREFDDFPSQRNYGVSLCSNDWIFVLDADEEVSLELRKSILNAIKEESYTCFEVPRRTYYLGKYLDYVWYPEYVIRLFKKEYFKYEGKLHEKVVCEGKVGRLKGDLYHYSYKSLYHQFKKTIDYAQKMAEILYQEGKRFKFYNLMLNPIIIFIKFYFLKRGFLEGKRGLIISFSALMYVFLKYAFLYELQLKEKYKDKLWL

SEQ ID NO: 2857 - protein, 259 aa, Ideonella sakaiensis
MPKPGSLTVVIVAKNEARNIADCIRSAAFADEVLVLDSGSHDDTVARAQAAGARVVQTDWPGYGPQVARGFGLATGEWVLSLDADERITEALRAEVQAAIRAGTHDGYRLPRLSEFCGRFIHHGGWRPDYTLRLGRRAKSGFTDHFLHAHMTVDGPVADLRSPLVHYSYPDLHDVLEKLDRYSSGHAKDMLARGRSGGLGKALLHGTMAFVRTYFLRLGLLDGQHGLMLAIYNAEYTYYKYLKLKFLQSPARRPEFPGR

SEQ ID NO: 2858 - protein, 268 aa, Thiomonas sp.
MQPSDVSISAIIITRNESKNLADCLRGLGWCEEIIVLDSGSTDDTQERARSLGARVVMRADWPGFGPQKNRALDLAQYAWVLSIDADERVTPELAAEIRAIIARPDAANAYSLPRLSSYCDQFMRHGGWYPDRVVRLFRRGTARFSDDIVHESLQTTGRVGELRHDLIHISYRSLDDVLEKMNRYSTAGAHKAAAKGRTASLLSAWLHSRWAFLRAYVLRLGFLDGRLGFVLACSIAHETWYRHLKLWQLTKEKPRTVAPNTQSETQD

SEQ ID NO: 2859 - protein, 253 aa, Salinimonas lutimaris
MSHTPISVFLITLNEAATLDDVLSAVSQFDEIIVVDSGSTDDTVDIARRHGATVIHQPWLGFARQKAFALQACRNNWCFNLDGDEVVPASLAAEIQHMVDAGHCDAIRVYFDDVFIGQSLHSAAHKRSIVRVFKRDMTHYPLDRLVHENVITAGKVAHASGLIRHYGYDDVATYMGKQNSYSSLGAQEKFQRGKQYSLLKLFTVFPLMFFKEYILRKQFLSGPSGLIHATIDAMYAFLKEAKLYEQHKRRPRD

SEQ ID NO: 2860 - protein, 253 aa, Hymenobacter sp.
MPAVPLSIVIITFNEEANIGRCLEAVRGLSDDVVVVDSFSTDGTVAICQQLGARVVQHAFEGYVQQKNYATAQARHDYVLQLDADEVLTEELRQSIRQATANWQGGGYTLARLTNYCGSWVRHGGWYPDRKLRLYDRRLGRWEGLLLHERYEMQPGQPISALQGDALHYSYTSVEQHVQQLNRFTSIAADELWLRGRRRVTLFHLLFKPWWKFVHGYFFRLGFLDGFAGLSIAIISAWGVFLKFAKLKTKAAA

SEQ ID NO: 2861 - protein, 285 aa, Paraburkholderia sp.
MSDLLPSLHESDNPAPLTKRATLSVIVVAMNEAHDIRDCVESVRGLAMETIVFDSGSTDGTPDLCRALGARVFETDWPGDGPQKNRALDIATGDWVLCLDADERVGNELRREIEHLLEHGTTHAAFSTPRRSSFCGRFMKHSGWWPDRIERIFRRGSAHFTDVRTHTRLVIEGTVGRFNGPIIHIAIGDLQEALDKANSYSTSGALTMAENGKRSSLGKAIGKGLWAFIRTYIIRCGFLDGAEGFMLSVTNAEGTYYRYAKLALLTRATGTSTASGSTQQPGQTH

SEQ ID NO: 2862 - protein, 343 aa, Sphingobium sp.
MTATPPRIAATLIMRNEARCIRRCLDSVRPFVDAMIVLDTGSTDESVAIAQACGAQVHHLPWPDDFAAARNHVLALADADWNLVIDADEWIASGGEALRGWCDGPRRLGALCIRSSFDLPQPSAAPAPATRSWIARLLPRGVRYAGRIHEQPLSDLPVERIDLLIDHDGYQDAQAAGKRDRNTPMLLAERAADPDNPYILYQLGKEAESARDYPQAAIWYAQAAALIPHDAPWTHALLIRRLHCLGQSGAADDAMAIAGEQIAIWQDSPDFFFVLGNLAMDRAIADPAHALDEWLPLAATAWERCLAIGERPDLEGSVEGRGSHLARHNLDVLRQQLALLSGG

SEQ ID NO: 2863 - protein, 349 aa, Enterobacter sp.
MDEMTFGHSKISAVMICFNEEKTITSALDSLKGLVDEVIIVDTGSSDNTVKLIAQHPAGAKLYFRPWNNDFSQMRNYAISLASNAWCLVIDADEYVAEETRCIFRSTIQKISQQDRDALYAPLIDNLNGSRLINNARIFRKRPSLRYHGKVHEYLDEEASKIIFLPGIKILHYGYVNNAYEEKNKHTRNKTLLDEQILLEPDNLRWKYFSLRYLKPEDPEYKKILQHFGALPLPYDDEWEVYAYNIKSKLIISLLEKRHFQHAWQQAKALYEYYKDKDTCLLYLLANYLSAQNIFLAAVQESLDLLQLFESLHTDEYLTEKLNIDSFQNVLDELAMFMKKSEAASDSVP

SEQ ID NO: 2864 - protein, 251 aa, Rhodoferax fermentans
MRLSVVVITRNEQLNIESCLRSVEFADELVVVDNTSADQTADLARQRGAKVAVTPDWPGFGPQKNRALDLATGDWVLSLDADERVTPELRQEILTVIARADAADCYSIPRSSWFCGRFIRHSGWTPDYVDRLFKRGSARFSDDLVHERLVHRGQSQPLKNALLHYSHRSFSDVLTKIDRYSTASAQQAWGRGKRSSVWGAVGHGLWAFVRTYVFKAGFLDGGHGLALAIANAEGSYYRHIKLWQLAQPANQ

SEQ ID NO: 2865 - protein, 252 aa, Unknown
  Description of Unknown: Microgenomates group bacterium GW2011_GWA2_44_7 sequence
MSISILIPAKNEESMIEECLASARWADEVIVLDNGSTDDTKKIVKTHQWVKYFCAEGVLEKYGSRKNKLKSLATGGWLFYLDADERITPLLRNELLRVTKDNNPLAAYAVPRRNFLLGKELKFGGWGNDYVMRLFKKDALIKFIGELHEQAIFDGHFGKLTQALIHYQPVTLEEALAKSVIWSDYEAKLFLAPGINHPTVVWWRVLKMGGLTLWDRLIKKQGFRDGTEGWIESVYQAYHTMIVYLRLWELQQ

SEQ ID NO: 2866 - protein, 263 aa, Paraburkholderia phosphatilytica
MNQTTLGVAVITRNAASRLDECLAAVAFADAIVVVDSGSTDHTVEIARAHGARVLSHPDWPGFGPQKNRALDALGTDWILSIDADEIVSAELASAIRATLAAPAADVYALDRLSYFCGHQVRHSGWYPDWIPRLFRRGAARFSDDLVHERLVFEGPVQRLAGKLLHYSYEDFETVLRKLDAYSTAGARQRHAAGGHGSFGKALARGAWAFVRTYLLRRGFLDGRAGFMIAVFNAETVYYRFLKLAHMETARADTAVPASDTPR

SEQ ID NO: 2867 - protein, 277 aa, Pontibacter diazotrophicus
MTTSLDLTIAIPVRNEERNLPGCLKAIGSDLARQIVVIDSGSTDHTKEIARQHGAEVVDFVWDGKFPKKRNWFLRNHTPATKWVLFLDADEYLTDEFKSELREVLKRGDKVGYWLNYTIYFLGKQLKGGYPLKKLALFRVGAGEYERIDEDQWSKLDMEVHEHPVLQGEIGVIKSKIDHQDYRGVSHYVIKHDEYAAWEAGRFLKSSNDTQISGKWSWKQKLKYRLMNSVLIGPAYFCGSFFLLGGFRDGARGLAFAMLKMAYFTQVYCKIQENKTR

SEQ ID NO: 2868 - protein, 287 aa, Limnohabitans sp.
MQTPIAVVMISLNEAHNMDAVLQNLAGWAQQVFLVDSCSSDDTVSTALRHGVHVVQRRFKGFGDQWNFALNELPITAPWTMKLDPDERLTDELKASIQSLVASGDQDGIIIKRRLWFMGSVLPVQQPILRVWRTGTCRFTDVAVNEHPLVKGRIGHAKGILEHHDSPDLDHWLTKQNRYTTAEAISQFEGRALALPPRFFGTALERRMWFKCNFWKVPGRYLILFLYHLLVVGAWRAGRVGWVWARLRTEVYRMWEYKRFEMDCLGHVPAKIPANPGLPDPRVQLYD

SEQ ID NO: 2869 - protein, 264 aa, Unknown
  Description of Unknown: Acidobacteriia bacterium AA117 sequence
MTLSVCIITLNEEANIGRTLESVKGIADEIIVVDSGSTDDTVAIAQSYGAKAFVEPWKGFALQKNSSLEKATCDWILSLDADEEVSPELAASIRSVLHSATPQQFSGYEMARRNLYMGHWIRRSGYYPDRKLRLVKRGSATFELRAVHEDMKMPGPIGRLHGDLIHHAYASLESFIEHANRYSSLGAGMVVKERMVGFSFMNIVVRPLVRFIYSYFFRLGFLDGRMGLLVYMNHAAYVSWKYAKAWEMSVNASKSSPQRHEGTK

SEQ ID NO: 2870 - protein, 293 aa, Ochrobactrum pseudogrignonense
MTLSVLIMTRNEEVNLGACLDSLDWCDDIVVLDSFSDDRTVEIARARGARVYQRTYDSEDRQRMYGLTEIEFKHAWVYTPDADEITPDDLKTEMLAITSDPTRPEVFFKARYKNMFMGRWIKHASLYPTWITRLVRPDRVRFERSVHSRASGGAEGELKAHFIHYSFNKGLEAWYDKHNRYSTVEADLSSNHQLERTIDWRGFFSLKPEPRRRALKSLSYHMPFRPSLRFVYMYLLRGGFLDGKPGYLYCRLLAAYEFMIIVKMEERRQSRLQVSGDAVRPGMSNQQAERRMV

SEQ ID NO: 2871 - protein, 332 aa, Leptolyngbya sp.
MSTPTAKIPISVLIPAKNEEQNLPACLASLERAAEVFLVDSHSSDRSEAIATAAGAKVVQFDFDGHWPKKKNWALDNLPFSHDWVLIVDCDERITPELWDEIKTAIQRADFDGYYLNRRVFFLGTWIRHGGKYPDWNLRLFRHRAGRYENLQTADIPNTGDNEVHEHVMVEGPVGYLKHDMLHEDFRDLYHWLARHNRYSNWEAQVYYNLLTGMGDGGTIGANLFGDAVQRKRFLKKIWVRLPFKPLLRFVLFYILRLGFLDGRAGYIYGRLLSQYEYQIGVKLFELRQFGGQLNVTGKASGQEIAQETAQERALAPKPASQPPIVSVESAP

SEQ ID NO: 2872 - protein, 276 aa, Hymenobacter sp.
MNAALDLTIVIPVRNEERNLAGCLEAIGPGLARRVIIIDSGSTDKTQEIARSGGAEVIDFNWDGRFPKKRNWFLRNHTPTTKWVFFLDADEYLTTEFKAELRQALQDPQATKVGYWLSYTIYFLGQQLKGGYPLRKLALFQVGAGEYERIDEEQWSKLDMEVHEHPVLAGETGVIASKIDHQDFRGVSNYVLKHNEYAAWEAARFLKTGSTTTAGKWTWKQRLKYRLMQSIWIGPAYFCGSFFLLGGFRDGARGLAFAILKMSYFTQIYCKIRESK

SEQ ID NO: 2873 - protein, 248 aa, Unknown
  Description of Unknown: Betaproteobacteria bacterium sequence
MPLSVTIITLNAAAQLERCLESIAFAEEVIVVDSGSTDGTRELAARRGARVIRKEWLGFGAQKQFAVEAAGHDWVLCVDADECVSQELREGITEELKAPRGFVYAMPRRNRFLGRWLKHGEGYPDWSVRLFHRAHACWGSEPVHEKVMTRSPVLKLSGDLLHDSAETLEKYLDKQNRYTSLQAESMHAAGRRANAVHLVLSPLLRFIKFYLLRLGFLDGVPGLVHIAIGCMNSFNKYAKLKALERAAK

SEQ ID NO: 2874 - protein, 270 aa, Haliea salexigens
MTKSAEKLPISAFLVTCNEAAHIASVLDALQDFAEIILVDSGSTDGTQEIARAKGAKVVHQDWLGFAKQKNFAMSLCQYDWVINVDGDEILSSEVITHIRKLYEQSEDIAMRLYFEDVFWGETMSPYSGKRSIVRVFRRSQAQYPLDRKVHENLVLAKGVSTVKVQGLVTHFGYGTTELLMQKKNKYSSLKALEKFEKRKRPSLIKLCFIFPLTFVKSYVLQRMFLSGKRGLVHAHIEAMYAFLKEAKLFEYQQLAGKQHADALQRGRLK

SEQ ID NO: 2875 - protein, 261 aa, Unknown
  Description of Unknown: Microgenomates bacterium OLB22 sequence
MNEPVLTVVINAFNEEKHIVDCIESARGLTDSIIVIDTESTDATATLAKDAGANVYSFPYPRIVEPSRSFGIHKASGDWVFVLDADERITKALSAEIKMAIKNADTDGITHYLIPRKNMFARRIWLKHGKWWPDYIPRLIKKEAFKEWPAHIHSTPVITGSKGTLREPLIHFSQGDLDDMVRKTILFENAESDLLAQAKKPASVPIFFRKYLAELYRRFLKQSGYLDGTMGIIGSFYQAYSKTITYLLVYEKTHVKKGSHH

SEQ ID NO: 2876 - protein, 302 aa, Mesorhizobium sp.
MAPVRERLVSGKDTAGDDAKIERALTGISVLILTRNEEANLPACLQSLSWCDDIVVLDSFSTDRTVEIARAAGARVYQRQYDSEPKQRTYGVTQIPYRHPWVYSPDADELTPPDLRDEMLAIAADPARPEAFFRMRYKNIFMGRWIKHASLYPTWVTRLMHTDRVRWERDIHARCVGDGPVGQLKSHFIHYSFNKGLHAWYDKHNSYSSTEANIAIQRTGDEKIGWARLFSKVPSDRRRVLKEISYRLPFRSTARFLYMYVLRGGFLDGWQGYAYCKMLAAYEFMIVIKTEELRRRKAGLPV

SEQ ID NO: 2877 - protein, 258 aa, Unknown
  Description of Unknown: Photobacterium kishitanii sequence
MNTPTDKPTLSVVLIVKNEAKHLAACLDTVKDWVDEIIILDSGSTDETETIARRYTDKFYVNTQWPGFGRQRQLAQQYVNSDYVLWLDADERVTPQLKQSIQNVLQTNQHNVVYSVNRLSTAFGKFIRHSGWHPDWIVRLYRPQDTHYNDVQVHESVIVPPNYNIVKIDGNLEHYTFDDFFEFQKKQSQYAELWAQEKHSKGKKTSISSAIGHALFSFIRSYFIKCGFLDGKHGFIIACINMQYVLNKYLGLYLKQNK

SEQ ID NO: 2878 - protein, 257 aa, Acidithiobacillus sulfuriphilus
MTAQLSVVYITLNAERLLERSIRCVRPLAEDIVVVDSGSTDGTLAICAALGVRVIQRPWPGFGAQRQFAVSQAAHDWVLIVDADELVPESIHGGIRRAIAAPGDRVAFRLRRRNYLAGRPVRFGDWRKDLVLRLVDRRRGHYSEDPVHERWIATGPVGDLPGWLLHYPFADYRSMLAKLQTYAALNAEGLVQRGRRVKASDPISHSIWAFLRTYLFRLGFLDGVNGAAIAWTTALGAFMKYATALELQEQAAKEKER

SEQ ID NO: 2879 - protein, 271 aa, Corticimicrobacter populi
MTSPSTAATRATLSVIIITKNESRHIGACLESVSFADEIIVVDSGSTDDTCEIAARFDARIQVTPDWPGFGPQKNRALDLATCEWVLSIDADERVTPELADEICRQLQTTPANNTYEVARLSHFCGKAIRHSGWWPDYVLRFFKRGSARFTDAAVHEKLVAKDGRTGRLQAHFLHYPYDNLEALINKINRYSSDAAAMMYAKGKRTHVLGAVGHGFWTFVRSYLLRRGFLDGAHGFILAVAAGAGSFFRYAKLWLLQRQEASSRSKPHRNA

SEQ ID NO: 2880 - protein, 261 aa, Unknown
  Description of Unknown: Photobacterium proteolyticum sequence
MSATKPTLAVALIVKNEADNLQACLESVSGWVDEIVVLDAGSTDNTETIARQYTDKFFVNAEWPGFGPQRRLAQSHVESDYILWLDADERVTPELKQNIMDVLSSPKDKTVYSIPRLSWVFGRYIRHCGWYPDRVNRLYPTKLTQYNQDLVHEKVELSPEIKVQPLQGDLLHFTYNDLHHYLVKSAGYAKAWAEQREKRGKRSSIGQGLLHAIGCFLKMYVLRAGFLDGKQGFLLSILSAHSTFVKYADLWIRSSTEPPKA

SEQ ID NO: 2881 - protein, 281 aa, Cyanobium sp.
MISILILTKNEENDLPGCLSSVAWSDDVVVYDSLSTDATQSIALAAGARLIERPFDNWSSHQNWGLRNIAFKHPWVFYIDADERLPFAAADEFGFIASIPLHPDLMNPVAYRICRRDFFHGRHLKHVQSSPWYIRLFRPEYVHYERLVNPLTVVDGLIGDLQHPLDHYPFSKGLSHWIARHNSYSTFEAQQILLNRQNQEPFSLSAAFFEGDFNRRRFHQKELFYRLPARPLIKFLLLYVIKCGFLDGTPGFTYALLQSFYEAMIVLKVQELELTTSPPNP

SEQ ID NO: 2882 - protein, 256 aa, Lysobacter tolerans
MNVRAPLSAVVTTFNNAATLDRCLASLAFCDEIVVLDSGSTDDTRDIANAHDARVSVEPFKGYGPQKQSAIDKAGHDWVLLLDADEYLTDAGRSVIERELQSPRADGYRLPRQEWLFWCWPHPATRGNHQLRLFRRSQGGMNQVPVHAAPEVQGHVIDLDAPFRHCGETELSIRVDKINRYSSGLLEHTRGKRRRFIAMRLLFYPMLAFLKLYIGKRYFLNGWAGFFAAKTQSFYAFLKYAKLLEADRKREVQPFE

SEQ ID NO: 2883 - protein, 275 aa, Unknown
  Description of Unknown: Aquabacterium commune sequence
MTPVSVLILTKNEAQDLPGCLDSVAWSDDVHVLDSGSTDETAAIATARGAKVSVRPFDGYASQRNAGLKLPFLHPWVLVLDADERIPPELAREMGGFVAKAPANVAGGRIRRRDIWWGTWLKHAQISPFYVRLVRVGRAHYEREINEVMVVDGDILDLGQSFDHHPFSKGLDHWIAKHNVYSRMEAQVIASGQRGQPSWREAFFNPDFNERRVHQKGLFYAMPGRPFIKFAYMVLARRAFLDGWAGIRYAILQSIYEYFIVLKTKEMREGQGSGS

SEQ ID NO: 2884 - protein, 268 aa, Escherichia coli
MKFSVLIMTLNEQKNIASCIKSVQPFSDDIVVLDSISTDDTVAISNQLGARVYNRVFDNYASQRNYGINELKYDNTWLLMLDADEILTEELGEEILKLEPDSNDAIFRFRRKDFFCNKWIKHSSGYPTWFGRLVKIGSVSVQREINEEYHTNGNVRMLQHHIDHFPFNNGVSFWLERHNKYSTMEADRMGESVSVQYTKLFSKDPSDRRACLKSIVYKLPLRPLVVFMIFYIYKLGFLDGVPGLKFSLLKFFYEFMIDLKVEEKGTSL

SEQ ID NO: 2885 - protein, 254 aa, Burkholderia multivorans
MAEPTLGVAIIAHNAARRLAQCLDALSFADDIVVVDGGSTDDTVEIARAHGARVVIAPDWPGFGPQKNRALDALSTDWVLSIDTDEVVSEELSASIRAAIRAPSADVYAIDRLSAFCGRWIRHGGWYPDWIPRLFRRGAARFSDDLVHERLVFDGLVERLTGKLLHYSYDDIDSVLRKLDAYSTAGARQRRAAGEHASVGKAIRRGLWAFFRTYVLRRGFLDGRAGLMIAVFNAETVYYRFLKLAHDDTRAQRG

SEQ ID NO: 2886 - protein, 298 aa, Pseudovibrio sp.
MTSSCTASEKLPISVVILTKNEEDTVEGAIASAKADFEEVIVLDSYSTDQTSERAKSAGAVFVQNIFEGYASQRNFALKIMRHRCKWVFFLDADERISSELIAELRENFAEKAASVGMFYLRRKDMFGGRWIRRSSGYPTWFGRLCHADFVHVEREINEEYHCSRPTDRLEEHLLHYPFAKGLSHWLERHNRYSSAEAFTKAPPNNSSASNPLMRLIFSSDPGLRRKGLKQVYMSLPFRPFFGFLYLYILRGGFLDGLPGLRFALLRAFYELMISIKLDEIRSNTVPTATKTAKTELL

SEQ ID NO: 2887 - protein, 250 aa, Paralcaligenes ureilyticus
MTLSVIIISKNESRNIGPCLDSVAFADEIIVLDSGSTDDTCSIARAKGAKVSQTMDWPGFGPQKNRALDLATQEWVLSIDADERVTPELAQAIRDELQSPRAQAYKIARLSNFCGRWIRHSGWWPDHVLRLFKRGTARFSDAAVHESVQSEYPAVVLGGHFLHYPYADMESLIAKMNRYSSDAAAMMHARGKKTSALGAAGHGAWTFIRIYILRRGFLDGKEGFILAATGAAGNFFRYSKLLFLNKRDKS

SEQ ID NO: 2888 - protein, 276 aa, Unknown
  Description of Unknown: Histidinibacterium lentulum sequence
MKASVLILTYNEEINIRRCLESLEGFDDVVVIDSGSMDATCAIANGMGARILTRPFDNFANQRNFGLDEGGFVHEWVLHLDADEVLTPAFRTALAALPPTDALDGWRVPSKTMLNGKWLQHAGMYPTYQARLGHRDRLRFRQVGHGQREDVPPDRLGTFPEPYLHYSFSHGLAKWFAKHVRYAEDEARQLAQDATHPAARGRLLSGNATERRRALKAMVGRLPVWLRPPLRFFHVLVLRRGILDGRAGVQYALMLSAYEAMIGAFSFRRPGDQETL

SEQ ID NO: 2889 - protein, 280 aa, Clostridium sp.
MNDITAIILTKNEELNIARCITSIKGLADRIVVVDSGSTDKTMDIAKGLGAEIYQHEPFEHYAKQFNWALDHVNVQTKWVYRIDADEVVTPELKEEIIKNCLEHSEDDVNGLVMKFKIYFMGRFLTHGGIYPFYNLTIFKYGYGRYEDRSMGEHVVLSEGRTVDLENDCLHYDFKDLTAWINKHNWYATREVNDYMETLAMRQADTNLYHEAEKTKKLRDGLYYKLPKFWRARFYYWYRYYIKLGFLDGQAGRVHAFLQAYWYRYLIDAKIMEQELKNKK

SEQ ID NO: 2890 - protein, 266 aa, Vibrio vulnificus
MSESINKANKPTLAVALIVKNEAANLDACLKTVEGWVDEIVILDSGSSDETEAVARRYTDKFFINKEWPGFGPQRRLAQQYVESDYVLWLDADERVTPELKLSIQQAVQSNEANTLYSMCRLSWVFGRYIRHCGWYPDRVVRLYPTKLTQYDDALVHEKVEITKAMKVKELQGDAIHYTYNDLHHYLVKSAGYAKAWAEQREKRGKKSSISQGVLHAIACFVKMYIVKAGFLDGKQGFLLSLLSAHSTLVKYADLWIRTSTEKPKD

SEQ ID NO: 2891 - protein, 259 aa, Pantoea ananatis
MTSPRQRLSVVMIAKNEAELLPDCLASVSWADEIIVLDSGSTDDTMALARAAGAQVFQATEWQGYGKQRQRAQSFASCDMILMIDADERVTPELRQAIERVLEAPPGDTVYSLSRSNLFLGRFMRHSGWYPDRVMRLYPRTLSYNDNSVHESLNTEGAFVQALKGDLQHLTCRNLMVFQRKQLAYAEAWAQERFQRGKTCSLFSVFSHALGAFAKTLLLRAGFLDGKQGWLLAVVNAQYTFNKYAALWALTHASAKGRT

SEQ ID NO: 2892 - protein, 371 aa, Ralstonia solanacearum
MRKQPKPGGRSDIALVVIARNEAACIERCLRSAKPHVDRMIVLDTGSTDETVAIAEGCGAKVHPFTWVDDFSAARNAALQLANADWNLVMDADEWLESGAGELREACTFGPLLGVVCIQSLDDAGGAAQRTNTWIPRLLPRGVRYQGRVHEQPVASLRRVRLPLVFGHDGYVSAKLEKKRGRNAALLHAELADRPDDPYVLYQLGKETEINGKDPARAADLYARAVAGAPADAPYRHDACIRLLLCLRQSGRLEEAITRAGEWMDAWNASPDYFFVLGHLMFDSAVKHPAQAAEQWLPMAERAFLRCLEIGDQPKLDDSVFGRGSFAAAENLAVVYQAQSSALSAKANEYQALAERLKANLAAPGGAGSAR

SEQ ID NO: 2893 - protein, 375 aa, Selenomonas ruminantium
MKEIKLSVCYMVKNEAHNLPSSLASIQEAADEIIVVDTGSTDDTKSIARSYGAQVFDFPWQDDFAAPRNYAIEQAKGDWILFLDADEAFPRPLNRGALLDYLSRMAAQDVILLRRHDVETLTDRKCFNMDWSPRLFQRRSDLRYRGRIHEHISKSVGDLQVAYAPLEFYILHTGYAKMISEDKCRRDLQILQQVIASGDWEPVYDFFLTDCYYGIKDYEKALQHAVAFTESGTVIHGGNGHVYHMILECMRALGRPDADMLPWAEAAGRLYPDLPDFYAEQGMVLCGLGRLSEAQLLLTEALRRYDEGSADICHATYFSPAVAAKVAARLGEIHELWGEQNLAAQCFIRALDYCSEDEAVLNKAKRFLTTQDGGK

SEQ ID NO: 2894 - protein, 288 aa, Opitutus terrae
MDARCPISILIPTRNEAANLPACLASCAFADEVVVVDSGSTDGTQAIAAQHGARVVPFMWDHRFPKKKNWALAQVPWRHEWIFILDADERITPALAVELQQIVAAPGADGYYVNRCFWFLDGWLRHCGYYPSWNLRFFRHRLGRYEQLAGLDETDSGDNEVHEHVVLQGRTGYLQAEMEHYAFPTIATWLEKHNRYSNWEARLLNAPARQTTDTAVKLAPELARKRWLKRCARRLPFRPTARFVYHYLLRRGFLDGYRGYVFCRLMAFYEFLGSAKAQELRRQKPAPR

SEQ ID NO: 2895 - protein, 371 aa, Paenibacillus sp.
MKRSVTVSLCMIVKNEEATLERCLDSVSGLVDEIIIVDTGSTDRTREIALRYTDKVADFTWVNDFAKARNYAFSLATQDYLLWMDADDILLPADAEKFSTLKSALEWDTDAVSMNYNLAFDEHGNVTSSLTRNRLVKRENGFRWIGIVHEYLEVSGKVRRSDISITHGRVHGNSDRNLNIYESRHAAGEIFSTRDLFYFANELREHKQWDKAISFYEMFLQQVDSWIEDRINACGSLSDCYRELGNEQQAKAKALQSFSYDLPRAENCCRLGSLYMLENDFSKAIFWYKMASELTKPLDNYAILQHACWSWLPHLQLCVCYDRIGQYERASAHNEMAAEHIPFDSKVLANRAYFTGLGVARQTYTLGGTTR

SEQ ID NO: 2896 - protein, 369 aa, Unknown
  Description of Unknown: Cardiobacterium sp. sequence
HHTATDPYHWLQKRLAYAATWAADAAARGKKSSALGAVVRGLWALFKQYLADGRFLRGRIGWVYACLFAQYTYNKYALLCDHNRRPQSYRADYQPHTVNIHNLPASTLPASALPATPHPHPLSVVLITQNESRHLPACLASIQGLADEILILDSGSQDDTARIAAHFGAKWHENRDWQGFGIQRQRAQALASGEYILMLDADEQPDAALCTAIAQVLTHPPAAGTVYAVRRTNIFCGTRVHGWYHDRIARLYPRAHYQYHPYEVHESLDSGDARVITLPGSLLHHTNDNLAHFLEKNLRYSREWADEHRARRAPNLWTLPLKSLVAFLREYLVRGALCGGGYGLFLAASTACYHYNKYLMLAYHDKGQP

SEQ ID NO: 2897 - protein, 310 aa, Aestuariivirga litoralis
MKQPAPRAGAPNLTVIILTRDEELHIERALASVSDIASRCIVVDSGSTDRTLALAKAAGAEVWHHDWLNHAAQFNWALAELPPGTGWVLRLDADETVTPALATEIRQHLAALDGAVTGVVVGRRMTFLGRPIRWGGLFPVPVLRLIRHGHGRCESRWMDEHLVTDGRTASFAGEIIDDNRKPLGWWIDKHNGYAAREVVDILSREHGLGPQDNRGELEGHARGKRWMKTAVYARLPSGARAVLYFLYRYVLRLGFLDGYEGLAFHALQGFWYRFLVDAKLFEVRAYMARTGAPPADAIRAVLGIDLAKRG

SEQ ID NO: 2898 - protein, 262 aa, Arenimonas donghaensis
MSPRLSACIITFNEAARLADCLASLAFCDEIVVVDSGSTDATAAMARQAGARVFERPFEGFRSQKQFAIEQAAHDWVLCLDADERVDEVLRASIRAEQVLGFEHAAGYRFARLTNYFGRFLRHGNAYPDRVLRLFDRRRGGWRGAREIHEAASVDGPVRTLAGDLLHFPYRSLEQQLAKTQRYARMMAEHDFKRGKRASLARLVLSPAWRFWRGYVLRAGFLDGWHGLVYAYVRANYVRQKTIMLWMLQNKQPVVDPPGQAR

SEQ ID NO: 2899 - protein, 258 aa, Unknown
  Description of Unknown: Photobacterium damselae sequence
MKPDNTRASLAVALIVKNEEKHLAACLDSVKDWVDEIVILDSGSSDATEEIARQYTNKFYVSEDWPGFGIQRQRAQAFVESDYILWLDADERVTPKLRESIQNAVEQNQKNTIYQINRLSTAFGQFIHHSGWHPDWISRLHHRTETHYNDIKVHESIIIPSDGKVEKLSGNLEHYTFEDFFEFQNKQQKYAELWVEDRFSKGKKSSITSAIVHSVFSFIRTYILKAGFLDGKHGFIIACVNAQYVLNKYLGLYLKHKK

SEQ ID NO: 2900 - protein, 253 aa, Thermocrinis albus
MLSVLIRAKNEEKNIERAIRSVQGVADQVVVLDSGSTDGTVELAQKMGAEVFFREWTNYADQINYGVQLCKGEWVFVLDADEELSEELRESVMRALKDPECDVYMVCRRTYYMGKFLKHAWYPEWRVRLFRKGSVKFEGVLHERAVFEGRACKLKGDLYHYSYRSLWDQYSKTINYAMLMAKDLHEKGVRFSVAKLMFNPLWAFLKVYVVKGGFLDGMQGFSVAVSSGIYTFLKYLFLWELELKERKGGDLWR

SEQ ID NO: 2901 - protein, 265 aa, Rhodoferax saidenbachensis
MTPISVYIIAYNEAEKVRATIESVRWADEVIVVDSWSTDGTADIATGLGAKVVQVAFTGFGELRNQAIAACSHEWIFSLDADERCTPEVAAEIQSIVGNSNALDVYWTPRRNYFMGRWIKHSGWYPNYRQPQLFRKNAMRYDLKPVHEGYELLTDKPLGHMQNAIWQFPFKNMAEVMHKANRYSSLGAEKIKHKKISMWTALLHAKWAFWKHYLFKLGFLDGWAGFVIALGNFEGTFYRYVKAIESQNGQAWQAPQFENKTSDRS

SEQ ID NO: 2902 - protein, 288 aa, Unknown
  Description of Unknown: Verrucomicrobia bacterium sequence
MVVVASILRAAGGRGRIEPRPQCVRNSGSPRAGGEGAPGVNISFCLITLNEEENLPRCLASCADLADEIVVLDSGSTDGTAKIARRFGATFAHQDWLGYVGQKNKILSLAKYPWIFSLDADEELSPELRDEIRLFKGLEPANDRSGFSVPRCVFYEGRWIRHGDWYPDRLVRLFRRERARFSGGKVHERLEIEGRIVALHGELHHYSFKNAADHWDRCRKYARLWAETQREDGKSANAAAPYLHAAFRWLRGYVLRRGFLDGKQGWRIAALNAREAYLKYRLLREMNR

SEQ ID NO: 2903 - protein, 257 aa, Lonsdalea iberica
MSHPRLSVVLISRNEAELLPDCLASVSWADEIIVLDSGSSDDTQAIARQYGAQVFQHHDWPGFGRQRQRAQSYASGDYIFMIDCDERMTPELKLAIEQVLAAPDGKTVYRCARRNLFLGRFMRHSGWYPDEVIRLYPRHYRYNDNAVHESLDYGDAHVVSLAGDLEHLTCRDFFTFQQKQFDYATSWAQSRFEAGKRCSYLSILTHTLGAFAKTWLLRAGFLDGKRGLLLAIVNAQYTFNKYTGLWALNNQRKHHDD

SEQ ID NO: 2904 - protein, 535 aa, Unknown
  Description of Unknown: Comamonadaceae bacterium NML970147 sequence
MIVKNEAANLRRLLPLVAPVADEIILLDSGSSDDGQAVAQQYGAQWHVASDWQGFGIQRQRAQALSRGDWILVLDGDESPDAALLEAIARVKTQAPGDTVYGIRRIDEVFGHLIDYPRRGIKAHWRLYPRRFGYCDSAVHESLQLQGAQTQVLPGFLRHHTAATPHFWLEKRLSYAMAWARDRMQGRRVGVASVLLHTFWAFIKQYFVDRRFLCGRYGWIYAWLFAQYTFHKYALLNDVQRRPQGYAPDFEPHAINRHHLPPPPTAPVADAARPYRLSVVLIVCNEAKHLPACLASIADLAHEIVILDSGSTDESERIARHFGAQWHTSADWPGFGVQRQRAQALASGDYVLVIDADEQPDATLKNAIRQVLASAPDARRVYNIRRRNIFCGSVVHAWYTDGLVRLYPREHFQYHPYDVHESLDSRDAAVVTLPGRLDHYTNDNLYHFLQKNLRYSHTWAQEKAAQGKRAPSLWLLPLKSAFAFFREYIIRGAFWGGRYGLYLAISTAGYHFNKYLMLHWAREQAERTPNDPNPS

SEQ ID NO: 2905 - protein, 279 aa, Unknown
  Description of Unknown: Candidatus Entotheonella gemina sequence
MANPLSVCIITCNEEANLPRCVASVGFADEIVVVDSGSTDRTVALAVEAGCRVIDQPFLGYAAQKNMAVQAASHQWVLCLDADEWLLPGAEAVIRQALATHRPEVAGYALKRHTYYLGDWVNHGGWWPEYRLRLYDRQRGEWVGDSIHEDVEVQGAVARLDVEVGHFSFRDIAHHLNKINTYTSMRAQHWHAQDHASAGWLQLIGRPLWRFCRMFLFRGGWREGQRGFIIASIVAFYVFTKYAKLWELQHGQGQGKGPDVPVWDAVSDARVRNGNAMIK

SEQ ID NO: 2906 - protein, 277 aa, Shinella sp.
MSISVLIMTLNEEKNLPACLASLDWCDDIVVLDSYSTDATVEIARAAGARVYQRVHDTESNQRTYGLKEIEYKYPWVYTPDADEVTPPDLRDEMLAIARDQKRPESAFRIRYKNMFMGRWIKHSSLYPTWITRLVRPDRVRYERDAHSRCLTEGPEGRLNAHFIHYSFNKGMNAWYDKHNRYSSSEARETVVSLREKRVPWHDVLSGVPEVRRRALKELAMRLPFRPTARFLYMYVLRGGFLDGKEGYHYCRLLAAYEYMIVIKTEELRRREEGLPV

SEQ ID NO: 2907 - protein, 257 aa, Ahniella affigens
MRQPLSVVVTTLNNADTLPALLESVRFADEVYVLDSGSTDQTLELLLAAGARIGSQPFQGYGPQKAAAINAASHDWVLLLDADEAVTPALAAQIQATLMAPMCDAYRIARRERMFWQWQHPGSKHNRHLRLFDRRLISMSNDPIHAAPESRGRIGLIDAPILHWGEPDLYRKVEKINRYSSGMAAARLERASALLPLRLVFYPPLVLLKQLIVKRQLLNGWAGWINAVSLSYYAFLKDAKVLELQRQKATSAPSDQP

SEQ ID NO: 2908 - protein, 268 aa, Kushneria avicenniae
MSTAAARTPITGVVITLNEAASIEACLTSLERVCDELIVVDSGSADDTCALARAFGARVIEQPYLGDGPQKNVGPKAATHRWVLSLDADERLTDEAVTAISALQLADTPHDGFALRRRNFIGSRWVKRCGWYPDYCLRLFDRDRTAFSDSRQHSSVQARSPQALDADIEHYSFANLAELFTKAGGRFSTRAAKIMYLKGKKVNACSPLIHGANAFVRKYLFQRGCLAGLDGLSVSLSAGVNAYLKYAKLLEFQRDPQVREREDFNQVW

SEQ ID NO: 2909 - protein, 283 aa, Streptomyces aidingensis
MAGPPTLPIVVAIPTKNEAENIVSTVRSVIGRFKAVVVVDSDSTDDTRALAEAEGAEVVPYTWNGKYPKKKQWCLENVHPETDWLLFLDGDETPSPEMLAELERIFLDGRPVRPAAFDIPLGYWFAGRRLRHGYTMVKRSLLDRTRCRYPEPDDLHAPGMGEQEGHYQPLGEPVARLRAPIEHNDLDPVRTWFDRHNRYSDWEAWLETAPGAREEIRQAKTRQGQLFHKVPLKPLVSFAYGYLYKRGFLDGRAGFDFALALSFYRWQIGLKAREYARRNGPPG

SEQ ID NO: 2910 - protein, 277 aa, Unknown
  Description of Unknown: Gammaproteobacteria bacterium TMED34 sequence
MSTVPATATIIVRNESRNIVECINSVSFFDEVLVVDSGSIDDTVAKANQLGARVIVNQWPGFSRQRQFATENASNDWVFSIDADERVSDELRHAIEQVFKDGTKLDGYQINRRNYFMGQALAHGEGYPDWLLRLFHRGRAEWSHDAVHERVKLIGRIGKIKGDLNHRSQESLAAYFHKQNMYTSLQAKSMWESGRRSSLLKIAASPTVRFLKFYVMRLGFLDGVPGLVHIAIGCFSSFAKYAKLRELEINGGADLPEDDPISPVVGKAGSINPQRQS

SEQ ID NO: 2911 - protein, 269 aa, Trinickia symbiotica
MTVPSSDRPRPTLGVAIIALNSEARLAQCLEAVSFADEIVVVDGGSSDATARIAEAHGARVVVEREWPGFGPQKNRAVAALATDWILSMDTDEVVTPELAASIREAIAAEQAEVFELDRLSNFCGHWMRHSGWSPDWVPRLFRRGAARFSDDLVHERLVFEGPPGRLSGKLLHYSFDDFETVLRKIDAYSSAGARQRLAVNGKRGGVRQALTHGLWAFVKTYLIKGGFLDGRMGFILAVSNAEGAYYRYLKLMLALERQHASDDDRHVS

SEQ ID NO: 2912 - protein, 342 aa, Sphingobium sp.
MTANRPRIAATLIMRNEARCIARCLDSVRPHVDAMVVLDTGSTDDSVAIARQCGAQVHHLDWPGDFSAARNHVLALADADWTLVIDADEWIAQGGETVRDWCDGPPRLGALCIRSSFDLPQQAGPALPSTRSWIARLLPRGVRYAGRIHEQPVSDLPVERTTLILDHDGYEDAQAAGKRDRNTPMLLAALQGDPENPYLLYQLGKEAETARDYGRAADWYDQASARTPDGAPWTHGLLIRRLHCLGQSGASAKAIAIAGQQMAHWQESPDFFFVLGNLAMDRALAEPASALTEWLPLAATAWERCLEIGERPDLDGSVEGRGSHLARHNLDVIRQQLALLGG

SEQ ID NO: 2913 - protein, 252 aa, Unknown
  Description of Unknown: Chitinophagaceae bacterium K23C18032701 sequence
MAVSVVIIAKNEAHAIERCINSALQLTDNVLVIDTGSTDNTAALAATAGAKVVHSAWLGYGNTRNWGAPQAKYAWILSLDADETISPELAREIKQLPLNDNNVVYKIKRQNFFRQKKIRFGAWKNDQVLRLYNRNSTGWNQAPVHEDIELQNMQVTLLQQYIHHYTAKDFYSFIQKNLAYAQLSANKYAAAGKKAGTLKMYFSPLFNFLQGYVFRLGFLDGVEGWYIAKGNAFYTFMKYALLKEASANKEHT

SEQ ID NO: 2914 - protein, 260 aa, Unknown
  Description of Unknown: Gallionellaceae bacterium CG1_02_60_325 sequence
MPLSVILITRNEAANIRECLQSVAWADEIIVVDSGSTDETVAIARSLGARVYEHDWPGFGPQKNRALGYATSDWVFSIDADERVTPELRAELEAAMLDGNADGYCSPRLSQFCGTFIRHSGWYPDYVLRLFRRGKGSFHNLLVHESVQLHGRTEKLHTPLLHYSYHGRADVERKVAAYSTAAAQQMYAAGQRASGLRAATSAGWAFVRTYIFRLGILDGRAGWQIAGMNARTTWLKYRKLIALNMARNRSGEHTPDKPPA

SEQ ID NO: 2915 - protein, 273 aa, Xenorhabdus mauleonii
MNAKKRLSVVMIAKNSADLITDCLLSVNWADEIIVLDSGSTDATCQIAREMGAKVYSNTQWPGFGRQRQLAQSYASGDYVFMIDTDERVTPELRASIEHILAAPDADPDTSNKVYSCARLNLFMGRFMKHSGWYPDRVIRLYRREHYQYNDNHVHESLDTQGATIVALNGDLRHLTCRNLMEFQQKQLNYARDWAKHRYEQGRKTHYFAIISHTLGAFCKTWLLRAGFLDGKQGLILAIVNAQYTFNKYAALWELTQTKSKKNEKKSDLSRHL

SEQ ID NO: 2916 - protein, 385 aa, Frankia sp.
MITRSQRPTADSREPAPPSGGRAGWPVPYDAAGRDATTGQATATGQDAATGQDAVGPVPAPGSVPVTAIILARNEAPNIVRAVGSVGWCEQVVVVDSGSTDDTVELARRSGAAVWHIPWRGYAGQRQQAMMSPEVRHDWVFFLDSDEWVSTTLATEIASRLGTEECVAYSQRRRFVFDGRWIAHSGWYANSWQARLLDRRAASFDDSVNYGERASVAGPVARLAADLIDEDRKGLAAWLRKHVHYAELEAQRRTAQPALRERISRIRREIRHPGRSTRPLGRSIAKDVVFPLVPAKPAALFCYMYVLRAGWRDGRQGLLFCLYYAWYELTVGALARAGHTGAPGATGEPGRGDTAAATAPGAERAVPVPRQRTIPAGAAKGPIGA

SEQ ID NO: 2917 - protein, 266 aa, Acidovorax delafieldii
MPVATGGASAPPTLTVAVLTLNEAHRIEACLQSAAFADQLLVVDSGSTDDTVAIAQRLGAEAHSYPDWKGFAVQRNRLLAHARGDYIFFLDADEVMTPAFAQELQAIVRSGAQAVWTIRWRMVAYGHELKYFRSQSQIERLFVRAMVREFTGVVHEQAELLPPPGGGAVPRRLIEARLLHYSRTTVRGSLEKLTQYAMLGAAKRAATGKKGGVVRGLASGTSMFLRLYVLCGGAGFLYCLFVALEAFFRYAALEYDHQQLSESVRR

SEQ ID NO: 2918 - protein, 258 aa, Unknown
  Description of Unknown: Zetaproteobacteria bacterium CG12_big_fil_rev_8_21_14_0_65_55 _1124 sequence
MNPVSVFIPVLNEEDKIADAVQSVQWADEVLVVDTGCTDGTITIARKLGCRIESLPFEGFGKLRNQAVALCSNDWVLSIDADERCTPELSLEIQATLTGEPTFDAYFIPRRNYFMGRRINHCGWYPDYCQPKLFKKGALTYRNDMVHEGFDIHGRLGYLKSDVLHYSFRDLDQVINKMNRYSTLGMQKMQQQGKTAGMGTALARGLWAFFRIYVLKLGFLDGWAGFVIALGNFEGTYYRYAKLALRDKQAGVSGSHQA

SEQ ID NO: 2919 - protein, 257 aa, Psychromonas arctica
MSVKKHSLSVIVITKNEADRISRCLESVKNVADEIIVLDSGSTDDTVAICQQYTEHVFVTDWPGFGKQKQRALDKATCDWVLSIDADEALDEKMQAELSKLLAQPTIQHDAYKLPWGVTIHGKTLKYGRSARAVLRLFKREGAEFSLDEVHEKVIPVGTNFGKMKGILLHYTHRDFKHGLDKSANYAWLGSQKYFRKGKKSHGLLLALLRSMWVFFHIYVLRLGMLDGSIGFLVAMRYAHGNFNKYAGLWLLENDRS

SEQ ID NO: 2920 - protein, 260 aa, Thiomonas bhubaneswarensis
MKKSEKLSLIIITKNEARNIRNCIHSASGLVDEIIVFDSGSTDGTQLICREMGASVYETDWPGFGVQKNRALEKATGNWVLSLDADEQLSQELKNEIEKILSIDSDAADSYSIPRKSSYCGQFMKHSGWWPDRVVRLFKKSSGRFSDDIVHEKFISPGKTGRLNSPIIHHAITSVEQSIQKMNAYSTAGAERIFARGERTSVTRAFLKGLWSFLRTYILRLGILDGRMGLILAIANAEGTYYRHIKLWLKQRGEHGADKT

SEQ ID NO: 2921 - protein, 285 aa, Unknown
  Description of Unknown: Acidobacteria bacterium sequence
MSVSALILTLNEEVNIARCLESLRWCDDVVVLDSGSSDRTVTIAEAFGARVVHRPFDDWSTHQNWAGRNIPFKHRWVYYSDADEIVPEDLASELIGAAADVKSPNVAYRLRYKNIFQGRWIAHCGIYPVWVLRFFRPERVRWERSVNPIAVVDGSEGRLKSHFEHHSFSKGLEAWIDKHNRYSSLEAREAVAARIEGWPSLARLFSANPTVRRQILKHVGFLLPFRPTLRFAYMYLLRRGFMDGAPGFTYCRLLRMYEAMIDFKIREFASDTTSSTTPVVHPQSL

SEQ ID NO: 2922 - protein, 257 aa, Unknown
  Description of Unknown: Rhodocyclaceae bacterium Paddy-1 sequence
MPLSVVIITLNAAAQLPACLDSVDFANEVLVVDSGSSDGTVELARARGARVIHQDWLGFGPQKQFAVEQAAHDWVLCLDADERVSATLRASIVAALAAPGAKAYRFARCNRFLGRYLRHGEGYPDWSLRLFQRGHGRWSDDAVHEKVVLGPAAGAVATLAGDLMHDSAESIAAYLTKQNRYTSLAAEAAVAAGKRASAVRVVLSPLVRFIKFYVVRRGFLDGLPGFIHVAIGCFNSFAKYAKMREIQLRAAAMGAKR

SEQ ID NO: 2923 - protein, 261 aa, Unknown
  Description of Unknown: Acidobacteriaceae bacterium KBS 83 sequence
MQTHRRATLSVAIITLNEEANLPRTLASIAWADEIVIVDSGSTDTTRAIGQSHGARVVTEPWRGFAAQKNFALSLCTSDWVLSLDADESVSPELAASIQKTIASSPLHTGYALPRRNLFLGRWIRHGGYYPDTKLRLFPRGQANFQETPVHETATFAGNIQTLDGDLLHDAYPTLTSYLNHMQRYSTLGARIAVARGRTGRGLVSFLDGVLLNPLVTFLYNYILRAGFLDGREGLLLHLYHSAYVSWKYAKAWESSRRKIP

SEQ ID NO: 2924 - protein, 261 aa, Unknown
  Description of Unknown: Photobacterium marinum sequence
MSANKPTLAVALIVKNEAKNLQACLETVKGWVDEIVVLDSGSSDDTEAVARSYTDKFFVNADWPGFGPQRRLAQSYVESDYILWLDADERVTPELKASILAVLATPKPDTIYSIARLSWVFGRYIRHCGWYPDRVNRLYPTKLTQYNDDLVHEKVEISEDMAVKPLEGDLLHFTYNDLNHYLVKSAGYAKAWAEQREKRGKRSSISQGLLHAFGCFFKMYVVKAGFLDGKQGFLLSILSAHSTFVKYADLWIRTSTEPPKS

SEQ ID NO: 2925 - protein, 257 aa, Serratia rubidaea
MENRKSLSVVMIAKNEAELLPDCLQSVSWADEIIVLDSGSQDDTVAIAENLGAKVFVNRNWQGFGKQRQLAQSYAGCDYVLMIDADERVTPELRRAIEQVLSAADDDRVYSLGRRNLFLGRFMRHSGWYPDRVNRLYARERYRYNDDLVHESLNTLGARIVPLQGDLLHLTCRDFFAFQRKQLHYAQEWATQRHTAGKRCGYFSILTHTLGAFCKTWLLRAGFLDGKQGLLLAVVNAQYTFNKYAALWALGRNYSEK

SEQ ID NO: 2926 - protein, 223 aa, Unknown
  Description of Unknown: Gemmatimonadetes bacterium sequence
MKPRASGSTNARRAVSAVIIAKNEAERIEDCLASVAWADEIIVVDSGSTDATCDIARRHTDRIHAIPWRGFGPQKQAAVDLASHDWVLSVDCDERIGPELADEIKRLLAEDAPCDAYSIPRRTFLGRKEIRHCGWYPDRTVRLFDRSKARFSDSLVHEHVVTTGPVGECREHMLHYSFSGLAPLLDKLNHYSDLSARQMFDAGRRCSVFDLTLRPSFAFFKTY

SEQ ID NO: 2927 - protein, 266 aa, Unknown
  Description of Unknown: bacterium HR21 sequence
MLLSVCMIARNEASRIAAALESVAWADERIVLDCGSQDTTADIAAACGARVYRAEHTPNLNVNKNRCLRLACGEWILLLDADERVSPQLAAEIQERISGAPREQAFWIPRRNWYFGHPLRYGRQYPDYQLRLFRRGAAYFPERHIHEYPTVHGAVGYLHTPLEHFPYETLSHYLQKLDRDTDFQARWLQQRYGAISLGKFFRHGLWRAAKRFIERYIIWGGFRDGFAGFWAAWLDGVNTFVTLAKWWHLSQYEHGYALSETNSLLR

SEQ ID NO: 2928 - protein, 301 aa, Unknown
  Description of Unknown: Verrucomicrobia bacterium sequence
MSERSEARAPLSVLVPVKNEGANLRDCLASVSFAEEIVVVDSASTDGTLAIAKAAGARVVQFVWNGSFPRKKNWALENIPWQHEWVLIVDADERVTPQLEREIREAIRRTDVDGFYLNRRFWFLDGWINHCGYFPSWNLRLFRHRLGRYEQIEIEDNVLSGDNEVHEHVMLNGLAEYLSAPMEHYAFPDIATFVEKHNRYSTWEAAASGKLHEREGEKTLRATPFGTPVERKRWLKKLATRTPFRPSLRFLYHYVWKQGFRDGYRGWMLCRLLAWYERMILLKQREATAQSGVSSHSITQR

SEQ ID NO: 2929 - protein, 257 aa, Pantoea sp.
MMPRQRLSVVMIAKNAAPLLDECLASVAWADEIIVLDAGSRDDTPARARALGARVWQSDDWPGYGPQRQRAQQYASGEMILMIDCDERVTPALRQAIEQVLDAPPTDRVYSIARRNLFLGRFMRHSGWYPDRVTRLYPRRYRYSDHLVHESLETGDAEVVPLRGDLLHLTCRDFADFQRKQLAYAEAWAQERHQRGKRTGLLAIFGHALGAFVKTLVLRGGVLDGAQGWLLAVVNAQYTFNKYAALWALHQAAKGDK

SEQ ID NO: 2930 - protein, 276 aa, Unknown
  Description of Unknown: Gammaproteobacteria bacterium TMED50 sequence
MSTVPATATIIVRNESSNIVECINSVSFFDEILVVDSGSIDDTVAKAEQLGARVMVNPWPGFGRQRQFATENAANEWVFSIDADERVSDELRRAIEQLFANGTDRDGYQVNRRNHFMGRPLAHGEGYPDWLLRLFHRQRARWSQDSVHERVELIGRIGRIRGDLDHHSQESLDDYFHKQNMYTSLQAHIMWESGRRSSLLKLASSPTVRFIKFYIFRLGFLDGIPGLFHIAIGCFNSFAKYAKLRQLEINGGASLPEDDQISPAAETAGSTNPQQR

SEQ ID NO: 2931 - protein, 268 aa, Unknown
  Description of Unknown: Burkholderiales bacterium PBB4 sequence
MSKISVYIIAYNEAAKVAATIKSVKWADEILVIDSWSTDATADIAAQLGARVVQVKFQGFGDLRNQAIAQCSHEWIFSLDADERCTIEAANEIKTIVQDSDAADAYWMPRRNFFMGQWIRHSGWYPNYRQPQLFRKGRMTYEPKQVHEGYVLHSAKPIGHLKHAIWQIPFKNMAEVMHKANRYSTLGADRVSEKKVSMWMALGHGTWSFVKHYVFKLGFMDGWPGFVIALGNFEGTFYRYVKALEIQKGVQWQHPDSSSTYSEPQDSV

SEQ ID NO: 2932 - protein, 266 aa, Unknown
  Description of Unknown: Planctomycetes bacterium TMED75 sequence
MGTSQEQSDPIPGLTACFTCMNSMRTMPRSLDSIQGLVEHVVVVDSGSTDGTIEFCRERGAEVVHRDWTNFPEQKTRALELCADSPWVLNLDSDESPDSELVAGIRSALADPSESVDGFELNRLTLLHGQLLRHTFQPEWRLRLCRGGKGRVNHDSPVHDRIDVPGGVERLPGVLVHDSWIGATDMLTRGVRYGALVAEGYRGGGRPINLLVNPASAFLKQLLLRRGFLDGWRGWVAAGGVASQALAKHLAIMELRELKREERRSS

SEQ ID NO: 2933 - protein, 370 aa, Pseudacidovorax intermedius
MTRKTALVMIVRNEAARLARCLDSAAPWVDAMVVLDTGSTDGTPALAEAHGAQVGHFAWIDDFAAARNAALALSDADWNLVLDADERLVDGFEQVAALRDAMDDALGLVRIDSVYDNAGHEAVSSAWVPRLLPRGVRYEGRVHEQPIGPPALPRRRLPIVLDHDGYLPERLAEKRGRNGALLRLALQDHPDDAYLHYQWGKEQEVVLRDHAGAAAAYERALARMDPSLAWRHDVVVRLLFCLKCAKRFEDALALAQHEMPHWRHSPDFSFAVGDLLLDWAVAEPARAPALLPAIEQSWLRCLEIGEQPELEGAVHGRGSFLAAHNLHAFHLSLGDEAKAAAFAALRTAQGSRQSGASHGIEGTAGGTEEI

SEQ ID NO: 2934 - protein, 297 aa, Mameliella alba
MTLTVVLLTLNEARHIERALRSVAPFADRCVVVDSGSTDDTVARVRALGAKVLTHPFVNQARQFNWALDQLPEDTGWVFRLDADEVVSDALAAEIAARLTGLPNDVAGLTVPRRIAFLGRPIRYGGLFPAHVLRIFRHGRGRSEDRWMDEHIAVQGRVAALRGELLDDNLNPLGWWIDKHNRYASREALEVLLAERRSAAPGAVAMGQQAAAKRWLKRNVYDQLPPGLRALAYFLYRYLLRGGFRDGYPGLAFHVLQGFWYRFLVDAKLYEARSHLSKNGGDLVATAQEVLGIEIGD

SEQ ID NO: 2935 - protein, 260 aa, Grimontia marina
MSQAQRATISAIIITKNEEQILPECFASLDWVDEIIVVDSGSTDNTIAIAEAAGAKVHVNAEWPGFGKQKQLAQSHATKDWVLAIDADEVITDELKRSILDVLANPPQNTLFILRRTTWVFGRFLKHSGWYDKIVRLYPRELTGYNDALVHEKIIEPEGSTKQTLNGDMLHYSYRDLHQYLVKSAFYAKSWADGRQARGKKSSISQGILHALGCFLKMYLLKRGFLDGKQGFLIAVLSAHSTFVKYADLWIRANDSRAAK

SEQ ID NO: 2936 - protein, 254 aa, Selenomonas ruminantium
MPRLAVLILTKNEEANIEECIKSASFADEIVVIDSGSTDSTQAKAESLGARFVVHPMDDSGFAGQRNFAMTQTEADWVFFLDADERIVKDAAEKIKAIVAADTPTAYRVQRKNVIMGKMMQYGGHRPDYVARFYPRQSVKWHGRVHEGIETVLPIKELPGCLHHYTYTTWQQYFSKSNQYTSLSAQTMFANKKKASRMGVLSHAFFAFLKSYVLKQGFRDGYLGFVMSVLAANASMTKYLKLRNLYRLAKGQQE

SEQ ID NO: 2937 - protein, 307 aa, Halioglobus pacificus
MNVVAIVLTLNEEKHLRRCIESVSGVVDEVVVMDCYSTDSTLDIAQEMGARVIQHEWVNYAAQFNFALTELDQDTGWVLRIDADEYLTPDLAAEIRQGLALLSTDLEGVYLPRRMKFMGRLIRHGGVFPVQVLRLFRYGKGECENRWMDEHVKVSGNTACFSNELIDDNLNSLTWWIDKHNKYASREVVDMLNLEYAFMPHDTVASLSDGSQASLKRWIKENVYARLPGGFRAFAYFCYRYFLRLGFLDGKEGTAFHILQGFWYRYLVDAKLAEVKRYMKANGCSAPVAIQDVLEIDVVPESVSQAK

SEQ ID NO: 2938 - protein, 262 aa, Coraliomargarita sp.
  MOD_RES (49)..(49): Any amino acid
MSRVPVSCFIRTYNEEKRIKPVILAAREIVNEVIVIDSNSTDNTRIIAXEAGARIIQHKWLGNGHQKRLGEDAASHNWLLDLDADEILSPELQEAIRELFAAGDPHPGIYSLRLVTVPPFPKGAVWHRSNLFYRNKLYHRKIVRMPAHAAWDQFEVPSNQTVRELKGALLHYSFADIGQQMTKMNRVSSVRASETKLKPKPVLAFRILFGFPFYLFKKLFLQGMYRAGIYGFACAAVIASNRWLKDVKMYEIHLAKNGRNEI

SEQ ID NO: 2939 - protein, 254 aa, Unknown
  Description of Unknown: Hymenobacteraceae bacterium SYSU D60016 sequence
MEVSLSVVIITYNEEQNIARCLDSVEGIADDVVVVDSFSTDKTKAICLNRGVRFVERPFDGYVTQKNFANAQAAFPHILSLDADEVLSEELQQEVRALKQNWQLGGYYLSRLTNYCGAWVRHGGWYPDLKLRLYDRRQGQWEGLLLHEKFELAAGARSGAVKGDLLHYSYTSIKQHLDQINHFTEVALEEMKQQGKQVSVLGLIVKPPFRFLKMYFLQLGFLDGFAGFCIAVLSSYAVFAKYAKLYLFHKQPLS

SEQ ID NO: 2940 - protein, 250 aa, Bordetella genomosp.
MTLSVIIISKNESANILACLESVAFADEFIVVDSGSTDNTVELARDFGARVEITPDWPGFGPQKNRALDLATGDWVLSIDADERVPPELAAEIQAVMANPTADAYEIARLSDFCGRFIRHSGWWPDFVLRLWKRGSARFTDAAVHERVVPQQGTPARLKGHFIHYPYNNFEALIAKANRYSSDAAAMMHARGKRATIFSALGHSFWTFVRIYLIRRGFLDGKHGLVLAVTAASGSFYRYAKLMFLTDQRK

SEQ ID NO: 2941 - protein, 271 aa, Desulfomicrobium apsheronum
MIHDGHTVTALVITKNEETHLSECLASVIGWVDEVVVLDSGSTDRTKEIAEQYGARFYQNLEWQGFGRQRQIAQDYVTSSWCFWLDADERVTSALRDEILSVLRQGTANNVYAIPRLNWFFGRFIRHCGWYPKPVVRLYPLALTHYDDANVHEQVEIRDSFCVKTLVNDLMHYPYKDLRHYVTKSASYANDWAKMKDAEGKKSSLVGAFFRAVLRFFRMYLFQKGMLDGKQGFLLCVLSSYYTFLKYAELWILGQDKEKEIRNRHLQERQK

SEQ ID NO: 2942 - protein, 255 aa, Unknown
  Description of Unknown: Candidatus Sulfotelmatobacter sp. SbA7 sequence
MGLSVAIVALNEEANIGRTLESVRWADEIVLVDSGSTDRTPEIAQQYGARVVVEPWRGHVAQKNYALELCTQTWVLALDADEEVSPSLAKEIRSAIEDPNAQNGYWIPRKNLFLGRWIRFGGFYPDPKLRLFRRGEGYSTGHDPHDRYELKTGRAVGRLKNPLVHYAYPTLSYYLEHMNSYSSLGAKLAVANGHRRFSLVNIVARPILTFVYNYFLRLGFLDGREGLLLHLYHSVYVSWKYSKAWELGKQDHRHS

SEQ ID NO: 2943 - protein, 255 aa, Unknown
  Description of Unknown: Pectobacterium actinidiae sequence
MRKYLSIGIITKNESELIEECLQSISWADEIIVVDSGSTDNTVEIAHQYGAKVYQHNDWPGYGKQRQRAQGYASGDYIFFIDADERMTPELRQSIESVLLKPNLDDKIVYSCARKNLFLGRFMKHSGWYPDKVIRLYANKHYKYNDNNVHESLDCGDAPIQHLAGDLKHLTCRDFSAFQKKQLRYAVAWARERHEREISCRYSEILTHSIFSFLKTWIFRAGFLDGKQGLLLAFVNAQYTFNKYTALWSFNKNKK

SEQ ID NO: 2944 - protein, 300 aa, Unknown
  Description of Unknown: Oscillatoriales cyanobacterium sequence
MTSSSSKIPVSVLIPAKDEELNLPACLASIARADEVFMVDSQSSDRTVEIAISSGAKVVQFYFDNRWPKKKNWSLDNLPFRNEWVLIVDCDERIPPELWDEIARAIADPNFDGYYLNRKVFFLGQWLRYGGRYPDWNLRLFKHQKGRYENLGTESVPNTGDNEVHEHVILAGQVGYLKHDMIHEDYRDLFHWIERHNRYSNWEARVYYNIIEGRDDSGTIGAHLFGEKPLLRFILFYFIQLGFLDGKAGYIYARLLSQYEYQINAKLYELRSCGGQLNVAGSEPSLSPVVRSQETEVKSP

SEQ ID NO: 2945 - protein, 258 aa, Leptospira wolffii
MTLPISACIITLNEEDNIERCLSSLDFVSEIIVLDSGSKDKTEALAKKKGAKVVRRKFDDYVSQKNHVIGLAKFPWILTLDADEEISSQLKEEIKGLFQTVPKEDGFLIPRLTMYMGKWIRHGGWYPNYRVRLFQKSKGQFVGGKVHEAVKLEGKRKKLENPVLHYSYASLHDHVNFINRYSELAALEKFGKGKRYGLFLALLEASYKSFWMYFVRFGFMDGRRGLILAIMGFYYNFLKYTKIFEMTLLEKGKTDPKK

SEQ ID NO: 2946 - protein, 261 aa, Saliniradius amylolyticus
MSTTPISAFIITKNEQAHLAEVLDSLSKFDEVVVVDSGSTDQTRSIAREKGARVIERDWPGFAKQKQYAMTCCQHDWVLNVDGDEVLPEGTYEQLQKLIGAQAQSNTVIRLYFEDLFWGEPMASMSAKRSIVRCFHKSAVSYPDDRRVHENVVPKNVVNEKPMPNLVKHYGYDSTHGLMDKQNQYSLLKAKDKYDKGKRGSILKLAVIFPLTFIKAYVFKKMFASGARGFVHATIEAMYAFLKEAKLLEMNYRQRTKDRSI

SEQ ID NO: 2947 - protein, 297 aa, Marinobacter profundi
MALVNSTWEPGTAPVSVVMISLNEAHNMEAVLENLKGWAQEVFLVDSCSTDATVDIALRYGVHVVQRPFRGFGDQWNFALRELPICAPWTMKLDPDERLSDSLKQEIIEKVEKAADRSFTVPIRLYFMGKRLSSVLRLLRLWKTGTVQFSDVQANEHAISEDPPGILVGEVKHMDSPSLDHWVVKQNRYTTAEAISQSQNKPLAVPPKLFGNALERRMWLKRNFWKVPGRYLILFGYHFFVLGAWKAGKVGWIWSHLRTEVYRQWEYKRFEIEQTGRLPTSIPSNPGEPDSRVRYYE

SEQ ID NO: 2948 - protein, 267 aa, Unknown
  Description of Unknown: Gemmatimonadetes bacterium sequence
MPDRAPPVPPVPSVPPASLPLTVVIPTLNEAWQIAEALASLRWADEVIVADGGSTDDTVAIARAHGARVIEVKGPTIAAQRNAAIAAARNQWILALDADERVTAALREELGVVLAAPAHAAYRIRMQNIYLGRERRRGRWGRDWHVRLFQRSRRFVETRVHEHLERVPDTGELSGCIRHAPYRDLTHHLEKIILYARWGAQDLHARGRRATAWDLTARPLWRFARDYVVAGSWLDGRGGIVASVLTAYSGFLKYAYLWDLGARSPTA

SEQ ID NO: 2949 - protein, 256 aa, Dechloromonas agitata
MPATRQPLSVAIITLNAAAQLEACLRSVHFADEIVVVDSGSTDGTQELAERCGARVIAQPWLGFGPQKQFAVEAAKHDWVLCLDADERVSPELQAAIESTLQQPATGAYRFARCNRFLGRYLKYGEGYPDWSLRLFDRRQARWSDDAVHEKVVSQASVGTLPGDLLHDSAETLAAYLTKQNRYTSLAADMAWEAGKRSSFGRLVFSPIVRFIKFYLLRQGFRDGLPGLIHIAIGCMNSFLKYAKMLERQRTDSALR

SEQ ID NO: 2950 - protein, 258 aa, Xenorhabdus hominickii
MSEKKRLSVVMIAKNSADLIADCLQSVSWADEIIVLDSGSTDATCRIANEMGAKVYTNTQWPGFGRQRQLAQSYASGDYVFMIDTDERVTPELKSSIEHVLNNPDDNKVYSCTRLNLFMGRFMKHSGWYPDKVIRLYCRERYQYNDNQVHESLDMQGASIVTLKGDLRHLTCRNLMEFQQKQLNYARDWAKYRHEQGKKAHYLSIFSHTLGAFFKTWLLRAGFLDGKQGLVLAMVNAQYTFNKYAALWELTQMKSKKR

SEQ ID NO: 2951 - protein, 264 aa, Burkholderia sp.
MNRPTLGVAIITRNAGARFAQCLEALSFADEIVVVDGGSTDATADTARTHGARMIVRTDWPGFGPQKNRALDALATDWVLSIDADEVVTPELAASIRATLAAPGADVYALDRLSSFCGQWIRHGGWYPDWIPRLFRRGAARFSDDLVHERLVFDGAAKRLTGKLLHYSYEDVDTVLHKLAAYADAGARQRAAAGGRGSFGKALARGAWAFVRTYLLRAGFLDGRAGFMIAVFNAETVYYRFLKLALLNTRERETPKRRNPAARQ

SEQ ID NO: 2952 - protein, 254 aa, Pasteurella dagmatis
MSTLSVAMIVKNEAENLEKCLKTIQGWVDEIVILDSGSTDNTEEVALKFGAKFYTNTDWPGFGKQRQIAQQYVTSEYVLWLDADERVTPELRQSIQSAVEKNEENVIYKISRLSEVFGRKIRHSNWYPDFVLRLYKTKFTQYNNEPVHEKVIIPNNAKVEKLSGDLEHYTYKDMHHYLVKSAGYAKAWAEKREKAGKKGSLFSAFTHAIGCFTKMYILNAGFFDGKQGLLLAILSAHSTFVKYADLWVRTETKK

SEQ ID NO: 2953 - protein, 251 aa, Bordetella trematum
MSLSVIIITKNESANILGCLESVAFADEFIVVDSGSTDDTVELARSFGAKVQVTPDWPGFGPQKNRALDLATGDWVLSIDADERVTPELADAIRQAMAQGQAQAYEMPRLSWFCGRFIRHSGWWPDYVLRLWKRGTARLTDAVVHEKVVADGKVERLEPHLVHYPYPDFESLINKVNRYSSDGAAMMHAKGRRANVLTALGHSFWTFVRIYLLRRGFLDGRHGLVLAVTAASGSFYRYAKLMLKSEPGPPK

SEQ ID NO: 2954 - protein, 247 aa, Legionella sp.
MLSVIIIAKNEAQNIRRCLESVAWVDEIIVLDSGSADNTVAISREYTPHVFQTDWQGFGVQKQRALELATGDWVLNLDADECVGDTLRQRIVEVMAQNTHEGYRIPIQMCFYGKPLRFASSPSRHIRLFKRAGAVYSADYVHEKIELPFAARIGQIKAPILHYSVRDVSHAINKLNLYSSYSAAIRCQAHQPASLFKTIASSCWMFFRSYILQCGFLDGAPGLVFALLQSQGSWYRGIKQLYRDEIE

SEQ ID NO: 2955 - protein, 258 aa, Pantoea sp.
MTARQRLSVVMIAKNEAALLPACLDSVSWADEIIVLDSGSSDDTVDIARQAGAQVFHAEAWAGFGKQRQRAQRYASGDMILMIDADERVTPPLRASIEAVLAQPPSGTVYSLSRSNLFLGRFMRHSGWYPDRVMRLYPRALNYNDNLVHESLDTQGAPVVRLEGDLQHLTCRDLIAFQQKQLAYAAAWAQERHQRGKRCGLFSVFTHSLGAFLKTFLLRAGFLDGKQGCLLAVVNAQYTFNKYSALWALNHAADKGRL

SEQ ID NO: 2956 - protein, 254 aa, Selenomonas bovis
MSRLAILILTRNEEVHIEACMESASFADEIVVVDSGSTDRTQAIAESMGARFVTHPMGDDGFAGQRNFALTQTTADWVFYLDADERIEAAAAEEIRRIVSEDLPAAYRVERKNIVFGQLMRHGGHRPDFVDRLYPRTAIRWRGKVHEGIETDLPRKTLHDVLRHYTYTTWQQYFAKFNQYTSLAAQSMYERNKRVGEAGALGHAVFTFLRDYLLRGGFLDGFPGFTMSVMASVYTFVKYLKLINLYRCQDGGCK

SEQ ID NO: 2957 - protein, 266 aa, Unknown
  Description of Unknown: Gammaproteobacteria bacterium sequence
MTTDSRYSSQPQILISVFIIAKNEEDRIQKAIESVIDWVDEVIVIDSGSEDKTVQVAQASGAKVIYNSWQGYGQQKRFGEDQCKHPWILNIDADERVTPEAKNEIQTILSGEPKYSGYRMSFKDIMPFELTPHRRAWATNHLRLYDVRQGRFRNHSSLDSVVMDKSIVDSIKSPCHHQSIRSFDHLVAKANFYTNLQADDMTKKGRIIGAGRLLIEFPISFIKAYFLRHYYIYGVYGFGFSMIFAFSKFLRLAKRYEQQLQQKMKP

SEQ ID NO: 2958 - protein, 333 aa, Blastomonas natatoria
MIVRNEERCITRCLDSVRPWVDRMLVLDTGSTDSTRELARQAGADVHEIEWPGSFSEARNRSLDLADADWNLVIDADEWILSGGELLRAWCRNPARLGVVCQRSMIELGQDAPAAAARAEGQHWITRLLPRGVRYEGRVHEQAASDLPRIRLELHLGHDGYLDAQLNAKRDRNGALLLLDLKDNPGDPYILYQLGKEAEVRREFGDACRYYRQSLEATPGSANWLHCLSTHYLYCLGQTGDFDTAFAFADQNMTRWAHSPDFFFVLGNLALDKAMTDPANALGEWIPFAAAAWEQCLEIGDQPSLEGSVHGRGSHLARMNLEAIRSQMPGLAA

SEQ ID NO: 2959 - protein, 252 aa, Glaesserella parasuis
MPTLSVAMIVKNESQDLAQCLETVKGWVDEIIILDSGSSDNTKEIALQYGAKFYENTDWQGFGKQRQLAQQYVTSDYVLWLDADERVTQELKQSIQQAVSNNEQNTVYQIPRLSEVFGKQIRHSGWYPDYVVRLYRTDFAQYGDELVHEKVHYPKEAKVVKLKGDLLHFTYKDIHHYLVKSASYAKAWSEQRAKAGKKATLFQGVTHAVGCFVKMYILKAGFLDGKQGFLLAVLSAHSTFVKYADLWNKYQK

SEQ ID NO: 2960 - protein, 266 aa, Desulfuromonas sp.
MNNSSVRQTLSVTIITKNEEDRLPVCLDSVKDLADEIIVLDSGSDDRTVEIARQYTEQVFVTDWPGYGKQKQRALEKASCDWVLAIDADEALTPELQDEIQDMLARDVQEVAYFLPWAVTIFGKRLDYGRSARAPLRLFKREGARFTDAMVHETVITAPGKAGKMKGRLLHFTHRDFGQTLYKNAHYAWLGAQQRYQKGKKGGLVGATVRGILVFIQIYILRGGFLDGRVGFIMAVMYSQGAFNKYAGLWTLYRMEKLRGNGKMLK

SEQ ID NO: 2961 - protein, 257 aa, Xenorhabdus khoisanae
MGAQKRLSVVMIVKNASDLIEDCLLSVNWADEIIVLDSGSTDETCQIASEMGAKVYTNTQWPGFGRQRQLAQSYASGDYIFMIDADERVTPELKASIEQVLANPDDKKVYSCSRLNLFMGRFMKHSGWYPDKVIRLYCRERYQYNDNQVHESLDTQGASIVTLKGDLRHLTCRNLMEFQQKQLNYARDWAKHRYEQGKRTHYFSIFSHTLGAFFKTWLLRVGFLDGKQGLVLAMVNAQYTFNKYAALWELTQTKSKK

SEQ ID NO: 2962 - protein, 664 aa, Marinobacter sp.
MLNRQSISQALLLTGLGGALASSSIIAGTTLLLAIVGGYLIKQQTLIKEGWEVPKELRLIHFAFWFFVVTSVASWIAEGFEYEGGKTLGAHARLILFWPLAIALIGAKVNARTIFAAYMVSCGVICLLFLTELAGNSWSLTTTLRQRFGPGINPIHFGNLALLSALLAAAGAFFFHSQRQKTLSVLAILLGIGALAVALMSQTRSNLIALPALLPFFALLIPGRKKILAIAVLGAIAFTAVFNSERFTDSLEAVLEGKIDNSLEMRIEAWQLAWNQFLENPVMGSGLSGYHEAASRHEDDTFLACCTDHAHNDLLQQAATKGITGILSWLFLLAIPFAIFIRQTRNQNRTVSILATAGALVPSGYLVFGLTEAAFDRSLFLTYYLVSIAAISAAMLHELELSYTRKRKRKVSATIITKNEEDHIAACLSSVRPIADEIIVLDSGSTDKTVEIARQYADIVEITDWPGFGIQKQRALELASGDWVLSIDADERVSPALAREINHTLSDPDADAYRLPWAVTLYGKRLDFGRSGRAPLRLFRREGVRFSSAMVHEKILVPEDRKIRSMRGRLTHFTHRNFGHALEKSAKYAWLGSQEKFRKGKRTRFLVYPTLRGLMTFLQVYVFRLGFLDGSVGFLVAVTYAQGSFNKYAGLWTLTRTERQKSRE

SEQ ID NO: 2963 - protein, 251 aa, Unknown
  Description of Unknown: candidate division Zixibacteria bacterium sequence
MLTLSVIIITLNEEANLPRCLESVKWAEELVVADTGSVDRTLEIAKECRAKTIQLEWEGFGKAKQRALEAASCDWVLSLDADEVVSERLRAEIQNLLTSDPPPFDGYSIPRRSMFLGHWMSHGGWYPDYILRLFKREKGRFEHKKVHESLSLTGRAGRLKGELLHYSDPDLEHYLKKMNRYTSLSAQELQERGKVASLADVLFRPMATFWKIYLFKGGFLDGIYGFLLALFSSVHVVTKYVKLWLLSRNAE

SEQ ID NO: 2964 - protein, 260 aa, Robbsia sp.
MHAPTSSPARPTLGVALISLNAAARLAPCLAALSFADDIVVIDGGSHDATQQIAREHGARVIVEPVWPGFGAQKNRAIDALGTDWVLSIDTDEIVTPALAQAIAAAIRQPSADVYALDRLSSFCGRWIHHSGWYPDWVPRLFRRGAARFSDDLVHERLVFDARCERLAGKLMHYSYEDFDTVLRKLDAYSSAGARQRFAAGKRGGFGKALGRGFWAFVRTWILRRGFLDGRAGFMIAVFNAETVYYRFLKLGAHHDDRVA

SEQ ID NO: 2965 - protein, 290 aa, Unknown
  Description of Unknown: Aquabacterium sp. NJ1 sequence
MNKQLRISVLILTKNEQQDLPGCLQSVAWSDDVHVYDSGSTDDTLAIARAHGASISQRTYPHSTAPFGGDEAAHRNWGLREIQFKHDWVLLLDADERITPHLLDTISARLNQAPGRAAFRFCRRDYFLGTWLKHVTPSPMHIRLVRPRQVHYERLINPVLVVDGEIEDLSSYFDHHPFSKGIAHWFAKHNGYSDLEARQIANTPDQAGTFEWRKALFSRDVTERRQHQKSLYYRLPLRPAIMFLGLYIGKRGFMDGRAGLVFATLRAIYEYMIVLKVTEMQSRLQQGGQR

SEQ ID NO: 2966 - protein, 279 aa, Unknown
  Description of Unknown: Proteobacteria bacterium sequence
MNRSERITGASAGTDSRITGCVITYNEESVIETCLRSLSVCDELLVVDSHSTDRTREIAARCGARVIERDWPGYRSQKQFAVNEATYDWILFLDADEQLSPELAAEIEALKAQGLGRYAAYDIPFLSSYFGRYLRHGDWHPDHHIRLFDRRRASFGGYEIHEKVVVRGPVARLRGSILHDSYTSLEDQLAKLARYARLMGEAMYASGKRGSWAQVFFNPLWRFFRAYVLRRGFLDGWRGLAVALIEANYVRQKYLWLLILQRLARERARQNATGAPDRH

SEQ ID NO: 2967 - protein, 308 aa, Synechococcus sp.
MDSAALQLRGSGYSSSFHLPANTQITPTVKHASSPTIAGVVLCLNEASNLARALRSLSWCDELMMIDSGSSDGSQAIASSFGARVMEHRQEGRFLISEQRNWALSHGKLQSQWILFLDADEEISITCQQAIQQVIQHPAAADAYELTPRYWFLGRWLKRTQGYPNWHPRLVKRGVVGFEGGVWESFTAGHTIGRIQEPYEHYAFSKGIDDWLERHRRYADWEAEKIDAVLSGQGVQALGTRRWQHLRLAMAHAWPLRPILRFSQKYVLQGGFLEGWQGLLFALLMAGYDLITITKLIQRRRLKQGLPL

SEQ ID NO: 2968 - protein, 291 aa, Butyrivibrio sp.
MLDLTVVILAKNEEADLKRCIDSFGGIVKRFVVIDSGSTDNTVELAKSLGADVYYHEWTNYATQFNWGLNNTNIETAWTMRIDADEYLTPELCKEMAEKLPSLDYSVTGIELNRRLIFLGKWMRHGGIYPIFFLRIFRTGKAYCEQTNMDEHLILTEGKTIQFRNDFVNGDPKSLSWWIGKHNGYSDREVLDYLSKEKQLEDNATIKPNLFGNPAERKRWLKYNLYYKCPGSVRARLYYIYRYYLKLGFLDGKEGQMFAFFHAYWYRYLIDAKLYECKKYGIRKTGQGEAK

SEQ ID NO: 2969 - protein, 255 aa, Unknown
  Description of Unknown: Photobacterium profundum 3TCK sequence
MRKHTLSIILITKNEADRVTACLRSIAPIADEIIVLDSGSTDETVTICQEYTDNISITDWPGFGKQKQRALDKATCDWVLSIDADEALDTKMQQALIQLLEQDVIQPTAYKLPWGVTLYGKTLKYGRSARSVLRLFKREGARYTLDEVHETVIPVEGETATLPGFLLHYTHRDYGHGLDKSSQYAWLGAQKYHRKGKRSHGLGLALLRAIWTFFHIYILRRGFMDGSVGFIMAMTYAQVNFNKYVGLWLLEKGRS

SEQ ID NO: 2970 - protein, 256 aa, Leptospira langatensis
MSLPISACIITLNEEDNIERCLSSLDFVSEIIVLDSGSHDNTEKLAKKKGAKVVLRKFDDYVSQKNHVISLAQFPWILTLDADEEMSPALKEEILALFRKGEPDADGFLIPRLTMYMGKWIRHGGWYPNYRIRLFQKSKGKFVGGKVHEAVQLSGKKKKLKSPVLHYSYKNLYDHVNFINRYSELAAAEKFGKGKRTGILLALLEAGYKSFWMFFVRFGFLDGRRGLILAIMGFYYNFLKYIKIFEMSLAEKEKQK

SEQ ID NO: 2971 - protein, 256 aa, Unknown
  Description of Unknown: Pectobacterium versatile sequence
MIKKISILLIAKNESKLLESCLQSISWADEVIVVDSGSTDSTVEIAHRYGAKVYQHEDWQGYGKQRQRAQSYASGDYIFFIDADERVTPELRQSIESVLLEPNLDDKTVYSCARRNLFLGRFMKHSGWYPDKVIRLYANKRYKYNDNNVHESLDCGDAPIQHLSGDLKHLTCRDFSAFQEKQLRYAVAWARERHEKGRSCRYSEIFTHSIFSFLKTWIFRAGFLDGKQGLLLALVNAQYTFNKYTALWSLNKKTRK

SEQ ID NO: 2972 - protein, 255 aa, Unknown
  Description of Unknown: Enterobacteriaceae bacterium ML5 sequence
MADKKRLSVVLIARNEAGLLRECLESVAWADEIVLLDSGSEDETVEVARSFGAQVFRNAQWPGFGKQRQLAQSYATGDYILMIDADERVSPELRQSIENALKDPQENTVYSLGRSNLFLGKFMRHSGWYPDRVNRLYPAHFRYNDDLVHESLETDGARVLPLQGDLLHLTCRDFFAFQRKQLGYAQAWATQRHQQGRRCSFFSVISHTLGAFVKTWILRAGFLDGKQGLILAGVNAQYTFNKYAALWAFSQPLQK

SEQ ID NO: 2973 - protein, 235 aa, Unknown
  Description of Unknown: Candidatus Rokubacteria bacterium sequence
MAERPEISVVLITRNEAARIRACLDSVRWAEEIVVVDQHSHDDTAAICRAYGARVIARDMAAGFGEQKNFAIAQATRPWILSLDADEEVTPALRRAIEAAVAAPGACVGFRIPRLTSYLGRCIRHCGWYPSPVLRLFRRGRGRFTDALVHEEVLVDGPVGDLREDLQHRSYDSLADHVRKLLDYTAWDARMLRRRGVRLGLLGALWWLAVKPAATLVRKLVVQRGYREGWHGFVL

SEQ ID NO: 2974 - protein, 253 aa, Unknown
  Description of Unknown: Bacteroidales bacterium sequence
MRHISATIITFNEEHRIKACLASLDGIADEIIVVDSFSTDRTAEICIEHGCKVVRREFTGYGAQRQFATSLTTHSYVLSIDADEVLSPALRSTIQHLKETGFDHRVYRMSRLNFYCGQPVRHCGWYPDIQIRLFDKRYANWNLRDVSERVIFPDSLRPEMLDGDILHYRCTTPEEYRQVQTRHAAITGKVLSAHHDSISPVTPYIKGVTAFLDCYLNKGAILDGAEGRAISREQYRMAYLAYNLARRALKKAR

SEQ ID NO: 2975 - protein, 267 aa, Advenella kashmirensis
MPAEAARPTRRVTLAVALIVKNEAQNLAACLDSVAGWVDEIVILDSGSTDATEQIARRYTQAFYTSSDWPGFGPQRQRAQTHVTADWILWLDADERVTPELRASIQAVLQNPPDNTIYQVARLSWAFGQFIRHCGWYPGHVERLHPRGLTQYDNALVHESLVLPPGARLATLQGDLLHFTYATVDEHLRKSAGYAIAWAEQRAAAGKKGSLATATLHAAARFFRTYFLRLGILDGRAGFLLSVMAAQSVFNKYACLWSRTRQAKPPR

SEQ ID NO: 2976 - protein, 282 aa, Azospirillum sp.
MPRPSFSDASLTVVVVTLNEAVRLERCLDAIPDRYPVLVLDSGSTDDTLAIAQRRGCVVAHNPWPGFAEQRNVALTRCGIESRWVLFVDCDEFHQPAFFDWFEAEGRERQDFDVAMLTSWLVFRGVTLRHAPGYPIYHPRLVRRGAVHFVPNQSGHGETVAAGTRCLTLDIPYAHHFYDGDLSGWMTKHIGRAAQEAFLLPGPGREESRRARLLRLAGRLPFRPMLRFLYHYLLRGGCRDGRAGLEYALMYMWYEATKSLFRLAAGGRPASRAPAAHAQIVP

SEQ ID NO: 2977 - protein, 321 aa, Rhodopirellula sp.
MRRGHQGCARVDDRCGQSGSRDSQAGNQRVTQPRSDSADRPTRLAVSVVVLAKNEEINIARCVDALAWADEVVVVDDASTDATVALAERSGARVVNHPFESFAGQRNWALDHAGLRNEWVLMLDADEVSTAEFAEEIGRAIESAGPEVVAFRTCRKTMLDGVWLKYSDGFPVWIMRLVRRGRARFEDSGHGEVPVPAVDGDLGTIRAPFIHEAFSRGMDDWWMRHVRYAGREAKRECGQERDETPWLIFSLDASRRRRGLRSLARRVPARGAMRFFYQYILMGGFRDGPTGRRFCRMMACYESIISIRKSESLTVDRNGDP

SEQ ID NO: 2978 - protein, 281 aa, Parvibium lacunae
MPDLTQPTEAKSTTRRVPISVVIITLNAGAVLADCLASVAWAAEILVVDSGSTDNTVALAEAAGARVLQQIWLGFGPQKQWGVEQARYDWVFCLDSDERVTPALAASIATWLTQPFDPEKTLARCARRNRFLGRYLRHGEGYPDWNTRLFHRAYGYWTDLPVHEHVRSRQPVSCLATLEGDLLHHSQENLPDYLRKQERYTQLQAMLMYAKMRDLPLVKRLWRLGVTVLKVLLAGPVRFLRFYIFRLGLLDGWPGFLHIAIGSWFTAVKYAKLLRLLKRAS

SEQ ID NO: 2979 - protein, 251 aa, Aquifex aeolicus
MDRLSVVILTKNEERNIARAIKSVKEIADEILVIDSGSTDRTVEIAKELGARVIFRDFTNYPDQVSFAISKTNNKWVFVLDADEEVSEELKRSIKETLKFPKHDCYVVNRRTYFMGKFLNHTLYPEWRIRVFKKDKVKYEGELHEVVKCSGSIGKLKGDLYHYSFKNLDEFFSKNLKYSKISAEILYKNGRIVKNYELFTRPVWTFFKFFIMKRGFLDGWRGFLISASYAFFNFTKYAYLKELQITKNKLR

SEQ ID NO: 2980 - protein, 260 aa, Yersinia intermedia
MSARKRLSVVMIAKNEASLLADCLASVSWADEVVVLDSGSEDETIALAQQYGAKVYSNVQWPGYGKQRQLAQQYASGDYILMLDADERVTPELKTAIEAVLIAPDEGAVYSCARRNLFLGRFMRHSGWYPDRVTRLYPHHQFQYNDNLVHESLNSGSAKVIPLSGDLLHLTCRDFFAFQRKQLSYAEAWATQRHQQGKSCSYFSILSHTLGAFCKTWLLRAGFLDGKQGLLLAVVNAQYTFNKYAALWALSHQYQKSENS

SEQ ID NO: 2981 - protein, 259 aa, Ferrovum sp.
MSLSVIIIAKNEEAALGACLDSVLWAEECIVLDGGSQDGTVELARQRGARVEIAADWPGFGPQKNRALALTCGDWVLSLDADEQVSPALKAEILAVMANPEALDLYRMPRSSRYCGRALRHGGWWPDYVVRLFRRGKAHFSEDWVHERLVGTEEGSIGTLNNPLEHDTYVDLEEALDKANHYSTLGARQAYAKGRRATLGKALRHGCWAFFRTFILRRSFLDGGQGFLLAVSNAYATFYRYAKLWCLDQPECRSFPVDH

SEQ ID NO: 2982 - protein, 259 aa, Hyphomicrobium sulfonivorans
MTNSRADSMSTGLSCCIITHNEADRIERCIEAVRGVVDEVVIVDSGSTDDTLARAEAMGARIFHNDWVGYGPQKRFAEDCAQHDWILNLDADEIVTPELAAEITALMRTPKSDRLPAYRFRQVTVYPGKERPRLWADYHNYIRLYDRSKVRFRNSLVHDTVDAGSHPVGQLKGIALHYSWRSLKHVRDKLERYTDLQAKELKKPRWYAYARLPFEYPVLFFRYYILRSNVTGGITGLRITHEIARARTRRLLKIARSPR

SEQ ID NO: 2983 - protein, 286 aa, Unknown
  Description of Unknown: Planctomycetia bacterium sequence
MTTRLTVIIPCKDELPNIEACINSVVALADELIVADSGSTDGTLELVKARGDCRILEREYVNSANFKNWVIPQATHDWILLVDADERVTPELAAEILRLKQSGELEQTPHVAFNIPRRVFLLNQLVRFSGWQHDRVRRLFRKTCRYETRRVHAELDVSLTQMGVLTSSFEHHTFRSLKHFNAKLERYAYWSAEDLYAQGKRSGWLSLTLRPAFRFIKHYVFQYGVLDGRIGLLISTLMAFSVYLKYAALWELECQSATVSEASSAAATADPQTLALPDSQRQRRVA

SEQ ID NO: 2984 - protein, 258 aa, Unknown
  Description of Unknown: candidate division Zixibacteria bacterium sequence
MSLTVCIIAHNEEEKLPEVLESVRFADEVIVADCGSRDETNLIARSFGARVFSRPNLANLNINKNFTFDQAKSEWILCLDADEVVPPETAREIQEVIRRKPAQAGFYLPRRNHFFGQWLRHGGQYPDWQLRLFRRGQGRFPEAHIHERLKVEGTVGRLRHPLDHYPYSTPEDIRRKLDFYTAFEAEHLYRTGVRPSPLHALRLLYATPAQRFLRRYLLKGGFLDGRPGLQAALMDVRNFRQRYRKLRTLAAKLAHPAR

SEQ ID NO: 2985 - protein, 254 aa, Magnetococcus marinus
MSPKLPISGVIITLNAAHQLEECLQSLALCAEIVVVDSGSSDGTQALAARYGARIIEQPWLGFGPQKQFATQQASYPWVLCLDADERLSAPLQQSIVELFSTQPPAQHAYQMPRCNRFMGRWLRHGEGYPDPNLRLFHRDYAHWSQDPVHEHVVALGAVGNLAGDILHHSEEGLECYLNKQNRYTSLQAEKLAQGKAISPHKIYLSPLFRFIKFYLLRRGFLDGLPGLLHILIGCFNSMIKYAKAYHHQQNPTH

SEQ ID NO: 2986 - protein, 254 aa, Burkholderia glumae
MAEPTLGVALIALNAAARLPNCLAALGFADEVVVVDGGSTDATVEIARAHGARVLIEREWPGFGPQKNRAIAQLSTDWILSLDTDEVVTPELAASIRAAIRAPAADIYALDRLSSFCGTWIRHSGWYPDWIARLFRRGTARFSDDLVHERLIYDGPTARLTGKLLHYSYEDFETVLRKLDSYSSAGARQRHAAGQRGGFGKALGRGLWAFVRTYLLRRGFLDGRAGFMIAVFNAETVYYRFLKLGAQARRGPHA

SEQ ID NO: 2987 - protein, 283 aa, Azospirillum brasilense
MIPVSVVVMTRNEAANLPHCLPALKRFAERFVVDSGSTDGTPSIAEAAGARVVPFRWDGGYPKKKQWCLDRLPFRQDWVLFVDADERLGGALVEEIAALMTAGPRHAGYFIDGHPVFLGRRLRFGARNRKLALFDRRKAHFPTVPDLDVATMWEVEGHYQPVIAGTVGRLRHSLDHADDKPVAAWFDRHARYADWEAALRSDGRMRDLVAWECGARRWLKALFDVVPARPFLVFLYGYVWRLGFLDGGPGFQHALARAFYYWQVGVKIADARRRAEPPASTDD

SEQ ID NO: 2988 - protein, 259 aa, Proteus mirabilis
MSENKRLSVVMISKNVADVIEACLDSVQWADEIIVLDSGSDDTTCQLAHEKGAKVFSNTQWPGFGKQRQLAQQYATGDYIFMIDSDERITPELKASIQAVLQQPESGVVYNCARRNLFMGRFMKHSGWYPDKVTRLYAREQYQYNDNLVHESLETQGATIKTLPGDLLHLTCRDLIEFQQKQLKYAKAWAQERHQRGKTTGYSAIISHTVGAFFKTWLLRMGILDGKQGLILAFVNAQYTFNKYASLWELSRKNREYEK

SEQ ID NO: 2989 - protein, 298 aa, Unknown
  Description of Unknown: Chitinophagaceae bacterium sequence
MRPERLDLTIAIPVKNEEKGLPGCIRAIGDDLAKEIVIIDSGSTDATRQIAREAGVGVVDFAWDGRFPKKRNWFLRNYQPTTKWVLFLDADEYLTPAFKTELREVLQNTDKVGFWLNYSIYFMGKKLKGGYPLKKLALFRVGAGEYEKIDEEQWSHLDMEVHEHPVLEGEIGHIKSKIDHLDDRGISHYVAKHNEYSSWEAARYVKLTGSKAEMKNFNWKQRLKYKLSGSILIAPVFFFGCYFLMGGFRDGVRGFAFALLKMAYFVQVYCKIKELKTKQSQRQMLKIASPSSVLQENA

SEQ ID NO: 2990 - protein, 273 aa, Paraburkholderia acidipaludis
MSDSGKFSAQSDAISVIVIVKNEAHDIRDCLASVHGWVGEIVVLDSGSTDGTQAICREFGATVVETDWPGFGPQKQRALEAARGPWILSLDADERIPPALRDEILASVKASAADLFRLPRRSNYCGQWIRHSGWSPDYVTRLFRRDAAHFSNDLVHERVIAAPDTRLGTLSEPLMHYSFRDFSEVLGKIDSYSSYGATQRAARGQPGKRSGGVGRALLHGFWTFVRTWIIQRGFLDGKMGLVLAISNAEGTYYRYLKLMLLEAEPTREGTKKP

SEQ ID NO: 2991 - protein, 359 aa, Unknown
  Description of Unknown: bacterium 1XD21-70 sequence
MKINLVMIVKNEERSLERCLRTVDNLVDEVIVVDTGSTDKTVEIAKGMGAKVYSFAWVDDFSAARNFALDQSDADWNLVLDGDEYLRAVTREKLEEMLQARKGMWLGCITRYDSFRNEEGISVSTAVLPRLLPREVRYEGKIHEQPEGEYLCYAVPLQADHDGYLYSDKGERNLPYLEQAVAEHPGDGYYLFQLASTLRNLKRHEESLPYFREFYRLTGREDGYRAGGVVLYLYTLLDLSTPEHLDEAAAIIEKEEPALGGWSDFCFVCGLFYMKRVLSDAGRYIDLLPNIEKCYLKCLELGEQPEAGGVVGTGSFRAAYNLGAWYEVSGQMDRAARAYLMSAQEGYAPAVKRLKREWH

SEQ ID NO: 2992 - protein, 285 aa, Unknown
  Description of Unknown: Methylobacterium sp. 4-46 sequence
MTRADDEPIPLTVLMRAFNEADRIEAAIRSALPLRAEILVIDSGSTDATATIARSLGARVVTNPWAGFGPQRRFGEGECRHDHVFSMDADEVLTPALVREIRALFRPGPPPALAKVRKAMALPHRDRPPPFAFCTEQIYLYDRRVARTIDNPNWDHLEIRTDEAPRRLRAVAWHFTYRDWNHAVAKANYVAELAARTSAPRSRLSLTLRLLVEFPSTFLRFYILRRLFLAGADGFAMATILAFGRFLRIAKMREAKMREAKMRERAPSRAADPAGGATDAQGAAR

SEQ ID NO: 2993 - protein, 260 aa, Marinomonas sp.
MPDRTSTISVVMIVKNEEQKLQHCLDSVTGWVDEIVILDSGSSDATLSIAKKYTSKIYQNTDWKGFGHQRRLAQSYATCDWILVLDADEQVTETLRSEILKVVKTSHLNVCYKVNRLSKAFGKYIKFSGWSPDWIVRLYPRELTQYNDALVHEKVIVPKDITINKIKNGYLLHDTYENVHHYIEKTTGYIKAWSDQREGRKYPSLATALFHAWGCFVRMYIFKLGFLDGKHGFILAWLGMHSTFVKYIDLWLRNYRGNDE

SEQ ID NO: 2994 - protein, 269 aa, Unknown
  Description of Unknown: Opitutaceae bacterium BACL24 MAG-120322-bin51 sequence
MSVSILILTLNEAPNIAACLESVAWADDVVVLDSFSSDETCAIAESMGARVVQRKFDDFGSQRNYALDSIEFKHDWIFHLDADERFNPELQSECERVVGLEERSAYFVPNRIIFLGKWIPRCTQYPFPQVRLIKQGEVRFAKAGHGQREAAAQRGVGHIDVAYDHYNFSKGVEDWIAKHNRYSSEEAQWAAEIERRPLGECLSKDSMLRKRALKSWFVRMPCRPWIKFFYLYIVKRGFLDGYAGLVYCRLQMMYESMIAIKRAELERGE

SEQ ID NO: 2995 - protein, 253 aa, Caballeronia catudaia
MTHPTLGIALITYNAAARLAQCLTSVSFADEIVVIDGGSTDATVEIARAHGARVRIERDWPGFGPQKNRALDALSTDWILSIDADEVVTPELAAAIRAAIATPVADVYAVDRLSSFCGEWIRHSGWYPDWIPRLFKRSAARFSDDLVHERLMVSADTPVQRLQGKLMHYSYEDFETVLRKLDAYSTAGALQRHAAGKRGSLSIAITRGLWAFTRTYILRRGFLDGRSGFLIAVFNAQTVYYRFLKLAHLDQPR

SEQ ID NO: 2996 - protein, 276 aa, Unknown
  Description of Unknown: Chloroflexi bacterium sequence
MSISILLLTLNEEANLPACLGSVEWSNDIVVLDSFSSDKTCEIAERLGARVIQRSFDNWASHQNWAMEHISFKHEWVFYLDADERMTDSLKQELLAVASNRTRPEVAYYCGRKNYFMGKWIRHAMPPGAIMRFFQPKHVRFERLVNPTPIIDGVYGYLENYLEHYNFSKGLTEWFTKHNRYSTWEALEGHNLLANDRFAIEMLFQKDRYSRRQTLKRISLYLPLRPLLKFAYLYIVNKGFLDGRPGLQYCLLQTSYEYMIVIKQYELRRRQLGLPV

SEQ ID NO: 2997 - protein, 305 aa, Hymenobacter amundsenii
MTTSPSLATDLVPLAAPAPWLSERAPVSIIILTHNEQADLPACLAAVGWSDDVHVLDSGSTDQTEAIARAHGARVWLNPFVSFGQQRNFALDELALRHEWVLFLDADEVATPAFARAVRTAVATAPAEVAGYYCCWKMMLEGRWLRRCDNFPKWQFRLLRRSRARFTDFGHGQKEGEVQGRIDYLPEPYLHFGFSKGWTHWLARHNRYSSLEAAARLHQRPPLRDVLSAHASRRNPALKSWLSRLPGWPLLRFVQTYVASGGFLEGIPGFIYCTNMAYYEFLIQIKMREIGLRAASPPHSTGGPA

SEQ ID NO: 2998 - protein, 254 aa, Psychromonas sp.
MLNKISAIIITKNEQNNLPHCLDSLGWVDEIIIVDSGSQDDTQEIALRYGAKFYSHPNWQGFGKQKQLAQNYASHTWILAIDADEVVSDKLQLSIQQQIIQTNVNSVFQITRKTWVFGRFLRHSGWVDKIVRVYPKKIANYNDALVHEKVIFNKDINIKKIKGDLLHYSYSNLTNYLIKSASYGKAWADGKQQRGKQSSIFQALIHGLGCFLKMYILKKGFLDGKQGFLIAVLSSHSAFIKYADLWIRENDIRK

SEQ ID NO: 2999 - protein, 261 aa, Unknown
  Description of Unknown: Photobacterium angustum sequence
MNQQNTKPSLAVALIVKNEAKHLAACLDSVKDWVDEIVILDSGSTDKTEAIARQYTDKFYVSDDWPGFGIQRQRAQQYIQSDYVLWLDADERVTPELKISIENVLQSPDHKTVYLINRLSSAFGQFIHHSGWSPDWLVRLYSTQFTQYNDALVHEKVIIPEYAQQQKLSGRLHHHTYDNLHHYIEKTTKYIKAWTDEREGRKKSSITTALLHAFASFLKMYVIRLGFLDGRRGFILAWLTMHSTFVKYTDLWLREQQDKTQ

SEQ ID NO: 3000 - protein, 606 aa, Paenibacillus sp.
MSSGRISLCMIVKNEERSLPSCLNSVRGAVDEVIVVDTGSTDLTVKLARQQGAAVIPFEWCDDFAAARNRGLEAATGDWILFLDADEMLDDRAREELPLWAAQEGVDGFFLQIHNYTGNGSGGVTINPVLRMFRNHPEHRFAGRIHEQIAESIVNHNPQAHFHMTDMIIHHYGYSEEIVLEKDKVSRNTRLLQQVIHEDPDNPFHRYNMGVEWLRIGRLEEALSSFRKAWEGLDPIKASYAHLVLKYEIRCLQALGRWEEAEAQITKGLQLYPDYTDLLHCRALTEEAFGREKQAEAALREALRLGPAPDLYHTEEGIGTYQTHYLLGLNAEKREALDEAVDCYVKAIRCKPSLTPPLYRIFRIMQAALQEEHIPELLKARFSFSTPESTWKVIHILNECGCYSSVIPMLHQLEQESPPHARKQIRVHRVEAMWKAGEWKQADRLRRKAHIPSSSSRSELMNWSMDIRSKEEAYQDPAIRLLQNKCSLSEALGGGAEQGAAADTTREEIPQLWSSFASLCQAAMNAKRQELFSSVLEGWIETVEQGLQEGEFTSVSGVNMLLHTMISAADHHLAHMSTLQREQEHRGKDWRIIQRLRLTLPWSDGH

SEQ ID NO: 3001 - protein, 499 aa, Salinibacter ruber
MLPDFALMWFRSPSCVERHEHGRRRARHCRQPVGPEVRRRRARPPGAVGRWRRPVSMDAAPALRRAERAAASLRGRGGLQRPHSPPRHNLLPLEPVGWRLELGRGGGPHLQPRADRDWRAGDDLPAGTPLRRYARRERSRHAPPKAADCRRRPGLGVCRRVRRARGDRRGWGRRWGAGRGGYGRRAVDDRRRKPGPSPQRTHPRPRRILMISVLVLTLNEEVNIADCLDSVAWADDVLVLDSGSEDRTVEIARSKGARVLHRDFDNFASQRNYGLEEGGLRHDWVLHLDADERVTPALRQALRDKADRGAHRAYRVPSKLMFQGRWLKHAGMYPTYQIRFGRREALTFTQVGHGQRGALPADQVGTLDEPLLHYAFSKGITDWVRRHNRYSSDEAEHARETQLGDVDWSALMTGDAQARRRALKDLSYALPFRPLLRFLYVYVGRLGLLDGRPGFDYAVLLAFYEYLIGLKQREHRRGGGRTNGEESADSPLETEARKA

SEQ ID NO: 3002 - protein, 253 aa, Sulfuricella denitrificans
MQQKTPLSVVIIALNAASQIEACLKSAAFADEIVVVDSGSRDDTREIALKYGARVLHQDWLGFGRQKQFAIEQASHDWVLCLDADERVSDPLRASIVEMLQAPRFRAYRMARCNRFMGRWLRHGEGYPDWSLRLFDRRVANWSEDEVHEKVLTTSPAGNVQGDLLHESQESLTVYLEKQDRYTSLQAEALARRGKQVSFGRLVASPLLRFVKFYFLRLGFLDGVPGLVHIVIGCFNSFVKYAKLHELNEKGKL

SEQ ID NO: 3003 - protein, 298 aa, Unknown
  Description of Unknown: Candidatus Woesebacteria bacterium GW2011_GWA1_39_21 sequence
MISVVINTLNEEKNLPRVLDSVKNFADEIVVVDMYSDDDTVVLAKKAGAKVYQHKRMGYVEPARNYAIEKATGDWILILDADEEIPKSLTEKLKKLVETPKSYDYFRVPRKNIIFGKWIKHSNWWPDYNIRFFKKGFVSWNEIIHSVPVTCGNGADLEVDEKNAIVHHNYSTIEQYIDRLNRYSSHQKTALLKGGYKFTWKDLIREPMHEFLRRYFQGEGYKDGLHGLSLSLLQAFSELTVYLKVWQEEKFKDEKATVENVTVVVKESQREMNYWVADTLYKIDNSLVQKIKRRFRLS

SEQ ID NO: 3004 - protein, 254 aa, Hymenobacter amundsenii
MPAVPLSVVIITFNEEANIARCLEAARPVADELLVVDSFSTDRTVEICRALGARVVQHAFEGYVEQKNFATAQAGHDYVLQLDADEVLTEELRASVLAAKTQWQGGGYTLARLTNYCGSWVRHGGWYPDRKLRLYDRRLGRWEGLLLHERYELRAGHPTPLPLAGDALHYSYTSVEQHVAQLNRFTSLAAEELWQKDKRQVSAFHLLLKPSWKFVHGYVIQGGFRDGFAGLSIAVISAWGVFLKFAKLKTRSAA

SEQ ID NO: 3005 - protein, 351 aa, Butyrivibrio sp.
MVTVSLCMIVKNEEKNLQSCLDSLKGLMDEIIIVDTGSTDSTVNIALANGAKVYDFKWIDDFAAARNFAFSKAGCDFIYTADADETMTEEGRQMFMGLKSLLTASDIPEGDDLPVDIVQMYYVGQLQGKRSVYNYDRELRPKLFRRVRGFYWINPIHEQIRVEPIVVDSDIEIIHHMDESHAARDLAIFEKMVEEGRQITPALLDFYARELYMAGNRENFEKAGDFFRNITESEESSVDDIRKASVILCKRASIMGDLQEMMKYALKEVAAGASSETCCELGDYYMKEGDPSEASLWYYNAAYEQVPVLDIRSGKGRPLMALYKCYSMMGDEKQAQMFKQKAIEECGEEDI

SEQ ID NO: 3006 - protein, 259 aa, Frateuria sp.
MAREPLSVVLITYNNADTLEACLREVDWAEEIVVLDSGSTDATLAIAARHGARIAAHPFDDYGPQKQRAYAMASHDWILNLDADEILSPGTREVIEQALESPRHAGFRLPRRERMFWTVQHRRSWRNGHLRLFDRRRGGMNDVEVHAAVEVRGPVKTLRRADFVNDGDSDIATRVEKINRYTTGMVAHKLRKRQRFTGLRMVCYPPLFFLRQYVGKRYFLSGWAGFIASVCGAFYAFLKYAKLHEARERARREDSGGLR

SEQ ID NO: 3007 - protein, 285 aa, Bacteroides finegoldii
MTDITAIILTKNEDVNIERCIKSLNGVADRICVVDSGSTDRTIEIAESLGAEVFYHEPFNHYAAQFNWALDNVDIKTTWVYRIDADEEVTPKLAVEIVAACKEHRDDDVNGFVMKFLIAFMGTFLKHGGMYPFYNLTIFKFGKGRYENRAMGEHIILSEGRILDLENDCLHYDFKGLDAWVNKHNWYATREVADYFSTRTVGQADPNTLYHEARKTSKLRDGFYYRMPKFLRAKLYFWYRYYFKLGFLDGKAGYVHAYLQAYWFRFLVDAKIMEQEIKSKQQNKK

SEQ ID NO: 3008 - protein, 286 aa, Streptomyces hoynatensis
MTRLPIVVAIPTKNEAANITGAVRSAAGHFEAIVVVDSASTDGTRELAKAAGAEVIPYVWDGRYPKKKQWCLEHVRPETDWVLFLDGDETVSGELLAELRRIFLDGRRVRPAAFDIPLGYWFGGRRLRHGHTIVKRALVDRTRARFPEPDDLAAPGMGEQEGHYQPLADPVHRLRAPIEHRDLDPVRTWFERHNRYSDWEAWLEAHPEVREQIRRAKTRQGRLFHRAPLKPLLSFGYAYLYRRGFLDGRAGLDYALAMSFYRWQIGLKARELAAGRDPGDPASGSP

SEQ ID NO: 3009 - protein, 279 aa, Streptomyces sp.
MTVLPIVVAIPTKNEAANIAGTVRSVADHFTAVVVVDSDSTDDTRALAEAEGAQVVPYRWDGRYPKKKQWCLENVRTDIPWLLFLDGDETPSPALLAELRRIFLDGRAVRPAAFDIPLGYWFGGRRLRYGHTIVKRALLDRTRARFPEPDDLEAPGMGEQEGHYQPLADPVHRLRATIEHKDLDPVRTWFERHNRYSDWEAWLEQHPDVREEIRVAKTRQGQLFHRAPFKPLLSFAYAYVYRRGFLDGRAGLDYALAMSFYRWQIALKAREAGAPPHAD

SEQ ID NO: 3010 - protein, 258 aa, Unknown
  Description of Unknown: Acidobacteria bacterium sequence
MNRLSVCLIAFNEEHNLPRALTSLAGIADEIVVVDSGSTDRTAEIANARGVSFFERTFTNHADQKNYAASCARNEWIFLLDADEELSGELRKSLMEWKHREPEFPVYEMARLTWYLGAWIRHSRWYPDFQRRLYLRNKASFSGMIHSALRFQGRAGRLSGNLLHYTIRTFAEHEAKVEGYTTVMARELFSQGKRSWRAAMWLATPWSWFQNYLLHLGFLDGYRGWLISRMAARGTWLKFKKLGELLEAERRAGGARTP

SEQ ID NO: 3011 - protein, 251 aa, Unknown
  Description of Unknown: Candidatus Rokubacteria bacterium sequence
MTRARLSVVLVTLNEEERIRQCLESVVWADETIVVDAESQDKTAAIARELTDHVIVRPWPGFAAQKNFGLAQASGDWIFSLDADEIVSPALRAEITAVLEGHGEAAGYAVPRRNIFWGRWVRHGGLYPDWQVRLFRRGRGRFVERAVHESVTIDGAVGRLRGHLEHRSYRDVADFLARADRYASLAADEWIAGGRPSRPLRDLVARPVGRFLGMYVARAGFLDGWRGFLLATLYAYYVLMRSAKIWERARR

SEQ ID NO: 3012 - protein, 253 aa, Barnesiella sp.
MRHISATIITFNEEHRIEACLESLKGIADEIIVVDSFSTDRTAEICASHGCKVVKREFPGYGAQRQFATSLTTYSYVLSIDADEVLSPALRMSIKKLKETGFDHRVYKMSRLNFYCGQPVKHCGWYPDLQIRLFDKRYANWNLRDVSERVIFPDTLRPEMIDGDILHYRCSTPEEYRQVQTRHAAITGKVLSAHLESVPAITPYIKGIKAFLDCYINKGAILDGAEGRAISREQYRSTFIAYNMARRTLKKTR

SEQ ID NO: 3013 - protein, 298 aa, Unknown
  Description of Unknown: Acidobacteria bacterium sequence
MTISVVLITQDEEANLPKTLESVMPLVRDGKGEIIILDSGSTDQTLEIARSYGAKIFSEPWKGFAEQKNSAMQKASCDWVLQLDADEALAPELAEEIHRIIEFPADMDREQRKRRIHELAYVLTARTLRQIHEITQREGSKTRDYGSFDKLSGFWIPRKNFFLGRWIKHGGFYPDPKLRLVRRGAGRFEEYGAHPTMKVDGPTGQLKHALVHNAYPTLRGYIDHMNSYSSSGAVIAQEKGHCDFSFTNIVLRPLFTFVYNYFFRLGFVDGSEGLLLHLYHSVYVSWKYAKAWEIGRRP

SEQ ID NO: 3014 - protein, 247 aa, Methylomonas sp.
MLSVIIVTKNEAENIVECLASVAWADEVIVLDSGSTDDTIALAAAAGARVIQTDWPGYGPQQNRGIASASHDWIFSLDADERITPELAKEIRSAIENEQFNAFDVPRRSWFISRFMHHSGWWPDRTRRLFKKGHARFSEHLIHANLTTQEPVGHLNNPLIHYSFRDYHAVIEKMNRYSSGSAQDLYVSGKRGSLWLALVHGMWAFFRTYCLRAGFMDGQQGLILAIANANGTFYKYIKLWELQNRKS

SEQ ID NO: 3015 - protein, 291 aa, Cephaloticoccus primus
MISVVILTLNEEGNLPRCLASLSQCDDIVVLDSGSTDRTADIAREHGARVFTNRFENFAQQRNFAHEKIPFRHPWLLHLDADEQMTPELWGECCEIAQKDLGPPGGTASATRRPPPDSPAIYDGYYVAPRMIFRGRWIPHCTDYPSYQARLVHAARFRFIQVGHGQREAPGLRIGTLRASYLHDLSAAPEPHWLAKHRRYAAGEVATHLAQRRSAPPPRLRDLLSRDRLTRRRTLQRFAFHLPFRPQLRFVYQYILRRGFLDGLPGLRYCRLLMHYERFIVEALREAKAKR

SEQ ID NO: 3016 - protein, 254 aa, Burkholderia metallica
MAELTLGVAIIAHNAAGRLAQCLGALSFANDIVIVDGGSTDDTVAIARAHGARVVLATDWPGFGPQKNRALDALSTDWVLSIDTDEVVSDELAASIRAALRAPQADVYAVDRLSAFCGQWVHHSGWYPDWIPRLFRRGTARFSDDLVHERLVFDSPAARLDGKLLHYSYDDVETVLRKLDAYSSAGARQRRAAGERASVGKAVRRGFWAFVRTYLLRRGFLDGRAGFMIAVFNAETVYYRFLKLAHDSAPSAER

SEQ ID NO: 3017 - protein, 272 aa, Unknown
  Description of Unknown: Methylobacterium nodulans ORS 2060 sequence
MTQDEPPIPLTVLMRTFNEADRIEAAIRSALPLRAEILVIDSGSTDATVAIARSLGARVVTNPWGGFGPQRRFGEALCTHDHVFSMDADEVLTPELVWEIRGIFLFGPPPALMKLRKAMALPHHDRPPPFAFCTEQIYIYDRRVARTTENPNWDHLDIRTAEKPRRLEAVAWHFTYRDWNHAVAKANYVAELAARTSEPRSRLELGLRVFVEFPFYFLRFYFLRRLFLAGADGFAMATILAFGRFLRIAKMREQAASRAVDPAAQAAADEAR

SEQ ID NO: 3018 - protein, 253 aa, Haemophilus pittmaniae
MPTISVAMIVKNEAADLADCLETVKDWVDEIVILDSGSTDNTQQIAEQYGAKFYQNVDWPGFGKQRQLAQQYVTSDYVLWLDADERVSSLLRQSIEQAVQQNLPSTAYQLPRLSSVFGREIRHSGWYPDYVVRLYRCQDGQYGDELVHEKVHLAKGTQIKKLQGDLLHFTYKSIHHYLLKSAGYARAWAEQRAAKGKKATLWQGISHALGCFIKMYFIRAGFLDGKQGLLLAILSAHSTFVKYADLWERGQKK

SEQ ID NO: 3019 - protein, 204 aa, Unknown
  Description of Unknown: Gemmatimonadetes bacterium sequence
MASPAPVTVVIPTRNEGAQIAECVGRLAWAAEVIVVDGGSTDGTRELARAAGARVLDGAVVQGPTIAHQRNAGIGAATHEWVFALDADERVGPELSAELAATVAAPAREAYAVRRRNVFLGETVRHAGWGRDWVVRLFRKNRRFVAAHGRRPRVTDLIVRPPARFVRMYFLQLGILDGWRGAMLCGLAAASVLVKYARLWERSR

SEQ ID NO: 3020 - protein, 257 aa, Unknown
  Description of Unknown: uncultured archaeon GZfos18F2 sequence
MPSVKLSVAIITLNEETNIGRCLYSVARVADEIVVVDSFSVDKTKEICIAKGVRFIENRFESYMQQKNFALWETTHDHVLFVDADEALSDELADSVRKVKNNWDADAYQFNRLTSYCGQWIRHCGWYPNRRVRLWDRRKGIWGGGELHEKVIMEEGSKVSVIAGDLLHYSFPSIKSHVQTANNFSEIAAREAVRRKKNVNFVIHILLNPAYTFVYGYIFRLGFLDGYYGFVICAISAVANFLKYSKIRQLQKSVEDE

SEQ ID NO: 3021 - protein, 254 aa, Burkholderia sp.
MAEPTLGVAIIAHNAARRLAQCLDALAFADDIVVIDGGSTDDTVEIARAHGARVIVAADWPGFGAQKNRALAALSTDWVLSIDTDEVVSDELAASIRAALRAPQAEIYAIDRLSAFCGRWVHHSGWYPDWIPRLFRRSAARFSDDLVHERLVYDGPAARLDGKLLHYSYDDIESVLRKLDAYSSAGARQRRAAGEHAGIGKAIRRGLWAFVRTYLLRRGFLDGRAGFMIAVFNAETVYYRFLKLAHDSTPPSGR

SEQ ID NO: 3022 - protein, 274 aa, Unknown
  Description of Unknown: Flavobacterium sp. ACN6 sequence
MNKIPITVIVSVKNEALNLPSCLDKLKRFDQIIVVDSGSTDDTPVIAVAKGAEVLQFKWNGKFPKKRNWALQNANLRHEWILFLDADEFVTEEFVSEVGFKTQDPTYNGYTIQFENYFMGRKLKYGYGFQKSALFKKSKGSYEKIEEDLWSHLDMEVHEHPIIEGKVGIIKAKVIHKDFKNLEHYIAKHNAYSTWEAQRYLQLKQSKNEHLSFNQKIKYSLLNTGLLPAVYFMGAYFLKLGFLDGKEGFYLARFKSHYFFQIQTKVNSIKNNIE

SEQ ID NO: 3023 - protein, 254 aa, Burkholderia pseudomallei
MAEPTLGVALIAYNAAARLAECLSALSFADDVIVVDGGSTDATVDIAKAHGARVIVAADWPGFGPQKNRAVSALDTDWILSIDTDEIVTPELAASIRAAIRAPRAPVYSLDRLSSFCGTWVRHSGWYPDWLPRLFKRGAARFSDDLVHERLVFDGSSAKLDGKLLHYSYEDFETVLRKLDAYSSAGAEQRRAAGKRGGLAKAFGRGAWAFVRTYVLRCGFLDGRAGFMIAVFNAETVYYRFLKLGLARQRKARD

SEQ ID NO: 3024 - protein, 374 aa, Sphingomonas elodea
MEPNIAYNAERGVATAPRGKVRVVRLALVMIARNEARAIARALDSARPYVDRMIVLDTGSTDDTVAIAERCGATVHKFAWCDDFAAARNAALDHSDADWNLMLDADEWLEAGFEALAPSALPSASAARPAFIGCARLRNEGAEGNTARRFLPRLLPRGVRYAGRIHEQPVSSLPLVPGALQIGHDGYAEAQLAAKHGRNLALLQAALAETPDDSYLWYQLGREHLVRGAAEAAVMPLQTAYRLTPPEAAYRHAVVLSTVRSLKEAGQLQGALALVDAEQAAWPSSPDFYFAVADLYLAWAGHAPEIAFDELLPVVEGAWLRCLEIGEQPMLDGSVIGCGSYLAAANLAMFYEQLGIQDEAKRYAALERDLRAAA

SEQ ID NO: 3025 - protein, 250 aa, Unknown
  Description of Unknown: Nitrosomonadales bacterium sequence
MQTQPFSVVLITLNAAHQLDACLQSVKFADEIVVVDSGSSDDTHAIALKHGARFIHRDWLGFGPQKQFAVGQASNNWVLCLDADERVSGDLRASIAAALQQPEFQAYHMARSNRFMGRYLRHGEGYPDWSLRLFDRRHARWSGDAVHEKVLTGSQIGTLRGDLLHDSAEDLGAYLDKQNRYTTLQAAAMHSAGRRASMAQLIFSPAVRFVRFYFFRLGMLDGIAGLVHIVIGCGNSFIKYAKLMALQKGE

SEQ ID NO: 3026 - protein, 256 aa, Unknown
  Description of Unknown: secondary endosymbiont of Heteropsylla cubana sequence
MFHKNLLSVIIITKNEAELLPACLLSVNWVDEIIVLDNGSTDQTRNIAIKAGARVFHTDEWIGFGVQRQLAQTYASSDYILMLDADERVTPSLREAIQNVLKNPKSNTVYSCTRRNLFLDRFMRYGSWYPDRVVRLYEREHYGYNALPVHESLTIGHADVVSLGGDLEHLTCRDLITFQRKQLWYAEIWAKSSFKKTNKYGIIKIIIHTISSFLRSWLLRAGFLDGKHGWILAMINAQYTFNKYTTLWALNKQNKL

SEQ ID NO: 3027 - protein, 259 aa, Biostraticola sp.
MPTAKRLSVVLITRNEAELLPDCLASVHWADEIVVLDNASADQTRQIALGQGARVYEAPDWPGFGKQRQRAQAYASGDFILMLDADERVTPELRQSIEAVLRQPAPNTVYRCIRSNWFLGRYMRHSGWYPDKVVRLYPRETYRYNDDTVHESLACRQASVVTLQGHLEHLTCRDLIAFQRKQLQYAEAWALERHRQHRHCGFLSIIGHTLGAFIKTWLWRAGFLDGKQGWLLSVVNAQYTFNKYTALWALRRSEKRDVL

SEQ ID NO: 3028 - protein, 253 aa, Polaromonas sp.
MKLSVILIVRNESVNLKACLSGVTVADECVVVEHGSDDDTVETAAALGARVIVAPDWSGFGAQKNRALDAAQGNWVLALDADERVTPKLMAEILTAITLDQADAYEIPRLTQFCGTWIHHCGWTPDRVVRLFRRGSARFSDDLVHERLVMLDGRSRIGRLAEPLLHYSYPTPASYWQKLQRYSHDWALQKQAEGRRTSIVRAAVSGVTAFLRSYFFRLGFLDGSMGFVVCVLQAQAAFGKYFELYWLNQKNET

SEQ ID NO: 3029 - protein, 409 aa, Unknown
  Description of Unknown: bacterium CG17_big_fil_post_rev_8_21_14_2_50_64_8 sequence
MGRLSLCMIVRNEQRMLPDFLASVAGIWDELIVVDTGSEDDTPRLAEAAGARVLHHLWQDDFSAARNASLAAATGDWICYLDADERCTPELAVQVRDLLEDPQAGAATVVMRNRRPDGTHRDADLLRLFRNDPDIRFRHRIHEDPSGHVQAYLERTGLAMRRLTGVVDHLGYLKNVAAAQGKRRRDTALLRRQVKGNPDDLYSWFKIMEQARYWEDRSAWRKAARGCRRRFEKADPADLARQPWADELCALLAQGLHNHPAQGLQWLDALPEELRMGPAVQLRRGMWLEEVGRPDDAEAAYTACAAAGDRAGNDTQFGLRCGMGLCRLKAGAGDVPGAWDQAVRAGRACPSDPEALLAAVMFAPSDLARADWLAGHLTAYPEAAPAVAETLKSCGLTDLAEALAATQLS

SEQ ID NO: 3030 - protein, 248 aa, Unknown
  Description of Unknown: Candidatus Cloacimonas acidaminovorans str. Evry sequence
MEQLSAVLIVKNEEQNISRCLKSISWADEIVVLDTGSSDETVNLCKALGAKVYYLDKWEGFGKAKQQAVDLASFDWILSIDADEEFSQELQKELQALKKRNFDNSAWRLKRRSYYLGKPIHFCGWQNDAPVRLFNRKKGGFNEKLVHEGIQTSQKVKSCKHYLYHFTNPTAEVHYAKMRMYGELSAKQLYAQGKRANEFIAWVRGIFKFLKMFIFQLGFLDGAKGFLLCKNSAWGVWYRYHLLGKMKK

SEQ ID NO: 3031 - protein, 254 aa, Unknown
  Description of Unknown: Chloroflexi bacterium sequence
MIPLSPPAPRLAAVILTKNEDAHIGDCIAGLRDWVDLVVVWDSGSTDATCARARAAGAAVVQRPFDTYAAQRQAVLDTLTVEWVLFVDADERAGPELAAEIRRRLAEDTAIDGYWIPRRNWIAGRETRWGGFYPDYQLRLLRRAAARYARGVHEIASVTGETAYLQTPLLHYNYRDWAHFHAKQPGYARLEAGLLAARGIRPRPHNFVLQPLREFRRRYFTLQGRRDGLHGLRLALWLAWYYGFMPYWYLLRGG

SEQ ID NO: 3032 - protein, 252 aa, Pontivivens insulae
MTRLPLSIFIITKNEEARLPRTLAAIEGWVDDLVIVDSGSTDRTLEIARDAGARVLHRDWTGFGEQKRHGEEACRNRWVLNLDADDLVTPELREEISALFAEGAPEPASYKTRQYLVYPGDEAPRGQVLDYNVIRLYHLDAARFSDHPLFDRVHAEPGTNVHQLNAPMWHFSILTYGDFAEKVVRSAAFQAEAAKRKPRWQLLIRLWLEFPLQVLKIWLTRGHWRAGWRGFAVAVIAAFGRWLRVLRLLERG

SEQ ID NO: 3033 - protein, 258 aa, Paraburkholderia caballeronis
MNHTTLGVALITRNAAARLADCLDALSFADEVVVIDSGSTDGTADIARAHGARVIVQTDWPGFGPQKNRALDALGTDWVLSIDADEVVSPELAAAIRAAIAAPQADVYAVDRLSNFCGAWVRHSGWHPDWIPRLFRRGVARFSDDLVHERLVFEGAARRLTGKLLHYSYDDYAAVLRKLDAYSTAGAQQRAAAGQRGSFGKAIARGAWAFVRTYWLRGGFLDGRAGFMIAVFNAETVYYRFLKLALLNKHDGNARGPR

SEQ ID NO: 3034 - protein, 356 aa, Intestinimonas timonensis
MATISLCMIVKNEEKVLSRCLESVAGLVDEMVIVDTGSTDTTREMALSYTNRVYDFTWRDDFAAARNFAFSKGRMEYLMWLDADDVLLPEDREVFLELKRTLTPDVDVVMMPYHSGLDEGGRSVFTCYRERLVRNLGRDLWEGAVHEAIAPFGKVIWSRAAVTHRKEGPGDPDRNLRIYEQKLARGETLSPRERFYYARELMDHQKYGLAAVQLEQFLDRGGGWIENEIEACRLLSRCRLEAGDESGALQALLDSFRYDDPRAETCCALGAYFQAREAWRRAIFWYELALTRERNDEGGGFVQPDCYGFLPCIQLCVCWDRLGRHAEAEAWNQRAGGYKPDDPSYLWNLAYFSSLS

SEQ ID NO: 3035 - protein, 261 aa, Pusillimonas sp.
MTLSVIIITKNEARHIAACLDSVSFADEIIVLDSGSTDATCDIARAKGAKVSVTPDWPGFGPQKNRALDLATGDWVLSIDADERVPPALAESIRQVIAQSENDAYLVARLSSFGGRWIRHSGWWPDHVLRLFRRGAARFTDAAVHEKVVAQTKPAVLSGHLVHYPYADMEAMVTKVNRYSTDAACMMHARGKKTSVAGIVGHAFWTFIRIYFIRRGFLDGKEGLILALTAASGSFFRYSKLYFLGRHPQGRWPDDTSHPSK

SEQ ID NO: 3036 - protein, 536 aa, Desulfotomaculum profundi
MSEGMKVSLCLIAKNEQHCILSCIESVKHLVHEVVVVDTGSSDDTVLLAQKAGARVFHIAWTGDFAQARNFGLEQAAGDWILVLDADEVLAPGSTEEFHQLLNDAEVEGYFLTIINFLGNGQEFTTDKVVRLFRNKPSYRFTGAIHEQVAPSILKATGGKGLVSAPVVIHHYGYLDAELAEKDKFSRNTSIIYRELAKNPGDPFLLYSLALEHFQRGQVAEGVRCLEWALSQMKGSEGYFEDVLVHTAIGLWGLENLQRLLDFLNNSLSMLPEQGDLLLIRGMTFLTLKQYAEAAGDLVHAFKTGSSKLFPQYKILCLAGDAFSLSGDFIKAEENYLSALRMNTRFLYPLLQLIGLIQRGHLLLDCDRLARFCPLKNKDSLWRDLLSGGGTLLALIVLLLEIYHLAVDPDQEFLLWQLSGELVSLVEKLDSLPARKPVHEYISVASREIHAYALIIDKGYQGRYFCALDKMKDLVIRLLLMFMRECCPQWRWTPRNRHLFVQWKGDMNDKKSYGGKSCQAKKSNPERISRVTGEIG

SEQ ID NO: 3037 - protein, 252 aa, Unknown
  Description of Unknown: Xanthomonadales bacterium CG17_big_fil_post_rev_8_21_14_2_50_ 64_11 sequence
MTRQPISAVVTTLNNAGTLEACLASLAFCDELVVLDSGSSDDTALIAQRFAARWQVQAFQGYGPQKQAAVNLAQHDWVLLLDADEQLTEAGRERIERELRAPRAVGYRLPRQEWLFWRWVHPLARANWHLRLFRRSHGGLNDVPVHAAPEVHGRVIDLPAPFRHFGEADIAARADKVNRYSSGMVAHKRARRVRLPGLRMLLQPGLAFLKLYLLKRYFLNGWAGFIAARLHAHYTFLKYAKVYEAQRRERDQ

SEQ ID NO: 3038 - protein, 277 aa, Unknown
  Description of Unknown: Phyllobacterium myrsinacearum sequence
MSVSVLIMTLNEEASLPACLASLSWCDDIVILDSFSTDQTLEIARKAGARIYQHKYETETRQRMYGLKEIEFKHPWVYMPDADEITPDDLRDEMLAIARDPDRPEALFRVRYKNMFMGRWVKHSSLYPTWITRLCRPERVRYERECHSRCVGDGPTGRLESHFIHYSFSKGLTAWFDKHNRYSGFEAKESLQILRDKGIPWKEFFSPLPEARRRALKELSYRIPFRPAARFAYMYLLRGGFLDGWQGYHYCRLIAAYEYMIVIKIQEQRRREHGLSI

SEQ ID NO: 3039 - protein, 259 aa, Unknown
  Description of Unknown: Fusobacterium sp. oral taxon 203 sequence
MTLTVAMITLNEEKNLERTLKSVQDFADEIVIVDSGSTDKTEEIAKKFGAKFVYQQWLGYGPQRNRAIELSTSDWILNIDADEEISPELANKIKGIKENSRYKVYKINFMSVCFNKKIKHGGWSNTYRIRLFRKNAGSYNENSVHEEFVTNQEIVKLHKYIYHHSYSDLADYFKKFNKYTTLGAIEYYKKGKKARLISIVLSPLYKFIRMYIIRLGFLDGLEGFLLATTSSLYTMVKYYKLREIYKNGSYIEGEENNGN

SEQ ID NO: 3040 - protein, 252 aa, Halomonas sp.
MTPITGIIITLNEQDNVEEAIASLAPVCDEVIVVDSGSSDDTVALAEAAGARVIHQPYLGDGPQKAFAVPQASHDWILALDADERLDDDAVAAIRELSLDDPRKAYRFKRRNFAGRHWIRAAGFYPDPVTRLYNRTTSGYLPKKAHSSVQAPEVVDVDAHLRHFTYRDLSHWMQRIDQLSTRDAWAMKERGVTPSSTRPTLHAMTAMLRKLVLKGGLLQGQDGMTVAITTAFHAYMKYAKLNELYENERADR

SEQ ID NO: 3041 - protein, 289 aa, Unknown
  Description of Unknown: Planctomycetes bacterium sequence
MISVLILTKNEEANLPHCLDAVKWSDDIVVLDSFSTDRTVDIATAAGARVFQRTFDNERSQREYSLTLPFKHSWVYNPDADEIATEQLRDEMLKAVRDGRHVAYRVRFKTMFMDRWIKHSSLYPTWVMRVFRPECIQFAREVNLTYIANGSVGRLNEHFLHMTFRKGIAAWLDKHNLYSTGEAAESVQSLRNKRIPWGDLFQTSDPVRRRAGLKELSTRVPCRPLLRFLYMYFAKLGILDGVAGYHYCRLLSIYEYMIVLKMRELQRQSLPQHTRLRMVTGAPVITAES

SEQ ID NO: 3042 - protein, 273 aa, Zavarzinia sp.
MSKTNDKDGPKAVPPLSCYIRTLNEERNIEAVVRAARRVAAEVVVVDSGSTDRTAALAEAAGARVVVNPWPGNGFQKQFGEAACSHDWVLDLDADEVVTPELAAEIAALFATGEPPLGVYEIDLTCVPPVGEPWYDFDHAFRRKLYDRRRFSMPGHKVWDQLELPAGTRVGRLRATLMHYAFRDIAHVVAKLNGYSTMGARDGKRKTKGKLLFRIWCALPFYFFKHYILRGLCRAGTYGLIIAASAAYGRWLRDAKMYEAIRIEERRAREAGR

SEQ ID NO: 3043 - protein, 368 aa, Sphingomonas gei
MAIGTAVPAKDITAMPCLALVMIVRNEARCIARCLDSVRGHVDAMIVLDTGSTDDTVAIAEACGATVHHFDWCDDFAAARNAALDYSDADWNLILDADEWLEGDVGALGRATLPPAPAPARFIGCVRIVNRTASDQPVARKFVPRILPRGVRYEGRIHEQPVSPLPMKVLPLAVRHDGFDGAQLARKAGRNEALLRAELDADPGDSYFWFQLGREHLVRGKPDEAADALMTAHRTGTPDSAWRQGVVVAALQALKRAERFDEALAFADAEHAHWQRSPDFFFAVADLYLEHASRNPGIAMVELLPIVEGAWKRCLEIGERPDLDGSVEGCGSHLAAQNLAMLYETLGIDDEAQSYAAMAAEMRERLAA

SEQ ID NO: 3044 - protein, 255 aa, Rahnella variigena
MADKKRLSVVLIARDEAGLLPECLESVAWADEIILLDSGSKDATQDVARSFGAKVFQNTDWPGFGKQRQLAQSYASGDYILMIDADERVTPELRQSIENVLKTPQENTVYSLGRSNLFLGRFMRHSGWYPDRVNRLYPSTFSYNDDLVHESLNTGSAAVVPLQGDLQHLTCRDLFAFQRKQLSYAQAWAEQRHQQGRKCSFFSVISHTLGAFMKTWILRAGFLDGKQGLILAGVNAQYTFNKYAALWALSHQLQK

SEQ ID NO: 3045 - protein, 266 aa, Acidovorax valerianellae
MPAERGGVARATLTVAVLTLNEGHRIEACLASASFADQIVVVDSGSTDDTVAVAQRLGAQVHAYPDWQGFAVQRNRLLAHATGDYIFFLDADEVMTPAFREELQAIVRSGERAVWKIRWRMVAFGHELRYLRTTSTVERLFRREMVREYVGVVHEEAVLTEPGVPRHVMRAQLLHHSRETVRGSLEKLTQYAMLGAAKRAAAGKRGGVGRGLASGTSMFVRLYVLRLGFLCGGAGFLYCLFVALEAFFRYAALEYDRDRLSESVRR

SEQ ID NO: 3046 - protein, 281 aa, Deinococcus apachensis
MNPRISVVINTLNEEHNLPLALDSVCRWVDDIVVVDMHSNDRTATVARAYGARVFLYERLGYADPARAFALAQATGDWVLVLDADEVVPAALAAQLHAIARRGDFDAADLPYQNFVGGVAVRGLGWGPTQDHHVRFFRQGQMRVTGEVHNFFHPLPGTRVLRLPYQGDNALLHFSYTDYTSVMEKINRYTGIEAQTKQGQGVRPSLLRETALPVREFLLTFLVKRGYRDGRHGLRLAVLLALYKYLREIKLDERVQRGTREDMLNRYRQLARQAIHPKDPL

SEQ ID NO: 3047 - protein, 302 aa, Albimonas donghaensis
MRPLFPPLTELSRRAAPESSVPESRRLSSPRLRPYPRPPVPDRSAAVSAPLSVFLITRNEAARLPRTLAALKGLADQVVVVDSGSTDDTLAIARAAGAETHHRDWTGYGAQKRHAEDLCRHAWRLNVDADEIVTPALAEEIRALLASDPAPAAYRAKILNLYPGRDRPRPLANDYDVVRLYHRDAGRYRDHPLFDRVETTGPVKRLRAPIHHVPFLDWAGLVAKENAYSSFQAEAAKPRPMWKLRARLLVEFPFVFLKGYFARGHVLGGWDGLIFATVIAFARWLRIAKMIEAAKARKRRGA

SEQ ID NO: 3048 - protein, 283 aa, Streptomyces sp.
MTRLPIVVAIPTKNEAANIASTVRSAIGHFAAVVVVDSDSTDDTRALAEAEGAEVVPYAWDGAYPKKKQWCLDHIRTDIPWLLFLDGDETPSGQLLLELRRIFLDGRPIRPAAFDIPLRYWFAGQRLRHGHTIVKRALLDRTRARFPEPDDLAAPGMGEQEGHYQPLADPVHRLRGPIEHLDLDPVRTWFERHNRYSDWEAWLETHPEVREEIRTAKTRQGQIFHRAPLKPLLSFGYAYVYRLGFLDGRAGWDYAWAMSFYRWQIGVKAREAGRAAARAGDGG

SEQ ID NO: 3049 - protein, 490 aa, Unknown
  Description of Unknown: Candidatus Rokubacteria bacterium sequence
MASARPTGPGCCSVSGPDPDLSRRVSDSRPREGPALRRLPALSACLIVKNEEKFLDRCLGSLGGLVDEIVVVDTGSTDRTREIAAAHRARLDEFPWRDDFAAARNRALGLAHGEWILYIDADEHVRPTSPDRLRSQLSEPGYVGHHVLLHPRPGFTPYWEMRLFRNDPLIRFRGIIHENIWPGIQAYRARHGGKLGRSDLVLDHDGYERDQDVKHRRNLPLLRKSLRRDPSKVFSWCHLAGIYTALGKPRLAEQAWKSGLAASRKRPRSGIGEDSLPYIGLIRSRLGTWRRVERLLAEALERFPQNHELQWLQGLTHMKARRHEQAIPWFGRLITAGRTGEIDRSMAYDVRLFDVLAAEGLATCHFKLGRYAESRRYFDLASKHDPDKLEYRVKQALCARLERASSNPRARVRSQADRRSLEPAHAGRSGARRPSELHAGSPGSGRASSRPVQAALRRRASAPSASLAARSRRQRRAGPGSRGPAARRRR

SEQ ID NO: 3050 - protein, 254 aa, Desulfuromonas sp.
MNFKKNQQQKISAVIITRNEQQNIERCLNSLDWVDEIVVLDSGSTDKTKTICRQKGCRVISAQWVSFGSNKQKAVENASYDWILSVDADEQVSPELKNRIRELLVKPTYSAYRIKRESFYLDRFIRYCWKNDYPVKFFNRQKAAFNSQQVHETVDLCGELGVIEQPLYHYSYLSISSHLLKMDRYSQITSEVMKNEGKRVNLFSVFLRFHLMFLKMYLLKRGFMDGKWGLILSFNSAYGVFLKYLKLWVSQNQN

SEQ ID NO: 3051 - protein, 273 aa, Spiribacter curvatus
MGQALPLSVAIITKDEEANLPRLFDSLERLEPAEVIVVDSGSTDSTVAIARDYGAQVIETDWPGHVEQKNRALSACHQPWVLSLDADEPISPELADNLRDLLAKNNAPQRNGYEISRLTYYLGDWLRHVWYPEWRLRLVRRGMAKWTGYNPHDRLEVEGATGRIDGDIHHYSYTGVEDHFRRSIDYAKIGAEALSARGKPFRWHKMIFSPLARFIRLLIFRQGWRDGWRGWIIAWSSMFSGFLKYAFLYEMQRQQRKFGTGTNGTTDRDGSHG

SEQ ID NO: 3052 - protein, 261 aa, Unknown
  Description of Unknown: Betaproteobacteria bacterium HGW-Betaproteobacteria-10 sequence
MPASRQPLSVVIITLNAASQLEACLQSARFADEIIVVDSGSTDDTQALAERYGAKVMAQDWLGFGRQKQFAVEAARHDWVLCLDADERVSPALQASIEIALKTASTAENATPAFRFPRCNRFMGRYLKHGEGYPDWSLRLFDRRQARWSDDAVHEKVITQAKIGELSGDLLHDSAESLASYLSKQNRYTSLAADAAVAAGKRASFGRIALSPLIRFIKFYFIRQGFRDGLPGFIHIAIGCFNSLMKYSKMLERQNSDTTLR

SEQ ID NO: 3053 - protein, 253 aa, Unknown
  Description of Unknown: Desulfobacteraceae bacterium sequence
MNEEDRIETCLKSVAPIADEIIVLDSGSTDRTRDIAGNYTDRVYETDWPGYGPQKQRALEKASCEWVLSIDADEALTPALRDEIDQVLSTRPVEVGFNLPWAPVILGKTLGYGRSARAPLRLFKRAGARFTDARVHEKVLLPRGKTRKLKGRLLHFTHRDFRHALYKNAEYAWLGAVQRHEAGKRGMGLFGATIRAILEFFQIYILRGGFLDGSVGFLMAVLYSQVTFNKYAGLWVLYRQDKLKPPAQNEQQE

SEQ ID NO: 3054 - protein, 299 aa, Parapedobacter koreensis
MISVLILTKNEEQDIAGCLSSVSWCDDVHVLDSFSSDDTVDIARAAGARVSQRAFDGYASQRNAGLALPFKHEWVFILDADERAPQCLFPILREAVLAADDRIAGFRLRRRDFYNRRWLKHAQITPYYIRLVRKDKAHYYREVNEVLQIAGEVGELPAYFNHYPFSKGMRHWLKKHNRYSTMEAMRWIEEHDGNIKFSIKKALFSKDFSEKRYHQKGLFYKLPARPLIKWLYIVFFRLAILDGRAGLTYATLQAIYEYFIRLKTKELLRADKRLNGSLWAAQEMEDRRSVPNTLLMERI

SEQ ID NO: 3055 - protein, 263 aa, Acidipila sp.
MPETLSVATIAFNESANIARTLESVKWADELIILDSGSTDNTVAIAESYGAKVYVNKPFPGHGEQKNVAIDHCTSDWILLLDADEVITPELAKEIRQVLAGPAKHDAYWIPRLNLIFGRWIRHGGFYPDRKLRLFRRGSARLSEGVGPHSTPQFAGTPGILKGDMLHYAYPTLPLYLEHMNRYSTEMGRLAAAKGKTSRSLFAFLWNVVLNPVATFTYNYFFRLGFLDGREGLLLHLYHSGYVSWKYAKAWESARKASKQSGV

SEQ ID NO: 3056 - protein, 358 aa, Brevibacillus brevis
MLRITLSIITKNEEAKIKRCLDSANVIVDEIILVDTGSTDNTKQIAIECGAKVYDFPWTGSFADARNYSLEQATGDWILVLDADEYLAPGSADAIKEFISGPPAIGRISQLSNYLDNGEIRYESVPISRLFPKGVYYTGSIHEQVVSDLPHRMTSVTVYHDGYFETDKTGRNIPLLEKELQKDGNNPYLLMQLAREHKNKQDYVQADYFFSQAYLYATKLEGYYPKLVVEYLYNLMKIGKLDTGYTVIQAEQNQDQLSNFPDFHFALGMFYMDYVLSNTAAHIDKLPRIEASFHKCLELGDRKEFGGIIGAGSFLAAYNLGVFYEVIGDHKKAVEYYHFSAEHDYQKAKERLSSLING

SEQ ID NO: 3057 - protein, 322 aa, Unknown
  Description of Unknown: Candidatus Eisenbacteria bacterium sequence
MAAPRGTARRDRGSGPGLPPLQRDGLPLGRGSVFALHAGRDDGDGDRGVPRAAPRTGRERRLSAREAGSAREPLSVLVTTKNEERTIRACLESVRWAEEVVVVDSGSTDGTLPIARSIADRVVDHEYENPAAQKNWALPQLRHTWTLILDADERVPPPLRSEIESVLADAGREDGYWIYRENHFYGRPIRSAGWQRDKVLRLFDRTKGEYRPTMVHEEMVLRGREGFLRERLVHEPYRDLDQYFEKWNRYSRWSAEDLRRRGVRASGSRLLVRPWLRFLRMYALEGGFREGRRGMVLCWLAAFSVFTKYARLWEAETRDEER

SEQ ID NO: 3058 - protein, 260 aa, Polaromonas sp.
MAYPPRLTIAVLTKNEAQRIERCLRSAAFADELIVVDSGSSDDTVALARALGAQVFVHADWQGFAVQRNHLLAHAHGDYIFFLDADEEITPALQQELCAAVQSGARAVGCIRWRVVAFGRELRHFRSQAPVERLFPRDRLQRFEGAVHEHAVLAGEPLPRHALRTPLLHYSRDSVRASLEKLTQYAMLGAAKRARAGKPGGIGAGMVYGVSVFIRLYVFKLGFLGGGAGFLFCYFIALECFFRCVAQRYDSASLTDAVGR

SEQ ID NO: 3059 - protein, 625 aa, Hydrogenibacillus schlegelii
MEDRPRRSGAMLLGVHILAKNEAARLPAALESVREIADEIIVIDTGSTDGTPEVARAFGARVLFVPWQDDFAAARNSGLEAARTDWVLVLDADERVVAGRRVLRSLIRETENEAFTVEIQNAIGSDPWARVVFRPVRLFRPSAFGGLRFLGRIHEQLVTPDGRPAPFRPAASPLVIEHVGYRPDVLREKGTAERNARLLARCLEERPDDPFYRYHRGITLVQLRRLREAAAELERALETAPKSAPYRPSLVRTLSLVYEGLGRPERARTLLQAEAPDVEGQPELWHLLGESFLAAGWVRPAEAAFRAALAAALRADPSDDNVRTFGVGGFRTRTRLTEALARQGRWAEAMEALRAALLERPDFAPARRLLEALVEPPALPGRPADRASQGGRREQDAAPEAARASPAPEAAGRRPKTAAEAWAMYRAGAVRPAAEFFLESLGDGTLTAEGAYALGELLYERGHGAAAEAMFVRAIALAEAAEGRRRVLQADESGGDVPPAADKGPGGAGEGAFGPAGLSDRARVGAALSRLDDLLAGVARALRRADERAASAVRRAEEGRDGSSPGPAAVVRRWTAAEAALRRMHHRLAEARTALAGLPWRVRMIGDRGGSGEGTRRTEGAEGAD

SEQ ID NO: 3060 - protein, 281 aa, Aeromonas salmonicida
MGANSSMPRQPGANKSLQPVKKPTLAAVLIVKNEADNLKACLASLDGLVDEIVILDSGSQDETPAIAAEFGARFFVNTVWPGFGRQRRLAQSHVQSEWVLWLDADERLTPELKEAIATVMANPASDTIYSIPRLSWVFGRFIRHSGWYPDRVLRLYPKALTRYNEVLVHEKVEVRANMQIVNLHGDLLHYTYRDLEHYLVKSAGYARAWADQRTARGKKGSLGQGLVHAVGCFLKMYLLKAGFLDGKQGLLLAILSAHSTFAKYADLWIRQQPQAPDQTGS

SEQ ID NO: 3061 - protein, 265 aa, Unknown
  Description of Unknown: Desulfobacteraceae bacterium sequence
MSKNKNYTLSVILIAKNEEDRIERCLRSVAPIADEIIVLDSGSTDRTKEIAQQFTRQVVETDWPGYGPQKQRALEKATGDWVLSIDADEELSPELCEEIQETLAAGPSEAGFKLPWAVRIFGATLNHGRSGRAPLRLFRRTGARFTDALVHETIVLPKGKIKTLKGRLFHYTSRDFGHYLEKNRQYAWLGARQRHEKGKKGLGLTGAALRAIWTFFLIYVIRLGFLDGRVGFLVAVMYGQSSFNKYAGLWTLRQVGASENKSEQP

SEQ ID NO: 3062 - protein, 257 aa, Jonquetella anthropi
MTVKLSLFILAQNEERRLPRTLQAVAPLADEIVLIDSGSTDRTVEIAEQFGARVIYHPWKDVGDQVKLGQDQCSNDWVLLLAADEVLTPELQQEIRKIKEHPDCDGYKLRICDVFPGTRPNRWVKHYKLIRLYNRRKFTMAGRIGHDDVDPLVPDATSRVLHGLVAHYSQLSISHTVGKYNLATDRRVNECERKGVHYSPWRMVGALSGNFLRVYFLDRFFLLGWWGFIHSVRIGHMRFLKFAKWYERGHSAGWFDS

SEQ ID NO: 3063 - protein, 262 aa, Halomonas sp.
MATITGVVITLNEAANIEACLASLANVCDELIVVDSGSTDATCRLAEQAGARVIAQPYLGDGPQKNVGPAQASNRWVLSLDADERLTDEAIKAIRGLELDNSEQEAFALRRRNYLGSRWIKTCGWYPDYCVRLFDRERTAFSDSRQHASIPASNATRLDADIDHYSFANLSELFTKASGRFSSRAAKIMYLKGKKANALSPFVHGTNAFVRKYVFQRGFSSGLDGMSVALSAAVNAYLKYAKLLELQRDSQVREAEDFDRIW

SEQ ID NO: 3064 - protein, 257 aa, Thiomonas delicata
MDSPISAIIITLNESKNISECIDSLRWCREIIVVDSGSTDDTVARARDAGARVHITEDWPGFGVQKNRALALATQPWILSIDADERVSPALAREIQMAIAENNRFDAYAVPRLSSYCGQYMRHGGWYPDVIVRLFRRGKARFSDALVHESVQVQGTIGRLHHHLYHESFHDLEQVLVKLNVYSTSGAQMMLRDNRSSGVLTALVHGWWTFIRCYVLKLGFLDGRLGYVLAMSNAHGAYYRYLKLWLINKKRSQEKQG

SEQ ID NO: 3065 - protein, 278 aa, Xylophilus sp.
MQPLHGDRAGGVDRPTAAARTPTLSVAVLTRNEAHRIRECLDSAAPIAHELVVVDSGSTDGTMAVAEAAGARVFSHPDWQGFAVQRNRLLAHCTGDYVFFLDADEQMTPALRDELQAIVQSGARGVWKIRWRMVAFGRPLTWYRAQSQIERLFPRELLREFTGVVHEEAQLRGEPLPRHLVRAPLLHHSRETVRGSLEKLTQYAMLGAAKRAALGKRGGVLRGLASGLSMFFRLYLLRLGFLCGGAGFLYCLFVALESFFRYAALSYDRAHLTGQVVR

SEQ ID NO: 3066 - protein, 279 aa, Unknown
  Description of Unknown: Kiritimatiellales bacterium sequence
MAGVSVLILTKNEETNIERCIDSVSWSDDIVVYDSLSDDRTVELAEKLGARVVKRKFDNWSAHQNWGVENIDFKHPWVYYTDADETCDDQLRAELQNLPETGEGFSAFQVRRKDYFMGRWLKRSQLYPTWITRVFRPDKIRYERLVNPVAVVDGATGKLEGHIIHYPFSHGVGHWFDRHNKYSQMEATDLVEEVAAKVGFGDFFSRDAATKRRALKTMAYRMPGRPVLMFGYLYFFRLGLLDGLPGLRYSIMRSMYEYMIDLKVAEIRYKEQMNEGEML

SEQ ID NO: 3067 - protein, 362 aa, Ralstonia solanacearum
MRRQPKPGRRSEIALVVIARNEAGCIERCLRSAKPHVDRMIVLDTGSTDETIAMAEACGARVHRFTWVDDFSAARNAALQLADADWNLVMDADEWLESGASELREACTFGPLLGVVCVQSLDDTGGAVQRTNTWIPRLLPRGVHYQGRVHEQPVAPLRRVRLPLVFGHDGYVSAKLDKKRGRNAALLHAELAERPDDPYVLYQLGKETEINGKDPARAADLYALAAAGAPASAPYRHDACIRLLLCLRQSGRLEEAISRAGEWMDAWSASPDYFFVLGHLMFDAAVRHPAQAAEQWLPMAEHAFLRCLAIGDQPKLDDSVFGRGSFAAAENLAVVYRAQNQPSKADEYQALSQRLRAQPTAR

SEQ ID NO: 3068 - protein, 290 aa, Streptomyces sp.
MDKLPVVVAIPTRNEARNIAGTVRSVIGHFAHVVVVDSGSTDDTRALAEAEGAEVVPYTWDGRYPKKKQWCLDHVHPEVDWVLFLDGDETPSEELLREIRRVFTPPPGRTVRPAAFDIPLGYWFAGRRLRHGYTIVKRVLLDRTRCRFPEPDDLAAPGMGEQEGHYQPLAPTAVRLAAPLEHRDLDPVRTWFERHNRYSDWEAWLEGRPRVREQIRQAKTRQGRLFHRAPLKPLVSFAYAYVYRRGFLDGRAGFDYALAMSFYRWQIGLKAREAADPPGAGTGSGARGRR

SEQ ID NO: 3069 - protein, 253 aa, Gayadomonas joobiniege
MTVKPISVYFITLNESATIAEAIQSVQAIADEIIVVDSGSTDNTVEIAESLGARVIKQSWLGFSAQKSFAMKQCRNDWVFNLDGDEIVPENVNKEIMQLVASDCCDAIRVNFEDIFMQQPMHKKSHKRSIVRVFNRHKVRYPQDRLVHENVIVEGKVAQINGCIIHHGYADVGNLMAKQNKYSSLSAKEKYKKGKKASLLKLFGVFPVMFLKEYLIRKMFLSGVRGFVHAMISAMYAFLKEAKLYQAEKTKRR

SEQ ID NO: 3070 - protein, 251 aa, Fluviicola sp.
MKITATIITFNEERNIERCIRSVEGLADEVIVLDSLSTDRTQEICKSLGVRFESRAWEGYSESKNYLNSLVTTDYILSLDADEALDPTLRAEVLKVKTDSKPQIYSVNRLTNYCGKWIKHSGWYPDVKARLFPKEGSYWDGAIVHEELIFPEELKIIQLDGHLEHYSYYSFEDHRARADKYSSLTAQKMHQAGKTASVLKPYLSALGRFVSMYLLKAGFLDGKMGFKIAQISAQSNVFKYKELRRLNRENH

SEQ ID NO: 3071 - protein, 267 aa, Desulfovermiculus halophilus
MTPHPLPLSLAVIVLNEEQNLQRCLQSVSGLVSEIIVVDSGSTDRTVAIAEEFGARVFYNSWPGHVAQKNYALSLCSQPWVLSLDADEALSDQLFASIQSLFAHKEQACAGYWLNRKTFYLGAWIEHAWYPEWRLRLAKRDTAAWQGTNPHDKLVVHGSTSSLSGDILHYSYTDLNDHLKRTIDYGRIGAEAALDQGKRFHCSQLLFSPFGRLVKSLLFKQAWRDGWRGWIIAVSSFLTCFAKYAFMFEHWATREKEASCPRLEEKY

SEQ ID NO: 3072 - protein, 277 aa, Opitutus sp.
MADSPPVSILILTLNEEKKLPACLAAVARFDDIVVLDSGSTDRTAAVARAAGARVFVNPFRDFASQRNHAHETIAFKHPWVLHLDADEIMMPELAAECTTLDPAAPLDGYYIAPRMMFHGNWLRRCTDFPAWQARCVRARGFRFIQTGHGQREAPEMRMGRLAGNYLHDISVDDIAEWEARHQRYARQEASQFLAAPETLGQTLQKLLAGAPLARRRALKRLSYHLPARPLMRLLYQYVLRGGFLDGAGAWRYCLLLARYERIAAAEIKRQRAAGHG

SEQ ID NO: 3073 - protein, 335 aa, Lachnoclostridium pacaense
MADITAIILTRNEEENIKACIDSIQGVVSRIVVVDSYSADKTEEVARSCGAEVYKNEFFNYAKQYKYAVDIAQVKTVWILRIDADERLTEESAEELEHLCNVNTNTDVEGIILRFCNEFMGKSLKHGMHYPWKKLIVYKTGKGDIEDRYMDEHIVLNGTKKIVEAKRDSLHLAYRGLDYLVNKCNWYSTREVMDYYDEKDLRSDNTSIRTWIKMSIYYKLPMGLRSWAFYIYCYYIRLGFLDGREGKIYAVIKAYWYRFLVDAKIYEHEKLKKELKPTGALNDMSNPGNWHGDRKNGNVEDVGIGGGGHKGTFRIAYSRSVLYPFIIREVQCGTC

SEQ ID NO: 3074 - protein, 260 aa, Prosthecobacter fusiformis
MPYPISIAIISKNEQANLRRCLASAAGLAEEIVIVDSGSTDATAEVAAEFGARFVHQDWLGYTDQKNLCNSFCTQPWILALDCDEELSPELQQGIAAFFESGDSAIYDAAWMARCVWFLGRWIRHGDWYPDKKVRLFRREKGQWQGHDSSQVHERLVVQGPHTTLRGDLYHYSFTGMRHYLDKHLSYTEVFADHEKAGGRGWSLVDAVFRPWWRFFRAYFIKAGFLDGFPGLWIAIATAFFTFMRYSRAYEGQVAQKPRD

SEQ ID NO: 3075 - protein, 284 aa, Magnetofaba australis
MSLITAQERPAGLSAIIIGRNEAANLPRCLGALGGVVDEIVYVDTGSTDDSAQIAESSAARVFHRPWDDDFSAAKNHAIAQAKFRWLLSLDCDEELVPHSATNLILKEWRANLDSPGAIVRIENIMGDSAQRVPQNALRLFLNDDRIRFQNPIHEDVSGSIYRHWPQTPLPRLPITILHHGYAAGRNQEKLQRNMEILGKWADAEPDYPFAQYKYGKNLLHVGRAQEAWRYLQRAVTLINNDAQPATYAFLDALVEDYREAAQLLGIKEKVPLRLIEALRLQDR

SEQ ID NO: 3076 - protein, 279 aa, Unknown
  Description of Unknown: Planctomycetaceae bacterium sequence
MSCTHSLTAVILTKNEEGQVTRAIESLRFCRRIIVLDSGSTDSTQLMAEAAGAEFVVHVPEPPFRISQQRNWALAHLEIDTEWVLYLDADEVVPEALAKRLTGLAADANVALDAYELTPRYLFWGKWLRRTQGYPNWHPRLVRHGRADFAGGVWEHFTEGTRVGKIYEPYDHYANSKGLRDWLDRHYRYAAWDAERIIDALESGNPEALGTTRKRWLRRLAARFWPLRPFARFLQMYIFRLGFLEGWTAFNFCLLYFCYEVMTINLIVENRRRRAGKDL

SEQ ID NO: 3077 - protein, 372 aa, Ralstonia pickettii
MSKHAKHHAKPAKGSLALVVIARDEAACIERCLMSAKPHVDRMIVLDTGSTDDTVAIAKACGAQVHHFTWVDDFSAARNAALAAANADWNLVLDADEWIEAGTEELRNACTFGPLLGVVCIRSEYDISGHVEHSNSWIARLLPRGVRYKGRIHEQPVATAANLQRVRLPLVIGHDGYMNAKLDRKRGRNHTLLQLELAAHPDDPYVLYQLGKDFEINQKDPAEAAAHYQRALAMAPKVAPYRHDLCICLLACLSKSKQLDAAITLAGEWMEEWSGSPDYFYMLGHLMFEAAAQDPAQAEKQWLPMAENAFLKCLEIGEQPKLDAAVFGRGSFAAAKYLALTYRALADTLAIKSNQYSDIARQMQERSAAVAA

SEQ ID NO: 3078 - protein, 754 aa, Alicyclobacillus acidocaldarius
MLLSACLIVKNEAHVIERCLKSLEGVADEIIVVDTGSTDDTPRIAAAFGARVYQAPWTGDFGEARNRSLQHAQGDYVLVIDADEFLPQEDGKRLRRAIEAGEADAYTVDLVNYVGSVARFVRAPGVRVVRVFRRGFTYQGTIHEQILPQIAARGGRVQVLDVELHHLGYLAEFVAMKGKPDRNLSILKQVLDQDPENLFHLTNLMAEYARINQPERVIEVGERAYAIAASHLVTEPHLVLRLYRMLAAAYGDIGDSNRLERLASEGEQLFPSIPDLPFIHGVYEMKQGRWHKAIRLFERCLEIGPVRSEIVDTIAGAGSFVAAAKLGELWLLEGDVERARDYFVQSLRANPRQEGVFFFLASLLPLGEPPVWSQLWRAAEHDPVCLAYLAIAGAMWRQDWVWSALNEIDHTPVTSPILAKLRASGVALGKLEPSSFPDEPAAKLEQRWFEALLAINRREGDLARSLLQDQPERLAQLEPWLSGGTPLHIGPLLDELLLVRAHRLLLQSLPQAADRDEVLSRVLASPLRDMLHHVAWRGERGWECDFLATAAFHRRDIATSLEWLERGLAYEPTVRRAVMEADLALAHRNVDHASTVVRQARAWFPSSDILRHIEERLHVTERQARSLDELLEEGTTMHPHRAYQMSVATMPLKVKIVKLHERAVECVDQVMELVKQGDIMGARTYIQYVQDIITFLRSNLDVSTEAGKAANASYGYFYKMLVGWFLQPARVAEEYQEMRQFWQSWADTWAKVQA

SEQ ID NO: 3079 - protein, 254 aa, Unknown
  Description of Unknown: Gammaproteobacteria bacterium sequence
MSENRISAVIITLNEEKRIKECLESLDFVDEIIVVDSGSSDNTVNICLKMGARVVSQEWLGFGAQKQFATEQSVNDWVLCLDADERISPELKSSILDAINNSKYSVYKMPRRNIFLGRWLAHGEGYPDYNIRLFKKDSAKWSNDPVHEHVVTNNETGTLKGDLLHNSEDGIADYLNKQNRYTSLQAELLFTSGKKIGAAKMVISPLVRFIKFYFFKRGFLDGIPGLIHVVIGCVNSFTKYAKTIELQRQQDNDK

SEQ ID NO: 3080 - protein, 341 aa, Butyrivibrio sp.
MVTISLCMIVKNEESCLEKCLKSLEGIVDEMIVVDTGSTDRTKDIAKACGAKVLDFTWTGDFSDARNFAFAQANCDYIYSADADEELDEENRQRFMELKADLSELDIDIVQMYYCNQLQYRTVYNFDRELRPKLFKRVRHFVWEDPIHEQVIVDPVICNSEIEIIHRPKENHAGRDLETFRRTIAGGRRLSKRLHGMYARELFMAGTDEDFLKAKEFFTASALDTTRGLDEIKEASCVLAHIAVIEDDLAALLKYTLKDAITEMSSEMCYELGDYYFGKKDIDEAIVWYYNAAYECSSILDIKKSGSLPRLALAKCYHELGNEEQARDYEREASEVEENTD

SEQ ID NO: 3081 - protein, 250 aa, Pusillimonas ginsengisoli
MTLSVIIITKNESAHILDCLESVAFADEFIVVDSGSTDNTVELARNFGARVEVTPDWPGFGPQKNRALDLATGDWILSIDADERVTPELADEIKEVLANPSMQACEIARLSDFCGRFIRHSGWWPDYVLRLFQRGSARFSDVAVHERVVLNTGAPRRLKYHFLHYPYANLDALITKVNRYSSDAAAMMYARGKRATVFSAIGHGFWTFVRIYLIRRGFLDGRHGLVLAVTAAAGSFFRYAKLSFMSGPKQ

SEQ ID NO: 3082 - protein, 276 aa, Unknown
  Description of Unknown: Candidatus Competibacter denitrificans Run_A_D11 sequence
MANKPLSVFVTTYNNGRTLPACLESVKWADEIIVLDSFSTDDTLVVARRYGALISQQMFIGYGPQKQSALTATTHDWVLLLDADEALSPDLQKELRQVLADGPVADGYEMPRQEQMFWRMYHPGTRMNYYLRLFDKRKGLIDDMPIHAAPKIQGSVTRLSSPLYHYGETNIHTKVEKINAYSSGLVADKVRKHRWGIRLIMIVYPPLFFIRSYLFKRNFLNGWAGLINSVIAAFYVFLKYAKLYEHYQFAKYGKGLLPDDAPPLPGEYQPGTGEET

SEQ ID NO: 3083 - protein, 262 aa, Labrenzia alexandrii
MTQRLPLSAFIIAKNEADRIPAAIKSVIGWVDEVIVIDSGSEDETVAVAESLGARVVFNEWPGYGLQKRFGEDQCRNDWLLNLDADEEITPALAAEIKTKFDDQSYMASDAWRIMIRDTFPHETEPASWAYGYNQIRLYDRRKGRFSASTVHDTVRPQEGATLGDLKGIMAHRSDRSLEFSVGKYNRYSDMQVQDMLDRGRKIPRYRLLTEFPVSFLKGYFVRKYRKYGWWGFILAMNYAHGRFLRVAKAYEAELLRKTGRK

SEQ ID NO: 3084 - protein, 261 aa, Unknown
  Description of Unknown: Chloroflexi bacterium OLB13 sequence
MTRLTAVILTFNEEANIAECLASVVFADARVVFDSGSTDRTAEIAREAGASVIQRPFDNYANQRNAALESVAGSSAWVLFVDADERVTPALAAAVRRAVNQGDAYAGWRIARHNYIFGKLTLGAGWYPDYQTRLLRCGAAHYDPERKVHEVVLLDGPLGTINEPFVHINYTRFDQFVAKQQRYTAYEAGILYEQGVRPKLRNFILQPLRHFRWRFITLKGYRDGLHGLRLSALMAWYELRKYQLLAALWRDHDRRSASDPQ

SEQ ID NO: 3085 - protein, 294 aa, Ochrobactrum sp.
MSVSVLIMTWNEEVNLPACLSSLDWCDDIVILDSFSDDRTVELAKAAGARVFQRPYDTEDRQRMYGLTEIKFKHDWVYTPDADEITPADLRDEMLAIASDPTRPEVFFKARYKNMFMGRWIKHASLYPTWITRLVRPDRVRFERSVHSRASGGPEGALQSHFIHYSFNKGLEAWYDKHNRYSSAEADLSSNRLLERKIDWGGIISTAPERRRRALKSLSYHMPFRPSLRFLYMYLVRRGFLDGKPGYLYCRLLAAYEFMIVIKMEERRRNQSVKLDSAPVRHDLENKEPERHMV

SEQ ID NO: 3086 - protein, 289 aa, Unknown
  Description of Unknown: Acidobacteria bacterium sequence
MISVLIPTKNEVQDLPCCLNSVAWSDDIHVYDSGSTDSTVDLAKSMAARVTVRSYAPGQPAFGGDESAHQNWALQTIPFKYPWVLHLDADERVTPDLAASIRQAVENPGKNVAFRIQRRDFLHGRWLKHVQASPFYLRLFRPEKMRYERLINPVSIPDGPVGRLSGYLDHFPFSKGMRHWLDRHNSYSTLEAQQFIMNRASHSSFSLKQALLAKDLNNRRFHQKELFYRLPARPLIKFLLLYFGKRGFLDGDAGMTYALLQSFYEYMIVLKTRELEGSAATQDAAGMSA

SEQ ID NO: 3087 - protein, 353 aa, Sphaerotilus natans
MRPKPARLYRIALVMIVRNEAAGLKRTLDSVRRHVDRMVVLDTGSSDRTREIARAAGARVADFAWCDDFSAARNAALDLAGADWHLVLDGDEWLSEGTQVLAALRTCKPDFVGALRVDSLHALEGGEPGGEAVASSWISRLLPGTVRYRGRVHEQPQHALPVRRLPVTIGHSGYRPEALARKADRNARLLQREIADRPDDAYLWYQLGKDHDVHGRAAAALDCFARAETLQPCGPEAPGWTHDLSVRRLHALKCAGRHAEGIELASAQMALWSDSPDFFFALGDLMLDWAAREPRRAGELLPMIEGAWTRCLEIGERPELDGAVHGRGGELARHNLELLRSLRAELAPAAQPG

SEQ ID NO: 3088 - protein, 251 aa, Unknown
  Description of Unknown: Gemmatimonadetes bacterium sequence
MASPAPVTVVIPTRNEGAQIAECVGRLAWAAEVIVVDGGSTDGTRELARAAGARVLDGAVVQGPTIAHQRNAGIGAATHEWVFALDADERVGPELSAELAATVAAPAREAYAVRRRNVFLGETVRHAGWGRDWVVRLFRKNRRFVERKVHEALEPVPDVGRLAAPLDHVPYRDLTSYLQKLDRYTAWAAEELAAHGRRPRVTDLIVRPPARFVRMYFLQLGILDGWRGAMLCGLAAASVLVKYARLWERSR

SEQ ID NO: 3089 - protein, 261 aa, Unknown
  Description of Unknown: Vibrio sequence
MSKATIGVLMIVKNESKHLASCLETVKEWVDEIVILDSGSSDDTETIARQFTDKFYTNTDWQGFGKQRQLAQSYLTTDWVLPLDADERVSDELKASILDVLKQNPHKTVYTLNRLSHALGKFIRHSGWYPDTIVRLYRRNEVQYNSALVHESVEVPNDFTRKHLNGDLLHYTFDSLSQYTNKTALYMKSWADQREGKKKVGITSAILHGFFRFFKMYILKRGFLDGRHGLLLAILSANTTFTRYADLWIRDYTKQKSDKQS

SEQ ID NO: 3090 - protein, 256 aa, Polaromonas sp.
MASLSVTVITKNEAHNIEACLRSVAFADEVVVLDSGSSDDTVQKALAMGAIVSVNTDWQGFGQQKNRALALASSDWVLSLDADERVPPQLQAEIRAALGAPSFDAYSFPRLSSYCGQEILHSGWYPDRITRLFRRDSAQFSNDLVHEKILTTGTIGQLQSALQHASFTSLEAVLDKVNRYSSAGAQALLDKGRNASLCKALGHGLWAFVRTYFLRLGFLDGQMGLVLAISNAEGTYYRYLKLWLLRRNRREVLGTP

SEQ ID NO: 3091 - protein, 366 aa, Sphingomonas sp.
MPSEAPHRRRGKVHVVRLALVMIARNEARAIARALDSVRPHVDRMIVLDTGSTDDTVAIAERRGATVHSFAWCDDFAAARNAALDHSDADWNLVLDADEWLEGGFEALSPAALPPATKAPAAFIGCAKLRNEGVAGTVARRFLPRILPRGVRYAGRIHEQPMSPLPLVPGALCIGHDGYAEAQLAAKHGRNLALLQAALAEAREDCYLWYQLGREHLVRGAAEAAVEPLQTAYRLTPPGAAYRHAVVLSNIRALKEAGRLHDALALVDAEQAAWPASPDFYFAVADLYLEWASHAPELAIDELLPVVEGAWLRCLEIGEQPLLDGSVVGCGSYLAAGNLAMFYERLGILDEAERYAALERELLAAA

SEQ ID NO: 3092 - protein, 274 aa, Unknown
  Description of Unknown: Verrucomicrobia bacterium sequence
AFTAVVLTKNEAPNLVRCLATLRWCEEIVVLDSGSTDGTAVQARALGARVCEHVPPPPFKIDEQRNWALDHGEITTPWVVFLDADETIPAELARELEAVGGAADGPFDAYELTPRYLIWGRWLKRTQGFPNWHPRVVRLGHARFAGGVWEHFTAGSRVGRIAVPYDHFANSKGLSDWLARHDRYSTWDAGKIVAFLDSGEDGAFGSTRKLGLRRWAARFWPVRPWARFFQMYFLRLGFLEGRAAFAFCLLYFFYEWMTVVKIVELRRQRKGLPL

SEQ ID NO: 3093 - protein, 279 aa, Unknown
  Description of Unknown: Verrucomicrobia bacterium IMCC26134 sequence
MATKSHLTAVVLTKNEVANLPRCFASLGWCSEILVVDSGSTDGTQAEAERLGARVLVHVQPPPFKISEQRNWALTEGGINTPWVVFLDADETIPENLAHELIRVAGDPDNELDAYELTPRYLFWGTWLKRTQGYPNWHPRVVRCGRTHFEGGVWEHFATGAKVGRVDIPYDHFANSKGLSDWLARHDRYSSWDAEKIVKYLESRDDASFGTKRKLALRRWAARCWPLRPWARFVQTYVFRCGFLEGRAAFTFCLLYFFYELMTVVKVVEIRRKKRGLPL

SEQ ID NO: 3094 - protein, 275 aa, Unknown
  Description of Unknown: Planctomycetes bacterium sequence
MSAKLTVLIPCRNERRNIRACIASVQGLADEILVADSLSTDDTLDIVRSIGGCRIIEREFVGYADFKNWAIPQAAHPWVLIVDADERVTPELAAEIRAILADPPEHLDGYWIGRENYFLGHRIRYCGWNSDAVFRLIRRDVCRYRQVRVHEEIDVDPRRAGHTRANLAHYTYWTFDQFFAKHVKYTKLGAEDSWDRGRRTGFFGLAIRPMLRFLQLYLLRLGFLDGLAGLQVCMLTAFFNTFVKQARLWEMEHALPQPDDDPSVTANVSNTRAAA

SEQ ID NO: 3095 - protein, 257 aa, Unknown
  Description of Unknown: Acidobacteria bacterium sequence
MIRLSVCIITLNEEHNLARALESIRGVADEIVVVDCGSRDCTGEIAREHGARVITNAWTNFAEQKNIAAAAANNDWILSLDADEELSSELRDAMLAWKHKEPEFAVYEFARRAWYVGGWINHSGWYPDRQRRLYRRDAARFLGIVHEALQFPGEPGRLGGDLLHYTIRSFSEHEEKVDRYTTLAAQQMCAAGKQSWRAAMWLATPWNWFNSYVLHLGFLDGSRGWVISRMAARSTWLKFKKLGELVESGRHAGTHSS

SEQ ID NO: 3096 - protein, 294 aa, Unknown
  Description of Unknown: Chloroflexi bacterium sequence
MTRPLPISLLVLTYNEEANIGQTLSSVREWVDEIYVVDSGSTDETCRVAEQYGATVAQHAFESHTRQWDWALHTLPLANEWVLALDADLRITTELRDELTLLFTTNRHKLNSIAGIYLNRRAVFQGRWIRHGAFYPKYLLKLFRKSCVSLSPRDLLDHHFYVVGSTLTLRSDMIEENLKDLDIGFFVDRHRRYARKSAEEEFAQRIDGNDWPIKPDLLGSPDQRVVWLKRRWYRMPLYVRPLMLFLYRYVVRMGFMDGRQGFVFHFIQSLWFRMMVDIYLAEMLSARDRGGELV

SEQ ID NO: 3097 - protein, 256 aa, Unknown
  Description of Unknown: Photobacterium damselae subsp. damselae sequence
MEKKHTLSVILITKNEADRVEICLRSVADIADEIIVLDSGSTDDTVEICRRYTDDITITDWPGFGKQKQRALDKASCDWVLSIDADEALDDEMKQALIQLLSQQSIQETAYRLPWGVTLYGTTLKYGRSARSVLRLFKREGAKYTLDEVHETVIPASGEIGTLKGLLLHYTHRDYGHGLDKAAQYAWLGSQKYHRKGKKSHGLVLALFRAIWTFFHIYIIRRGFLDGSVGFIVAMTYAQVNFNKYVGLWLLENDRS

SEQ ID NO: 3098 - protein, 257 aa, Ramlibacter sp.
MKSLSVILITRNEARNIEACLESVSFAAEAVVVDSGSSDGTAALAQARGARVVVTQDWPGFGPQKNRALELATGEWVLSIDADERVTPELRESILAAIAQPRFDAYEIDRRSSYCGQSMAHSGWSPDRVVRLVRRGTASFSPSQVHERLVPAGPVGRLEGKLLHESMRDFESVIDKMDRYSTAGARMLMERGVRGSMGKSIAHGLWAFLRTYVFRLGFLDGRLGFALAVSNAEGTYYRYMKLWLMQRQAAGNEAGPG

SEQ ID NO: 3099 - protein, 274 aa, Bryocella elongata
MSVLILTRNEEQDLPGCLDSAAFSDDIHVLDSQSTDRTREIAVARGAKVTIRPFDSYAKQRNAGLALSLAHAWVLVLDADERVTPALAAEMQQVVSNVAEDVAGFRMRRRDFLWGTWLRHAQMTPFYVRLLRVGRARYTREINEVVEVEGDIANLTAPLDHHPFSKGISHWVAKHNTYSTMEAELLAARADDSSASLRKALFAKNFHERRVAQKAIFYRLPGRPLIKWAYMMFVRGAVLDGSAGIAYATLASFYEYLIELKAKEIRRRNASLPL

SEQ ID NO: 3100 - protein, 267 aa, Pandoraea thiooxydans
MNNGPQNASAPSRAPATKLPLSVIVTTLNERTNITACLASVEPIAAEMIVVDCGSTDGTVELAREAGATVHVTPDWPGFGPQKNRALALATQPWILSIDADERLSPALAGEIADAVSQARHAGYEIPRLSQFCGHWVRHSGWYPDYVLRLFKRGAGRFSDHLVHERVLVDGTLGRLHEQLLHYSYTTMAQVQEKSARYAKAGAEELFRRGVKVSPLTPWYKSGWAFVRAFVLQRGFMDGWAGFAISRSHAHTTYSKYQQLRALRRQP

SEQ ID NO: 3101 - protein, 292 aa, Unknown
  Description of Unknown: Verrucomicrobia bacterium sequence
MSEQGEARATVSVLIPVKNEAANLRECLASVSFADEILIVDSGSTDGTQGIAAAAGAEVVQFHWNGEFPRKKNWALENVPWRHEWVLIVDADERITPELAGEIQRAIRRTDVDGFYLNRRFWFLGGWINHCGYFPSWNLRLFRHRLGRYERAESGGGGSSGDNEVHEHVILNGRAEHLAAPMEHYAYPDISTFVEKHNRYSTWEARVSETFYRDSSAGTLAARPFGTSLERKRWLKQCFRRAPFRPTLRFLYHYAWRQGFRDGYRGWILCRLLARYEFLCVAKEWESRQLRR

SEQ ID NO: 3102 - protein, 268 aa, Oceanicella sp.
MVHSPAGKAPLSCYIRTLNEERRIADVVRAALRVADEVIVVDSGSTDRTLELAVAEGARIVDQPFLGQGFQKRVGEDAARHDWLLDLDADEVVPPALADEIAALFAQGEPSGPVYALPMIICPPDGPAWEGFSISWRNKLYDRRRLRMPEHRRYDQLELPADVAPQRMANPIHHFAFRDIANLVAKMNGSSTRGAEGSKRKGRAVLALRILFGMPAYMLQHVVMRGRWRGGLYGVAVGTVLAWGRWLRDVKMYELHRREQWHRRNPPK

SEQ ID NO: 3103 - protein, 280 aa, Haliea salexigens
MISLNEAHNMQAVLDNLKGWAQEVFLVDSYSVDDTVDIALANGVHVVQRKFRGFGDQWNFALENLPVQAPWVMKLDPDERLTDKLKQSVGAATARNAATGISFSRRLWFMGKPLPIRQEIVRVWKAGRCRFTDVSVNEHPLVDGDVCHVEGDLEHHDSPDLHHWVDKQNHYSTAEAVARMNLALAAPAKLFGSHLERRMWIKKHFDKFPMRFFAVFLFYYCYKGLFRAGWVGYTWSKLRAHVYWMRYIKYREMLITSRASTSSTSDPSAKGQPDLRVPQY

SEQ ID NO: 3104 - protein, 248 aa, Unknown
  Description of Unknown: Candidatus Methylopumilus turicensis sequence
MKNTLSIVICTKNEALNISDCVISASFADEVLVVDSGSTDDTVDIAKKLGARVLETDWPGYGPQQNKAIDASKGDWIYSIDADERITPELKTEILNVITHEEHKVYDVPRKSFFITKFMNHSGWWPDRTRRLFKRGFARFTTHEIHANLSTSFRVGHLKSHMIHYSYKNCHEVLEKMNRYSSGSANDMLANGKNSSLPKALAHGFWAFFRTYFIKLGFLDGQAGLILAIANAESSYYKHLKLYLLSQQ

SEQ ID NO: 3105 - protein, 257 aa, Legionella massiliensis
MLSVIVIAKNEEVNIRRCLESVKWADEIIVLDSGSSDNTVAIAKEYSDKVYSTDWQGYGVQKQRALALTTGDWVLNLDADEAVDAKLQAVIKEAMASDKADAYRVPICMNFYGYPLRFSSSPQRHVRLFKRVGARFSEDIVHEKIILPVETRISKIRTPIMHHSFKDVSHALYKINRYSSYSAKIKIEKNKRGSFAKTLLGTGWMFFRCYFLQRGFLDGKAGFLFAVFNAQGTFYRGIKQLYHDAQLDKLPDTVKEN

SEQ ID NO: 3106 - protein, 279 aa, Lysobacter sp.
PRLLSAVVTTHNSMATLGVCLDSLAFCDEILVLDSGSADATVDFARERGACVFIEPFRGYAAQKQRAVDLASNDWVLLLDSDEWLEAGASAVLRATLEDMAGDVAGFSLRRREWLFWRWQHPRSRHNRYVRLFDRRRARLSHHAVHETVIAEGRVIALPVLLMHRGDADIAAKIDKANRYSSLQQPDIARRDVRGLQWRMLLYPHVAFLRYYLLRGHWREGWAGFVAARVHAFYAFAKYAKAYGNRQQPDSMACPTAACGASHSAGAARHSGTLDSPHP

SEQ ID NO: 3107 - protein, 253 aa, Unknown
  Description of Unknown: Oxalobacteraceae bacterium OM1 sequence
MKLSVIIITKNEAANIQACLDSVRFANEWIIVDSSSTDGTVEIARAAGAKVIQTSDWPGFGPQKNRALDAAQGEWVLSLDADERITDALREEILAAIAQVEHAAYAIPRLSSFCGHFIRHAGWYPDYIVRLFRRGAARFSDSLVHESIVVQRGTTGRLKAHMLHYSYLDDESVLRKLDHYSTLGARQAFAAGKRGGLGKAVLHGVSAFLRSYVFKRGFLDGGAGLMVAISAAESSYHKYLKLALLTQAGRTRP

SEQ ID NO: 3108 - protein, 263 aa, Rhodoplanes sp.
MPKITAYIICYNEAAKIEAAVSSVLWADEVLVADSNSTDNTVALAEALGARVVQVPFHGFGDLRNRTLEHCTNEWIFSLDSDERCTPEARDEILALVSGEPSHDAYLVPRRSYMMGRWITGSGWYPNYRQPQLFRKSAMRYTLDPVHEGYELKTAKPVGHLTNAIHQFPFRNLDEVIRKMNRYSTLGAAKLTKKRVSMASALGHGLWAFIKHYIFKRGFKDGWAGFVIALGNFEGTFYRYAKRYEETQNWQPPPSEKLTRPPQ

SEQ ID NO: 3109 - protein, 412 aa, Sulfobacillus thermosulfidooxidans
MSDISVALIVRNEERFITQCLESVKPITDDIVVVDTGSEDRTIELAEKEGARVISRPWPRDFARARNWAIEEAKNPWILMLDADEVLLEDDQHMLIEAVKHPTADAYNIRIVSLTDRPEDLTEARVTRVFRNDPRIRWEGRVHEQIIPSIGRAGMTLEPLDVRLMHYGYLKEVMTDRNKLERNLDLLDQSLSETKPNEWKAYLHWQRAQTLVPLERYDDAIKDMRLAMTLAHPTAALQPLFWLTLAKIFTAKRDYHKVHQTVREALKLFPDYTDLVYWEGQVFLDEGLWDKAEQRFKKALAMGVPKNYLQSELGVGTFKALWQLARISRMQGKMTQAEAYYLKTIELKPAFYPAWKEYLALLDGNPAPIIVTRLSMVLPKDTIIRTISSWASLSMNEQAILSYLQDTKNELG

SEQ ID NO: 3110 - protein, 248 aa, Pusillimonas caeni
MTLSVIIITKNEEAHIGACLDSVAFADEIIVVDSGSGDRTCAIAREKGARVVETTDWPGFGPQKNRALDLATQDWVLSVDADERVTPELAQAIAQAIRQPAAQAYQIARLSNFCGRWIRHSGWWPDHVLRLFKRGTARFTDAAVHERVQAQGPVATLDAHFLHYPYADMDALIAKVNRYSTDAARMMHAKGRRSSVPGAVGHAIWTFIRIYLLRRGFLDGREGFILAATASAGSFFRYAKLYFLGRGE

SEQ ID NO: 3111 - protein, 267 aa, Butyrivibrio sp.
MTPDITVIILTKNEEKNIEAAISSAKQISNRIIVIDSGSEDNTTFLAEKNGAEVFFHEWLGHAKQFNWALDNCDINTTWVFRLDADERISKELAQEINIKVKNTEVVGFEMRWRVYFMNKWIKHGGTHKPYFLRLFRFGRGKVEEKLMDEHIIVDGKVEKLEGDLIHYDYKGIDAWLSKHIWYSNLELSMYNSQMNMTGGNVKQKRKRSIYYKLPPFFRARLYFFFRYYIQMGFLDGREGKIFCFMQAYWYRYLVDAKIFEYNLQNK

SEQ ID NO: 3112 - protein, 255 aa, Unknown
  Description of Unknown: Acidobacteria bacterium sequence
MLAVKISAVIITLNEEQNIARAIRSVRWADEVVVVDSGSTDSTRQIASELGARVIEQEWLGFGRQKQFAVDAAANDFIFSLDADEEASEELSAEIRQLLRHDSISDGYRIPRLAVYLGREIRHGGWYPDFQLRLFDRRKGRWSDEVIHESFKLDEGACSGQLHNDILHFTCNDISEHARMIQERYAPLSARSMYEKGKRTSVVKILAAPVFSFFRDYVLRAGFLDGTQGVMIAGFGAYNVFLKNAFLWQMHRATK

SEQ ID NO: 3113 - protein, 280 aa, Streptomyces specialis
MTRLPIVVAIPTKNEAANITTTVRSVIDHFVAVVVVDSDSTDDTRALAKAEGAEVVPYTWDGKYPKKKQWCLDHVRPDIPWMLFIDGDEMPSEELLAELRRIFLDGRPVKPAAFDIPLGYWFGGKRLRHGYTIVKRALLDRTRARFPEPDDLDAPGMGEQEGHYQPLADPVYRLDAPIEHMDLDPVRTWFDRHNRYSDWEAWLEEHPEAREQIRTAKTRQGQLFHRAPLKPLVSFAYAYVYRRGFLDGRAGLDYALAMSFYRWQIGLKAREMRGGWSSPS

SEQ ID NO: 3114 - protein, 268 aa, Unknown
  Description of Unknown: Ignavibacteriales bacterium CG07_land_8_20_14_0_80_59_ 12 sequence
MGDGTGTDRFPLSVTIIAANEEANIAECLESVSWVDEIIVVDSGSNDRTKEVASRCTLHVVSHPWEGYARQKTFGLSLATHEWVLSLDADERVSPELKAEISSLDFSKADGFFIPRRNFFLDRVIRTCGWSPDYQLRLFRKSVTHVTGRKVHERFVVEGRTSRLRGELLHFTHPTVEGTLRKINEYSTLRAAEKSMRKHPSGITLVLHPLWEFLHHYILRRGFVEGVHGLMVSLIHAMTDAQTYMKIWELQNVKRNRQKSPEPPHPSV

SEQ ID NO: 3115 - protein, 259 aa, Tatumella morbirosei
MSTRQRLSVVMITKNEAELLPDCLQSVAWADEIIVLDSGSTDQTADIARQAGARVFYSEQWPGYGLQRQHAQQYASGDMILMIDADERVTPELRAAIEEVLQQSASPDNVYSIARSNWFLGRFMRHSGWYPDRVTRLYPARFRYNSHLVHESLEHSGASVIRLSGDLKHLTCRDLHHFQQKQLAYANAWAAQRFSQGRSCSLYSVYSHTVAAWLKTAILRAGILDGSQGWVLALVNAQYTFNKYAILWALNKTKPPGVQ

SEQ ID NO: 3116 - protein, 269 aa, Candidimonas nitroreducens
MSRAGVQAGRRLSVIIITKNEAAHIAACLESVAFADQVVVLDSGSTDGTPDMARQAGAQVHHTADWPGFGPQKNRALDLADGDWVLSVDADERVPAELAAEIRRVVAAPAHDGYEIARLSDFCGSPIRHSGWWPDYVLRLFRRGAARFSDDAVHERVVLQGAPGRLRGHLRHYPYADLEALVAKINRYSTDAAAMMHRRGKRAGALAAVGHGFWTFVRIYLMRRGFLDGRRGLVLAGAAAAGSFFRYAKLMLLSQDDAAPRAPADKERS

SEQ ID NO: 3117 - protein, 258 aa, Unknown
  Description of Unknown: Bacteroidetes bacterium GWF2_43_11 sequence
MKSDNPEPLKLSAVIITLNEEANIQRCIQSLLIVADEVVVVDSGSTDLTQDLATSMGAKVIFHPFEGHIQQKNFALSVASFPLILSLDADEALSPELATSICEVKHSPAAMCYSMNRMTNYCGKWIRHGGWYPDIKVRLIRSGKACWDGVNPHDKLTPEPNADIRHLKGDLLHYSINSLADHLKQIDYFTTIAARERVKQSKPVGIHHLLLNPAAKFIKDYFLRGGFRDGLTGFAIASFSAWASFLKYMKTAFLYRGL

SEQ ID NO: 3118 - protein, 267 aa, Cohaesibacter sp.
MSKPVTSTDKLPVSVFIITLNEDDRIETAIRSVIQWVDEVIVVDSGSSDRTVELAKACGAKVSHNDWRGYGEQKRHAEDLCKHDWLLNIDADEEITTALRDEIVSLFKPFPDTDICRVEILDIFPHEDKAKKWAYGYWQYRLYNRHKGRFSDSSVHDTVRPLPKARIDTLKAKVNHRSMRSLQVSVAKMNRISDMQVNDMLQRGRHISRWRLLTEFPLAFLKGYVLRRQFIYGFWGMALAYNYAFSRFLRVAKMYETELNQKTRRDQ

SEQ ID NO: 3119 - protein, 255 aa, Williamwhitmania taraxaci
MEVKISAVILTLNEEKNIERCITSVLGVVDDVVVVDSFSTDRTEEICSAMGVRFVKHKFEGYGAQKAWAIQQALYPVILSLDADEALSDDLRASVLEAKHHWDADGYSFNRLTSYCGQWINHCGWYPDIKLRLWDKYKGDWSSAVVHESVEMQEGAVVRHLKGDLLHYTTESIHQHMSVLLQYASMSAMKALKEGKRSSYFKILVSPRAKFVKLYFIKLGFLDGYYGYVIAKTTAFSTYLKYVYMLDIQRREIKN

SEQ ID NO: 3120 - protein, 529 aa, Unknown
  Description of Unknown: Acidobacteria bacterium sequence
MTRLTAIVLTGNCQDSLPGCLESLDFADEILVVDSGSSDRTREIALAHGARVLEHPLERFDEQRNWAQQQADTDWVLFVDSDERVPPELAEEIRTLLTSGTDADAYSMPRKNHFLGRRIRRCGWGSDRVTRLLHRHAVRWEGAVHEKPRVRGKVGVLRTPLTHHSYPSISAYWDKMQLYSRLAAAQDFQRGKRSGFLRMAFQPKLLFLRMYVLRGGWLEGRHGLVLCLLSAFSAFTRALRLWEHQLGASGRSLLPEGPPVEAPHQGGHPLSILVPTHNESANIEGVLDSTGWADEVLVVDSFSDDDTVATARRRADRVLQHEYINSAAQKNWALPQTRYPWAMVVDADERVTPELAREVRQVLASKATHQGYVIRRVNHFHGQRIRHCGWNRDRVLRLFNRERSRYQEQEVHADVEVDGTVSELRHPLLHFTFRNVDQYWPKIRRYTDWGSSQAYRDGQRSSLYQLVARPVGRFIKMYFLRLGMLDGTRGLVICTISFFSVFNKYAKLWEKDLDTSGLHGTVKTGSSSE

SEQ ID NO: 3121 - protein, 255 aa, Mesocricetibacter intestinalis
MPTISVAMIVKNEARDLALCLDTVKDWVNEIIILDSGSSDETESIALSYGAKFYRNTHWQGFGKQRQLAQQYVSGDYVLWLDADERVSPALRESILQAVAQDRADTLYQLPRLSEVFGRKIYHSGWYPDYVTRLYPTKLARYGDELVHEKVHYPAGAEVKKLSGDLLHYTYKDIHHYLVKSAAYAKAWAEQRHAQGKSAGLAEGVFHGLGCFVKMYLLKGGFLDGKQGFLLALLSAHSTFVKYADLWLRTLVQKN

SEQ ID NO: 3122 - protein, 255 aa, Bradyrhizobium sp.
MAAAPTQTRPSRVACTIIAYNEADRIERTILSVVGLVDEIVVVDSGSQDGTVALCEGLGARVIHNPWAGFGPQKRFAEEQASCDWILNLDADEWLSDELRAELADILSRPLPQKRCFRVRILVVYPRRERPAPFAYFHNYVRLYNRATARMRDSLTHDEVAPTDDVVQLKGGVLHRSYRDFAHIVTKTIGYYSLQRQEGIKPSGVGVARLIWEFPFQFFRYYFLRRHIFGGADGFAYAVALSMGRWARIFILKGW

SEQ ID NO: 3123 - protein, 280 aa, Silicimonas algicola
MPDNAVPRIPCTVVIPARNEAAALPEVLSRLSRFAEVVVLDSQSEDATAEVAEAHGARVLQFAWDGRYPKKRNWFLLTHPPATPWVLFLDADEFVDAAFVEALARAIRRDDVVGYWLTYSNSFLGRPLRHGVPQRKLALFRVGAGLYERIEEEAWSGLDMEIHEHPILEGRTAEITVPIEHRDDRGLAQFLRKHIDYAAWEAKRTAALAGDPLAWEALTGRQRFKYRHIGAGWYAMFYFVYTYVVKLGVLDGRAGYHYATYKAWYFRTIRLLLREQSRTK

SEQ ID NO: 3124 - protein, 256 aa, Polaromonas sp.
MASLSVTVITHNEAHNIEACLRSVSFADQVVVLDSGSTDDTVEMARSLRAEVSVSPDWKGFGIQKNRALALATSDWVLSLDADERVTPELQVEILACLKAPAFDVYAFPRLSSYCGQYMRHSGWYPDRVTRLFRRNAARFSDDLVHEKVIFQGQQGQLQSHLLHESFRSFEAVLDKANRYSTAGAQSLLSRGKTASVGKAIGHGLWAFIRTYFLRLGFLDGKMGLVLAISNAEGTYYRYLKLWLLQRDGKGAPGAQ

SEQ ID NO: 3125 - protein, 271 aa, Unknown
  Description of Unknown: Acidobacteria bacterium sequence
MYGTLVRTSMPAISAILITCNEQSDLPEALESLRGIADEIVVVDSGSTDRTCEIAQSLGARVVSRPFTNFGEQKNFAAAQAAHDWLLSLDADERLSGELRGSIAAWKQSEPEYAAYQMNRKPNYLGGWIRHSGWYPEYCVRLYRRDCARFVGALHESVQVNGRVGRLRGELLHYTIRSLREHYAKMEAFTTRAAEDLYARGRRHWRCGMCLAAPWTLLQRFFFQLGFLDGYRGALIAWTSARYVWLKYRKLGVLVRGGKLEARVWPQARDV

SEQ ID NO: 3126 - protein, 250 aa, Pseudorhodoplanes sinuspersici
MPRLSAIVITKNEARNIEACLESVAFCDERIVVDGGSNDNTAALADAKGARVTVAEEWRGFGPQKNLALSLATGDWVLSLDADERVSERLADEIKRAVAAGGADGYEMPRLSTFCGKPMRHSGWYPDYVLRLFRRGHARFSDDLVHERVICDGAVRRLSEPLTHHPVERLEDSLSRMDRYSTARAEMIVSSGRRVSFFTGILRGWWTFIQTYFIRLGFLDGREGFLLAVANAEGTYYRYMKAWLKERGRG

SEQ ID NO: 3127 - protein, 249 aa, Deefgea rivuli
MPRIGVAIITKNAAAHLDECLKSVAWAQQIIVLDSGSTDATLEIAARHGVEIHQTSDWPGFGIQKNRAIALLNTDWVLALDADEVLSETLINSVQSAINSEAAAPVYRLSRLSNYCGRWIKHAGWYPDHLPRLFQRGAAQYSDDLVHERLIYQGDAPLLAGELLHFSFDNLDDVLDKINRYSKAGAQQRQSRGESSHLGKAIYKGLWTFLRTYFLQRGFLDGREGFILAVSNAEGAYYRQLKLMYLNEN

SEQ ID NO: 3128 - protein, 288 aa, Unknown
  Description of Unknown: Gammaproteobacteria bacterium sequence
MVPAYSPRPVDCGVLAMNNNEQTPLAGQQHRPYSISVVMIVKDEVENLQISLPAVADWVDEIIVLDSGSNDESKSVAEKYGAKWFVNTDWQGFGKQKQLAQSYARGDWILALDADEAVSPELKESILSVSKDKPGDKVYGFRRIDYIGRYCIDNPKWILPLKTYWRLYPNHFTYNDNNVHESLDISRASKTLSLQGYLNHHTAFDYSHWLNKRVKYAIIWAEEKHSHHKKTNIFSIIGHSFWAFVKTFIIEGRFLLGGKGFLYSSLFAQYTFNKYVVLYDLNRRGQKE

SEQ ID NO: 3129 - protein, 248 aa, Pusillimonas soli
MSLSVIIITKNEAAHIGACIDSVDFADEIIVVDSGSTDGTREIAQAHGARVTLTSDWPGFGPQKNRALDLARCEWVLSIDADERVTAELAQAVQRAMASPAADAYRIARLSRFGDRWIRHSGWWPDYVIRLFRRGTARFKDVPVHESVLAEGAVSTLDGHFLHYPYADLESFIAKINHYSSVAAGMMHARGKRTTALGAWGHATWTFIRIYVLRRGFLDGREGFILACMAAAGSYFRYTKLLFLNRRG

SEQ ID NO: 3130 - protein, 256 aa, Oceanospirillum multiglobuliferum
MPTIAAVLIVKNEEKNLAACLESVKWVDQIIVVDSGSTDKTAEIAAQYRAEFYSHNDWQGFGIQRQRAESYVKTDWIFVIDADERVTPELKNSLQDCIKAEKCIGSIARLSWCFGRFIRHSGWYPDRVLRLYPTNAASYNSALVHEKLENPNGLPEKKLQGDLLHFTYDNMRHYLIKSAQYAEAWAEGRAKKGKTTTLSNGVLHALGCFVRMYLIKAGFMDGKAGFLLALLSAHSTFVKYADLWLRTKTTTKNEQE

SEQ ID NO: 3131 - protein, 249 aa, Acidaminococcus massiliensis
MGTCTVAILTKNEERHILDALASARPCADQLLVVDSGSTDHTVSLAREAGAAIAFREWDNDFAAQRNFALSQAKGDWILFLDADERLTPELAEKINTIKAGSLDHQYSFRRINIAFGHEFHHGAFSPDRVKRLFPREKVCWVGKVHERPECLLPETKLKEPLEHYTYDTFAQWWNKAGHYTTLWAEEAYGRGKVATAGTAASHALMGMVKAYVLEGGFLEGSMGFVAALQHGIYTAMKYMKLAEICRKK

SEQ ID NO: 3132 - protein, 268 aa, Rickettsia canadensis
MTKISAFIITKNEAARIARAINSVKNIVDEVVVVDSESSDGTVSIAEELGATVVIKPWLGYVGQKSFAESLCIHDWILNIDADEELSKDLQDEIEYIFVSGNQDHYLAYKIKLLIMHRDDRKPRMFAPFNKCIRLYNKKFASFANNVNSTTHDSVVFNKDVDFTNKVYLLNEPAYHYSGISIEQLVTKANFYSSEQAKDLMVQDKKVSNIRIATEMLWWFLKAFFIRRYFVFGFDGFVDSMIFAFARFLRLAKLRDKTKNNYERKFSR

SEQ ID NO: 3133 - protein, 267 aa, Unknown
  Description of Unknown: Candidatus Parcubacteria bacterium sequence
MISVIILTKNEKERIHACIESVKWADEIIVIDSNSSDNTTELAIKNGAKVYTRTFDNYANQKNWAMGKASGEWVLYLDADERVLFGLKEEILSLINSTDCSAFAISRRNIILGQEKKYGPFWPDWVIRLVKKDYFQNWVGEVHEHMEFKGKLGYTNNSFLHLTHRNVEQIILKNLHWSKIDAKLRLEVCHPEMSGWRFLRILFSELFYQGFIRRGFFNGTVGTIDALMQTFSLVTTYVRLWEMQQSKSLDKVYRDVDSKLIKDDFKF

SEQ ID NO: 3134 - protein, 259 aa, Pantoea sp.
MSARQPLSVVLIVKNAADLLPECLASVDWADEIIVLDSGSSDGTPQIAARHGASVFHSKEWHGYGKQRQLAQSYASHPMILMIDADERVTPPLRHAIEEALQKPSATIYSLGRRNLFLGRFMRHSGWYPDRVIRLYPASYHYNDHLVHESLDTRGAPVTPLKGDLLHLTCRDFSAFQWKQFTYAEAWAKQRHHQGKKCTMFAIFSHTLAAFFKTLVLRAGFLDGKQGWLLAVVNAQYTFNKYTALWALNHSSHASKGGL

SEQ ID NO: 3135 - protein, 257 aa, Agarilytica rhodophyticola
MERQKLSCFIIVCNEADRIEPCLQSLAGWVDQLIILDSGSTDGTVEIAQRYTQEVYQTDWPGFGPQRNRALAKCRYDWVLNIDADERMTEELRDEIDKTLSQPHLNANLIQIPWRTFLFGKALRFGRYSSPQGKLFKREGVAFKDRQVHETLLIPNEVALTLKAPLLHFSWRSYQHVQEKHLKYACLLAQQKFDAGKRSSIKMAVIRFFLDFLQQYILRLGFLDGWRGFLMAVILGQYAFHKYAALVALQNKDSDAK

SEQ ID NO: 3136 - protein, 372 aa, Unknown
  Description of Unknown: Oribacterium sp. P6A1 sequence
MIINLVMIVKNEERCLARCLEAASPFVDHIIIADSGSTDRTLEIAEGFGAKIYSFPWENDFAKARNFALGNSERDWNADINLVLDADEYLIQDENCNPKALRDFIDHMYDKQGMRWLGNIRREDSYPNGDEIDRSITEIPRILPAEMRYQGSIHEQVNAKVVHKLSPLYALHDGYMQKGKGERNFKYLEEALKKEPNYPYYNYQMAITLRNLNKKEESLPYFRNFWRYSGKKEIRQSAYWTDGIMRYLYTLYDIDTENSLEEAHDIMSKVQYDFTRNPDFYFYSGLFYMKLVLKNTEKYKDLLPYIEKSYLKCLDLGEVSRPEGVIGTGSFKAAYNLGTWYEVSGNLDKARHYYKMAADEGYEKAAERLKNL

SEQ ID NO: 3137 - protein, 231 aa, Cronobacter sakazakii
MSWADEIVVLDSGSSDDTVAVATAAGAKVFTESDWQGYGIQRQRAQQYASGDYILMIDTDERVTPELAQAIRQVLEQPDPQAVYSIARRNLFLGRFMRHSGWYPDRVTRLYARERYRYNDNQVHESLDAPGARVVTLSGDLLHLTCRDFASFQRKQLNYATAWAQERHQQGKKVSVPGIFGRTLAAFCKTLILRAGVLDGRQGWLLAVVNAQYTFNKYTELWALNRGFTER

SEQ ID NO: 3138 - protein, 257 aa, Comamonas kerstersii
MARLTIGILTMNEERRIAACIDSAAFADQIIVVDSGSTDTTVEIAKAKGAEVYVYADWQGFAVQRNRILRHATGDWVFFLDADEEVTPALAQEIRSIVDANQQGVWEVAWEQIAYGQSLGRMRSSGGIPRLFPREQIVQFEGVVHEGAKLKTPTLPVKLMRNRLPHYSRETIYGSLQKLAQYVQLGAYKRLQAGKRGGVFRGMGSAFANFIRLYIFHRGFLCGRAGFLHSFLVSLECFFRYVALEIDRDYLKDAKKR

SEQ ID NO: 3139 - protein, 670 aa, Quadrisphaera granulorum
MASPSSPEAHLTLVLIDSAGPEALVRCAQQALRTGSEFSLVLVTANTSSVPAAVGRRARVVRSSTTELEAVAAQEASRSALVVLAPTSTAFSRGWTDEVRARAAMHSQAISVYGAYGRSVLVVPAEVTDTHGTRLTWIDAACLRLRGHATGGARRQTLGAVMIVKDEEDVLDECLTALKPFVDEVVVYDTGSSDRTVEIARSHGVKVIEGYWNDHFGDARNRALEHATCDWVLQIDADEVITGDIEALRRQLDTEVHDQVSLTIVSTNYRGGTTGMETQPARFFRRNLYRWTGALHEYPDALPGVTIRGMSPQHSAIRVLHSGYQQERTESRDKTSRNLALATKELMEASADDPARAVKLSNQGRSLMWAGKVDEALRVFEELRSTQGNPTSIVSGGRAAMEGLLGTNRLDEVEPWLKVMADNGESAGNLAFFRARRHLALNEHREALECMEDVKGGRGGTDTWGTPFDTTRIDVIEAAANVALGEPARAAELLVELVRTSPAAVPFDLLVRAVSLAGRPLEDAAVVASHEFIERTIREAAAQHPLLALAWFEALFTTHPEDPRPVVAGNVFAVRAGWRVALVWAMRALELGLSDVNALTTMAGDAAMPLHDRCMASALLAQYFSQAAMFDRFEQLTQEASSSTLDTLVVDLREIGVEVSSIGSESAVGS

SEQ ID NO: 3140 - protein, 254 aa, Unknown
  Description of Unknown: Acidaminococcus sequence
MGTLTAVILTCNEAKNIRGVIRSAKLVADQVLIVDSGSSDETVALAEKLGAQVIYRAWDQDFAAQRNFALTGVSCDWVLYLDADERLTAAAVEKIKAIKAGPLDHQYSLERINIAFGHEFHRGAFGPDRVTRLFPAGQVRWEHKVHERPVCPLPLTALTESLRHFTYDSFQQWWDKAGHYTTIWARDAFEQGRRATAAQAARHALGGMFKVYLLEGGILEGSMGFIATLQHGIYTAMKYMKLVERGSLKKKEKS

SEQ ID NO: 3141 - protein, 248 aa, Halomonas songnenensis
MIVKNEAHHLRECLETLAWADEIVVLDAGSQDDTCAIAREYTENVSVETDWQGFGVQRQRAQALASHEWVLMVDADERVTPELRASILKAIQQPPAVYSASRLSWCFGRFIRHSGWYPDRVLRLYPRTQAVYNAALVHEKLDVPEGLAVKRLSGDLLHYTYRDLRHYLEKSAHYAQAWAEQRAAQGKTATLGSGVTHGIACFLKMYVLKAGFRDGKQGFLLALLSAHSTFNKYADLWIRTRTSPVEKR

SEQ ID NO: 3142 - protein, 259 aa, Pantoea allii
MTSTRQRLSVVMIAKNEAELLPDCLASVHWADEIIVLDSGSTDNTIALAREAGAQVYQATEWQGYGKQRQRAQSFARCDMILMIDADERVTPALRRAIEQVLDAPPGRTVYSLSRSNLFLGRFMRHSGWYPDRVMRLYPHTLRYNDNLVHESLNTEGAPVKVLDGDLQHLTCRDLMAFQRKQLAYAEAWAQERFLRGKACSLFSVFTHTLGAFIKTLLLRAGFLDGKQGWLLAVVNAQYTFNKYAALWALNNASAKGRT

SEQ ID NO: 3143 - protein, 251 aa, Burkholderia paludis
MVITKNEARDIGACLASLRPWVDEIIVFDSGSTDGTQTICREYGAIVHETDWPGFGAQKQRALDQARGTWVLSIDADERVPPELRDEILACIESPGAELYDLPRRSNYCGTWIRHSGWSPDYVRRLFVRGRARFSDDLVHERVIGNDDARCARLATPLLHYTYRDLSEVLGKIDSYSSYGAAQKVARGKSGGLRRAVLHGLWTFIRTYVVKLGFLDGRMGFILAVSNAETSYYRYLKMMLLGDDRGNHPQA

SEQ ID NO: 3144 - protein, 258 aa, Pantoea conspicua
MPTRQRLSVVMIAKNEAELLPDCLASVSWADEIVVLDSGSEDNSVAIATQAGAKVYRNDDWQGYGVQRQRAQQYASGDMILMIDADERVTPELRAAIEQVLIAPPSRTVYSLGRSNLFLGRFMRHSGWYPDRVMRLYPPTLHYNGNLVHESLNAEDAPVVALKGDLQHLTCRDLVAFQRKQLAYAEAWATERHQRGKRCGLFSIFSHTLGAFVKTLLLRAGFLDGKQGWILAVVNAQYTFNKYSALWALNHASAEGRA

SEQ ID NO: 3145 - protein, 267 aa, Unknown
  Description of Unknown: Cytophagales bacterium B6 sequence
MVPVSVVIITKNEAAFIANCIKMACLITDDIIVVDNDSSDSTPQIAADLGCRVYKKNWSGYGANKNKGIAKARHNWILSLDADEVPDHELVEAIHHLKLDNPNVVYDIRFKSYFGRKLIRYGNWGNDHHPRLFNRRLVKWSETEVHETLVLPPAAKIVKVSGYLHHHSVTDTDDFNTKAVHYARLSAAKYFKAGKKATFFKLHFSALFGFVRNYIVRLGFLDGAEGLAIARISYKNTRLKYRYLKQYETKPATGENVYRNDLVVERV

SEQ ID NO: 3146 - protein, 254 aa, Hoeflea sp.
MKPTISAVIITRNEAEMLPGLLESLTFCDEIVVVDSHSDDATRDIAASFDAKVITRDFNGFGDQKEFARAQAGCDWVLSMDADERVPPSLAEEIVSTLADPAFDAYQVPRLSYFLGKPFRHSGWWPDAPLRLFRRDAARFNSKLVHEFAETDRPTGTLSNHMDHFTVRSLEQALAKGQHYSALGAQQLEKTGRRVTLLSPFGHAAGAFVKTYVLKRGFLGGVEGLVNAWIHGQTVFWKYMIVYVNRRAELRSRR

SEQ ID NO: 3147 - protein, 252 aa, Marinomonas alcarazii
MSTVGVLLIVKNEGKMLAKCLSSVASWADQIVVVDSGSDDNTIEIARSFTSDVYVHSDWPGFGKQRQIAQSYINTDWVFAIDADEEVSEALQQSILAAVKLNEPVLYRLDRLSSAFGKRISHSGWSPDWIVRLYPREFASYNDALVHEKVVSDRSLGSKKLSGHLYHDTYSSLAHYSAKTTGYLKAWADDREGKKSSSVSKAISHALSCFIKMYFVKRGFLDGRHGFILAWLAAHSTFYKYIDLWLREYQKK

SEQ ID NO: 3148 - protein, 251 aa, Pusillimonas ginsengisoli
MTLSVIIITKNESDNIGDCLASVSFADEIIVVDSGSTDGTRDIAASLGAKVALTTDWPGFGIQKNRALDLATCDWVLSIDADERVTPELADAIGAAMADPTADAYKIARLSNFGGRWIRHSGWWPDYVLRLFRRGTARFKDVAVHESVLPQGQVAILKGHFLHYPYADLESFIAKINHYSSVAAGMMHARGKKTSALGALGHAIWTFIRHYVVRRGFLDGKEGFILAVMAGAGSFFRYTKLLFLNRRQQSE

SEQ ID NO: 3149 - protein, 260 aa, Sulfuricaulis limicola
MAEPSGTRLPVSAVIITRNAASCIEPCLQSVSFADEILVVDSGSTDATLEIARRHGARVLHQDWLGYGGQKEFATRQAKHDWVLSLDADERVSDELRESIREALAAPNFQACRMARRNRFMGRWLRHGEGYPDWSLRLYHRGHARWSDDPVHEKVETGGKIITLPGDLLHESEQGIADYLEKQNRYTTLQAEAMHRAGRHANPLKLLLSPVFRFIKFYFVRLGFLDGVPGLVHISIGCFNSWCKYAKLIDLRRRENRKPD

SEQ ID NO: 3150 - protein, 257 aa, Aeromonas schubertii
MKPTLAAVLIVKNEAENLRACLATLQGVVDEIVILDSGSQDETAAIAAEFGARFFVNNQWPGFGRQRQLAQSHVQSDWVLWLDADERLTPELAQSIRTVLENPPADTLYTLPRLSWVFGRFIRHSGWYPDRVLRLYPRALTGYNDALVHEKVEVRANMKVVDLSGDLLHYTYRDLEHYLVKSAGYGRAWADQRQARSKKSSLGQGLLHAIGCFMKMYLLKAGFLDGRQGLLLAILSAHSTFIKYADLWIRHQPQRPE

SEQ ID NO: 3151 - protein, 255 aa, Unknown
  Description of Unknown: Proteobacteria bacterium sequence
MSNRLPISCFIIAKNEADRIGRAIDSVREFVDEVIVVLDPSTTDETAEVARRHGAEVVTNAWAGYGPQKRFGEDRCRNTWLLNLDADEAVTPELRAEIVGLFANGEPQADGYKIAIVDLFPGEERPSRFAYRLSPVRLYRRDRGRYADSPVHDRVAFSPDARISRLKGIIHHRSIRSLGDQISKLDRYSTMQAEDFVARGRRLPTVRVYGEFPAAFLKAWIGRRLFLRGTYGFLIAMNYAIFRHMRVAKIYEKMK

SEQ ID NO: 3152 - protein, 275 aa, Mucilaginibacter pineti
MATVSVVIITKNEAEMLNRSLAMLRQISDDIIVIDNDSTDDTLTVAASNGCRIYPKNWDGYGANKNKGIQLAKHDWILSIDADEIPDAELLNTIALLQLDDNKTVYDIPFRSYYGSKLIRFGTWGRDHHIRLFNRIHVKWTEPPVHETLLLPKKSTVKKLTGHLHHYSVSNAKEHEAKTLLYSRLSAIKYLQSGKKAGVVKLYIAPLFHFVKIYVILLGFLDGKEGWNIAKMAFKNTWLKYHYLNKALHQHHPQSTYQHELPVMAYKFNADARVE

SEQ ID NO: 3153 - protein, 290 aa, Oceanicaulis sp.
MNEQTNTQAEPQRDIPVSVIIMTKNEEANMQACLSRLTRFEQVFVVDSDSTDRTCEISKAHGAEIVNFSWNGQYPKKKQWCLENLPFRHDWVLYVDADEHLYPELADEIAALLAAGEPEHAGYFVRFDGFFMGKILRHGHFNLKLVLMRRDKARFIDVEDLDVASMWEVEGHYQPVIEGTVGQLRGRMLHRDFKTLYHYFERHNRYSDWEAKLRLRDALSQPDEAQLPGRRTLKYIFDRLPAKGVALFIFNYFVRLGLLDGWAGFNYAMSRSIYYWQIEMKMTEFTQNKE

SEQ ID NO: 3154 - protein, 261 aa, Microvirgula sp.
MTPFLSVILITKNEAAHIDACLDAVAFADEIIVVDAGSSDDTVARAEAHGATVTVTGDWPGFGPQKNRALDLARGQWVLSIDADERVTPALAAEIRALLAAPAHDAYRIPRLSSYCGRFIRHSGWWPDPVLRLFRNGRARFSDVPLHESVQFDGSPGMLSQPLLHYTYPDLDSAITKMNRYSSDAAAAMFARGKRASLPGAFGHGLWTFIRIYLLRRGFLDGREGLLLAVGAGIGSFYRYAKLSLLTRPRQLPDENSRTRL

SEQ ID NO: 3155 - protein, 265 aa, Tepidimonas taiwanensis
MPLPTRGTRPTLCVGILTLNEERRIKSCIQSAAFADQIIVIDSGSTDRTAALAESLGAEVFHYPDWQGFGVQRTRLLQHCRCDYIFFLDADEEITPELRTELLRFIEQHPKTIGEIVWQQVAFGAPLRHMLARGALPRLFPAAEVVAFEGAVHEGPIMRNPRLPRRRLKSPLLHYSRETIHDSLRKLTQYSMLGAAKRKEAGRRGGIWRGLGSGLAIFARIYIFRLALLDRGPGFLFSVFVALECFFRYVALEYDREHLSNDVKR

SEQ ID NO: 3156 - protein, 293 aa, Unknown
  Description of Unknown: Candidatus Woesebacteria bacterium GW2011_GWB1_41_10 sequence
MSMAKLSVVINARNEEKNLPKAIGSVKDLAGEIVVVDMESEDGTAALAEKLGAKVYSHKNVGYVEPARNFAISKATGDWVLILDADEEIPGHLAGVLKATLEESNPADYYRISRKNIIFGKWVKHTLWWPDYQIRFFKKGFVSWGDEIHSLPITKGKGTDFPAKEGLAITHYNYNFLDQYIERLFRYTKIQAEELLKAGYVFDWKDVVKKPLNEFLRRFFEGKGYKDGVHGFILSLLQSFSEFVVYVRVWEKQGFKEAEIGKREFGRELGGAIKDLKWWIRKEFSWMRFLMSR

SEQ ID NO: 3157 - protein, 272 aa, Unknown
  Description of Unknown: Flavobacterium subsaxonicum WB 4.1-42 = DSM 21790 sequence
MSKIPVTVIIPVKNEELNIVHCLKLISGFDQIMVIDSNSTDNTAKIAAEHGAEVHQFTWDGQFPKKRNWVLRNLPIRNEWVLFLDADEYITDAFVAEIQQAIKNPDYNGYWITFINYFMGRQLKHGDPFKKLPLFRVGKGEYEKIKEDSWSHLDMEVHEHPIIEGKVGQLQSPIIHNDYKGLEHYIAKHNAYSTWEAKRFVALEKEGFGNLTKRQKFKYSLMQSGFLPIIYFIGAYFLKLGFLDGKQGYFFAKYKSYYFLQIQTKINELKKI

SEQ ID NO: 3158 - protein, 269 aa, Thiomonas sp.
MTASPRPTVSAILITRNEAHNLPECLAGLAWCDEIVVLDGGSDDATVAIAREHGARVEIAADWPGFGLQKNRALDLARCDWVLSVDADERVTAELAAEIHAAIARPDTPDAYSLPRLSSYCGQFMRDGGWYPDRVVRLFRRGTARFSQDIVHESVQAGGRIGELQHDLLHISYRSFDDVLDKMNRYSSAGARKAAAKGKTGSLLAALAHSRWAFFRAYVLRLGFLDGRLGFVLACSMAHETWYRYIKLWQLQRTETPFAPEASSNASQG

SEQ ID NO: 3159 - protein, 270 aa, Comamonas sp.
MTDSPLGGAPASRKLTLTIGILTLNEEDNIEACLRSASFADQVVVVDSGSVDRTTAIACGLGAQVFRYEDWQGFALQRNRLLSHAKGDYVFFLDADETISPAFREELQAIVQGGEEAIWMVRWRMVAFGKELRYLRSTAKVERLFWRGLLREYTGVVHEEAQLSRANVTRHLMRTPLLHHSRSTVHTSLEKLTQYAMLGAAKRAEEGVRGGILRGMASSIAMFVRLYFFHFGILCGGAGFLYCVFVALESFFRYVALAYDRPYLSGDVRR

SEQ ID NO: 3160 - protein, 250 aa, Halomonas sulfidaeris
MPINVSVVIITRNAASTLRRTLDAVQCYDEVVIYDNGSSDDTIQIAASYSNVTLQKGDFLGFGPTKRHAVSLAKYDWILSLDADEAPSAELIESITSWVNSASPSDLGEILRENWMMGQPVHYSGWGNDWLIRLFNRRSHNFNNAMVHEAISVSSISRVQRLSGTIKHTAVTDLSQFLEKINRYSNIRAESGELKRYSVLVIFLKAVFAFLRTYFLQQGWRDGWRGLVIAVSNANGVFWKYMKNSLKAKH

SEQ ID NO: 3161 - protein, 303 aa, Natrinema versiforme
MKYVYDHLLDHVKTTLSNREASNQPTRHRSPEDLETLPVSVCLTTKNNADTIRDCLESVVRWTDEIVVVDSDSQDGTVEICEEYGANVYQHEFESFAQIKTQAMEHADNDWVFVLDADEEVPPELRDEIIDAFGTVGVVAFYMEKQEHMMGARTNQYHYKRPYLARKDILYFEHEYIWERLSVQQPYRERTKTLSNRIDHYRFERASEIESKIMQYSALEAVQAVESGNRNGFLSFLLRGIAVGLDRLIISGAALDGYRGFFVAFLEFYQMIAAYVKVQDIHRLQEEHPEQWKDIWIEEECRR

SEQ ID NO: 3162 - protein, 822 aa, Selenomonas bovis
MARPRAAGHRTPGRAWNVWRKAGETRRSMEDANRIAYITCVSDEEMYAACRQALARQQLPEGMEAEFVPIRGAQSMCAGYQLGQERSRAKYKLYLHQDCILQRADAVKRMLSVFAHYPKAGLVGLAGARKLPEYGMWWLGEELYYYLAEQTGDTIQLHAAGTTEGAEALEVAAVDGVLMLTAVDIPWRSDIFTGWHFYDISMCMEMRWRGYEVYVPNQEQMRPWALHRTRNRRLPDVYFAWRQTFLDHYGQKDPEIAMFSVNHDASLHPRLSVCYIVRDGARELSLSLARLQGEADEIIVVDTGSSDATAEVARSFGARVYAYAWDDDFAAARNLALEKATGDWILILDADEHLPAVHGSLHHSVVRAAAGGAEALTVTLVNVDLDAGGRETPPEPLLRLWRSRPGRRYTGRVHEAIGDHGAPLAPLGEAREIVLRHTGYSEARAKEKMARNLVLLQRQIEERGERDTDWRYLADCCYGLEEYELALHYARLAIEKGARTLAGPARMYEVAIASLAKLDRPTSERLALARQAAAACPAEASFAREAESAAAQCEAEAWYAAQAERDDASLSAAAEAWSAAAEQPETRRSFLAAWAGETGRVRLCMALDGARRGAASRLVEEMTVGEALSAAPIVRQASQSICDLFLSLYLLSGTREGQRQLLAEEWPERLPASFTRLIYALCLLGHEDRAAGCPSLTAADFAAWSLGLGMIARAAASAGLTRYARLALDFAPDWACVTRAADALLARQDWQDALLLLSAVPEDAAAESACGHFWYATGRALYHLGQSGAAECFARAEAAGCTERALSSYQAWSEEAEHGTEA

SEQ ID NO: 3163 - protein, 265 aa, Unknown
  Description of Unknown: Betaproteobacteria bacterium sequence
MYTESPEVSHKVSRPLSRQTLSAVIITKNAANQLAACLESVSFADEIVVVDSDSSDGTAELAALRGARVLRKEWLGFGAQKQFAVEAARHDWVLCLDADERVSEHLRASILAQLAAPATQAYAMPRRNRFMGRWLRHGEGYPDWSLRLFDRRHARWSDDPVHEKVLTGAPVARLEGDLLHDSAETLEAYLDKQNRYTSMQAVALFKAGKRAGVAQLLLSPVLRFAKFYFLRLGFLDGAAGLVHIAIGCCNSFHKYAKLMALQRGG

SEQ ID NO: 3164 - protein, 280 aa, Leptospira biflexa
MTSIPLSCAIITLNEADNLSRTLKAISFIDDIVVVDSGSTDETVTIAKSFGVKVYNRPFENYADQKNFAISKTKHDWVLAIDADEVVSPNLKTEILDLFSKNQLETKGYLIPRLTFYLGKWIRFSGYYPNYQIRLFHKSEGQFSGGLVHERVKLSSKPHKLKNPLFHYSYKNISDHLKFIDRYSSLFAEEEYRKGKRSSVLWAFVKGCFKGFYMYWIRLGILDGKQGFVLALLGFYYNFLKYLKLYEKSNSVPSFFVMVDSIHDVKGKKSTKKNSDQIHV

SEQ ID NO: 3165 - protein, 346 aa, Unknown
  Description of Unknown: Chlorobi bacterium NICIL-2 sequence
MDSQIPTVGVAMIARDCAETIARALCSVRTIARQIVVLDTGSHDRTPTVAARLGAEVYFHPWRNDFSDARNLALDYLRTDWVLVLDSDEELDGESFRAHCPNLADPMIGGVELTIVSALEGGITTAEHRYTRLFRRHRDIRFEGAIHEQIAASIQRAGFEIARSQVRILHYGYQTVQPEKIERNIALLHAELERQPDSPWLRYHLGLAYFAAGKFDSAAALLAPLCTCPELSAEQRELARLRAAQCALAQDRLLEAEQLLEMPCNDSHHEGLRRFIVAGVLAARRKFASALEALEHPSTCASGLVNQLQRERFCEHLRALGATQRLQARTLFPLGQSHAEWQTLFR

SEQ ID NO: 3166 - protein, 283 aa, Streptomyces pathocidini
MRKLPVVVAIPTKNEAENIARTVASVIGHFEAVVVVDSDSTDDTCAIAKSQGAEVVPYAWDGRYPKKKQWCLDHVHTGTPWLLFLDGDETPSPALLAELRRIFSQPVSAAAFDIPLGYWFAGRRLRHGHTIVKRALMDRTRCRFPVLGDLAAPGMGEQEGHYQPLADGPVVRLRSPIEHEDLDPVRTWFDRHNRYADWEAWLEHHPQVREEIRLAKTRQGRLFHKAPLKPLLSFAYAYVYRRGFLDGRAGLDYALAMTFYRWQIALKARELSRLTSSPTGRSR

SEQ ID NO: 3167 - protein, 265 aa, Unknown
  Description of Unknown: Deltaproteobacteria bacterium HGW-Deltaproteobacteria-2 sequence
MKLFSEEKYLEKIPLSIAIITKNEEENIRSCLQSISFADQIVVVDSGSTDRTLELAAEFGCEIYPEGWHGFGRQKQLAIEKCRLPWILVLDADERIPSETADIIKQIVIDPDVEEAGFSFPRKNYFQGRWIKHAGWWPDRIIRLFRKEKGRMTSAQVHEAVEVIGIVGELNVPIEHYTESSLSKIIQKIDKYSTLGAQEAFKGGKHSSVFSAFMRALFTFNQDYFLRLGILDGRQGLTLAVTDAVNKFFKYAKLSELVKINRGGR

SEQ ID NO: 3168 - protein, 529 aa, Unknown
  Description of Unknown: Cardiobacterium valvarum F0432 sequence
MYRLSVVMITQNEADNLRRCLPLVATVADEIIILDSGSSDDSAAVAAQYGTQWYENRNWQGYGIQRQRAQALASGDWILALDADEAPDAVLLAALADIKKEAPASTIYGIRRLDNLFGQPIDHPRWRNKAHWRLYPCHYHYNANPVHESVELAGATTAILPGYLHHHTATSPYHWLQKRLAYAETWAADAAARGKKSSAPGAVVRGLWALLKQYLADGRFLRGRIGWVYACLFAQYTYNKYALLCDHNRRPQSYSADYQPHTVNIHNLPKSTPPATPHPHPLSVVLITQNESRHLPACLASIQGLADEILILDSGSTDDTARIAAHFDAKWHENRDWQGFGIQRQRAQALATGDYILMLDADEQPDATLRTAIAQVLTYPPEAGTVHAVRRTNIFCGTRVHGWYHDRITRLYPRAHYQYHSYEVHESLDSRDATVITLGGCLLHHTNDNLAHFLEKNLRYSREWAEEHRARRVPNLWTLPLKSLVAFLREYLVRGAVCGGGYGLFLAVSTACYHYNKYLMLAYRDKGQP

SEQ ID NO: 3169 - protein, 330 aa, Congregibacter litoralis
MRLSLCMIVKDEAFFIEECLAAAAPHVDEIVVVDTGSTDGTRDIAARYADTLLDFEWIENFSAARNAGLAAATGDWILVLDADERIAAEDYPRLREAMATTAFDGFYLTTRNYTSNTTRSDFILATPDDSMSRGYAGYALHPIMKLFRARDDIRYEGGVHEIVDGSIVDSRRGTLDAIIHHYGEANPERPKKDRALRYLSMMENEPYFKEDGRLLSMAGSAAMYFAEDYAKANRYLRRAAELGYEPSRSLEGAAEAAYRHGNYGEAQDLYRRLYDDGQRTTSLCLNLANLAVRSGDKPRAASLLEECLALGGMGPQTDETIRRNIEFLKN

SEQ ID NO: 3170 - protein, 266 aa, Mucilaginibacter sp.
MVPVSVVIITKNEATLIEDCIKMACLITDDIVVIDNDSTDGTPLIASSYGCRVFRKSWSGYGSNKNKGIAEARYNWILSIDADEVPDTELIKALHDLNLDKPNIIYDIKFRSYFGKKLIRFGNWGNDHHLRLFNRSLVKWGETEVHETLLLPPDAEIKSVAGYIHHHSVTNIDDFKRKAVHYAQLSAAKYFKAGKKASFIKLHFSPAFGFLRNYIIRLGFLDGKEGLAIARGIYKNTHLKYLYLKQYKEQPQKQGTYRNELAIEQV

SEQ ID NO: 3171 - protein, 252 aa, Paraburkholderia phenazinium
MKETTLGVALITKNAASRLAECLAAVAFADAIVVIDGGSTDGTVEIARAHGARVLQEPDWPGFGPQKNRALDALDTGWILSIDADEIVTPELAAAISAAIAAPSAEVYAVDRLSSFCGQWVRHSGWYPDWIPRLFRRGAARFSDDLVHERLVFNTPAQRLTGKLMHYSYEDFETVLRKLDTYSTAGAQQRHAAGKSGSFGKALARGAWAFVRTYVLRRGFLDGRAGFMIAMFNAETVYYRFLKLARLGARER

SEQ ID NO: 3172 - protein, 440 aa, Unknown
  Description of Unknown: Calditrichaeota bacterium sequence
MSKPSLSVCMIVKNEERFLADCLASVKDVADQIVVLDTGSTDGSADIARRFGAEVYKYEWRDDFADARNASIKYARGDWIFWLDADERLLAESRTALREALTTEKKPVVYEIQINNHTLDDANAYLSTAYRLFRNGQGIAFYGRIHEQVGFTKKQGEVRPAHIVLEHLGYALDSQTDAAKKERNQRLLERMVAEEPDNAYAHFTLGQHYNLMKRYTDGVRHLEKAREIGGLGKPLTASLYTILSETYHKLGASEQAERMARESIHLESCQVGAWFMLYQLARARQDWDEALTYLDTMAEHNRTIREKGRTLPNDVLFEDLKIDITRAEIYASAGLYGRGFEIVAGYINRGNKDNRLWRRALDFALQAERWDDAEQLATALFRQNQSDLSLLDTLGKIYIKQQRFHEATQVFEALTAQQPAHTDYRRILDHLRTLNPQPMH

SEQ ID NO: 3173 - protein, 259 aa, Unknown
  Description of Unknown: Betaproteobacteria bacterium sequence
MSSAPPPAATAPLSAVLITLNAAHSLPSCLQSLAFADEIVVVDSGSSDGTVALAEHYGARVVHQEWLGFGRQKQFAVSQARHDWVFCIDADEQVTPALAAAIGAALQGPRHHAYRVARCNRFMGRYLRHGEGYPDWNLRLFHRGHARWSDDAVHEHVLTGESVGDLAGDLLHDSAETLDSYLAKQNRYTTLAAEAAHRAGKRAGSGRLLLSPLFRFIKFYLVRRGFLDGLPGLVHTLIGCTNSFAKYAKMIDLQRRSGR

SEQ ID NO: 3174 - protein, 258 aa, Pantoea dispersa
MSQRQRLSVVMIAKNEADLLPEALASVSWADEIILLDSGSSDATIEVARAHGAQVYQADGWAGFGKQRQRAQAFASGDMILMLDADERVTPELRRAIEQVLTQPPSDKVYSLGRSNLFLGRFMRHSGWYPDRVLRLYPRHLRYNDNLVHESLETQGTPVVALPGDLQHLTCRDLIAFQRKQMNYAEAWAQERFQRGKRCSILSVFSHTAGAFIKTLLLRAGFLDGKQGWILAVVNAQYTFNKYSALWALHHTSTQGRV

SEQ ID NO: 3175 - protein, 414 aa, Unknown
  Description of Unknown: Micrococcales bacterium sequence
MARSLLSAALIVKNESAMLAGCLDSLNALRPLLSDVVVYDTGSTDGTQDIAAAHGARVHQGSWTGDFAAARNAAIGLTRSRWVLIIDADERVSADVAQLRALLRRANETAEGMTVQMSLINDAGARESTFPSVRLLDPRKAKYVGAVHEQVAPRRGKRGLRAIHTDASVISVDHVGYRAAHMPAKLARNAALADAEITKGLAAGRDLGELIQPLVDRARSLAPSDPEAAIADYEQLAAMADATSGYRLWGLEKYTELLIELGRHERAAEIIELLASAEQASDTATAWLRVQLLLATGRFERALDLLRTLNAVESTTTRMTVNNANLTFARLRAAINVGEHEEALACCLSLIVDHGRSAGLAPELIALWHDRPVQPLVQILQSAQHRTVLELATQLQGVREPGPTVAQQLAGQAA

SEQ ID NO: 3176 - protein, 269 aa, Steroidobacter sp.
MLPVTLIVIAKNEAPVIGRCLDSVPFAADKVVVDSGSMDGTADIAAAHGARVVHQQWLGFGPQRNFATGVAKHDWILVLDADEQLSPALAAELERRLPSIMESSLAGAHFRRATRFMGKAMRWYRPMSGERIARLYHRERARWSDKRVHESLQFKGAVTSFRERLLHDHNPTLVHRHIKMLRYTELRAQDWHERGRKVRMWLCPLVFITTFLKDYWLRLAFLDGWRGYIVAQTAASYAVYKRLRYYELDVDPSSAALASELLRKHGLEP

SEQ ID NO: 3177 - protein, 252 aa, Acidihalobacter prosperus
MAREPFSAVIITHNEAARIGACLDCLDFADEILIVDSGSTDGTLAIAEGRGIRVVHHDWAGFGPQKRFAVDQALHDWVLCVDADERVSEALRASIEGALTEPKAMVCRIARRNRFMGRWLRHGEGYPDYVIRLFHRDHAEWSEDAVHETVLTDDPVITLAGDLLHESEYGVAEYAAKQARYAHLQAERVRAAGGGSSWVRAVVSPGLRFVKFYVIRLGFLDGLPGLAHILLGCFASFLKHLDLVAGRRRGTD

SEQ ID NO: 3178 - protein, 258 aa, Unknown
  Description of Unknown: Candidatus Woesearchaeota archaeon CG10_big_fil_rev_8_21_14_0 _10_44_13 sequence
MQKINEGKSISAVIVTKNEEENIKDCLESIKWVDEIVIVDDFSTDKTRGIAIDYGARVYQKKWRGYSRTKNYAVSLARGPWILLIDADEVLSKGLKEEILHELGNDNNEVYRILIAEFLMGRDINGNSGEGMIRLFRKGSGRFMGEVHEKFSIDRIKVKKMRTLRNPLFHDRKRTIERLISKIDKYSSIEAEGLYKKGFRPGIIKILFSPPIYFFRSYIIERRFLKGKPGLVYSTLMSYYVFLNLAKTKEMDMKNEKG

SEQ ID NO: 3179 - protein, 263 aa, Methylomonas methanica
MLTVAILTYNEAGNLPRCLAAIPDRYPILIVDSGSSDATLTIAREHGCRIYSNPWPGFAEQRNFAMNQCDVETPWLLFVDADECYPADFYQQFDSGVLPLEDIDVLMVPSILYLREKRLNHAPGYPIYHPRLVRRETVRFVRNHTGHGEAVIDSCRIAYGELPYLHYFYHGEIIEWMHKHVDKAAQEVQLKPTAGAVMTTRGRLSVLLGRSWLRVLARFLYHYLFRAGFLDGRAGLEFALMFTWYEATIYLQAKAARQARRKV

SEQ ID NO: 3180 - protein, 255 aa, Desulfomicrobium apsheronum
MAKPEVTGLILTLNGARHLDACLTSLDFCDRILVVDSGSTDATADIAAAHGAQVLVNPWPGPKKQFELAFEHIATPWVVSLDQDEILSDELRASVIQALQDPSDMSAFLCPRTSYYFDRFLRHSGWYPDLLPRVFKLADTGVHVSGPHYGFETKGKTRRLAGDIIHYPYENLKQHVEKINYYTQIAAEEMHAKGKRAGVATAIGHGLARFMKIYFFRRGFLDGKAGFVLAVNSFFYAFQKYIRLAELGAKKTQSS

SEQ ID NO: 3181 - protein, 281 aa, Unknown
  Description of Unknown: Chitinophagaceae bacterium sequence
MIRWKDKQVSWYWLLLLSLGSRNYHHPMYNQLSVVIICRNEAAIIGKTIAAARTCTDDIVVVDSGSTDGTQAIVTSLGARLIETGWEGYGPNKNKGVAAAKHDWILSIDADEIPDETLQQELQQLSFTDLSVVYNIRFRVFLGQQMIRFGEWSNDRHIRLYNRRHGGWNNAAVHEGLVFPAETKTVTLKGYIHHYTSRNIADFATKTVNYAMLNAQKYHQQGKGAGWLKCRLAPGFSFVKNYIFRLGFLDGEAGYTVAKMNAWYTWLKYARLRELNRENRG

SEQ ID NO: 3182 - protein, 264 aa, Unknown
  Description of Unknown: Comamonadaceae bacterium CD01 sequence
MTMTQDARPTLTVVVLTLNEEHCIEQCLKSAAFADQLLVIDSGSTDATVALVQGQGAEVQVYADWRGFGVQRTRALQHVRGDYIFFLDADEVMTPAFAQELKAVVATEEKAVWKIRWRIVAFGQELRYFRATTEVERLFRRDQLQEYTGVVHEEAVLREKNVPRHSICEPLLHHTRPSVRAGLEKMTQYAILGAAKRIELNKKGGVIRGLAAGMVMFVRFYFFRLGFLCGGAGFLYCFFVALEAFFRYAALQFDREALTDEIRR

SEQ ID NO: 3183 - protein, 246 aa, Unknown
  Description of Unknown: Epsilonproteobacteria bacterium sequence
MKITANIITLNEENNIRDAIKSVQEVCDEVLVIDSLSNDKTCDIAESMGAKVVKQEYLGDGKQKAFGAPIAKYDWILSIDADERLDANAIEAIKNLDLDKSSYDAFSFARKTYVGKNFIKLWYPDRVTRLYNRTKCEYTTAGGHAKVDTDNVKALRADMLHYSYEDYAHMIKTTHKFITRGAKISYKEGKRASKFDPFTHGVGALFKALILKGGAFHGINGWNVAVISAFSSYMKYALMLEMQENE

SEQ ID NO: 3184 - protein, 252 aa, Unknown
  Description of Unknown: Planctomycetes bacterium sequence
MATVCVVVTTKNAAATLPRCLSSASFCDEIVVVDSGSDDGTVDVARSFGAKVFVRHYKNAADQKNWALQHVHSDWVLVLDSDEWLSDEAAGAVRRVVAANRPYAYRIRRVSRFLGREVRHAWRHDYPLRLFPRGSGRWDNRRVHADFLCSLPVRRLETPLYHDVAETLSAYLPRWLRHIEMAAEDLAERGGCSLLKGLLSAGWRLLRQYVLQCGWLDGRAGLYVALLSAGSVLLRHMLARDIRAAGSSAPSN

SEQ ID NO: 3185 - protein, 255 aa, Rahnella sp.
MADKKRLSVVLIARNEADLLPECLESVTWADEIILLDSGSEDATLDVARQFGAKVFTNVQWPGFGKQRQLAQSYATGDYILMIDADERVSPELRQSVENVMNNPQENTVYSLGRSNLFLGKFMRHSGWYPDRVNRLYPSSFHYNDDLVHESLNTGNSAVVPLQGDLLHLTCRDFFAFQRKQLSYAEAWASQRHQQGRRCRFFSVISHTLGAFIKTWILRAGFLDGKQGLILAGVNAQYTFNKYAALWALSHQLQK

SEQ ID NO: 3186 - protein, 273 aa, Dyadobacter sp.
MIPVSIVIITKNEALLIGECLKSAALITDDIVVIDSGSTDGTLEIARQYGCRIYQENWEGYGANKNKGVALAHYDWILSIDGDEIADRRLIRSLHNLDFDDPRIVYDIKFRSYFGKKPIRFGEWGRNHHVRLFNRSQIKWAKAKVHETLLLPKGTIRKKTEGRLHHFSVQNIFECHNKAIYYARLSAAQYAKNGNKASFLKLYLSPSFVFVKNYILRLGFLDGWEGLVIAKMMFKNTRLKYYYLKQYEQGKFVRDENLPHHQHLFLNIDPFEK

SEQ ID NO: 3187 - protein, 258 aa, Unknown
  Description of Unknown: Comamonadaceae bacterium sequence
MALSVIIITRNEADNIAACLASVAFADEVVLLDSGSTDATVELARSLGAQVHVSDDWPGFGPQKNRALQLARHDWVLSIDADERVSDALALEIRQAISRGGQGAYEIPRLTQFCGRWIRHCGWTPDHVLRLFRRDSARFSADLVHERVLLTHATATALKTPLLHYSYPTPGHYWRKLEHYSRAWAQQRHAQGQRTSMLRACLAGVVAFIRSYFFQLGVLDGAMGFAVCAMQAQGAFGKYFVLYCLNRADESKIPLPPA

SEQ ID NO: 3188 - protein, 253 aa, Thiohalophilus thiocyanatoxydans
MSITATIITLNEEENIRDCILSVQKVCDEVIVVDSLSQDKTVEIAESTGATVYRQAYLGDGPQKAFAVPGAKNDWILSIDADERLEQDTIEAIQNLDLVNSHYDGYSLKRRNFVGEHWIKAAGFYPDRVVRLYHRERAGYLPRKAHSRVEGENIARLDAHIEHFTYRDYTHWVERINQLSSRDAWAKHQKGVKVTRFTPALHATGALIRKLIFKGGIFQGQDGITVAVTTAFHAYMKYMKLIELKELSSRNKL

SEQ ID NO: 3189 - protein, 266 aa, Hydrogenophaga sp.
MAETRTPLPTLCIGILTLNEAHRIAQCIQSASFADQVLVIDSGSSDRTREIAEELGAQVHAYTAWQGFAEQRNRLLTHVQTDYVFFLDADEVIPEGLQKEIRAAVDTGDNAVWKIYWDQVAFGRTLHLMAKTEGGVWRLFRSDQLLRYEGVVHEHAVLRDPLTPVKTFQTRLLHHSRETVYGGLLKMAQYAQLGAVRRVQMGRRGGVWRGLASALSNFVRLYVFRRGFLCGAEGFLFCLLVAMECFFRYVIIKYDRPVPGPTMVKR

SEQ ID NO: 3190 - protein, 325 aa, Niveispirillum lacus
MGSAIPVSVIVMTRNEVANIARCLAPLSAFAQVLVVDSDSHDGTATIAAARGAEVVNFHWNGAYPKKKQWCLSHPSLRHDWVLFVDADECITPQLVAEIDDLMRSGPSHNAYWVNSRPVWLGRLLRHGTPYRKIALLHRRRSRFPICPDLHVSRMWEVEGHYQPMVEGQTGRLSATLIHADAKPLADWFDRHNRYSDWEAALANDGGASALLAGERGLRRVAKQVLARLPGRPLLAFLHAYLWHLGFLDGKAGLHHALSRAFYYWSIDLKRDWLAARMTASQTETTGTLLSDTRDHTAFVLSSGSPASVFTNSNVRRRTDSSGIR

SEQ ID NO: 3191 - protein, 247 aa, Unknown
  Description of Unknown: Acidobacteria bacterium sequence
MLSVVMITRDAAHLLKRTLSAVSFADAIIVVDSGSTDGTRELAEELGAKVYLQEEWQGYGHQKSYALSKAEGDWVLLLDADEVVDDTLAAGIQGAVQSKGSVAGYSMRRVNYYCGARLRFGNGRPSYVERLFQREKGRVSDHRVHERVLVDGVVERLEGELHHYTTESLSHRVLKGDTYATTAAEELHRQGEHAGVLKLLFIFPLSVFRDLILKAGILDGRSGIIMAMTGAFYSFSKYAKLWELRKK

SEQ ID NO: 3192 - protein, 258 aa, Polynucleobacter meluiroseus
MPTLSVILITRNEQANLGDCLASLEGIAQQIVVVDTASNDGTLEIAKNYGALISQPADWPGFGPQKNRALDLATGDWILSLDADERLTPALRSEILTAMHHSAGVDCFAIPRLSWFCGRFMRHSGWTPDYVERLFRRGTARFSDDLVHERLIPNGQVAKLTNSLLHYSFMNAAQVTAKMERYSTDSAKQAFLKGKKASILAPITHGTWAFIRTYILRAGFLDGPQGLSLAFANAQGSYYRYTKLRKLNQTAELESAQT

SEQ ID NO: 3193 - protein, 264 aa, Tepidicella xavieri
MPMTDGHRPTLCIGVLTLNEERRIEGCLRSAAFADQIVVVDSGSTDRTRDIAQSMGAEVYVYDQWEGFATQRNRLLAHVKTDYVFFLDADEEITPALQAEIEAAIKFPMPKVWETYWQEVAFGKPIFNLMGKKSLARLFPKSYLLRFEGVVHEHAVLLNDALPRQTFKSALLHYSRETVHDSLRKLTQYSMLGAAKRAEKGKTGGVLRGLASALPMFFRLYVLRGSFLSGGPGFLYAFFISLECFFRYAALRYDKNRLSNTVRR

SEQ ID NO: 3194 - protein, 256 aa, Raoultella ornithinolytica
MSTRLSVVMIAKNAADLLADCLASVAWADEIVLLDSGSSDNTVELARRLGATVYINSDWQGYGIQRQRAQDYATGDYVLMIDTDERVTPELACSLRRVLEAPQKGAIYSIARRNYFLGRFMRHSGWYPDRVMRLYERSRFRYNNNLVHESLDAKGAQVIELSGDLLHLTCRDFSGFQQKQLAYASAWARERHQKGKKTSLASIFGHTLGAFVKTLLLRGGVLDGKQGWLLAVVNAQYTFNKYTELWALSRGYSEKV

SEQ ID NO: 3195 - protein, 258 aa, Unknown
  Description of Unknown: Bradyrhizobiaceae bacterium sequence
MSESQEVRSRARLSAIIITKDEAANIGACLESLAFCDERVVVDSGSTDGTLMIAREKGARVNFHAWQGFGAQKNHALSLARGDWVLSIDADERVTPELAAAIQAAIGKEGMDGYTIQRRSSFCGRMMRQSGWSRDRVLRLFRRGKARFSDDLVHERVVCEGPVGRIDAPLLHHPVRRLEDAIRRMDSYSTLGAQQIIASGRPVSFLTGIVRGGFAFLRVYVLQLGFLDGAAGFLLAVANMEGTYYRYMKAWLERQKLG

SEQ ID NO: 3196 - protein, 260 aa, Limnohabitans sp.
MTHAHPTLSAIVITRNEAHNLHDCLQSMRGLVDEIIVVDSQSTDATVAIAQQHGAKVAQPADWPGFGPQKNRALNLATCDWVLSIDADERVTPALAAEIKQVLQAEASDVAYKLPRLSSYCGKFIHHAGWQPDYVLRLFKRGTARFSDDLVHERVVSEQKVDALQNHLLHYSYLNFSQVLSKVDAYSSASAKQAYARGKRSSVAGALGHGAWAFFRTYVIRRGFLDGGHGLALSISNAETSYYKYLKIWQMQQAEEAAAK

SEQ ID NO: 3197 - protein, 257 aa, Comamonas badia
MPTLTVAVLALNEARCIARCLRSAAFADQLLVVDGGSTDATVDIARSLGAEVHAYPDWQGFAVQRNRLIAHASGDYLFFLDADETMTPAFAAELQAIVAGGARAVYSIRWRLVAFGRELRRFRADTRVERLFRRDQLREYVGVVHEQAVLRETEVPRRLMRERLLHEARPTVRISLEKLTQYALLGAAKRAGGSARGGVLRGLAAGSWMFARMYLWRGGFLCGGAGFLYCWFLALEAFFRYAALYYDRDDLTAEVAR

SEQ ID NO: 3198 - protein, 260 aa, Limnohabitans sp.
MTQTRSTLSAIVITRNEAHNLDDCLQSMHGLVDEIIVVDSQSTDATVAIAQQHGAKVAQPADWPGFGPQKNRALDMATCDWVFSIDADERVTPELAAEMKHVLQTGRTTAAYKLPRLSSYCGKFIHHAGWQPDYVLRLFKRGTAKFSDDLVHERVVTEQFVVALQNHLLHYSYLNFSQVLSKVDAYSTASAKQAYARGKRSSVAGALGHGAWAFFRTYVVRRGFMDGAHGLALSISNAETSYYKYLKLWQMQQAEESAAN

SEQ ID NO: 3199 - protein, 273 aa, Rhodopirellula maiorica
MPVISAIVICRNEADNILRCIQSLDWCDEVIVVDDNSTDGTADIARNAGAKVINHPFESFASQRNWAMCQPVVQGEWILHFDADETSSPSFASAVNDAIRTASNDCVAFALCRKTMFHGAWLKYSDGFPVWIMRLVRRNTVLFEDSGHGEVPIPKIAGTLPKIDEPFIHDAFSKGLSNWVERHNKYSSYEAGHERQSEQPLMFRQIISTDRAIRRRALRGLSRRLPARPVMRFLYQYVLKFGFLDGRPGLQFCLLMAIYEWFIVLKKNELESA

SEQ ID NO: 3200 - protein, 255 aa, Unknown
  Description of Unknown: Betaproteobacteria bacterium sequence
MNAAPRAPLSAVLITRNAAAVLAPCLESLAFADEIVVVDSGSSDGTAEIARRYGARLVQKEWLGFGQQKQYAVDQAQHDWVLCLDADETVSPQLAASIQAALAAPVSPVYRMPRRNRFLGRWLSHGEGYPDWSPRLFNRMNARWSDDLVHEKVLYAVTPGTLQGDLLHDSADDLTAYLERQNRYTTLAARQAYELGRSAGFFHILMSPVVRFFKFYVFRLGFLDGMPGLMHISIGCMNSYLKYAKLIELRKADEK

SEQ ID NO: 3201 - protein, 758 aa, Unknown
  Description of Unknown: Actinobacteria bacterium sequence
MPGRTTRDRCTSTIPFSTVSQVPQTGADGTYVSRASVSVIVTASGSPEDFRACLAGLRNALGPRDEVVCVLPAGRADLSSELRGTPPVATVEDTSGDQGTRWSAGLAQTTHPVVVLLDGDAVGAGPWLDRLAEAFDDPDVVAAGPRCHRSSGPQWVDLPDEAAHSTADFRAYARHWSREHRRKITIVDRLGPVCVAVRRDALLQAGGPGPELPYQALRTTGRLVVVHDALFAHIGGDRCVLRTPAAISGEAPLLSVSMIVKDEEEVLAECLAAVRPFADEIVVYDTGSTDRTVAIAREHGARVIEGYWDDHFGDARNRSLAHCRGEWILMVDADEVASGDPEALRAYLAGTSERAVLVPLASLEGRGYTGQGALTPRLFRRADARYHGRLHEQVVDAVTGDNLIGPATSDLELAHSGYTRDRFVAKDKGARNVHLAKLAEDERTNDPRAAQNLARSLMFAGRAREAIDVCTAALAEDHGPLYRQTLLYVVVSAALALDDVDTARAAVEDLRSVSGSPVLADFVETQVRYAAGDHAGALRIIEAFPERGTDDRLMVFSRAQLAVFEILGLCELGRHRDAADRLRGYLGRGELPLDVPQTARVLEAGGTGVAELADLVPERSLRRLLIAVAEAPPELADDVLEALWRRRDGDRRILAVAARIGGQLRLIRAMEWSARLRQHGLAERCTLRALAADPQRSSRDRALAAAIAVELFADQDVLPALADALADVPDEEGPAVLDELRVFAPGIAAAIEPAPVQR

SEQ ID NO: 3202 - protein, 265 aa, Unknown
  Description of Unknown: filamentous cyanobacterium CCP2 sequence
CIHSVQWADEVLVLDSGSTDRTREIATSLGATVYEQEWLGYSAQRHKAITLAKHDWIFFLDCDEIVTPALAHSIQQVMAGSPDPQDGYSVDRQGDFYGVLLPNSSPHHRKLNFVRLFNRQYSGYDTSVKVHEEVQVAGKAILLEGVLIHWRAYMMDEYIASANRYATLEAEMLDEQGVRSNALKLLLRPIFRFLWCYVRHAEFRLGMRGLIHSCLMATSEYIRYAKLWELQNAKRVLHPPATIYSPSISSSRTSHSLYPAAGERT

SEQ ID NO: 3203 - protein, 416 aa, Austwickia chelonae
MAVPLLAAALIVKDEAQNLPECLAALNALRPLITEICVYDTGSTDGTQEIARAAGATLSQGYWDGDFARARNEAIGMTNAKWVLIVDADERVSADQAAVRRSLRAALTAANGRVDALRVPCTNVEENGSDGVLWGSDRLFRRSRAHYVGAVHEQVMRLDGKPVVFDELSPRQILIRHHGYLDEKLLSDKLQRNLQIAEDEVAALPPGAPAENLIRAYIDRARSRVGAGDTEGGLADLEVVRATPSPSKYRLHGLQQYAGWLIDLERVDQAAEIIAELAEAPIHQSHTQWLTARILFLRGRHAEALTLLRAIDKLVGATGTVDVPRPLVEARLKAAAITGEIDEAAACAVRLIADLGVVESYPRLLMTLWGDRELSVLAQILVDSDRGYLSSALPAFEELGDRGQELAGLIRKKLAP

SEQ ID NO: 3204 - protein, 253 aa, Gilvimarinus agarilyticus
MRLSAVLIVKNEADKLADCLASLDFADEIVVLDSGSDDATVAIAERYGARVTVNTDWQGFGVQRQRAQALARGDWVLMIDADERVTPELRASIEAALAGPSAIYYLNRLSWCFGRYMRHTAMYPDWIPRLYPRTLAGFDDTRVHERLCNRDNLPEHRLAGDLLHLVYDNVRHLVNKSALYAEQWAIARAEAGRTCSLWSAFGHGFSCFVRMYLLRRGFLDGGQGFLIAVVMSHSTFVKYADLWVRSRSQPHSP

SEQ ID NO: 3205 - protein, 288 aa, Unknown
  Description of Unknown: Betaproteobacteria bacterium HGW-Betaproteobacteria-11 sequence
MSPPAVPPLPAPPPLSAVLITRDAVGMLPACLESLAFCAEIVVVDSGSEDGTPELARALGARVIESHWRGFGAQKQFAVEQARHDWVLCVDADERVSPGLRESIRALFAVAAPQSGNVCPRRGIPGMQSPGTQGTSAPGFCAYRFPRCNRFMGRYLRHGEGYPDWSLRLFDRRHARWSSDAVHEKVLCTDPMGVLEGDLLHDSAESLETYLAKQNRYSTLAAEAALAAGKRAHAGHLLFSPLLRFLKFYVFRLGLLDGVEGLVHILIGCTASFAKYAKMLDLQRNRSS

SEQ ID NO: 3206 - protein, 255 aa, Unknown
  Description of Unknown: Candidatus Melainabacteria bacterium sequence
MATLSVVIVAKNEERIIGRTLDAVRDIADEILVVDSGSEDKTIEISTSKGARVVHQDWLGYAGQKNFALSLAKSDWLLSLDADEVLTPESVAEIKAIVSGETTGKCDGYKIPRILYIGEHPVRHGGFYPDAQLRLIQNGKGKFRDRMVHERIFVDGPVAVLRHPMLHYSYRNVDEFTKAMDKYARLSAEEFKQDGSKKWRANPLNELLHPMWTFFARYVLRLGFLDGKLGLEMNLIYSNYVRNKIRYLRESEGAF

SEQ ID NO: 3207 - protein, 261 aa, Paraburkholderia sp.
MQETTLGVAIITKNAAARLAECLRSVAFADQIVVIDGGSVDGTADIARAHGAQVIEQTDWPGFGPQKNRAVNALNTAWILSLDADEIVSPELAASIRAALAAPAADVYAVDRLSSFCGHWIHHSGWYPDWIPRLFKRGAARFSDDLVHERLVFDTPAQRLTGKLMHYSYEDFESVLRKLDAYSSAGALQRHAAGQRGSFGKALGRGAWAFVRTYLLRRGFLDGRAGFMIAMFNAETVYYRFLKLARLGEASRSKPGSQQRP

SEQ ID NO: 3208 - protein, 249 aa, Pseudolabrys sp.
MPRLSVIVIAKNEAANIGACLDSVALADERIVVVDGGGTDGTAAIAAAKGVRVVEHAFAGFGAQKNFALSLANGDWVFSIDADERVTPALAAEIAKAMNEPKADGYEMPRLSSFCGRQMRHSGWYPDYVLRLFRRGRARFSDDRVHERVICDGPVARLANDLLHTPVLRLEDALSRMDRYSTAGAAMTVARGKRVSFSSGITHGLWSFFRTYILRGGFLDGREGFLLAVANAEGTYYRYMKAWLAGRNR

SEQ ID NO: 3209 - protein, 252 aa, Dyella sp.
MAREPLSVVVITYNNADTLDACLREVDWADEIVVLDSGSTDSTVAIARMHGAKVEVHPFDDYGPQKQRAYDLARNDWVLNLDADEMLSPGTRAIIERALEDPSHAGFRLPRRERMFWTVQHRWSHRNGHLRLFNRKRGGMNDVEVHAAVEVRGPVKTLWGADFVNKGDGDIDTRVEKINRYSTGMVAYKLRRGQRFAGLRMVIYPPLFFLRQFVLKRYFLSGWAGFIASVLGAFYVFLKYAKLYETRRVNRS

SEQ ID NO: 3210 - protein, 259 aa, Halomonas sp.
MSLAAVLIVKNEEAHLQACLETLSWADEIVVVDAGSMDGTRDIARAFTDKVVVEDDWQGFGVQRQRAEALVESDWVLMIDADERVTPELRGSIEAAVALNQPAIYTLPRLSWCFGAFIRHSGWYPDRVARLYPRQRAGYNASLVHEKLENPERLVVKPLQGDLLHFTYRDLRHYLEKSAHYAQAWAEQRAARGKRGSLAAGIGHGIGCFLRMYLFKAGFLDGRQGLLLALLSAHSTFAKYADLWVRTRTSPPPDDISAH

SEQ ID NO: 3211 - protein, 274 aa, Unknown
  Description of Unknown: Holophagae bacterium sequence
MDVAPIPKAPLSAVLITRDAERQLERALAPLAFCSEILILDSGSRDRTRAIAAAHGAVWHEHDFEGYGPAKRRAVALASCDWVLSLDADEVLDEQAITALAGIDWAAADPRTCWSLRRRPFVGSREIRHGDWAPDWVVRVFNRRHHTVSADLVHESVTPTGPLRRLDGSLLHFTAADLAAVFRPDYYRLKAVVYRQRGRRAGAPVLALRAAVAFVRSYLVRAGFLDGRAGVVVAVAAAANAVTGLALAASETASVPGSADVDRRPAPEGGRDPR

SEQ ID NO: 3212 - protein, 253 aa, Polynucleobacter sinensis
MPTLSVILITRNEEANLADCLASLEGIAQQIVVVDTNSTDRTLEIAKMHGALVSQPADWPGFGPQKNRALDLATGDWVLSLDADERLTPALKSEILTAIHHSAHVNCFAIPRLSWYCGRFIRHSGWSPDYVDRLFKRGTARFSDDLVHERLLPDGQVAKLENPMLHYSFMDFSQVLQKIDRYSTASAEQAYAKGKRSSPLKAILHGAWAFIRTYFIRAGFLDGQQGLALAISNAEGSYYRYMKIWLIQNQVEK

SEQ ID NO: 3213 - protein, 391 aa, Unknown
  Description of Unknown: Deltaproteobacteria bacterium sequence
MQTLSLCMIVKNEAGNLERSLAPLIPFVDEAVVVDTGSDDGTPELAASLGARVHQFAWGHDFSAARNFSLEKAAGDWIIWLDGDNRVPEEDGALLKSLVQRPQDAILWATEVLEPGGGRLLQKRFFPRRPEIRFRYRVHEQLVHPPDLAQVITPVRIFHWGYETRELRQAKARRNLTYLLAELQERPEDFYLRYHLTRHHFYAGELEEAWGQLQMVLATPWLENQNPEIARHARLLAALLLDRADDLSGALRQFREVVERYPDYGLAWYHLGQTCFRRNDFDTAALALARFLELGCGHFFLDQPEEKLTLTALLTRAQALRRLERFPEAGEVLKDAQRRYHQEPGVWLETAALARACEDERAARRALGACLNLRPGFRRARMLLAEMDGRV

SEQ ID NO: 3214 - protein, 403 aa, Reyranella sp.
MRRRARTHCRGSVRITATLIARDEEHFLPGCLQSIRPLVDEIVVVDTGSRDATRAIARAHGARLHDFAWRDDFSAARNFALDQAGGDWILYIDADERLRPLDRATVERELSTPEWWAATLRFHPQTGYTAYRELRLFRRHPEIRFQGAMHETIVPSLNRLAGDRGEAIGTSTLTIDHLGYDGGSVRKHARDLGLLRRQIAATPDRTYLWWHLGSIERERGDPAAAERAWRQGVEAARRSPIRLAEKTMCFAELARQCGIDGRNGEALALIAEARTLQGDNYLLDCLEARSLAATGRCEEALAIFESLASIDADMLVDDFAYDRALFGAGALAEGGLCLFRLERYADSAHWFGRAVAREPGNLAFRARFQLARARAQQSKQKHHRLGSGHADTALGEAPSPETG

SEQ ID NO: 3215 - protein, 254 aa, Halomonas anticariensis
MKPITGIVITLNEENDIACCIRSLFLVCDEVIVVDSLSQDNTVDIARTEGARVIEQAYLGDGPQKAFGVPYAKNDWILALDADERLDDDAVELIKSLDLSDAGLAYGFRRKNFVGHHWIRAAGFYPDAVVRLYNRTQAGYLPKKAHSAVQAPQTLQTSAHIRHFTYQDLSHWIQRIDQLSSRDAWAMKERGIPPSTWRPTLHALSATIRKLVLKGGLLQGRDGMTVAMTTAFHAYMKYAKLNELYENEHTRQER

SEQ ID NO: 3216 - protein, 249 aa, Acidaminococcus fermentans
MGTCTVAILTKNEEKHILAALDSARPCADQLLVVDSGSTDHTVSLAREAGAEIAFREWDEDFAAQRNFALSQAKGDWVLYLDADERLTPALVEKINAIKKGNQDHQYSFKRINIAFGHEFHHGAFSPDRVKRLFPREKVCWVGKVHERPECPLPVTELGESLHHYTYDSFAQWWNKAGHYTSLWAEEARERGKKATARTAAGHALLGMVKAYVLEGGFLEGSMGFIAALQHGIYTAMKYMKLAELCSRK

SEQ ID NO: 3217 - protein, 255 aa, Campylobacter jejuni
MADKKRLSVVLIARNEADLLPECLESVAWADEIILLDSGSEDATQDVARRYGAKVFQNTVWPGFGKQRQLAQSHATGDYILMIDADERVSPELRQSIENVLHTPRDNTVYSLGRSNFFLGRFMRHSGWYPDRVNRLYPAAFRYNDDLVHESLKTENASVIPLQGDLLHLTCRDLFVFQRKQLSYAQAWAEQRHRQGRRCSFFSIISHTLGAFSKTWILRAGFLDGKQGLILAGVNAQYTFNKYAALWALSHQLQK

SEQ ID NO: 3218 - protein, 249 aa, Halomonas subglaciescola
MLAELSAVIITRNAAATLARTLDALEDVDEVVVYDNGSTDGTLELAARYPNVALHQGEFHGFGPTKRHAVSLARHDWIVSLDADEAPDARWLESLAGWLPTADSRQVVEVHRENWMLGKPVRHAGWGNDWLVRVFHRREHNFSEAMVHESVTLGQATQIARLDGCLTHLAVTELAQFLDKINRYSEIRARSDKLRVYPVALIVLKAAFAFFRTYLLQRGFLDGWRGLVIAVSNANGVFWKYMKRRVRDL

SEQ ID NO: 3219 - protein, 261 aa, Unknown
  Description of Unknown: unclassified Limnohabitans sequence
MKTNAPTLCIGILTMNEERRITQCIESAKFADQIVVVDSGSKDNTVAMAQTLGAQVHTHADWQGFAEQRNRLLQYATCDYIFFLDADEVITPELQAEIQAAVSSGRKAAWKILWNQVAYGKSLTRMKSTGGVMRLFQSANLLRFEGVVHEHAVLADPTTPVITCKGRLLHYSRETVYGSLQKLAQYAQLGAAKRAKAGKRGGVLRGFASAFANFIQLYFFRRGFLCGAEGFLFCFFIALECFFRYAMLHYDKDTLEKIVTR

SEQ ID NO: 3220 - protein, 255 aa, Desulfocarbo indianensis
MALLSVALICQDEAANLPAWLEAVKPFADEIVAVDSGSQDATLRILEQAGALVRARAWTGYADQRNHAASLCRGDWLLFLDADERPDAELAAALNALKTGPPPKERAFELNYKVFFFGRFLRHGGFFPERHLRLFRAGAARWERREVHERLSAEGPLGRLPGYVHHHSYATVGQYLRRMERYSAEAARQMAAAGRRAGPLTAVGHGAWAFLGRYVLRLGFLDGWAGYLAARLEALYTFTKYARLMELNRAPRDVS

SEQ ID NO: 3221 - protein, 251 aa, Bibersteinia trehalosi
MPSLSVAMIVKNESQDLAACLETVKDWVDEIVILDSGSTDSTKQIALEYGAKFYENLDWQGFGKQRQLAQQYVTSDYVLWLDADERVTPELKQSILRAVQENKADSVYQLARLSEIFGRQIRHSGWYPDYVVRLYPTKLAKYGDELVHEKVHYPAGTKVIKLSGDLLHFTYKDIHHYLVKSASYAKAWAMQRASQGKKASIGQGISHALSCFFKMYILKAGFLDGKQGLLLAILSAHSTFVKYADLWDRTR

SEQ ID NO: 3222 - protein, 247 aa, Stenotrophomonas acidaminiphila
MTSPLPLSAVIITRNEADRLGRCLASVRDVCSEILVLDCGSDDGTVALAQSYGARVEHQDWLGFAEQKNEAIRRATQPWLLLMDADEWLADALRRLFASGAVERADVWKLKRCNWFLGRMLSGFERTERLVRPDHRYLPMRVHEKPDLSGKRVQDCDIVIEHNTARTLDAHRAKNARYARLWAEQRHADGKRCSALSPWTHATAYWLKMYLLRAAWRDGRQGWWFHASHAQAVLDKYRHLHALGRTP

SEQ ID NO: 3223 - protein, 252 aa, Unknown
  Description of Unknown: Betaproteobacteria bacterium sequence
MPQPLSVVLIAQNAAAQLPQCLASAAFADEIVLVDSGSSDGTAELASRCGARVLHKEWLGFGRQKQYAVEQARHDWVLCLDADERVSAQLAAGIRQALEAPAAPVYRMARRNRFLGRWLRHGEGYPDWSVRLFDRRQARWSDDAVHEKVLFAVTPATLAGDLLHESAEDLGRYFEKQNRYSALAARQLHERGRSAGIAELLLSPLVRFVKFYLLRLGFLDGVPGLVHIAIGCAASFLKYAKLIELQRARPAP

SEQ ID NO: 3224 - protein, 257 aa, Unknown
  Description of Unknown: Halomonadaceae bacterium T82-2 sequence
MQPITGIVITLNEADNIVDCLRSLKRVCDELIVVDSLSEDNTVALAEAEGATVIAQAYLGDGPQKAHGVPFARHDWILALDADERLDDDAVALIERLALDDPNTAYAFRRKNYVGKHWIRAAGFYPDAVTRLYNRTTAGYLPKKAHSSVRAPRVETTRAHLHHFTYTDLSHWIRRIDALSSRDAWAMKERGVAPSAVRPALHAGIAALRKFLLKGGILQGSDGMLVTLTTAFRTYMKYAKLNELHENEKAPSSGDAP

SEQ ID NO: 3225 - protein, 242 aa, Unknown
  Description of Unknown: Deltaproteobacteria bacterium sequence
MTWCDEIVVVDGGSTDGTLGIARRFASRILVNPWPGYRAQKQAALDASRGEWVLNVDADERVTPDLATEIRAALAEVPPEVVGFAIPRLVCYLGRWWYRGGWYPRPIVRLVRRTATRWGGVDPHERAEVKGRVARLRWPLLHYTYRDITDHLRSLNKLTSVAAGQPKLPQRIGASRLVAEPAWRFVRSYLVHRGFVDGVPGLFVAMTGAFYVFLRWAKVWERRRDEEQAGEVPPLDRSQAGF

SEQ ID NO: 3226 - protein, 258 aa, Trabulsiella guamensis
MTMRLSVVMIAKNAADLLAECIASVRWADEIILLDSGSTDNTVELAQSLGVKVYSNTDWQGYGPQRQRAQSYATGDYVLMIDTDERVTPELEQSLRQVLASPQPGAVYSMARQNYFLGRFMRHSGWYPDRVIRLYERERFQYNDNLVHESLDCHDALVIELNGDLRHLTCRDFASFQQKQLAYATAWAQERHQKGKRVTLAGIFGHTLGAFVKTLLIRGGVLDGAQGWLLAVVNAQYTFNKYTGLWALNRGYSASEKA

SEQ ID NO: 3227 - protein, 272 aa, Noviherbaspirillum sp.
MNQPLPGQPEKNAASPKLTIGILTLNEEKRIANCIASAKFADQIIVVDSGSKDRTCEIAAALGAEVHAYPQWQGFAVQRNRVLQHAKGDYIFFLDADEEIPPALQQEIAAVVAAGKDEIWEVQWNQVAFGRPLTLMKSTGGIQRMFRTGSIREFTGLVHEHADMHGDSRAVHLFRARLLHYSRESIYSSLNKLAQYVQLGAAKRAQAGKKGGVLRGMASALAIFLKLYVFRRGFLCGAAGFLFCFFIALECFFRHTAIKYDAGRLEQAAMRG

SEQ ID NO: 3228 - protein, 289 aa, Brackiella oedipodis
MTTSHSSLSQTTDHAKPASLAIVMIVKNEEQSLRDCLHSVADLADQIVIVDSGSTDATAAIAREFKADFHSHTDWPGYGKQRQIAQQYVHCDWVFWLDADERMTPQLRQSIERVLKQSSSYQQTVFSVARLSWAFGRFIKHCGWYPGYVERFYPHALTTYDDALVHESVIVPAHAQVQTLDGDLLHYTYRNLQDYLTKSANYAQAWAQQKYQAGKRTSLLAACGHSFGRFFRTYIFKKGFLDGSAGFLLTLFACQSVFNKYAALYLKQKEKHASQHSTTSTTSTSHENS

SEQ ID NO: 3229 - protein, 334 aa, Unknown
  Description of Unknown: Sphingomonas sequence
MPAPTIAATLIVRDEARCIARCLASVAPFVDRIVVVDTGSVDDTVAIATGCGAEVHHLGWPDDFAAARNHALGLADADWHLVIDADEWIVSGGEALRDWCAGGERLGRACVLSDDGEGATTTRSWITRVLPRGVRFEGRVHEQVASALPRVRTGLHIGHDGYRAAQIARKRDRNHRLLLAELAGRPGDAYLLYQIAKDADMRGDGAASAEGYAQAVAVTPPDAGWRHELVTCAIPALAKAGRLGDAMALAEAEMPRWAESPDFFFVLGDLLLDHAIADPARAVDQWLPLASGAWERAIAIGERPDLEGSVAGRGSHLAQHNLDVVRGQLAMLGG

SEQ ID NO: 3230 - protein, 265 aa, Kyrpidia spormannii
MRSVKNWADEIVVVDMYSEDRTTEIAKQYGAKVFYHDRIGFVEPARNYAISRTQGDWILVLDADEVVPLSLSQMLCQIVEDDRADVVKIPRLNYLLGAPMYFCGWGPGQDRHMRFFKRNMLIMSEDIHKPPQPTSDARVYEIEYTEPGLALIHFNYIDATQFIEKLNRYTTIEAVQAYDRGQRPSTITIIWTMIKEFLIRYVLLQGFRDGWRGWYLSLFMMFYRAATFTKLTEFQRYGGRERVIRDYQNLAEQIVREHEREVTQT

SEQ ID NO: 3231 - protein, 273 aa, Marinimicrobium sp.
MSAPQDYEQSNARQRISAVLIVRNEAQKIADCLATLDWADEVVVLDSGSEDNTCAIAREHGARVSVRTDWQGFGEQRRRAEALATGDWIFMIDADERVTPALRDSILAAVARGIPAIYRANRLCWCFGRYIRHSDMHPDWVARLYPKGQAEFPTQRVHEKLHNPKGLSEYRLEGKLLHWVYDSVAHQKRKAAHYAEEWAAERAAKGESTSLSSAYLHAIFCFVRMYFLRLGLLDGRQGFLLAVLMSQATFAKYAELWTRSRAQAPEDNHADHV

SEQ ID NO: 3232 - protein, 265 aa, Unknown
  Description of Unknown: Deltaproteobacteria bacterium HGW- Deltaproteobacteria-21 sequence
MGREEGGLSVAIVSKNEEERLPGCLDSVGFADEVVVVDSESSDHTVDVARNFGARVLIEKWRGYSGQKQYAVDCCRNPWVLILDADERIPLETAEIIMKALAGADPSISAFSFRRKNLLHGRWVKRCGWWPDRVLRLVDRRRGRFDGRPVHEQWVTDGKIDRLNGCIEHISFRNYSELVDKMERYSCLASEELFLRNVKASGFTPVSHGLWMFFRTYVLELGLLEGFDGLVISLMNAGGSFLKYAKLREKWIYSGKGQGSGIRYK

SEQ ID NO: 3233 - protein, 257 aa, Unknown
  Description of Unknown: Acidobacteria bacterium sequence
MNRLSACLITLNEEHNLPRTLASLLGIADEIIIVDSGSTDGTEAVAREHGAAFHFRKWTNYSDQKNYAASLTRTDWILSLDADEELSSALQTSIVDWKKRSAQFNVYEVARRTWYLGAWIKHSGWYPDFKKRLYRKGIAQFAGSLHETLQFSGPCGRLAGDLLHYTIRDFGEHEANVERYSALAAQQMFAAGKRHWRGAWWLATPWSFFQNFILRGGFLDGHRGALISRMAARTVRLKYEKLGKLIAAQKDAVRAER

SEQ ID NO: 3234 - protein, 258 aa, Erwinia teleogrylli
MTMRLSVVLIVRDAADLLPDCLASVAWADELVVLDSGSQDATLAIAREAGAQVYVREDWQGYGVQRQRAQQYASGDYILMIDADERVTPELADAIRSVLTAPAAGAVYSIARRNLFLGRFMRHSGWYPDRVIRLYPREQYRYNDNQVHESLDYASADVKPLPGDLLHLTCRDFASFQRKQLNYATAWAHERHLQGKKTSLWGIFSHTAGAFIKTLLLRGGVLDGAQGWLLAVVNAQYTFNKYAELWALNHGYTQKRPL

SEQ ID NO: 3235 - protein, 252 aa, Crenobacter cavernae
MGVSISAVLITKNAAHSLKACLESCRFADEVILVDSGSSDDTLAIANAYGAKVIHQDWLGFGPQKQFAVSQARNDWVLCLDADEWLSDALIKEIKDLPDNPQTSAYRFPRCNKFMGRFLRHGEGYPDMSLRLFDRRRARWSDHQVHEYVIADGPVGTLAGDLMHESGEDVSVYLAKQNRYTDLQAEALFAAGKQVGAMKLIASPLLRFFKFYIVRQGFRDGLPGLVHIAIGCFNSFVKYAKLLERQRLEKKA

SEQ ID NO: 3236 - protein, 256 aa, Limnohabitans sp.
MTLRAPTLSVIVITRNEAHNLDDCLMSLKGWVDEIVVVDSHSTDETVAIALRHGAKVAQPDGWPGFGPQKNRALDMATSDWVLSIDADERVTPALAVEIRGVLTSGADAVAYEIPRLSWYCGKFIHHAGWRPDHVLRLFPRLQAQFSQDLVHERVVTTLPCKQLQNDLLHYSYRDFSQVLAKVDAYSTASAKQALARGKRATVGSAVGHGAWAFFRTYVLRAGFLDGGHGLALAISNAETSYYKYLKIWAQAQSAE

SEQ ID NO: 3237 - protein, 255 aa, Chitinimonas koreensis
MQKLSLVLITRNAAGQLAACLDSARGLADEIVLLDSGSDDGTLALAERYGARIASQPFLGFGPQKRAAVALAQYDWVLCLDADERLTPELAASIRAALADPQHAAYRFARRNRFFGRYLGHGEAYPDWCLRLFDRRRAGWSADAVHEKVEVREGGTGSLAGDLLHDSAESLASYLTKQNRYTDLQAEALFAAGRRAGIGKMALSPLTRFIRFYFVRRGFLDGAGGFAHILIGSFFAFVKYAKLAERWQRHDSERT

SEQ ID NO: 3238 - protein, 376 aa, Thermicanus aegyptius
MFFLSDSVRLSLCMIVKNEADCIARCLESAGPLVDEIIVVDTGSTDGTDAICRSLGAKVFSFRWNDDFSEARNYSLSLAQGEWILWLDADEEIEASPDELRELTASEAYDLYSFRLNNYYGARADRNQVITIAHPRLFRNRIGFRFHQRIHETLNVEEVLPGPDQKERIGSAPITIWHYGYLDDYVKKKGKAERNLSLLKEEVAKNENDPWLHYHLAAEYYRAQKFNLSFQHVNRSIILFILANQTPPSLLYKLKYSILLSMRSFEGAYPAIEKAIALYPDYVDLIFYKAVILLHLDKPLEAIGALDRCLEIGEQNLKHLTQKGLGSFQAWYCKGLCYEKLNDLETAERCYRNALALTPNHSEAEAALVRLKRDSN

SEQ ID NO: 3239 - protein, 347 aa, Unknown
  Description of Unknown: Saprospiraceae bacterium sequence
MSVFSTDIQKLKPSLTRHFCLLITGVAQMAKVELMIQPQKNTHLILRTLLSGVAVLALRHGVKLQIAGEPGPIHPKFSKLAAVKTTQKLTAVIITHNVAGTIGDCLAALQEVAGEILVLDSFSDDGTVEICRQYGAALVPQEWLGYSATKNLGNSLARYDWILSIDADEVLSDELVNSLKNLMPEDGVVYALDRLTNYCGKWIRHSGWYPDWKVRLFNRNDVQWQGDFVHETLAIPAGFEVARLAGKMYHYSYKDSGDHLRRIEKYARLSAQEQFERGKKATFAGLWLSPIARFVRTYFIKKGFLDGKEGWVISCRNACLVRRRYEILKEMWDGKAPRVKHPLFLAP

SEQ ID NO: 3240 - protein, 265 aa, Mucilaginibacter gotjawali
MVPVSIVIITKNEAATIAACIEKCRLISDDIVVVDNDSIDGTPEIAGTYGCRIFKKTWDGYGANKNKGIALAKYDWILSIDADEMPDVELAISLHQLNFSDPCTVYDIKFRSYFGKKAIRYGSWGRDHHIRLFNRTLVKWSETVVHETLVMPQTIAIKKTVGYIHHYSVKDAAEYDIKGKFYAKLSAKKYFNNGKKANLVKLYISPAFGFIKNYICYLGFLDGKEGWEIAKATLRNTRRKYVYLSQLENLDQKRQAVKDRYAVEY

SEQ ID NO: 3241 - protein, 398 aa, Jatrophihabitans sp.
MGNLGCELSACLIVRNERGRLADCLSSLHPLVDEIIVYDTGSNDGTVELARSLGARVIEGYWDDDFARARNAALVAATGRWILSIDADDRFTGDPAALRPLLAAENVDGYRVQIDNLSGTDGADSYTSFPLRLFRRDRASWRGQIHERVCHADGSELKLGIATARGLRHIGYADADEARGKAARNAVLGLRELQQLHDAGCADPAELARVLLDLGRSLMACEQRQGAVDAFVGVRDLPLRGPEFVQATDFMARLALGANQPDDAANLVQQLRAAGADAEYCNWLEAQVLAQQGDAVSAYRMLAGVSSLVDPAGRVYNQGQVVEMRALAAALAGRNDDAVADLVEAMSRYGRVAGRGKLLLEWWGDRPLAPLWEQISQYGTTYLDGIQRELSACEVAPV

SEQ ID NO: 3242 - protein, 269 aa, Mucilaginibacter mallensis
MTVSVVIITKNEAATIGRCVAAAKRITNDVIVMDNGSTDETTDIALNHDCRVYQEKWYGYGTNKNHGAALARHNWILSLDADEIPDDELITAIQNLQPETDNVIYDIRFRAYFGGKSVRFGTWGRDHRIRLFNRNYTCWSEPLVHENLIKPAGGVIKKLPGLVHHYSGKSPEQYRAKTMHYARLNARNYLREGKKTTTVKLYLAPLFHFLKDYIFLLGILDGKRGWLIANTVAQYTRAKYQYLKQETEQKEKNYYTGENLLVEYQNHSH

SEQ ID NO: 3243 - protein, 258 aa, Pantoea sp.
MTSRQRLSVVIISKNEADLLPDCLASVSWADEIVVLDSGSEDNTVEVARQAGALVWQSTHWQGFGKQRQLAQSYASNDMILMIDADERVTPPLRQAIEQVLSSPVSNTVYSLGRSNLFLGRFMRHSGWYPDRVMRLYPRQLSYNDNLVHESLETQGAPVVALKGDLQHLTCRDLVAFQRKQLNYAAAWAQERHQRGKRCGIVSIFTHTLGAFCKTLILRAGFLDGKQGWILAVVNAQYTFNKYSTLWALNRPSAKGSV

SEQ ID NO: 3244 - protein, 246 aa, Unknown
  Description of Unknown: bacterium CG_4_9_14_3_um_filter_65_15 sequence
MKVSAAIITREAAVDLDRCLASLDFVDEIVVLDQHSADDTAAVCARHGARLHQTEWFGFGPTKQKAVSLCRNDWVLSIDSDEEVDAGLREAIAGLPEAPGFAAYRVNRLSRFLGKWIRHCGWYPDPVVRLFDRRHAEFNERPVHEEVVVSGSCGRLEGHLLHYAYSDMEQYLAKLNRYTTLAAEQMHADGRRSGLAEAVARSVTGFWRMYLLQAGILDGAHGLVLCTASSFSILTKYVKLWRLGRS

SEQ ID NO: 3245 - protein, 271 aa, Bacillus sp.
MQTLPLTLAVITHNEADTIARCLDSVPFAAEKLVVDSGSDDATVAIAQAHGARVVVQDWLGFGAQRNFAASQCEHDWILVLDADEYLTPELAAELRRQLPELMVSTTPAAYLRRSTIYMGAPMRWYRPAVGERLARLYHRGRARWTDARVHESLRFEGNAPTLDAAFNHTNNPTLAHKQLKVLRYAELKCRDWLDKRKPVRMWQAPLVFALAFLKDYLLRLAFLDGWRGFMIAQTAASYALYKRMRYYEMVNHRESVARAASLLHKHGIDR

SEQ ID NO: 3246 - protein, 341 aa, Unknown
  Description of Unknown: Frankia symbiont of Coriaria arborea sequence
MIRTRGTTRSLAPPYGTTIPSAPPPRSVPVTAIILARDECHDIARAVRSVGWCRQVVVVDSGSTDGTQQIARAQGATVWEEPWRGFAGQREWAMRNPGVQHDWVYFLDADEWIPTDLANEIAARVGRENCVAYIHRRRFFFLGRWIAHCGWYSNSWQARLLDRRFSSFATTDQFSERASVKGTMLRLACDLVDEDSKGLTCWLHKHVTYAELEAGRRAALVPPFRRLKQVLAGGSEESTRPLPRTIARDIVFPLVPFKALAIFVYMYLFRSGWRDGWQGLAFCIHRAWYEKMIYLLGRPEALPGGSGGNLAPAPDSIDIPPVPPATDTANDGGFHALRCSS

SEQ ID NO: 3247 - protein, 262 aa, Unknown
  Description of Unknown: Rhodocyclaceae bacterium sequence
MPATRQPLSVAIITLNAANQLEACLQSARFADEIVVVDSGSTDGTQALAERCGARVLQQDWLGFGPQKQFAIEAARHDWVLCLDADERVTPALQAAIESALEISQTSASTSAAPHAFRFPRCNRFLGRYLKHGEGYPDWSLRLFDRRHARWSDDAVHEKVLCDGPIGTLAGDLLHDSAESLSSYLTKQNRYTSLAADMALLAGKRSSLGRVALSPLVRFIKFYFIRQGFRDGLPGFVHIAIGCFNSMIKYAKMLERQNAAPR

SEQ ID NO: 3248 - protein, 263 aa, Burkholderia multivorans
MSERTAAPTLSAIVITKNEARDIGACLASLRPWVDEIVVFDSGSTDGTQAICREHGAVVYETDWPGFGAQKQRALDHAHGKWVLSIDADERVPPKLRDEILACIASPRAELYDIPRRSNYCGTWIHHSGWSPDYVRRLFMRGRAHFSDDLVHERVIGDRDARCARLVTPLLHYTYRDFSEVLGKIDSYSSFSATQKVARGKSGGLRQAVLHGLWTFIRTYVVKLGFLDGRMGFILAVSNAETSYYRYLKMMLISDGHNHHPHA

SEQ ID NO: 3249 - protein, 282 aa, Herminiimonas arsenicoxydans
MTMLNFTPAKTEQNRQPSHTDEAVSEPTLTIAILTKNEAHRIASCLHSAAFADQIIVVDSGSTDSTREIALAEGAEVFNYPDWQGFAVQRNRLLQHARCDYIFFLDADERITPELQDELLAAVRSGKRAVWKVQWRMVAFQHELKYFRSDAKIERLFRRDMVREFTGVVHEQALLEIEPTPRVLLKGRLLHHSRETVRGSLEKLTQYSMLGAAKRAENGKRGGVLRGLLSGSSMFLRLYIGQRGILCGGPGFLYCFVVGLEGFFRYAALAYDHDSLRTDIPR

SEQ ID NO: 3250 - protein, 256 aa, Gayadomonas joobiniege
MTQRPPISCFVIACNEADRIEACLQSLAGWVDQLIVLDSGSQDSTVEIAQRYADHVYQTDWPGYGPQRNRALGYCKHDWVLNIDADERLSQGAKDEIDALLAKPDLDINFVKIPWHTYLFGGLVKRGRYASPQGKLFYKVDAQFKNSQVHETLQLPNEKVAVLKSPVFHYSWRSYQHAQEKHLKYAALLAEEKYAKGKRSSLSFAVLRFFTDFIQQYFFRAGFLDGKRGFFMAMILAQYGFHKYAALAALTMAEKK

SEQ ID NO: 3251 - protein, 237 aa, Unknown
  Description of Unknown: Chitinophagaceae bacterium sequence
MIARTPISIVIITRNEAANIADCLRSARFLSDDIVLVDSGSTDGTPRLAALCGARVFHNNWEGYGAARNKGAAAARHDWILSLDADERLDFDLIEQLKNQEPLRGCVYRFRRRNHWEEKPIRFGTLGFERIARLYHRSDAHWNDFAVHERLVGKFQVCNWPGTLLHFGIAYPAHYEKKKEHYAWLSAITYARQGRTARSYNRLGAPLFDALKSYLLLGGFLDGIAGWKIALITARYT

SEQ ID NO: 3252 - protein, 256 aa, Lysobacter oculi
MTSREPLSAVVTTFDNAATLDRCLASLAFCDEIVVLDSDSTDATRDIAAAHGARIFIEPFMGYGPQKQSAIDKATHDWVLLLDADEVMSDAGRLAIERELRAPRADGYRLPRQEWLFWRWPHPATRGNRQLRLFRRSMGAMNAVPVHAAPETRGRRLDLDAPFRHHGEAEIAVRVDKVNRYSSGLVEHVRGKQRRFIGLRLLVQPTLAFLKLYVGKRYFLNGWAGFFAAKTQSFYVFLKYAKLFEAGRKRGAQPFE

SEQ ID NO: 3253 - protein, 263 aa, Ferruginibacter sp.
MKPLSAVIITLNEEHNIGRCIDSLWYVADEIIVLDSFSSDNTVAIAKERGAIVKQEMFAGYKEQKNRALKLASYDYVLSLDADEVLSPELMEAILNAKKDFKFEAYCMNRYNHYCGRFIRHGLWYPDKKIRLFDKRIAYWGGINPHDKIILPENCKAQFLKGDILHYTFNSLEEHLERNERMSSIAAKSLVDLGKKKHWSKIILSPLWSFVNGYFFRLGFLDGYYGFIIAIQNAHLSFLKYQKLQRLKRENKKSLVTALNPIH

SEQ ID NO: 3254 - protein, 253 aa, Yersinia ruckeri
MSARKRLSVVMITKNEASLLPDCLDSVSWADEIIILDSGSEDGTLDLARQYGAQVYSNHQWQGFGKQRQLAQQYATGDYILMIDADERVTPQLKTSIETVLIEADDNTVYSCARRNLFLGRFMRHSGWYPDRVTRLYAHHLYQYNDNLVHESLNTGVAKIIPLKGDLLHLTCRDFFAFQRKQLSYAEAWATQRHQQGKSCSYFSILSHTLGAFCKTWLFRAGFLDGKQGLLLAVVNAQYTFNKYAALWALNQK

SEQ ID NO: 3255 - protein, 372 aa, Unknown
  Description of Unknown: Oribacterium sp. C9 sequence
MIINLVMIVKNEERCLERCLTSAAPFVDNIIIADSGSTDRTLEIAEKFGAKVYSFPWENDFAKARNFALGESEREWNADINLVLDADEYLVNDENSNPEALREFIDMMYDKQGMRWLGIIKREDSYPNGDEIDRSITEIDRILPAGMRYRGSIHEQVAAKVVNRLSPLYVLHDGYMRKGKGERNYQYLAEALEKEPNDPYYNYQMAITLRNLKKEEESLPYFRTFWRFSGRKEIRQAPYWTDGIMRYLYTLYDMDTEESLEEAHDIMSKVQYDFTRNPDFYFYSGLFYMKLVLKNTEKYKDLLPYIEKSYLKCLELGEISRPEGVIGTGSFKAAYNLGTWYEVSGNKEKARYYYGISAEQGYEKAAERIRLL

SEQ ID NO: 3256 - protein, 278 aa, Unknown
  Description of Unknown: Actinobacteria bacterium sequence
MKNRQRIPVSAIVLTKNEQEAIGACIRSLHSFDEVFVVDSRSTDDTRQIAAGLGATVVDFSWDGKYPKKKEWSLRNLPFRNDWVLFVDADERPSEALVSSLHQLLPAGSAQRHAAYDLPVFYRFMGRPLKHGHHVVKRALVRHADAEFPPIDDLDVTTMWEVEGHYQPAVHGSVGSLRGGLIHDDPDRLFDYFSRHNRYSDWEAAVATDPDLRRQVNALRTSQGSLFARLPAKPIAFFVYSYLARAGFLDGRAGFDYAVALATYYWQIDLKVREARAR

SEQ ID NO: 3257 - protein, 278 aa, Skermanella stibiiresistens
MPVSVIVMTRDEAANIGACLASVSRFAEIFVVDSGSRDGTAAIAKSMGARVIDFHWDGKYPKKKQWCLDALPFSHDWVLYLDADERVTGALAGEIAGLMAAGPEASGYHIPGRPVFAGRPLRFGAWNSKIALLDRRRASFPPVPDLDVASMWEVEGHYQPRLAGTAGRLRHPVIHHDAKPPYAWFERHNRYSDWEAALMMDGRLESIAVREKGARRLLKRIFVRLPARPLVVFLHSYVLRLGFLDGLDGLDHAIARAFYYWQIAVKVRARRRGPVPYP

SEQ ID NO: 3258 - protein, 258 aa, Pantoea rodasii
MSQRQRLSVVMIAKNEAELLPEALASVSWADEIVLLDSGSQDATADVARALGAQVYQAEGWDGFGKQRQRAQAFASGDMILMLDADERVTPELRRAIEHVLEQPAANTVYSLGRSNLFLGRFMRHSGWYPDRVLRLYPRALNYNDNLVHESLDTQGAPVVALTGDLQHLTCRDLIAFQRKQMNYAEAWAVERFQRGKRCGLFSIFSHTLGAFLKTLLLRAGFLDGKQGWILAVVNAQYTFNKYSALWALHHTSTQGRV

SEQ ID NO: 3259 - protein, 256 aa, Thioalkalivibrio paradoxus
MTPLPITATVITLNEEAMIAGCIRSLRPVCDEIIVVDSLSADRTREIAAAEGARVIEQAYLGDGPQKAHGVPFARNDWILSLDADERLEDDAVALIRGLPLDDPRTAYALRRRNFVGNHWIRAAGFYPDSVVRLYHRGTSGYLPRKHHSRVEAPRVRRLKGHIRHFTYEDLSHWIRRIDELSALDAWAMKDRGVRPSGWRPAVHALVALLRKLVFKGGVFQGADGMTVAVTTAFNAYMKYAKLNELYEREQGGPRE

SEQ ID NO: 3260 - protein, 256 aa, Polaromonas sp.
MTTLSVLIITKNEALNIEACLRSVAFVDRVIVMDCGSTDNTVDIARNLGAEVSINTDWQGFGMQKNRALALASSDWVLSIDADERLSKELQAEIQQVLEHPVADAYCFPRLSSYCGQYIRHSGWYPDPVTRLFRRGAARFSDDIIHERLLVKGQVSTLRNRLLHESFPDFETVLDKVNRYSSAGAQRLLSKGKSSSFPKALGHGLWAFIRTYFLQRGFLDGWMGLALAISNAEGTYYRYLKLWLLLLDQKASPPSS

SEQ ID NO: 3261 - protein, 276 aa, Unknown
  Description of Unknown: Chitinophagaceae bacterium sequence
MMQNRVPISIVIITRNEAANIADCLRSARRLSDDIVVVDSGSTDGTARLAALCGARVLHNKWEGYGAARNKGAAATRYDWILALDADERLDFDLLEQLKEDAPKRGRVYRFRRRNHWEERRIRFGTLGFERIARLYHRHDAQWNDFAVHERLTGSFQLCKWPGTILHFGIAYPDQYLRKREHYAWLSAITYARQGRKARLYHLLGAPLFDALKSYLFLGGFLDGIVGWKIARITAWYTARKYTLLRSGQHETHPAPTAGESACTVASLQQLSSAAS

SEQ ID NO: 3262 - protein, 247 aa, Pandoraea sp.
MPLTVTILTRNERHNIAECIASVRALASQIVVLDNASTDGTADIARDAGAEVHVTPDWPGFGPQKNRALSFATQPWVLSLDADERITPELAADIAAAIASNRHAGYRMPRLSQFLGHWVRHCGWYPDYVLRLFRRDAGRFSDNLVHERVIVEGEIGTLPNHLLHFSYTEVRQVEDKVQRYAKAGAKEMALRGKKVSALKPWINGGWAFVRTFVLRRGFLDGATGAAIARMNARSAFLKYALLRRGES

SEQ ID NO: 3263 - protein, 247 aa, Pandoraea pulmonicola
MPLTVTILTRNERHNIAECIASVRAVASQIVVVDNASTDGTADLARAAGAEVHVTPDWPGFGPQKNRALSHATQPWVLSLDADERVTPELAADIASAIARGAHAGYRMPRLSQFLGHWVRHCGWYPDYVVRLFRREAGRFSDNLVHERVIVDGELGTLAHHLLHYSYTEARQVEDKVQRYARAGAKEMAQRGKRVSPLKPWINGGWAFVRTYLLRRGFLDGGTGAAIARMNARSAFLKYALLRRGDV

SEQ ID NO: 3264 - protein, 288 aa, Rugosibacter sp.
MKTPVSAVLVTKNAAHTLPACLASVAFCDEILVVDSGSTDDTAAIALKYGARVIHSHWRGFGPQKQFAVGEAAHDWVLCIDADERVSDHLRQSLQAVLNDKTIATPAVSPTPARCLPCTTFRSPPGTFYAYRFARCNRFMGHYLRHGEGYPDWSLRFFNRHHAQWSADVVHEKVCATGAVGTLAGDLLHDSAESLANYLDKQNHYSTLAANAARAQGKRAHAAHLLLSPLVRFIKFYFFRRGFLDGLPGLTHILIGCGTSFVKYAKMAALQRQPPDLTHPTRPPGTHS

SEQ ID NO: 3265 - protein, 257 aa, Mangrovibacter sp.
MAYRLSVVMIARNAADTLEECLKSVDWADEVILLDSGSTDDTMAIASAHGAGVYSSPDWQGFGTQRQRAQSYATGDYILMIDTDERVTPELKSAIQSVLSTPPGNTVYAINRRNLFLGRFMRHSGWYPDRVTRLYAREKYQYNSNQVHESLDAPGAPQTRLQGDFIHLTCRDLSVFQAKQLQYATAWAHERHQQGKQTSVISIFTHTIGAFVKTLLLRGGVLDGKQGWILAVVNAQYTFNKYAELWALNHGYTEKQP

SEQ ID NO: 3266 - protein, 254 aa, Motiliproteus coralliicola
MNRITGIIITLNEEDNIAECIKGISSFCDDIIVVDSLSKDKTVQIAEEMGARVYLQKYLGDGPQRIYGAQFAKNDWILSIDADERPEADMLEAIANLKLDDPSTAYAFRRKSYVGNHWIKAAGFYPDYVTRLYNRTTSHYLDRKSHSKVIAPKTTKLDSHIYHLTYESYAHWLQRLDWFTTRDAWALYERGVKPSNIKPVTSCIGAFIRKMIIKGGIFQGLDGMTVTLTSMMRAYMKYIKLNELHEEKAANQRD

SEQ ID NO: 3267 - protein, 256 aa, Erwinia gerundensis
MHPRQPLSVVMIAKNESALLADALISVSWADEIVVLDAGSSDNTPEIARQHGAKVFTAGPWQGYGKQRQQAQQHASHEMILMIDADERVTPELRAAIEQALMQPQPDVIYSIARRNLFLGRFMRHSGWYPDRVLRLYPRAWRYNDNQVHESLETAGARVVPLQGDLLHLTCRDFSTFQRKQLAYAEAWAQQRHQQGKSCSIYSVFSHTTGAFLKTLLLRAGFLDGKQGWLLAMVNAQYTFNKYAALWALNQANQRK

SEQ ID NO: 3268 - protein, 400 aa, Unknown
  Description of Unknown: Candidatus Brocadia sinica sequence
MTQLSACLIVKNEALFLSHCIESIRSFVDEIIVVDTGSDDDTVEIACRHGAQVYHFAWIDDFSTARNESLCHAKGDWILYIDADETVDAINAAKIRQVITRKDITAVTVRQCIPQQSGNIANAFYSEYCRLFRRHPAIRFEGKIHEQILPSIERLGGKVLCTDIVIHHWAYAASEEKKQRRAERNLRYLLTELDRNQDDPFLYFNLGMTYRELGRRYAAIHSFHYALNKDDGCIKRELLGQTHLNLAKLYLESGDKTSAAHHAQMVATFDPANPLPDYMLATLAIEKGRYKKAIFHLEKALRIAKGETGVFSNVELNLAQIYLELGSCRCAAGDFVNAEHDFVRSMNLGPAVALPCLLLGNCRFLRGDLAGASEMFKRALSLNPLLEGARHGLSLCHPHE

SEQ ID NO: 3269 - protein, 307 aa, Pleomorphomonas sp.
MAEAAARLPVTVVVIAFDEAIHIARCLDRLVPYVERVVVVDSFSRDDTAAIARAHGAEVLQHAFTTHAAQVNWAIEAAAATTPWTMRVDADEYFEDGALAALGAMLAAQPGEVTGVTLRRKFVFRGRWIRHGRYYPVVLLRCWRTGAAVCEQRFMDEHMVLVSGRTAAFEGGDLVDHNLNDLDHWTAKHNRYATLAMADAVVREYGLAADDDRVAATGGAARRNRALKHGVYGRAPLYLRAVLLYVYRYVFRLGFVDGKVGFLFHTLHGLWLHLLIDAKIDEAREIIRRDGLDAFRERLAERHGIRL

SEQ ID NO: 3270 - protein, 300 aa, Niveispirillum irakense
MDTATGPIPVSVIVMTRNEAANIAACLASLTAFDQVVVVDSASQDGTDSIACAMGAELVPFLWNGHYPKKKQWSLQWPGLRHPWVLLVDADERVPPALAAEIRDLMRHPREEGAFFLSSRPVWLGRTLRHGSPYRKIALMHRARAHFPVCDDLHVATMWEVEGHYQPVVQGPVGRLRHPFLHDDGKPPFAWLERHNRYSDWEAMLGMGHAARLAGERGSRRWAKHLLRMLPFRPALVFLHSYILCLGFLDGRAGLHHAAARAFYYWQIGFKRDWLAAQGQASQARYRIDNSAMAEQTERA

SEQ ID NO: 3271 - protein, 284 aa, Unknown
  Description of Unknown: Microbacterium sp. 1294 sequence
MTSLLPVSVLVQTKNEAVGIGACLASLKQFDEVIVVDSASTDGTADVAAGMGVEVINFVWNGHYPKKKQWQLDNVATRNEWILFLDADETPSQLLVAELEKLFSAGPGSRTAAVDIDLDYVFAGRMLKHGHRVTKRALVRRDRVAFVPVDDLAVPGMGELEGHYQPVVEGSTVRAKGRILHNDLDPVSSWFQRHNRYSDWEAHLRFNATLSTSVRRNRTLKGRVFDAMPAKPLVFFLYGYVVRAGFLDGRAGFDYAFALAAYYWQIGLKYRELLRANRSMAGVR

SEQ ID NO: 3272 - protein, 257 aa, Halomonas saccharevitans
MTPITGIIITLDEAQNITDCIASLRPVCDEIIVVDSGSRDDTVAIAESLGASVIHQPYLGDGPQKAFAVPRARHDWILALDADERLDDDAVAAIRSLPLDDPSKAYRFNRRNFAGHHWIKAAGFYPDPVTRLYNRTTSGYLPKKAHSSVQAPAVVDTHSHIRHFTYRDLSHWITRIDQLSSRDAWAMKERGKGPSRWRPTLHAASAMLRKLILKGGLFQGADGMTVAITTAFHAYMKYAKLNELHENERAATPSDHA

SEQ ID NO: 3273 - protein, 247 aa, Unknown
  Description of Unknown: Gallionellaceae bacterium sequence
MPRLSVILITKNEAENIRACLESVSWADEIIVVDSGSSDGTAGIAREFTSHVYQHDWPGFGAQKNRALSYATGDWVFSIDADERVTPELKAELMEAMGQARADGFYCPRLSQFCGRFIRHCGWYPDYVLRLFKRTQGKFSDSLVHESLLLQGSSARLTRPLLHYSYRTSDDVRRKVEQYSAAAAQQMFNRGKNATPLDAPLRAAWAFFRTYCLWLGVLDGWAGFAVARMNAATTYLKYQRLRAMRQT

SEQ ID NO: 3274 - protein, 257 aa, Unknown
  Description of Unknown: Syntrophobacterales bacterium CG23_combo_of_CG06-09_8_20_14_ all_48_27 sequence
MNSKIPLSVAIITKDEADNLPDCLRSIAFAEQIVVVDSHSSDATVQIASDFGCDVFIEDWRGFGPQKQSAIAHCRHRWVLILDADERIPPETAMKIRDIVLNPSKTIVGYSFPRKNFFHGRWIRHAGWWPDRVTRLFQKDLGRVTPAMVHESVEVKGTVVALDVPIEHFTESRLSRILLKIDNYSTLGAREAFAMGKRMSVWSAVLRAFLTFSQDYFLRLGILDGAQGLTLAVTDAVNKFFKYAKLNELNRQEKSGD

SEQ ID NO: 3275 - protein, 312 aa, Rhodoblastus sphagnicola
MGPITEPPPRETALSITAIILTFDEEIHLERCLKSLSSLVERIVVVDSFSTDGTVGVARALGAEVAQRAFTHQADQLQWALDTLDIRTNWVLRLDADEYLEPALIAEIRARLPSLPSTVAGVRLRRKLIFRDKWIRFGGYYPTVLLRLWRNGQAHVPQLRMDEHIVLNGGEAIVFSKDFCDHNLRDITWWTEKHNRYATRKMADFIAMERGLGKANGTGADADASRAWKRFLQYAVFRRMPLYLRAVLLFGYRYVLRLGFLDGRPGFVWHALQGFWYTMLIDAKVEEARLFIAARGLDAFRAHVADRHGIVL

SEQ ID NO: 3276 - protein, 258 aa, Klebsiella pneumoniae
MSNRLSVVMIAKNAADLLPDCLGSVSWADEIIVLDSGSTDNTVELARRLGAQVYTHTDWRGYGIQRQRAQDYATGDWVLMIDTDERVTPELRQAILKVLDAPQRGAIYSISRRNYFLGRFMRHSGWYPDRVLRLYERARYRYNDNLVHESLDSLGAEVIPLTGDLLHLTCRDFAGFQQKQLAYAAAWALERHQKGKKTSMAGIFSHTLGAFLKTLLLRGGVLDGKQGWLLAMVNAQYTFTKYTELWALSHGYSEKESS

SEQ ID NO: 3277 - protein, 281 aa, Pokkaliibacter plantistimulans
MVTVAGGKSVKRRSREPLSAVIIAFNEASRIQSCLDSLEFCDEVLVLDSGSNDGTQSLCRRFGAKVVHQDWLGYGPQKRKAVELARHDWVLCLDADEQVTPELRASIEAAMQQPVLAGFRMPRCNLFMGRWLRHGEGYPDYSLRLFDRRQLQWTADEVHEKVDWVDASHGHERRVGKLKGDLLHESAESLEQYLLKQNRYTSLQADNLIARGKRISSSKLVGSPILRFLKFYLVRQGFRDGVPGLVHIAIGCFNSFIKYAKVRAYRKPDRIAAENDLDEKF

SEQ ID NO: 3278 - protein, 257 aa, Serratia marcescens
MSSRKSLSVVMIAKNEAGLLPDCLRSVEWADEIIVLDSGSEDDSVAVAEGLGAKVFTHTDWQGFGKQRQLAQSYASHDYVLMIDADERVTPELRQSIERVLNAPDDGAVYSCARRNLFLGRFMRHSGWYPDRVNRLYANQCYRYNDDLVHESLNIGGAKVIPLSGDMLHLTCRDFFAFQRKQLRYAEEWATQRHRAGKRCGYLSILTHTLGAFVKTWLLRAGFLDGKQGLLLAVVNAQYTFNKYAALWALGRNYSEK

SEQ ID NO: 3279 - protein, 289 aa, Hyphomicrobium facile
MDKLPISCFIIAKNEADRIARTIRSVRPWVDEIVVVDSESTDDTVRVAASEGCRVITQRWLGFGGQKRFAEDQCRNDWVLNLDADEVVTSALRREIISLFAHVAPRFVAYGMPIELVYPNTSRPRRWARDHWYVRLYDRRIVRFRDSIVHDLVVTDGHPVGILRAPAYHYSFRSYEDLKRKLAERMQLSAKHANSTPAKILARMAIEFPVNFFKYYIGRRHFMGGRNGLRYSWVQADYRLLKIFHMWRDRSSKSRAEPNSIADGQESVEGQADPNAAAVSPAAEMPLYG

SEQ ID NO: 3280 - protein, 264 aa, Raoultella terrigena
MSIRLSVVMIAKNAADLLPDCLASVGWADEIVLLDSGSSDGTVELARSLGAQVYINTDWQGYGVQRQRAQDYATGDYVLMIDTDERVTPELADSLRQALADSLRQALAAPKEGAIYSIARRNYFLGRFMRHSGWYPDRVMRLYPRLGYRYNNNLVHESLDAKGAQIIELTGDLLHLTCRDFSGFQQKQLAYATAWAQERHQKGKKTSLLSIFGHTLGAFVKTLLLRGGVLDGKQGWLLAVVNAQYTFNKYTELWALSRGYSERV

SEQ ID NO: 3281 - protein, 258 aa, Edwardsiella tarda
MSPRLSVVLICKNAAELLPDCLASIDWADEIVVLDAGSSDETQAIARAAGAKVYENRDWQGFGIQRQRAQDYANGDYILMLDSDERVSAELRDAIQQVLAQPASERVYSIARRNLFLGRFMRHSGWYPDRVIRLYPRQHYRYNANQVHESLDCNGAQIHPLPGDLLHLTCRDFASFQQKQLHYATTWAHERYAQGKITSLWGIFSHTLGALLKTLLLRGGVLDGKQGWLLAMVNAQYTFNKYTELWALQHGYTEKRLP

SEQ ID NO: 3282 - protein, 259 aa, Erwinia sp.
MTEPLRLSVVLIAKDEAELLPECLESISWADEIILLEANSGDATKEIARRHGAKVFSAGEWQGYGIQRQRAQQHAGGDMILMIDADERVTPELRSAIEQVLNSPLQRDVVWSIARRNLFLGRFMRHSGWYPDRVIRLYPSHYQYNDNQVHESLETLNASIRPLQGDLLHLTCRDFTRFQWKQFAYAEAWARQRYHQGKHCSFCAIFSHTLAAFFKTFVLRAGFLDGKQGWLLAVVNAQYTFNKYTALWALNQTAKKGPL

SEQ ID NO: 3283 - protein, 250 aa, Propionivibrio dicarboxylicus
MIPFSVVIISKNEAATIVPCLESVAALADEIVVLDSGSTDGTQAVCAAHGARVIETDWPGFGVQKQRAVDAARNDWVLCLDADERLSPELAASLRQALAVPQFQAFRFARANRFLGRYLRHGEGYPDWSLRLFDRRVARWSADAVHEKVLCETAVGTLAGDLLHDSAETLESYLTKQNRYTSLAAGMADPDGRPVSAGRLIASPLLRFIKFYVVRGGFLDGLPGLVHIAIGCFNSFVKYAKIRERQLRRG

SEQ ID NO: 3284 - protein, 253 aa, Luteimonas sp.
MNSPAPRAALSAVVTTFDNAATLERCLASLAFCDEIVVLDSDSTDATREIAQRHGARVDVEPFKGYGPQKQSAIDRARHDWVLLLDADEHLSEAGRAAIERELRAPRADGYRLPRQEWLFWRWPHPLTRPNWQLRLFRRSRGRMNAVPVHAAPEIDGEPVDLNAPFLHYGEPRLQDRVDKVNRYSSGLLERKRRPALLGMRLLLYPPFAFAKLYFGKRYFLNGWAGYFAAKTQAFYAFLKYAKILESQRKGDL

SEQ ID NO: 3285 - protein, 256 aa, Dechloromonas denitrificans
MPATRQPLSIAIITLNAASQLAACLDSVRFADDIVVIDSGSTDGTQALAASYGARVIEQDWLGFGPQKQLAVEAARHDWVLCLDADERVSPALQASIKNALNNPSTAAFRFPRCNRFLGRYLKHGEGYPDWSLRLFDRRQARWSTDAVHEKVVTEAPVGTLTGDLLHDSAESLATYLTKQNRYTTLAAEMALQAGKRTSFARIALSPLVRFIKFYIIRQGFRDGLPGLIHIAIGCFNSMMKYSKMLERRNTDAALR

SEQ ID NO: 3286 - protein, 253 aa, Gilvimarinus polysaccharolyticus
MRLSAVLIVKDEAAKLADCLASLQFVDEIVVLDSGSCDRTTEIAHEYGARVESNSDWQGFGVQRQRAQALATGDWVLMIDADERVTPELRASIELAICNSPTIYYVNRLSWCFGRFMRHTAMYPDWIPRLYPRTQAGFDDTRVHERLSNPQSLPQQRLSGDLLHFVYDDVRHLVNKSALYAEQWAIARAEAGKRCSLLSAVTHGLSCFIRMYILRRGFLDGGQGFLIAVVMSHSTFVKYADLWVRTRPNTNSP

SEQ ID NO: 3287 - protein, 262 aa, Unknown
  Description of Unknown: Desulfobacteraceae bacterium sequence
MSSEKKRTLAVALIVKDEAAHLNDCLETVKDLADEIVILDSGSTDATLEIARNYTDKVYSSNHWPGYGPQRRIAQTYVTADYLFWLDADERVSPELAQSIRSVLVSPEDRTVYTISRLTWLFGRYIRHGGWYPDRVIRMYPTDLTRFDDALVHEKVEVDNTIAVKPLKGDAIHYTYDDLHQYLVKSARYAKAWAEQRHRQGKTTSITQGLLHGTAHFIQMYILRAGFLDGKQGFLLAVLSAYASFSKYADLWTRPRIARSTD

SEQ ID NO: 3288 - protein, 276 aa, Streptomyces guanduensis
MTKLPLVVAIPTKNEAENIARTVASVIDHVQAVVVVDSHSTDDTCKIAASRGAEVVEYTWDGKYPKKKQWCLDHVRPEIPWVLFLDGDETPSAELLGELHTVFAAGPPSVAAFDIPLGYWFAGRRLRHGHTIVKRALMDRTRCRFPEVGDLDAPGMGEQEGHYQPLAPSAARLRAPIEHEDLDPVRTWFERHNRYSDWEAWLELNPAVKEEIRQAKTRQGRIFHKAPFKPALSFAYAYVYRRGFLDGRAGLDYALAMSFYRWQIALKARELRRGRG

SEQ ID NO: 3289 - protein, 256 aa, Ralstonia pseudosolanacearum
MPGKLTATILTRNEAHNIGDCLDSLAQLADEVIVLDSGSTDATRDIARARGAQVIEDNGPWPGFGPQKNRALDRATGAWVLSIDADERVPPELAQEIRAAMARADADAYAIPRLSQFCGAWVHHSGWRPDYVIRLFRRGKARFSESLVHESLQVTGSVARLRTSLLHYSYTSMDQVHRKSVQYAEAGARDLAQRGKHVGALSPALHGAWAFVRTLVLRRGFLDGGTGLAIARMNATVSYRKYRRARELASGANHRP

SEQ ID NO: 3290 - protein, 302 aa, Hansschlegelia sp.
MIPVSVVIPTRNEAANLGYCLEALRRFDQVIVVDSGSIDATETIARQHNAEIIPFAWNRQYPKKKEWSLLHPAVRHNWVLMLDADEIVSDKLVEEIASTIARGPRFAAYFILGRFVFLGEPLRFGHCNCKIMLVDRRRTRFPRPDDLDIPGGWEVEGHYQPIIDGPIGRMRASLLHWDRKPAAAYFGRHDLYADWEARLAKRGTLTKLASTESLARRLMKTAFRKTPARWLVAFLHSYVLKLGFLDGAAGFHFAMARAFYYWQIALRGRTLAADARMAEEAKGESAVAVRGTAASPAAVGRS

SEQ ID NO: 3291 - protein, 283 aa, Unknown
  Description of Unknown: Microgenomates group bacterium GW2011_GWC1_38_12 sequence
MPRALSSVKDFADETVVVDMHSDDKTQDIAKKFGAKVFEHDRTGYVEPARNYAISKTTGDWILVLDADEEIAKFLADKLRQISTDSDSADYYRLPRKNIIFGKWIKHSRWWPDLNIRFFKKGKVSWNEIIHSVPTTRGKGLDLEPKVENSIIHYHYETVEQYIERLNRYTGEHAKNLIKDGYKFDWSDLLRKPVNEFLSRYFQGEGYKDGLHGFALAELQAFSEFVMYLKTWQLEKFIGNHIEIEEVVNEMKEAENDLHYWESDALLKEVGGLKHRIKRKLKL

SEQ ID NO: 3292 - protein, 262 aa, Paraburkholderia unamae
MKNTTLGVAIITKNAALRLAQCLDAVAFADDIVVIDGGSTDGTADIARAHGARVIEETAWPGFGPQKNLALDALATDWVLSIDADEVVSPELAASIRAAIAAPQADVYAVDRLSSFCGTWIRHSGWYPDWIPRLFKRGRARFSDDLVHERLVFDASAQRLTGKLLHYSYEDFDAVLRKLDAYSGAGARQRAASGKSGSFGKAVVRGAWAFVRTYVLRAGFLDGRAGFQIAVFNAETVYYRFLKLALLNGKDEGSARRPVGDQ

SEQ ID NO: 3293 - protein, 202 aa, Ewingella americana
MADKKRLSVVLIARNEADLLPECLESVAWADEIILLDSGSEDATQDVARRYGAKVFQNTVWPGFGKQRQLAQSHATGDYILMIDADERVSPELRQSIENVLHTPRDNTVYSLGRSNFFLGRFMRHSGWYPDRVNRLYPAAFRYNDDLVHESLKTENASVIPLQGDLLHLTCRDLFVFQRKQLSYAQAHFVLRCVSLRHPSGA

SEQ ID NO: 3294 - protein, 309 aa, Unknown
  Description of Unknown: bacterium DOLZORAL124_64_63 sequence
MLSLIAIAKNEAAGMADFLIHHTPLCDEIIVVDTGSDDGTARIAEAHGAKVFTFAWCDDFAVARNFSLSMATCAWVMYLDIDERIDPSDFPRLRQAIKGRPTCYQLPQWNYYNDPRHMEWQPTPGRYPEAELDHRGFFQAEQYRLFPNGHGLRWEGRVHEDMSAAVAASGLPRRMLDVPIHHYGYVQSDERNRSRNTFYGRLVRRNVDDRPEDPKALLELGYILIQEGQSREAIPVLEKAVAMGAKGPVLCRVSSMLATLYQADGQPDEAIDILYRCMLENPSWLFGWRDLITMLMDGGHWEQASLGLQ

SEQ ID NO: 3295 - protein, 253 aa, Polynucleobacter sphagniphilus
MPTLSVILITRNEEANLGDCLASLEGIAQQIVVVDTNSSDRTLEIAKNHAAVISSPPDWPGFGPQKNRALDLASGDWVLSLDADERLTPALRAEIQRAIAHSAHVDCFAIPRLSWYCGRFIRHSGWSPDYVKRLFKRGTARFSDDLVHERLIPSGQVARLENPMLHFSFMNYSQVLQKIDRYSTASAQQAFLRGKRSSPLKAILHGAWAFFRTYFFRAGFLDGYQGLTLAISNAEGSYYRYIKIWLLQNNQEL

SEQ ID NO: 3296 - protein, 250 aa, Pseudoxanthomonas sp.
MNAPLPLSGVVISKNEADRIGRCLRSMQGVCAEIVVLDCGSEDGTVALATSLGARVEHQDWLGFGAQKNAAIALATQPWLLLLDADEWLADGAADVLRALFAEGRVEQADAWRLRRENWFLGRKLHGHECMARLVRPSHRFLPMRVHEKPDLAGRRVADCTATIEHDTARSLVAHRTKNDRYAQLWAEQRHADGRHCPPWSPWTHAAAYWLKMYLLRAAWRDGRQGWQFHASHARAVVRKYRTLHRLGRA

SEQ ID NO: 3297 - protein, 255 aa, Unknown
  Description of Unknown: Betaproteobacteria bacterium CG2_30_68_42 sequence
MPSSHTPVSAVLITRDAAAQLPAALASVAFCDEILVVDSGSTDATTALARERGARVLVQPWLGYGPQKQWAVSAAAHDWVLCIDADERVSERLRGAILAALARPRFPAYRFARRNRFMGRALGHGEGYPDWSLRLFDRRSFRWSDDAVHEKVTGEGEVGRLEGDLLHESAESLEDYFARQNRYSSLAAQAAHARGVRAGAARILLSPLARFLRFYFLRLGFLDGLPGLVHILIGCQASFAKYAKIAALQRKDGDG

SEQ ID NO: 3298 - protein, 727 aa, Dactylosporangium aurantiacum
MTHIPVSVIVAAGGTPDDFHACLQSLRPTLGVRDEVVCVLPPDRPDLRAELRGETWLRVLEPAAGSGVAERWTAGVDATRHPVVVLVDGDVILSAHWLDPVLEPFHDPAVVATGPSCQHTFGPQQVQLPDEAMTSPAAFKTHARQWRQEHRDEFTDVDRLGPVCVAIRRDALAIAGGPTTDLPWDALAAQGRITIAHAALVAHVASPACGLRTDLADAPDAPLLSASLIVKDEADVLGPSLDAIRDLVDEIVVYDTGSTDDTVAIARAHGARVVEGFWNDHFGDARNRSLEHCRGRWVLWIDADEVFTGDRRTVREAVERADGRAFLALIENREGHEGGGGSSAIYYPRLFRRAQARLYGRLHEQVLDRITGQGFMGPHLPELVLDHSGYTRLRRVVKSKTERNLRLAQLAVDDVNGMTAVGNLARSQISSGHVEEAIATSRRGLAEAKERSHRVLFLKILADAYLALGRIPEAAGVIEDLRAIATNPATVGEHEVKLRFVEGDYERALEIIDELPESGVNDLLYGVGRDRFAGLRIDALSRLDRHTEAAFHLRETLRKGQVPVPVARMAQILGAAGGSLAEVAELLPRSGVRGLLFGIAEAPPEAADELLEALWRRYPGEPTVLTVAARVGRLVPLIRAMEWSARLRQHGFPERCTLLALSGDARRTPRERTLAAAIALEMFHDEAALPLLGEALAAVPDEQSAPVLEEMRILAPRVSDSIELADA

SEQ ID NO: 3299 - protein, 265 aa, Hydrogenophaga intermedia
MTTEAEKRPTLCIGILAVNEARRIAACIASARFADQIVVIDSGSTDGTREVAAEAGAEVHLRADWEGFAVQRNRLLPHVRCDYVFFLDADEIIPPELAQEIQAAVRSGDDAVWEVQWNQVAYGRPLTLMKSTGGIRRLFRMDILSHFDGVVHEGGVLKRPEVPIRRFRHRLLHYSRETVYGSLLKLAQYVQLGAAKRAEKGRRGGVLRGMASATAIFIRLYIIRRGVLCGPEGFLFCFFIALECFFRYAALRYDKLEQGAALARR

SEQ ID NO: 3300 - protein, 264 aa, Lutibaculum baratangense
MGPRLPVSCFIIAKNERDRIGAVIAAVRDLVDEVLVVDSGSTDGTQDLASSLGARVVHNDWHGYGPQKRFAEEACRNDWLLNLDADEVPDETLLRSIAALFAAGGPDAKFHAFKIALVYPGEDRPRRFADGPSPVRLYDRRAGRYSDSPVHDRVVLPKGARVGRLHGEAAHFSYRSFGALVEKLNGYSDLQARTLKRGGRTRLLVRLPFEMPLAFVKYYLARRHILGGWRGFVFASINAFYRFLRLAKMLETSDRGSGGREVGD

SEQ ID NO: 3301 - protein, 317 aa, Indioceanicola profundi
MDRIPVTAIVLTRNEAENLPACLDSLARFAEVVVVDSDSTDGTAAVARDHGARVVRFVWNRAYPKKKQWSLDELDLLHDWVMFVDADERVTPALADELAALFAAGPMSLAYFVRARPVVMGRVLRFGAGFRKIALLNRRRCRYPVCDDLGVATMWEVEGHYQPTVDGQIGSLRQPMLHDDRKPLYQWFERHNRYSDWEVWLDGQERRLPVYRAETRARRLAKRVFARLPCRPLLVFLAVYIARLGVLDGGPGLHYALSRAFYYWQVDYKRRWTDAERKAGRDPDLAYSSSDSSSVASPASALISSNARRRTFSSGMR

SEQ ID NO: 3302 - protein, 526 aa, Kineococcus rhizosphaerae
MVGDRIVSVFISACYIVKDEERVLAASLDAVAPFVDEIVVYDTGSSDGTLEIARSRGAVVVEGHWDDDFGAARNRALEHCRGEWVFSVDADEVVQGDPRAFRTLLRRSAVADVVRVQVANAVWDSVDDDPLTVQMVRVFRRRTCHWTGALHEQVVRRGGERLSGTVSPLVLLHSGYTVQTMAEKGKTDRNLALARRELDRALEDGHHDVTVHRVNFARSALSSRHFQEALDALEPLDGQYAVQPPPADWLPLAASASYCAIQAAASLGRFETARSWIERLQSWGERPGALTRVRASVAMAEGDFRGALDLLRDVTEVTDLRGGRVTEVSLLLDTANCHAALGEYDQAADAMLEHLRRGAGDMPAPQMLAIVHGAHLPVEEFAAAVPPALVVPLLGQLSTLPFAEVSDVLEALLATAPSPAPVLAAAASMWPSMSLPEALPWSLRLREAGHPESCPLLAIAGSAEREPVDRLAAAAVLHEVGDERALSFVEHVLEGWEEATWPLVEQAVGMYSPRLRDLLAASVVEA

SEQ ID NO: 3303 - protein, 290 aa, Streptomyces sp.
MEKLPIVVVIPTKDEAENITGTVRSVIGHFAHVVVVDSDSADGTRALAEAEGAEVVPYTWDGAYPKKKQWCLEHVHPETDWVLFLDGDESPSPALLAEIRHIFSPPPGRTVRPAAFDVPLGYWFAGRRLRHGYTVVKRVLLDRTRCRFPEPDDLKAPGMGEQEGHYQPLADPVVRLAGPLEHRDLDPVRTWFERHNRYSDWEAWLEQHPQVREQIRRAKTRQGQLFHRAPLKPLVSFAYAYLYRRGFLDGRAGLDHALALSFYRWQIGLKARESAPSRDSRDGASGRGGH

SEQ ID NO: 3304 - protein, 250 aa, Pandoraea sp.
MPLTVTILTRNERHNIADCIASVQSLASQIVVLDNASTDDTTDIARAAGAEVHVTNDWPGFGPQKNRALSLATQPWVLSLDADERVTPELAAEIAAAIASSDRGGYTGFRMPRLSQFLGHWVRHCGWYPDYVLRLFRREAGRFSDNLVHERVIVDGEIGTLAHHLLHYSYTEVRQVEDKVQRYARAGATEMALRGKRVSPLKPWINGGWAFVRTYLLRRGFLDGATGAAIARMNARSAFLKYALLRRADA

SEQ ID NO: 3305 - protein, 257 aa, Polynucleobacter difficilis
MPTLSVILITRNEETNLRDCLASLGGLAQQVVVVDTASTDGTIAIAQEFGATIAQPVDWPGFGPQKNRALDLATGDWVLSLDADERLTPALQAEIAGVLEKPGNSTCFAIPRLSWYCGRFIRHSGWNPDYVDRLFQRGSARFSNDLVHERLIPSGAVVKLKNHMLHYSFMNYSQVLQKIDRYSSASAEQAFAKGKRSSPLAAIGHGAWSFFRTYFIRLGFLDGPQGFSLALANAQGSYYRYMKICELAKASQVEQKP

SEQ ID NO: 3306 - protein, 259 aa, Unknown
  Description of Unknown: Betaproteobacteria bacterium sequence
MNAAPRAPLSAVLITRNAAAVLEPCLASLAFADEIVVVDSGSSDGTAEIARRHGVRVVQREWLGFGRQKQFAVEQAKHDWVLCLDADETVSPQLAASILAALARPVSPVYRMPRRNRFLGRWLAHGEGYPDWSPRLFNRMNARWSDDLVHEKVLYAVTPGTLQGDLMHDSSDDLTAYLDRQNRYTTLAARQAYELGRGAGFFHLLLSPVVRFFKFYVFRLGFLDGMPGLLHISIGCINSYLKYAKLIELHGRDRRDRLE

SEQ ID NO: 3307 - protein, 224 aa, Unknown
  Description of Unknown: Phycisphaerae bacterium sequence
MVNKIYVVDSGSTDGTLAVCEKHGAEVVHKPWRGFAKQKEFAISLAQTEDWILLLDSDESLEPSLQEGLRLAISNAAPATRAIEINRKMWYVGGWINHVGFPDWVVRCGRQGALKMIHKPVHERLEADGPTVRAKGICRHDSWDGICDALERGAKYARLSAEVRKPKKFPLLYSFCSAFAIVFKHGVLRRGFLDGWRGAVALVMYAIGRFANTMAAFERGKRGD

SEQ ID NO: 3308 - protein, 262 aa, Macromonas sp.
MLSPNRPSLCIGVLTLNEAHQIERCLKSAQFADQVIVVDSGSTDGTPELASRMGAQVQHYLDWQGFGPQRTRLLQHVQADYVFFLDADEVISPALRDELLDAVSKNANVVGKIRWNTFAFGKELRYFVNRSSLERFFKVDNLERYEGAVHEHAVLKKADAPRFVFRAKLDHHTRQTVKGSLEKLTQYAMLGASKRAQRGKRGGVLRGLLSSTVVFFRLYVLRLGFTGGGAGFLLCWFVALEFFFRYAALHYDRDTLSGCIKR

SEQ ID NO: 3309 - protein, 256 aa, Chania multitudinisentens
MSHRKSLSVVIIAKNEAGLLTECLQSVDWADEIIVLDSGSIDGSAALAESLGAKTFIHTDWQGFGKQRQKAQSYATQDYVLMLDADERVTPELRQSIEHVLITADDSVIYSLGRLNLFLGRFMRHSGWYPDRVNRLYANQRYRYNDDLVHESLNTQGAKVVALQGDLLHLTCRDFFAFQRKQLHYAEQWATQRYQAGKKCGYLSILTHTLGAFCKTWLLRAGFLDGKQGLLLAVVNAQYTFNKYAALWALGRNTTQ

SEQ ID NO: 3310 - protein, 251 aa, Unknown
  Description of Unknown: Burkholderiaceae bacterium sequence
MTTLSVIIITRNEAGNIGDCLDSVSFADEIIVLDSGSTDATRDIARAKGAKVSVADDWPGFGPQKNRALALATQDWVLSIDADERVTPELAQAIVRVLQNPGARAYKIARLSNFCGRWIKHSGWWPDHVLRLFQRGTARFTDAPVHESVRADGAVAILDGHFLHYPYADMDTMIAKINRYSSDAARMMHARGKATSVLGVLGHTFWTFVRLYIIRRGFLDGKEGFILAMTAAAGSFFRYSKLLFLTRNKQI

SEQ ID NO: 3311 - protein, 251 aa, Amantichitinum ursilacus
MPTLGVALITKNAAAHLAPCLQAVAWADRIVVLDSGSTDATLEIARAHGAEVHINAQWPGFGPQKNRVLALLDTDWILAIDADEVVSPQLAASVQQRVANTTTAGDVYSLSRLSNYCGRWMKHSGWYPDHVARLFRRGSAHYSDDLIHERLVYSGPAPALAGELLHYSFDNLDQVLDKVNRYSAAGAEQRLQRGQRASLGKAVFKGFWTFVRTYFFKAGFLDGREGFILAVSNAEGAYYRYLKLMYLQERP

SEQ ID NO: 3312 - protein, 263 aa, Unknown
  Description of Unknown: Photobacterium jeanii sequence
MSTTNRATLSVVLIAKNAATTLHACLESVQWADEIILLDSGSDDNTTEIASQFGAKVYSNLDWQGYGKQRQIAQQYATCDYTFMIDTDEAVTLELKASIEAVLTQSIKNNVIYSCARRNWFLGRYMYHCGWYPDRVMRLYQTQERSYNDNLVHEAVDTTGATVVNLDGDLLHQTCTNFADFQQKQLTYARNWAQDRFQQGKKVGFGSAFSHAIGAFLKTYLLRKGVLDGAHGLLLSIIIAQYTFNKYIALWSLQQSVTNKSES

SEQ ID NO: 3313 - protein, 247 aa, Klebsiella pneumoniae
MSNRLSVVMIAKNAADLLPDCLGSVSWADEVIVLDSGSTDNTVELARRLGAQVYTHTDWRGYGIQRQRAQDYATGDWVLMIDTDERVTPELRQAILKVLDAPQRGAIYSIARRNYFLGRFMRHSGWYPDRVLRLYERARYRYNDNLVHESLDSLGAEVIPLTGDLLHLTCRDFAGFQQNSWRMPPRGRLSVTRKARRPRWQGFSAIRWARSSRRCYCAVGCWTVNRDGYWRWSTRSIRLRNIPSCGR

SEQ ID NO: 3314 - protein, 262 aa, Chitiniphilus eburneus
MTSPTLGVALITRNAARRLPECLRALAFADRIAVLDSGSDDDTVAIARAHGAQVETSPDWPGFGIQKNRAVALLDTDWVLLIDADEVVTPELAASIRAVLAQPVHEVYALNRLSSFCGHWMRHAGWFPDWIPRLFRCGVARFSDDLVHERLIFDGAVGRLDGLLMHYSYEDHADVLRKLDAYSTAGAQQRFAQGQRGGLGKAVLRGGWAFMRTYFIKRGFLDGAAGFQVAMFNAETVYYRFLKLGGMKRSRESTETTPATLR

SEQ ID NO: 3315 - protein, 256 aa, Unknown
  Description of Unknown: Rhodocyclales bacterium GT-UBC sequence
MPATRQPLSVAIITLNAASQLEACLHSARFADEIIVVDSGSTDGTQALAESHGARVIQQDWLGFGPQKQFAVDQARHDWVLCLDADERVSPALQTAIEAALAEPTHGAYRFPRCNRFLGRYLKHGEGYPDWSLRLFDRRQARWSDDAVHEKVVTNGPVGSLSGDLLHDSAESLASYLTKQNRYTTLAAEMALAAGKRPSFARIALSPLVRFIKFYLIRQGFRDGLPGLIHIAIGCFNSMMKYSKMLELRNSDAAVR

SEQ ID NO: 3316 - protein, 256 aa, Enterobacter hormaechei
MSTRLSVVMIAKNAADLLPDCLASVAWADEIVILDSGSTDNTADVARAAGAKVFTDTDWQGYGIHRQRAQGYATGDYVLMIDTDERVTPELRQAIQTVLAAPQPGAVYSIARRNYFLGRFMRHSGWYPDRVMRLYARERYQYNDNLVHESLACDGAQVIPLTGDLLHLTCRDFASFQRKQLNYATAWAQERHTRGKKATLTGIFTHTLGAFLKTLLLRGGVLDGKQGWLLAVVNAQYTFNKYTELWALNRGYSEKT

SEQ ID NO: 3317 - protein, 532 aa, Moraxella canis
MNAAKPYRLSVVMIVKNEAHNLALSLPSVAEFADEIIILDSGSTDNSRDIAESFGAKWFVNTDWQGFGKQRQLAQSHATGEWILALDADEVVTPTLKNSILQAIKNPPTNTVYGIKRLDFVFGHQIDNALWGVKAHWRLYPKHFGYDNNLVHESVVLTGANTAKLDGFLEHHTAPTPKFWLEKRLDYAKAWADDRHTQGKTGKFYKVVLNPLWAFVKQYVIDGRFLQGRYGLIYSLMFSQYTFNKYACLYDLSHNQAEQAFLNSVAMTKNLQPIDLSQKKSTLSLVMICKNESKHLKACLDTVHDIVDEIIILDSGSTDNTRQIAESFGAKWYVNTDWQGFGKQRQLAQSHATGDYVLVLDADERLDQTLRESIAKVLSLPVQTDKVFSVARVNTFCGVEVQPRRWYTDKLARLYARKFEYSDLNVHESLDQQGVPSQVLDGYLPHITNDDLHHFLVKNIRYSHDWAQEKHAKGKQVSLFGIMGRSLVSFLREYVLRADFSGGAYGYILAAASMGYTLDKYIMLWQMNQEKS

SEQ ID NO: 3318 - protein, 277 aa, Azospirillum lipoferum
MIPVSVVVMTRNEAANLPLCLPRLDRFAERFVVDSGSTDGTPAIAADRGAKVVPFQWDGRYPKKKQWCLDHLPFAGDWVLFVDADERPTPALVGEIAALMAEGPDRAGYWIDGRPVLHGRPLRFGCWNRKLALFDRRRARFPEISDLDVAAMWEVEGHYQPVVAGPTGRLRHPMDHADEKPLSAWFDRHNRYSDWEAALRGDGRMERLIDNEAGRRRLMKRLLHRVPCRPLLVFLHAYVARLGLLDGRAGFDHALARAFYYWQVAVKTRAAVVRRAP

SEQ ID NO: 3319 - protein, 278 aa, Pseudonocardia endophytica
MTRVPITAIILTKNEARVIERTIHSLLCLDQVVVVDSASEDGTPAIARGAGADVVDFLWDGQYPKKKQWALEHSDIRNRWVLFVDADEIFTRSLLDEMGQQILCRSSSADSPGAYSVEYAYRFDGRILHHGHRVRKVVLLDKDRCHFPVVDDLNVANMWEVEGHYQPVIDGEVGALSGEVVHDDVDPLYSYFARHNRYSDWEAHLRVNKSAQRQVRASKTLQGRIFDRLPLKPLLFFVYSYVLRAGFRDGIPGLNYALSLAFYYWQINVKTREARRAG

SEQ ID NO: 3320 - protein, 253 aa, Unknown
  Description of Unknown: Burkholderiales bacterium GJ-E10 sequence
MPPISAVLITRNAASQLEACLDAVSFCDEVLVVDSGSTDETVTIAQRHGARVIQTHWRGFGPQKQFAVEQAGNDWVLCIDADERVSKRLQGAIRAALAAPAFSAYAFPRCNRFLGRYLRHGEGYPDWSLRLFDRRHARWSDDAVHEKVVADGAVGRLHGDLVHDSAETLEHYLEKQNRYTTLAAQAAHARGKQAGAAQLLLSPTLRFFKFYVLRLGFLDGVPGLIHILIGCGSSFLKYAKLRALQDRTSAPRQ

SEQ ID NO: 3321 - protein, 270 aa, Verminephrobacter eiseniae
MSEAGAAPPPTLTVAVLTHNEAHRIEACLRSAAFADQLLVVDSGSEDDTVAMARALGAEVHSAPDWQGFAVQRNRLLAHARGDYVFFLDADEVMTPDFARELQAIVRSGAQAVWSIRWRIVAFGHELRRFRAQSYIERLFVRALLEEYTGVVHEQARLYPLPGGAAVPRRRIEARLLHYSRTTVRGSLEKLTQYAMLGAAKRAGQGRRGGVLRGLASGLWMFLRLYLVRLGFLCGGAGFLYCLFVALEAFFRHAALYYDRDSLTGRVIRR

SEQ ID NO: 3322 - protein, 250 aa, Unknown
  Description of Unknown: Bacteroidetes bacterium sequence
MHPFSVVIIARNEAHDIGRTLEPLRALTDDIVVVDSGSTDGTQDIARSMGARVIETEWLGYARTKNLGNDAARHDWVLSLDADEVVSPELARSLQAWQPRPDTAWAVDRLANFCGRWVWHSGWYPDWKVRLFNRHEVRWVGEYVHEHLDLPAHYRVERLHGKLWHYSYRSEADYLAKMEQYTRLSAEERFRRGQRPVWWRKHLGPAFRIFRTLVLKQGWRDGRLGWKLARLDARMVRRRYELLEEMWRMA

SEQ ID NO: 3323 - protein, 306 aa, Neorhizobium sp.
MSSVAVLILTHNEEKHIGRALRAVAPFASEVFVVDAFSSDKTVDIASAHGANVLSNPWTNYSKQFQWGLDNAPIKADWVMRLDADEVIEPELAEEIATKLPKLGQDVAGVNLKRKHIFLGRWIRHGGRYPLILTRIWRRGQGRIEDRWMDEHIMIWGGRTVLFDAPFSDNNLNDIGFFTEKHNKYATREAVDVLNQRYGLFLQDVVLKTEASSFQASAKRFLKERVYNRVPFPISTLCYFLYRYIFQLGFLDRREGLIYHFLQGYWYRFLVGVKVLELDRAIRQFPTAEEKCIELARLTKLDIVSD

SEQ ID NO: 3324 - protein, 260 aa, Halomonas sp.
MSIAAVLIVKNEQDHLRACLETLAWVDEIVVVDAGSTDGTRAIARDFTDKVAVEDDWQGFGRQRRRAEALVESDWILMVDADERVTPALRESIQAALSEGAPAIYTLPRLSWCFGAFIRHSGWYPDRVARLYPRGRAGYNEALVHEKLENPEGLAVRPLEGDLLHYTYRDLRHYLEKSAHYAQAWAEQREARGKRGSLAAGIGHGIGCFLRMYLLKAGFLDGRQGLLLALLSAHSTFAKYADLWIRTRTSPPPEDGARDR

SEQ ID NO: 3325 - protein, 257 aa, Gibbsiella quercinecans
MRQRKTLSVVMIAKNEAGLLAECLGSVAWADEIIVLDSGSTDGTATLAAELGAQVFSHTDWQGFGKQRQRAQSHANCDYVLMIDADERVTPELRQAIEQVLTAPDDNAVYSLGRRNLFLGRFMRHSGWYPDRVNRLYARQRYRYNDDLVHESLNTNGAKAIALHGDLLHLTCRDFFAFQRKQLHYAQEWATQRHQAGKRCGYLSILTHTLGAFCKTWLLRAGFLDGKQGLLLAVVNAQYTFNKYAALWALNRHYSEK

SEQ ID NO: 3326 - protein, 517 aa, Blastopirellula marina
MDRPMSMEANPRKLTVAMIVRDAAETLAATLDSILGIADEVVLVDTGSQDDTIAVAQSHGVTAIERKWEDSFSAARNFALTHVTGDWVLWLDAGEKLDVEEAQSLRQFVNDEADPSLAYVMIVKVPQTAGGIGSEQIGKIRLLPNNGKIRFEGRVRETPLVSLAECEMQLAALPFPIRRDLIEHDPQRKSRKAVRDIQLVNLEIHEIGPSARLLICMAEAMQALGDHKNALTFYQQAGQLAELNSTESLESYYGILTAFDEQENGLENQIQTCLAALETYPLDAQLLCAMGGYLQSQGHLELAIRSFETAYKYGQINPETWHIEDIDQIAVSCFALATQLAGQPEQAEEILNQALVEHPGSIRLRRQLIDMHVKYARRTEAMNQVQLLPESFPNREAYRSAVRGAAAAAQKNWVAARPYLETAFRNGCREPLCLRWLSISLLALGLQEEAIEILQVWRTLDATSLEPQQLLGSIEQANANLTVPGQSRTIRVDSSETSSKKSHAAAEAATLRDTNRI

SEQ ID NO: 3327 - protein, 483 aa, Sulfobacillus benefaciens
MKKSPRFTHIRKHLEAGRFQEAISLIRRTLTAHRADPEAWVYLAQALEKTSFKDYAGLAYERAWILDPRAEWISRTPSYPPRVSVADAPSWLQELLNVPLLSLSAAIIARNEAQSLKRCLEAVQPAVDEIVVVDTGSEDQTPSIAQDLGARVYSCPWTDNFSAARNFAMEKVRTDWVFWIDADEIFDPDDIHVPRVVAGLLDNCNPPVILRVVLINNTGSETHYNFDVSRLFPTRFGLRFRGRIHEQIGPPDGDLYAAAYNHPLVRIRLHHDGYHPDLIPRKLERNIRILRLAIHDNPDDVASWGFLGRELYLQGNLMEAVDVLYQAERMASNVAMYGRLPEIQAYLADALIQLGRLDEAITVSRRAVESNPQFPPGWYNYGKAQLMMAWQFSESARRALIAAREQAPLYEGIITYDPQIPRWKSLVALADVAKLQGDWMAAVRLYQQARNEQAPDQAVHVPLQHIRDQLSQLQNILGQDEKD

SEQ ID NO: 3328 - protein, 280 aa, Unknown
  Description of Unknown: Chitinophagaceae bacterium sequence
MPAATPISVVVITRNEAANIVDCLRSARLLSDDIVVVDTGSTDATTRLAALCRAQVHNLSWQGYGAARNLGAAMARHDWILALDADERLDENLIIQLKNQILKRGRVYRFRRRNHWEERPIRFGTLGFERIARLYHRGDARWNGYAVHERLTGAFRVQDFPGSIQHFGIADPDFYYRKKEHYALLSALTYARQGKKAGWLKRFVAPLFDAGKSYLLLGGFLDGAIGARLALTTFRYTARKYALLHRQRERLLELQPGQGVPEEAACTIAELRPLPSSAAS

SEQ ID NO: 3329 - protein, 254 aa, Unknown
  Description of Unknown: Metallibacterium scheffleri sequence
MSRPAISACVITLNEADRIEACLAALAFCDDIVLVDSGSSDATRELAARHGARVFTRAFDGYRAQKDFAVQQARHDWILCVDADERVSAELRASIEAARDAGFVGAHGYRCARATRYFGEFLRHGNAYPDRVLRLFDRRHGGFRGVREIHEHVEVDGAVALLRGDLLHEAYRSLDDQLARYQRYARMMAEHLHAQGRRARLRNIVLNPAWRFLRGYVLRGGFRDGWRGLFYAYVEAGYVRQKFLRLWLLQHGAG

SEQ ID NO: 3330 - protein, 251 aa, Unknown
  Description of Unknown: candidate division Zixibacteria bacterium sequence
MGTISAVIITQNEESNIKRCLDSIAWVDEIIVVDSQSADNTPKIAAEFGAKVYDIEWCGFGPAKGFAVERATCDWILSIDADEELTEELAAEIKGVAESSDSLYGYEIPRMTNFLGKWIKHSRWYPDYVLRLFRRESGRFTDSLIHEKVIVEGDVGRLKNQLLHYSYPDIDTYFVKFEKYTSLKARELYKDGKRFNIGGFVVKPLAAFCRHYITGLGFMDGFEGFLIALFSAFGVVTRCVKLRSLEKADRQ

SEQ ID NO: 3331 - protein, 258 aa, Erwinia sp.
MPTRQPLSVVLIAKDAAELLPECLTSVSWADEIILLDSGSSDGTKEIAERHGARVFHSTEWHGYGKQRQLAQSYASHAMILMIDTDERVTPELRRSIERVLEQPASETVYSIARRNLFLGRFMRHSGWYPDRVTRLYPRSYRYNDNQVHESLDTAQAQVRPLQGDLLHLTCRDFSAFQWKQFAYAEAWAKQRHQQGKRCGIVAIFGHTAGAFLKTLVLRAGFLDGKQGWLLAVVNAQYTFNKYTALWALNHASRNGRL

SEQ ID NO: 3332 - protein, 249 aa, Unknown
  Description of Unknown: Alphaproteobacteria bacterium sequence
MPHLSAIIITKNEAANIGDCLDSLAFCDERIVVDAASSDGTMMIAKQKGARVAAHSWKGFGPQKNYALSLAQGDWVLSIDADERVSPELAQAIRAAIDNPKADGYEIPRRSSFCGRMMRHSGWFPDRVLRLFRRQKSRFTDDAVHERVVCDGPVARLNEPLLHYPVARLEDAIRRIDQYSTLGAEQLAISDRKISAFSGVAHGIGTFLRVYLLKLGFLDGAAGFMLAVANAEGAYYRYMKAWLARQRRE

SEQ ID NO: 3333 - protein, 265 aa, Pandoraea pnomenusa
MTETSLSAAPLSAAAAQRLPLTVTILTRNERHNIAECIASVQSFASQIVVVDNASTDGTADIARAAGAEVYVTPDWPGFGPQKNRALSYATQPWVLSLDADERVTPELATEIAAALGDTSRAGYRMPRLSQFLGHWVRHCGWYPDHVLRLFRREAGRFSDNLVHERVIVDGAIGTLSHHLLHYSYTEARQVEDKIQRYARAGAKEMALRGKRVSPLKPWINGGWAFVRTYFLRRGFLDGATGAAIARMNARSAFLKYDLLRRGES

SEQ ID NO: 3334 - protein, 256 aa, Unknown
  Description of Unknown: unclassified Lelliottia sequence
MSTRLSVVMIAKNAADLLPDCLASVAWADEIVLLDSGSEDNTTEIARAAGAKVFVDTDWQGYGIQRQRAQSFATSDYVLMIDTDERVTPELQQSLLSVLAAPQPGAVYSIARQNYFLGRFMRHSGWYPDRVMRLYERERYQYNSNQVHESLECASAKVIPLAGDLRHLTCRDFASFQRKQLSYATAWAQERHQRGKKASIAGIFAHTLGAFLKTLILRAGVLDGKQGWLLAVVNAQYTFNKYTELWALNRGYSEKV

SEQ ID NO: 3335 - protein, 259 aa, Zobellella maritima
MSARPTLAAVLIVKNEAENLADCLATLDWVDEIVVLDSGSTDGTRQVAETAGARFFVNDDWPGFGRQRQLAQSHVQSDWVLWVDADERVTPELRTSIEAVLARPTTNTVYAAARLSWVFGRFIRHCGWYPDRVLRLYPKALTGYNDALVHEKVELGAGIKTARLKGDLLHYTYRDLEHYLVKSAGYAAAWSRQRAERGKRGSLSQGLLHGIGCFLKMYVLKAGFLDGKQGLLLCLLSAHSTFVKYADLWIKTNTERPNP

SEQ ID NO: 3336 - protein, 278 aa, Unknown
  Description of Unknown: Candidatus Dadabacteria bacterium sequence
MRQEQPAPDVGRREAADHGTAQAGCTRLPVTAAILAHNEADRLPATLQALNQHVERIIVLDSDSDDGTAEVAMALGAEVHNHRWEGYVAARRRLLELVDAPWCLMVDADEVVPPAFWDALARTGFPDTEASAYAVRRQTIYLGKRLRYAWQPDWKTVLVRTERARIEGGAVHEYLTTPDPVVRLPVAIDHYSYRGLGDHLRKMIAYARLGAAQLEQEGRRCHWWDLTLRPAWHVVRHLLVKQAWRDGLPGWIAATSSGVAVWMRYAFLLERRLELRKG

SEQ ID NO: 3337 - protein, 260 aa, Unknown
  Description of Unknown: Yersiniaceae bacterium 2016Iso4 sequence
MSRRKRLSVVLIAKNEADLLPDCLRSVAWADEIVLLDSGSDDATADIARQAGAAVYQSQGWHGFGKQRQQAQHYATGDYILMIDADERVTETLRHAIEQVLQSPDEGAVYSLGRRNLFLGRFMRHSGWYPDRVVRLYDAQKYRYNDHLVHESLDTQGARIVALPGDLLHLTCRDLPAFQQKQLGYARDWAKQRYQQGKGCSFFSILSHTAGAFCKTWLLRAGFLDGKQGFLLAVVNAQYTFNKYATLWALRHTQPTSEPS

SEQ ID NO: 3338 - protein, 254 aa, Unknown
  Description of Unknown: Betaproteobacteria bacterium sequence
MAAPTRAPLSAVLITRNAAAVLDACLESLQFADDILIVDSNSSDGTLEIARRHGARVVQKEWLGFGRQKQFAVDQAKHDWVLCLDADERVSPALAASIAQALAAPVSPVYRMPRRNRFLGRWLAHGEGYPDWSPRLFNRLNARWSDDLVHEKVLYAVTPGTLSGDLLHDSADDLAAYLDRQNRYTTLAARQAYELGRSSGVLRLLFSPVVRFFKFYILRLGFLDGVPGLLHISIGCINSYMKYAKLLELRKAEK

SEQ ID NO: 3339 - protein, 252 aa, Paracandidimonas soli
MHTISAVLIVKNEAANLDECLATLDWADEIVILDSGSTDATLDVAARHGAKVFSSEDWPGFGVQRQRAQRHASCDWILMIDADERVTPELRDSIRACVADGPAIGMLNRLSWCFGRYIRHSGWYPDRIARLYPRQQAAYNDALVHEKLEYPSSLPVKRLQGDLLHYTYRDLRHYLEKSAQYAQAWAQSKEAKGRKGSLAAGLLHGVGCFLRMYVLRLGMLDGRQGLLLALLSAHSTFAKYADLWVRTRTRSS

SEQ ID NO: 3340 - protein, 272 aa, Hyphomicrobium sp.
MTKYNSMRRAPVSCFIISKNEADRIGRTIRSVRPWVDEVVVVDSESTDDTVSVALAEGARVITQRWLGFGGQKRFAEEQCRNDWVFNVDADEVVTPALEREILDVFAGGDPKFVAYGMPLQMVYPSASKPRLFARDHWYVRLYDRRFVRFRQSNIHDAVVTDDHPVGQLRAPMHHYSMRSFPDMKRKLNDRTWLLVENSDVTTTGSVSLRLFTELPMNFFKYYIVRRHCMGGFTGLRYASIQAWYRFLKIYRIWGEAGHKTRRMPAPEAPAA

SEQ ID NO: 3341 - protein, 224 aa, Raoultella terrigena
MSTRLSVVMIAKNAADLLPDCLASVSWADEIVLLDSGSSDGTVELARSLGAQVYINTDWQGYGVQRQRAQDYATGDYVLMIDTDERVTPELAQSLRQALAAPKEGAIYSIARRNYFLGRFMRHSGWYPDRVMRLYPRLGYRYNNNLVHESLDAKGAQIIELTGDLLHLTCRDFSGFQQKQLAYATAWAQETPSEGEKNLADEYLRPYAGGICENAAAARRRAGW

SEQ ID NO: 3342 - protein, 253 aa, Sulfurisoma sediminicola
MPPSRQPLSAVLITRDAAASIAECLASVSFCDEILVVDSGSRDATREIARTHGARVIHQDWLGYGPQKQFAVEQAAHDWVLCVDADERVTPELRASILAILPEPNCHAYRFARCNRFMGRYLRHGEGYPDWSLRLFDRRDARWSDDAVHEKVIPDGPVGTLAGDLLHDSAETLATYLAKQDRYTTLAAEAALADGRRASLVRQLLSPLVRFAKFYFLRLGFLDGWPGFVHILIGCRNSYAKYGKMRSFRAEKS

SEQ ID NO: 3343 - protein, 1309 aa, Selenomonas sp.
MKISACYIVKNEAEELRRSLVSVQQAADEIIVVSTANDPFVAAAAMEFQAQIYFFAWQNDFALARNYALAQATGEIVIFLDADEYFFHPEEVRAGILDVVHSQPGLDIIMISLCNFMTHDSFQDAHFIQSPRIFRKEGLHYVGMIHEQLIREDGEERVLAYGDERVAAAHTGYLMEMGEEKIRRNIAMLERDAALRGRTAMHAFYLADCCFGLKDYEKTLALSKEALAGDIAFVGEESKIYHQMIESMRALHYPDEEMLELADEALAKFPMLPDFYAQRGMILCGLIRYAEGMDSLIEALRRYDEGGAHTENTSFFNDSVAAAIADRVARLCLHMEDREKADYWSARACSYRGDDVVKPSEDKMCITACYIVRDDAAHLKISIASLRDAVDELIVVDTGSIDDSVHVAQSYGAQVYHFPWTDDFAAARNEALAHVTGDWVVFIDADEYFSLETRDHLRTVIDHAAEDGEVLLVPWHNIDEETGETLLDSYAPRIFRWREGRRYVGRIHEELREADGAAPLCRTVAPELLTLVHTGYSARLTQEKGERNLRLLLAEVESSDTPERCWRYLAETYDNLGEERMAEHYALLDIGQGRRSVVYASLCYRILLRIYGAQPARRMERLTVAEQAVDAFPELPEMHAELAEALAVLHRYEEAIPAAEKAVEEEPPEGGTDCSFFNEEMREELRRRIQIWHRITARAKELRIAAAVFVRDDARDMETWLANTAVYADERIVVDTGSQDGTRALAADAGATIVDFPWKNDFAAARNAAVRAADGDWAAVLDADESFFDPSEVRSYLAMVDVTMPQVDAVLLPIVHVDEDAGGRETGRAPHVRLLRMGRGLRYEGRVHESLCKEEGTPVLYHEPVALSIRHVGYSSGRIRAKHERNLALMEQRIAEHGLQPGDARYLGDTYYGLGQYAAALLYARAALAESVTSLGAQSHLHHLLLDAMEKENIPLTEQIEAARTASFAFPQLPDFHGRLGILLAAAGADGALPALTHALEIYEAPLDTGGEASEFPAWAGPVSAARARILMEMGENAAAEEEVLRALSFDTAREEALDIYVEMHQRASSDQLLAALREIVGSDKESLIYLVRFADAYGWLYLAEEARSVLQREAGIHMPSPAIYGQARSLPSAEFGEQMVGALAAYVREMPEILLRLEKEQGGESPMLRHRLREQLPASMLEFWRHYDEPDAVPLPESREGYDLVRDSFIRYANAHQSERFLHIAASFGDDVLREATASFDHVRHWEGAFIGWSLLAATGGETADTLYGMALASLFLGGREEAKDYLERALGMDAAHRKSKELMELIA

SEQ ID NO: 3344 - protein, 258 aa, Unknown
  Description of Unknown: Candidatus Erwinia dacicola sequence
MHARQKLSVVMIAKNAAELLPECLESISWADEIIVLDSGSSDGTAAIAERHGARVYHSSEWHGYGKQRQLAQSYASHPMILTIDNDERVTPELQHAIEHVLEQPASDSVYSIARRNLFLGRFMRHSGWYPDRVTRLYPCHYRYNDNQVHESLETSGKCATPLKGDLLHLTCRDFSAFQWKQFAYAEALAKQRHQQGKRCGIAAIFGHTFGAFFKTLVLRAGFLDGKQGWLLAMVNAQYTFNKYAALWALNHASRKGRL

SEQ ID NO: 3345 - protein, 288 aa, Polaromonas sp.
MYTKNEQLDILACLQSVAWSDDIHVLDSGSNDATVAIARNFGAHVIERTYGENKLAFGGDEAGHRNWGLKNISFKHEWIYIIDADERMTPELFSAAESAIASPGRHVAFRVQRHDFFLDTWIKHVTPSPFNIRLFLHEKVHYERLVNSITVVDGPVGEIAAHFNHYSFSKGMSNWFDKHNRYSSLEAAQIVFNTNSKAKFSLRKAFFSKAINERRFHQKEMYYRAPFRPLLMFGLLYFVKRGFLDGRAGLTYALLRSIYEYMIVLKVREMKTLEPAVSNESHQTAVSG

SEQ ID NO: 3346 - protein, 267 aa, Unknown
  Description of Unknown: Betaproteobacteria bacterium sequence
MRPITLSVILITRNEAHNVAGCLGSVAFADEWIVVDSASTDATREIAEQFGARVVTTSDWPGFGAQKNRALALAQGRWVLSIDADERVSDELATSIQRAIAVDTSGHASGAAAMAQPLGYELSRLSSFCGQWMRHGDWYPDRVLRLFRRDAGRFSDDMVHERLIVDGPVGTLDGELLHDSMPTLDSALDKMNRYTAGRALDKVRAGKKGGLASALAHGLWAFIRCYVLRRGFLDGRLGFVLALYVAEGTYYRYLKMGLLAPARAAMQ

SEQ ID NO: 3347 - protein, 261 aa, Ralstonia pickettii
MSGKLTATILTRNEAHNIGDCIASLADLADQVIVLDSGSTDATRDIARARGAIVIEDNGTWPGFGPQKNRALDHATGEWVLSIDADERITPQLRTDILAAMHSASQTVFAMPRLSQFCGRFIRHAGWYPDPVMRLFRRGAARFSDDLVHEKLVFSGATGMLAHPLLHYSYRDYSDVLRKIEAYSSAGARQAFQAGKRATPSSALFHGVWAFVRTYVVQLGLLDGAQGFGVACMNAQASYYKYIKLWHLARTAQPRASDAHS

SEQ ID NO: 3348 - protein, 258 aa, Pseudoxanthomonas mexicana
MTDASATRTPPLLLSAVIITKNEVDRLGRCLASVQGLCSEILVLDCGSDDGTVALARSFGARVEHQDWLGFAGQKNEAIRRAERPWLLLLDADEWLADGSAAQLRALFATGEVERADVWRLKRCNWFLGRLLRGFERTERLVRPDHRYLPMRVHEKPDLAGKRVEDCDIVIEHNTARTLEAHRAKNDRYARLWAEQRHADGKRCSASSPWTHAAAYWLKMYLLRGAWRDGRRGWWFHASHARAVVDKYRHLHALGKRR

SEQ ID NO: 3349 - protein, 258 aa, Comamonas aquatica
MATLTIGILTMNEERRIAACIDSAAFADQIIVVDSGSSDATVEIATAKGVEVYSYPDWQGFAVQRNRILQHATGDWIFFLDADEVVTPALAQEMRAIVDGNVACVWEVAWEQIAYGQSLGRMRSSGGIPRLFPRAQILQFEGVVHEGAKLKDPTLPVRLLKERLPHYSRETIYGSLQKLAQYVQLGAYKRMQAGKRGGVLRGMGSAIANFIRLYFFHRGFLCGRAGFLHSFFVALECFFRYVALEIDRDFLEQAKKRG

SEQ ID NO: 3350 - protein, 281 aa, Unknown
  Description of Unknown: Sphingobacteriales bacterium UTBCD1 sequence
MEPVSAVIITLNEEHNLLSSLPKLSWCDEIIIVDSGSSDSTLDICKSFGCKIFHRQFDGYGTQKQYAVSIARNDWVLCLDADEVMSDALVDEIRKEMQAPLAEGYLIPMTFVFLGKKFHYGKEGWRYFMRLYNKKSGSFNDNKVHEKIELNGSTRKLCNNIYHYSYHSLNQYFDKFNRYSTYGAEMAFQRGKRKSLFAVVTAIPFNFLKYYFIELNFLNGLSGFYWSVLNAFYHFAKYIKIRELHQQQREVQKNEIKFNSRFIGSVEKISSAEKSCMPDLK

SEQ ID NO: 3351 - protein, 257 aa, Comamonas kerstersii
MARLTIGILTMNEERRIAACIDSAAFADQIIVVDSGSSDATVDIARAKGAEVYIHADWQGFAVQRNRVLQHANGDWIFFLDADEQLTPELAAEIRGVVDADQDAVWEVVWEEIAYGQSLARMSGGGGVMRLFPRRLLLGFEGVVHEGARLSREGVLQRQLSHRLPHYSRETIYGSLVKLAQYVQLGAMKRHAQGKRGGVLRGLASGIANFSRVYFFRRAFLCGRAGFLISLFVGLECFFRYVALETDQAQLQETKKR

SEQ ID NO: 3352 - protein, 271 aa, Unknown
  Description of Unknown: Candidatus Pacebacteria bacterium CG_4_10_14_0_8_um_filter_ 43_12 sequence
MNKPSMTAVVIAKNEALMIEACLETLQWCTEVLVIDNGSTDATADLAEKRGAQVISFKHQSFARLRTEALKAVATDWLLYIDADERVTPELAKEIMVRVETGNWAALAFLRQNYFFGQLFRHGGWETDTVIRAFKTEDLKEWRGDVHESPVFDGQSTLLTFPLVHFTHRSVAAGLSKSAEWTPIEASLLFQSATFQVGVGTIIKKGLAEFVKRAIYRQGYQDGQAGWVESISQAINRMLVYMQVWELQQNPSSAKKYEQLEKKIKEKWQSA

SEQ ID NO: 3353 - protein, 256 aa, Lelliottia amnigena
MPLRLSVVMIAKNAADLLPDCLASVAWADEIVLLDSGSEDATPDVARAAGVKVYTNTDWQGYGIQRQRAQAYATGDYVLMIDTDERITPELRQSIQNVLHAPAPGAVYSIARRNYFLGRFMRHSGWYPDRVTRLYARTDYQYNDNRVHESLACDHAQVVALRGDLLHLTCRDFASFQQKQLNYATAWAQERHQRGKKTSLTGIFTHTLGAFLKTLLLRGGVLDGKQGWLLAVVNAQYTFNKYTELWALNRGYSEKA

SEQ ID NO: 3354 - protein, 271 aa, Acidovorax sp.
MSVAAGGGTPSPTLTVAVLSHNEAHRIEACLRSAAFADQLLVVDSGSTDGTVAIAQGLGAEVHSHPDWQGFAVQRNRLLAHARGDYIFFLDSDEVMTPAFAQELQAIVRSGEQAVWKIRWRMVAFGHELTHFRSQSQIERLFVRRMVKEYTGVVHEQAQLHPQPGGADVPRRLIKARLLHYSRTTVRGSLEKLTQYVMLGAAKRAEKGQRGGVLRGLASGLSMFLRLYVFRLGFLCGGAGFLYCLFVALEGFFRYAALHYDRDSLTGRVIR

SEQ ID NO: 3355 - protein, 279 aa, Unknown
  Description of Unknown: Curtobacterium sp. MCBD17_021 sequence
MLPISVVIITKNEGVGLHRVLSRLSSFDQIIVVDSNSTDNTKEVATSFGAEVVNFDWNGRYPKKKQWSLELERLRNRWVLLLDGDEYPSDGLISELEEMSQTFREPSAIGAFDVPLLYRFTGKFLHHGHTVTKRSLLDREVAHFPVVDDLDAPGIREVEGHYQPQTAKTVGTLSHRICHDDLDPITTWFARHNRYSDWEAYLNTHPALRRQIAGNRSPKGRLFDRVPFKPLAFFIYAYLLRSGFRDGRAGFDYAFALASYYWQIDVKTRELRRLKDVVN

SEQ ID NO: 3356 - protein, 276 aa, Archangium violaceum
MKLGGYVIHGNNRDTLGACLESLSAVCDEVVALDSRSTDGSVELARSMGARSVSHSWRGYGAARAAAMEALGPCDYVLYLDSDERLAPEALSVIRAWRDSHPAEPAYRLPCRDWAEINGHRFRYRTHWRARLVRRDAAIWRPEMIVHEALPRMRAPRLHAPIDHRFATSLEGRAEKEERYALLWAVRAFAEGRRLKPAALQRPAHLIRDCLMHGALWRGGLDALRLAWAVSNYHSAKYRHLRVLRQGGFPELRKAFDEGRYGEVFALVREERTRAP

SEQ ID NO: 3357 - protein, 271 aa, Rhodanobacter sp.
MPALPLTLAVITHNEADTIARCLDSVPFAAEKLVVDSGSDDDTVAIARAHGARVVHQDWLGFGAQRNFTSGQCRHDWILVLDADEYLSPELADELQQRLPALIASDTPAAWLRRSTIYMGRPMRWYRPAVGEKLVRLYHRDRARWSDARVHESLRFDGIAPTLHATFNHSNNPTLVHKQLKVLRYAELKCRDWLDKRKPVRMWQSPFVFALAFLKDYVFRLAFLDGWRGFMIAHTAASYAIYKRMRYYEMIHNPASVARAGDLLDKHGIDR

SEQ ID NO: 3358 - protein, 279 aa, Melaminivora sp.
MLEAAGGADQAPPSSFPPEPTLTVAVLTHNEAQRIAACLQSASFADQLLVVDSGSDDETVAIAHRLGAEVYVHPDWQGFAVQRNRLLAHARGDYIFFLDADEVMTPAFADELRAIVRSGRQGVWTIRWRMVAFGRELRWFRAQTHVERLFTRALLVGYSGAVHEQAELRPLADGSAPPRRHMRARLLHYSRSTVRGSLQKLTQYVMLGAAKREEAGRRGGVLRGLASGSSMFLRLYVLQLGFLCGGAGFLYCLFVALEAFFRYAALHYDRGTLTQRVVR

SEQ ID NO: 3359 - protein, 260 aa, Tatumella saanichensis
MTTRQRLSVVMITKNEAELLPDCLASVLWADEIVVLDAGSDDATCEIARHAGAKVYQNDEWPGFGPQRQRAQHYASGDLILMIDADERVTPALRHAIETLLSKPINNNCVYSIARSNWFLGRFMRHSGWYPDRVTRLYPARFTYNSHRVHESLEHPGAEVIKLAGDLQHLTCRDLHHFQQKQLSYAHAWAQQRFEQGRRCGLFSIYSHTVGAWLKTAILRAGFLDGRQGWVLAQVNAQYTFNKYALLWALNATKPGESSS

SEQ ID NO: 3360 - protein, 253 aa, Paraburkholderia sartisoli
MQETTLGVAIITKNAAARLAECLQAVAFADQIVVIDGGSTDGTVNIARAYGARVLDQTDWQGFGPQKNRAVAALTTNWILSIDADEIVSPELAAAIRAALAAPTADVYAVDRLSSFCGHWIHHSGWYPDWIPRLFKSGVAHFSDDLVHERLVFDAPVQQLTGKLMHYSYEDFESVLRKLDAYSTAGAQQRHTAGKRGSFGMALGRSAWAFVRTYVLRRGFLDGRAGFMIALFNAETVYYRFLKLSRLGKKTQR

SEQ ID NO: 3361 - protein, 258 aa, Polaromonas sp.
MTSLSVTVITKNEANNIGDCLRSVRFADQIVVLDSDSTDATIEIARSMGADVSISPDWQGFGVQKNRALDAAKGDWVLSLDADERVTPELAQEIQAQLAQVQVSGQSVAFAIPRLTQFCGVWIRHCGWTPDYVLRVFKRGEARFSDDLVHEKLQLIRADMPIVRLKTPLLHYSYPTPEHYWRKLQRYSQDWARQRHARGQKATITRAALSAVTAFIRSYVFQLGFLDGAMGFAVCTMQAQSAFGKYFELYCLGHEHDK

SEQ ID NO: 3362 - protein, 258 aa, Sphaerotilus hippei
MIAFNEAEKIRDAVSSVLWADEIIVADSHSTDGTVEIAEGLGARVVQIDFQGFGDLRNRAIAQCRGDWIFSLDADERCTPEVRDEVLALVDGAARHDAYWVPRRNYFMGRWIRHSGWYPNFRQPQLFRRGAMRYTMEPVHEGYEMLSGGQPGVLRHAISQFPFRNLDEVMRKANRYSTLGAAKVRPGRASMSRALVSATWAFVKHLVFKRGLLDGWAGFIIAFAYFEQTFYRYAKRWEQDMDFQRPPQAPVRRTDRPA

SEQ ID NO: 3363 - protein, 261 aa, Halobellus clavatus
MAMDRPPITICTTTKNCADDLDRLLDSVIDFADEIVVVDSDSTDGTISVAENHGAEVYQRDFTGFAGIKRYAIQQATNDWVWILDADEEVSPDLRHEALSALSKADDTVAFKMRKRNLMFGEETNISHPKRPYLAKKEVLEFKNEIINETLQVKAEYRNRVKKLGSEITHHAYESIGEYLETWDRYSTLEAKQIRNQGNERPFLYYFIYGLGECVYYLFIEGAILDGWRGIFFALMSLNFRIAVYGKLRGDEILLGEKLRP

SEQ ID NO: 3364 - protein, 256 aa, Polaromonas sp.
MASLTVTVITKNEAHNIEACLRSVDFADQRVVLDSGSTDGTSELARLAGAEVSVQENWQGFGIQKNSALSLARSDWVLSLDADERVSPALRAEIEAAMASPQFDVYAFPRLSSYCGQYMRHSGWYPDRVTRLFRRGSARFSDDLVHESLVTASAVGHLTSPLLHESFRSFEDVLDKVNRYSSAGAESLKNRGQRSSVGKALGHGLWAFVRTYFLRLGFLDGRMGLLLAISNAEGTYYRYLKLWLLHRKVGKTPPAP

SEQ ID NO: 3365 - protein, 240 aa, Unknown
  Description of Unknown: Oxalobacteraceae bacterium IMCC9480 sequence
MDSGSSDGTVGLARAAGASVIETTDWPGFGPQKNRALAAAEGDWILSLDADERITPALRDEILAVIAAPQHDAYALPRLSSFCGQFIRHSGWYPDHVVRLWRRGSGRFSDSLVHERVLVNGGKIGYLRSPIIHYSYRDNGDLLRKLEQYSELGARQAFAAGKRGTLRKAFVHALSAFLRSFVFKRGFLDGRAGLIVALCAAETTYHKYFKLMMLTQAEGGSVRDADVYERTQTQQRSSQD

SEQ ID NO: 3366 - protein, 245 aa, Halotalea alkalilenta
MVKNEAQNLAACLDTLGFADEIVVLDGGSEDATREIAARYTDKVFVEAQWRGFGVQRQRAEAYASGDWILMIDADERVTPQLAQSIREAIAGEPAILSMPRLSWCFGAFIRHSGWYPDPVARLYPRSGAGYNDALVHEKLENRSGLPERSLEGDLLHYTYRDLRHYLEKSAHYAEAWAEARAARGKRGSLAAGIGHGVGCFLRMYLLRAGFLDGRAGLLLALLSAHSTFAKYADLWVRTRTGSPD

SEQ ID NO: 3367 - protein, 261 aa, Comamonas terrigena
MDARMSRLSIVVLTLNEAHNIEACLRSAQGVADQILVVDSGSQDATVSLAQGLGAEVVAYPDWQGFGEQRSRALQHVRADWVFFLDADERLTPALADEIRQVVAGNAEAVWEVEWEQMAYGQSLGRMRGTGGVARLFPMRVLEGFSGAVHEGAVLRTAVPTRHLRQRLPHFSRETIYGSLVKLAQYVQLGALKRHQAGKRGGVLRGLGSGIANFTRLYVFQRGFLCGRAGFLYSFFVGLECFFRYVALEVDRDQLKKPVRR

SEQ ID NO: 3368 - protein, 254 aa, Paraburkholderia sp.
MNHTTLGVALITQNAATRLADCLAALAFADEIVVIDGGSTDGTAGIARAHGARVIEQTDWPGFGPQKNRAVDALGTDWVLSIDADEVVSPELAASIRAAIAAPQCNVYAVDRLSNFCGTWVTHSGWYPDWIPRLFRRGAARFSDDLVHERLVFEGAAQRLTGKLLHYSYDDFDAVLRKLDAYSGAGARQRAAAGQRGSFGRALARGAWAFVRTYVLRAGFLDGRAGFMIAVFNAETVYYRFLKLALLNERDHRA

SEQ ID NO: 3369 - protein, 255 aa, Cupriavidus basilensis
MKISVVLITKNEAHNIRECLESVSWCDRAIIVDSGSRDGTVELARSLGAEVFETEHWPGFGAQKNLAVSKADGDWIFSIDADERVTPELRDEILAAVASGQSDAYEVPRLSRFCGRFIRHGGWYPDYVTRLFRRGRARFTDDLVHERVVADAPVGRLNSPLLHYTYDDFSQVLQKVDKYSSLGAQQGFARGKTASPASAVLHGAWAFLRTYLLRRGFLDGAQGLGVALMNGQASYYKYIKLWYLQQKTERQAPPR

SEQ ID NO: 3370 - protein, 248 aa, Unknown
  Description of Unknown: Candidatus Magnetaquicoccus inordinatus sequence
MAEPLSAILITYNAASLLPECLATLAFAEEILVVDSGSQDASCAIAQAAGARVLHHPWSGFGPQKQWAVQQARHDWVLCLDADERLTPQLQQQIQEVLRAPRYPAYRLPRCNRFMGRWLRHGEGYPDWVVRLFRRQHGQWSADPVHERVEVQGAIGTLTGDLLHESALSLHDYLHKQNHYTTLQAQQLLLQNRSIHLRHLLFSPLWRFMRFYFFKRGFLDGIPGLVHILIGCGNSFLKYAKAMALRRQ

SEQ ID NO: 3371 - protein, 355 aa, Sphingosinicella sp.
MTRLALVMIVRDEARCLARCLASARPHVDRMIVLDTGSSDGTIGIARAAGAEVHDFAWCDDFAAARNAALDYSDADWNLVLDADEWLEAGVEALSPEAFPPHARRTPAFIGCVRIANRQDANKGGGRRAYIPRLLPRGVRYEGRIHEQPVSALPLVQLPLVVGHDGYEAAQQARKKGRNAALLRAEIAAQPDDAYLRYQLGREYLVDDRAAEAAECLVAAYHAVQPDAAYRHGIVLYALRALRGAGRFDEALALADAEQSRWPHSPDFYYAVAELYLDWAGLNPEIARDQLLPVVEMAWLKCLQIGERPDLAGSVEGLGSIRPAESLAHLYRSLGLIEEADQYDRIAADLRAAKA

SEQ ID NO: 3372 - protein, 294 aa, Solimonas aquatica
MTTSLPEPDPRPLAARAPRRHSLSVLMICRDEADRIEAALRSVAGWADQILVLDSGSRDGTVDIARRYSSEVYQTDWPGFGPQRQRALRLCRGDYVLTVDADEEVTPQLRAEIDAELSAQTPRCAVYLIRWQPIFMGRPLRFGRFQAPQLRLFRRQGAEYPQAQVHEKLRRPPGAVGVLRGRLRHDSFRDYRHVVDKHTQYAWLLAQEKHARGERASLEFALLRGLGEFLMQYLLRGALLDGRRGLLMSAIQAQYAFHKYAALWSLRASGAAPRAEFMPDKRQRRETATPDAPP

SEQ ID NO: 3373 - protein, 262 aa, Uruburuella suis
MNTPTLQPGLTVALITKNEADNLEACLQSLAGLNAEIVIIDSGSTDATAEIAARHRARFYVHADWPGFGPQRNRAHQYIRTEWVLWLDADERLSDALKQSIQTALRTTPADARTVFAFNRLSNTFGAFIRHCGWYPDWVVRLYPTAFTRYSDDLVHEKVLLPAGTSVEKLAGDALHYTYANMSQFLAKQNLYSNIWAEQRAAEGKSAGLGDALLHGISSFVKMYVLKAGFLDGKHGLLLSVLSAQSAFNKYAALWLLGKKKP

SEQ ID NO: 3374 - protein, 365 aa, Unknown
  Description of Unknown: Beijerinckiaceae bacterium sequence
MSAPTVAAAIIARNELKFLPGCLESLQGLVDNVVIVDTGSSDGTQAVARSYGADLFEFEWIDDFAAARNRALSKVRADWILYIDADERLRTPGRRPIGDFLAPQTAGAYVRFQPRPGYTFYREPRLFVNHPEIRFRGRIHETHRGDLSAFAERRNLAIPPTPVVIEHLGFEGDQSHKHARNLPLLVRETAEHPERPYCWHHLAETLAGLGQRKDAIEACRRGLNISIEAPSAKEIIDRRQLGKTYARLLLDEGQVADDIIAELLEDTPEDWALLYLKARSDLAAGRHESVLSIAERLKAIDPDELTDGFIAYDRRLFTDFAWDLTGAACLLGGRRRDAAAAYREAACLAPDVVAYRAKAAALAMN

SEQ ID NO: 3375 - protein, 248 aa, Pleomorphomonas koreensis
MTAPRLSAILIVRDEARDLPDCLAALAFCDEIVVVDSGSRDGTPDIARAAGATVLETPDFPGFGPQKQRALDLASGDWVLSVDADERIPPELAAEIRATIAAPTADGYRIDRRSQFLGRVMRHGGWAPDRVLRLARRAAARFSTDIVHESLIVGGPVADLASPMDHLSYRGIDEVLDKQRRYALASAEVRRRRGKRGGLGPAIGHGLFTFLKHYLLQAGFLDGAHGFVAAAAKAQESFWRYLAVSWER

SEQ ID NO: 3376 - protein, 257 aa, Unknown
  Description of Unknown: Chloroflexi bacterium sequence
MALMAASLTVVIITLNEESNIVECIKSTLGADEVIVVDAGSRDRTAELATSHGARVVEHPMTDFAQQRNYANSIAKSDWIFHLDADERLTPALRDELKSALSSNTYSGYRVPRLNFIFGAPLHHGGWYPQYEMRLQRRGRGMWSRAVHETAALREGSVGTLREPYEHRGHPDVRTFLAKTDRYTSIEAEALAGRSMLTLGLLAVVVPPIYFAYKYVFQAGFRDGWRGFAAATLLSFYRALAYVKAMEVRSSRSSTKS

SEQ ID NO: 3377 - protein, 257 aa, Izhakiella capsodis
MTEPLHLSVVMIVKDEAELLPECLESVSWADEIILLDSGSQDTTREIAARHGALVFSTDVWYGYGKQRQLAQQRASGEMILMIDADERVTPELHLAIKQVLNAPLQQDVVWSIARRNLFLGRFMRHSGWYPDRVTRLYPRHYQYNSSQVHESLESGNARIQPLQGDLLHLTCRDFANFQWKQFAYAEAWAKQRFHQGQRCGFFSIFSHTLGAFVKTLIIRAGFLDGKQGWLLAMVNAHYTFNKYTTLWALSHAAKKG

SEQ ID NO: 3378 - protein, 301 aa, Rhodopirellula sp.
MSTLDLTIVIPAKNDADRLGICLDAIGHDLASSVVIVDSESSDNTAEVAEAYGAELIQFRWDGMFPKKRNWFLRNHTPATKWVLFLDSDEILTDEFKAELRRTLPQSDCDGYWLRYTIYFLREELKYGYPLRKLALFRVGAGEYERIDEDRWSKLDMEIHEHPVIEGPVGELRSKIDHRDFRDVSHYIAKHNEYSSWEAHRFLRSLEQQTDHGKLTLKQKVKYRLVQSPFAGVVYFFGAYVMMRGFLDGKRGLAFALLKLGYFTQVYCKIRELRGQQPNANPRAAEPVRTAPQAGQPLEVS

SEQ ID NO: 3379 - protein, 252 aa, Haemophilus ducreyi
MPTLTVAMIVKNEAQDLAECLKTVDGWVDEIVIVDSGSTDDTLKIATQFNAKVYVNSDWQGFGPQRQFAQQYVTSDYVLWLDADERVTPELKASILQAVQHNQKNTVYKVSRLSEIFGKEIRYSGWYPDYVVRLYPTYLAKYGDELVHEKVHYPADSRVEKLQGDLLHFTYKNIHHYLVKSASYAKAWAMQRAKAGKKASLLDGVTHAIACFLKMYLFKAGFLDGKQGFLLAVLSAHSTFVKYADLWDRTRS

SEQ ID NO: 3380 - protein, 274 aa, Mucilaginibacter lappiensis
MVPVSVVIITKNEAEMIGRSITMLRQLTDDIIVVDNDSTDHTVDISMENGCRVYQKSWDGYGANKNKGIALARYNWILSLDADEIPDAALLTSINQLKLDDCNTVYDIPFKAYYGNKPINFGNWGRDHHIRLFNRTQVKWSEPPVHETLVMPQNMRVQKLNGHLHHYSVKNVQEHEAKIVHYARLSALKYLQSGKKASLVKLYLAPLFHFVKAYVFLLGFLDGKEGWNIARMAFKNTWLKYYYLHKAKQNPILKKNFYEAPVMAYEFKANAHSE

SEQ ID NO: 3381 - protein, 262 aa, Erwinia billingiae
MSSRQALSVVLIAKNAADLLPECLESVSWADEIVLLDSGSSDGTPQVAARHGAKVFHSTEWHGYGRQRQLAQSYANHPMILMIDSDERVTQQLRASIEAVLTSPASADAVYSLGRRNLFLGRFMRHSGWYPDRVTRLYPSRYQYNDHQVHESLDTQGVAVTALKGDLLHLTCRDFSAFQWKQFAYAEAWAKQRYHQGKRCGIVSIFTHTIGAFFKTLVLRAGFLDGKQGWLLAVVNAQYTFNKYAALWALNNSSHASGKGGL

SEQ ID NO: 3382 - protein, 258 aa, Sulfuritalea hydrogenivorans
MTSADRMPISAVLITKNAAHQLADCLASVAFCDEIVVVDSGSDDGTAEIAGRHGARVIQSEWRGFGPQKQFAVDQASHDWVLCIDADERVSEGLQESIREVRGAVSSAPTFSAYRFARRNRFMGRYLRHGEGYPDWSLRLFDRRHARWSDDPVHEKVIAAGAIGTLQGDLLHESAESLETYLAKQNRYSTLAAEEALASGKRATVMHLLFSPLLRFVKFYFLRLGLLDGLPGLVHILVGCGASFFKYAKMLAFQRSGQ

SEQ ID NO: 3383 - protein, 385 aa, Unknown
  Description of Unknown: Oscillatoriales cyanobacterium sequence
MSIRAALGQKPFLSFCAIVKNESENLARCLASVQPYVDEIIVVDTGSQDGTPEIATQYGAKVGYFEWCDDFATARNYALSLVTGEWILVLDADEELVVTSVDFRETLKFHPEALAYSIIRTEVRHQAGMTPLHMIRLFRNLPEIRYVGRFHEQIQYQNRSFSDSEVRSLDSVRVLHHANSHQQVAAKVVNRNIPILELARQEEGLSLMLLYSLAGMYGSAGEDEKARDCWEEALERLFPHLIDGNPPEEFGFIPSLVFTLAGRSLQNRDYETTMLLCQRGLEWCPNYPPLNYIAGMTLINLGFPLGAVAYFENCLKLGKDNSYYTREPFEPSFTTTDPACCLGLAYINLKRWSDAVSAFELALTFDENCTAAQENLAKIRQSFNQ

SEQ ID NO: 3384 - protein, 261 aa, Erwinia mallotivora
MTTRHPLSVVLIARDAADLLPECLASVSWADEIILLDSGSSDGTPQIAARHGAKVYHSAEWQGYGKQRQLAQSYASHPVILMIDSDERVTPQLRSAIETVLEQPLSNTVYSLSRRNLFLGRFMRHSGWYPDRVVRLYPATFHYNDHQVHESLDARGATVTALRGDLLHLTCRDFSAFQWKQFAYAEAWAKQRYHQGKGCSIASVFAHTLGAFFKTLILRAGFLDGKQGWLLAVVNAQYTFNKYTALWALHNASHSSGKGHL

SEQ ID NO: 3385 - protein, 332 aa, Pseudohaliea rubra
MATLSLCMIVRDEAWILEECLAAARPQVDQLVVVDTGSVDGSREIAAAHADRLLDFSWCDDFAAARNHGLDAATGDWILVLDADERIAPADYPRLREAMADDTVDGYYLPQHNYGDDQTAWGWRPVGEHRALARGYSGYTINPILRLFRRKDGICYQGRIHEIVDGTIAEGRRSELPVPLHHYCHANSERPRRARGERYQAMLERELAGDADGRLYGIAAAGAMHSKGDYRRAKDYFLRAAALGYEPQRCLEGAAEACYRDGDFGAAGDLYQRLYRDGYRTASLCLNLANLAVRRGDRSGALGLLRECLALGGLGPAVNDVIERNIKHLEGA

SEQ ID NO: 3386 - protein, 251 aa, Chromohalobacter salexigens
MKPLTGIVITLNEQANIADCVRSLRRVCDEVIVVDSLSTDDTVAIAEAEGATVISQAYLGDGPQKAHGVPFAKHDWILALDADERLDDDAVALIESLALDDPRTAYSFRRKNYVARHWIRAAGFYPDPVVRLYNRTTSGYLPKKAHSSVQAPRVEATSAHLRHFTYEDMSHWIRRIDTLSSRDAWAMKERGKRPSRLSPILHATNAMLRKLVFKGGLFQGMDGMTVAMTTAFHAYMKYAKLNELYELERDA

SEQ ID NO: 3387 - protein, 256 aa, Enterobacter lignolyticus
MPLRLSVVMIAKNAADLLPDCLASVAWADEIIVLDSGSSDDTVALAQSLGAQVHVNTDWLGYGIQRQRAQSFATGDYVLMIDTDERVTPELAQSLQQALASPQPGAVYSIARRNYFLGRFMRHSGWYPDRVLRLYERARWQYNDSLVHESLACEGAPVVALSGDLKHLTCRDFADFQRKQLAYASAWAQERHQKGKKASLGGIFGHTLGAFIKTLLLRGGVLDGAQGWLLAVVNAQYTFNKYTELWALNRGYSKKA

SEQ ID NO: 3388 - protein, 258 aa, Nitrospira japonica
MPAVTALIITKNEEINIADCLASVRWTEERLVIDAESKDRTAELARAAGADVVVRPWPGFGPQKNFGMERAASDWILIVDADERVPGPLAEEIRSLLSRWTEGDPVAYEIPRMNFYYGAWIRHAGLYPDYQIRLVRKGTAAYNDVPVHENLIVRGTIGKLVQPFEHQTERRIDDHFRKFGLYTTLAAREKGRTVSTVRRRDLLARPLVVFLKTYLLKRGYRDGVRGLIVCLFASMYTFVKYAKLWDATRTPAASRGPA

SEQ ID NO: 3389 - protein, 257 aa, Halomonas zincidurans
MPITGIVITLNEAANIAACIRSLQRVCDEVIVVDSLSEDDTVAIAEAHGAHVIAQAYLGDGPQKAHGVPFARNDWILALDADERLADDAVALIEGLALDDPSQAYAFRRKNYVGNHWIRAAGFYPDSVTRLYNRTTAGYLPRKAHSSVEAPRVKLTQAHLDHFTYASLSHWIQRIDALSTRDAWAMKERGVTPSPLRPAVHALTATLRKLLFKGGLLQGADGMTVALTTAFHAYMKYAKLNELYENERTANAQEPPP

SEQ ID NO: 3390 - protein, 249 aa, Unknown
  Description of Unknown: Desulfobacteraceae bacterium CG2_30_51_40 sequence
MLSVAVITKNEAANIEDCLRSVSWASEAVVLDQFSNDGTADKAAALGAAVFQEDWKGFAGQKMSAIEKTHGDWILSLDADERVTPELQMEIEAVIREKDALNGYFIPRRNYFAGTWIRYGGWYPDYCLRLFRKGLGRFEERVVHEKLTVQGRPGYLKNPLEHYTYRSVGDFLLRMERYSRLAAAQISDKKRFFPFSGLLFRPPFTFLSMYVLRGGFLDGRKGFFLAVSYSYYTFLKYYRLLEKDLDAPD

SEQ ID NO: 3391 - protein, 310 aa, Unknown
  Description of Unknown: Rhodospirillaceae bacterium NAU-10 sequence
MNRLPLSIVVMTRNEAANIGACLDSLAGLGELVVVDSGSDDGTPALAAAGGAWVVPFQWNGRYPRKKQWCLDLPGLHHDWVLFVDADERVTPTLRRALERLFRAGPDCAAYFIDSRPLFLGRMLRFGTRYRKIALMHRRRCRFPDCEAGGGWEVEGHYQPAVRGRIGRLGGFLLHVELRGPHWLFDRHNRYSDWEAAGRGAAGSALALHAERPWRRLLKTLFQHLPLRPLLVFLHAYLLRLGLLDGQAGLDHALFRAFYYWQVELKRRWAGTGPTIQSSPRASSPARSPASLSPASALISSKARRRTGSS

SEQ ID NO: 3392 - protein, 258 aa, Erwinia toletana
MTARQRLSVVMIAKNEAGLLPDCLASVSWADEIILLDSGSSDDTAEIARQHHVQVYHSEGWPGYGLQREHAQSYASGDMILMIDADERVTPELRASIERVLEHPQPHTVYSIARRNLFLGRFMRHSGWYPDRVTRLYPRDYHYNDNQVHESLNTRDAHVVPLLGDLLHLTCRDFSAFQRKQFAYAEAWARQRHQQGKGCTVFSIFSHTISAFLKTLVLRAGFLDGKQGWILAVVNAQYTFNKYAALWALNQAAEKGSL

SEQ ID NO: 3393 - protein, 717 aa, Motilibacter rhizosphaerae
MRRSPASVVVVAAPGPEGRARADFLVRGLRPSLGVRDEVVLVADGTPAGDALAAVGGGSLAARRDTGVRLATRDVVVLVCADSVAPKHAIDPLVAALDSGAIAAGPVHDLGTGRQGLTPPLPALASAQELREWTARWHDEHRGGRLGVEDLGEGVLAARRAHLQAVGCREGVVQRLLAAEGAGALGPAVVVQDSVWHHRGAPGCALPPSPQPLLSIVMIVKDEEKALPSSLASLAGLGDEVVVYDTGSSDGTVEIARAMGARVVQGYWDDHFGDARNRGLAHARGRWFLQVDADEQFTGDAASLRAQLEVATDPTFMVDVESQTESGFGTTYCTPLRRIGLREDCWFLGRLHEQIALRAGGVPPSSVLRDGRLLHSGYLASTAADKDKRTRNLRLAELATADEAGDLPRGVVLCNLARSQRFAGDNEGVLATAAEAWEAEHTSVSRRDLCATAATAAAVLERYAEAELWCDRLEEQGVPLRAAETRAVVLLAQERWLECLEAVRRIPDSGWDRGDVREIKRSGSIVVELKALVSLGRYDEAVDRLLRVVRAGELNVCLPDVLELFHSAPARLREYATDLPEELLLPTLAEVRTVPVDRADTFLDALYTAGRRQAAVVAAAAPVAPHLPLPRAVEWSLRLRAAGDPGSCPLVRIARAPERSPRDRVLAAALVMESFADETVLPQFLEAAELVPDAQADAVGKELRLLAPLTAARLLAV

SEQ ID NO: 3394 - protein, 261 aa, Erwinia typographi
MSSRLALSVVLIAKDAADLLPECLESVSWADEIILLDSGSSDGTPQVAARHGAKVFHATEWHGYGKQRQLAQSYATHPMILMIDSDERVTPQLRSSIEAALEQPAPGAIYSLGRRNLFLGRFMRHSGWYPDRVTRLYPASFQYNDHQVHESLETQGAVVTPLKGDLLHLTCRDFSTFQWKQFAYAEAWAKQRYHQGKRCGVFAIFLHTIGAFFKTLVLRAGFLDGKQGWLLSVVNAQYTFNKYAALWALNHTSHASGKGGL

SEQ ID NO: 3395 - protein, 281 aa, Rhodopirellula islandica
MLDLTIVIPVKNEADSLGDCLDSIGTDFASQVVVVDSGSTDASCQIANDWGAEVVGFVWDGKFPKKRNWYLREHTPATKWVLFLDADEHLTPAFKSELSQTLPSTSHVGFWLHYTIYFLGRELKHGYPLDKLALFQVGAGEYERIEEDGWSHLDMEIHEHPILDGTLGTIRSKIDHRDFRPLHHYIAKHNEYSSWEAARFLVRSEEDRASMTWKQKLKYRMVTSPLAGPVYFVGAYLFLRGFLDGSRGFVFALLKMSYFTQVYCKIREARQAAGPDSHGDV

SEQ ID NO: 3396 - protein, 255 aa, Paludisphaera borealis
MPEPKITALIVARNEERKLPGCLDSVRFAHERIVVVDAASDDDTLAIARRSAEVVIVRPFDDFASQRNAGLAAATGDWILSIDADERVTPGLADEIRSALAEPANRHAGFRIPIRSEILGRPFGYSGTQQDLPMRLFRRGRGSWTGQVHETVDLDGSIGRMRHPLDHHTIPDVRVFLRKIDQYTTLEAHDLYRSGDRYRTRDLTLRPVWLFLKLYLYKQGFRDGLEGLMFCALSGVSAAVRTWKLRELDHLETAS

SEQ ID NO: 3397 - protein, 269 aa, Pseudoxanthomonas mexicana
MNVSSLHRPAISACIIAFNEADRIGACLASLDFCDDILVVDSYSGDDTAGIARSMGARVMQRPFDGFRSQKQYAVDQARHDWVLCLDADERIGDALRASILQARDAGFGAAAGYRFARLSDYFGRFLRHGNAYPDRVLRLFDRRRGGWRGKREVHEAASVDGPLETLAGDLIHYPYRSLDQQLAKTQRYARMMAEYDHAHGRRATLTGLILSPAWRFWRGYLLRGGFLDGWHGLVYAYVRANYVRQKTIMLWMLERGQPIATPPASGDG

SEQ ID NO: 3398 - protein, 309 aa, Unknown
  Description of Unknown: Alphaproteobacteria bacterium HGW-Alphaproteobacteria-16 sequence
MTTSLTVILLTHNEELHIGRALAAIAPIAQRVVVVDSGSTDATVAIAQSHGATVLHNPWINYAQQFAWALDHADITTDWVMRLDADEIIGPDLADEINAKLPALPADVAGVNLQRRHIFLDKWIKHGGRFPLTLIRIWRTGQGRIEDRWMDEHMVIWGGRTVTFNGAFSDHNLKDITFFTAKHNGYATREAIDVLIDKYGLGDKDDALSAKSASFQASLKRFVKERIYNRMPFYVSTTGYFLYRYIVQLGFLDGKAGLIYHFLQGYWYRFLVGAKVVEFEHAIAGATTKEERARILSEVSGHRITLPAP

SEQ ID NO: 3399 - protein, 301 aa, Natronolimnobius innermongolicus
MSYTYDHLVEHVKTAFSDRHSSGESASYDGPLESLPISVCLTTKNNVETIDACLESVHAWTDEIVVVDSNSQDGTVERCEAYGANVYQHEFESFAQIKTQAMEHAENDWVFILDADEKVPETLRDEILSTFGTPGIVAFLIEKQEYMMGARTNQYHYKRPYLARKDVLYFQNEYIWERLSVEEAYEDRTETLSSRIDHYRFDRASEIESKMMQYSALEALQAVEGDGGESFLSFLVRGIAVAGDRLVISRGLLDGYRGFYVAFLEFYQMIAAYVKVRDIYRLQRRYPDRWREIWIREECRR

SEQ ID NO: 3400 - protein, 244 aa, Pigmentiphaga sp.
MRLSVIVITRNEAHNIAACLESVRFADEVIVVDSGSTDGTVDIAGSFGARVTAAPDWPGFGPQKNRALALATGDWVLSLDADERVTPELAAAIAQVLRDPRHDAYDMPRLSSFCGRFIRHSGWWPDRVLRLFRRGTARFSDDQVHEKVLPDGSVGQLAPHLLHYTYPDLDTAIAKMNRYSADSAQTLHARGKRASIGTAIGHGLWTFIRIYLIKRGFLDGRHGFLLATTAAAGSFYRYAKLSLK

SEQ ID NO: 3401 - protein, 289 aa, Hyphomicrobium sp.
MDKLPISCFIIAKNEADRIGRTIRSVKPWVDEVVVIDSESTDDTVRVAASEGCRVVTQRWLGFGGQKRFGEDQCRNDWVLNLDADEVVTPALRREIMALFKYVAPSRVAYGMPIELVYPNTKRPRLWARDHWYVRLYDRRVVRFRDSNVHDTVVTDGQAVGILRAPAYHYMFRSYEHLKRKLGERMLLSAKHANSSTAALVARMAIEFPVNFFKYYIGRRHFTGGLNGLRYSWIQADYRLLKIFHMWRDRSSKGQSPEPDTAGGHENFKAKADADTKAGSSAAELPLYG

SEQ ID NO: 3402 - protein, 263 aa, Limnohabitans sp.
MNISASRQSLCIGILTLNEEKRIAQCIQSARFADQILVIDSGSQDQTQALARAAGAEVHNYPDWQGFGEQRNRMLGHCRCDVIFFLDADEEITPALEKEIQQAVQAGDDVIWEVMWDQVAYGRALSHMKTTGGVQRMFRSASIDRFEGVVHEGARMKAGKLPVRTFKARLLHHSRETIYGSIQKLAQYAQLGAAKRAQKGKTGGILRGFASGLASFIQLYIFRRGFLCGPEGFLYCLFVALEAFFRYAMLRYDREHLNKIVKR

SEQ ID NO: 3403 - protein, 256 aa, Geobacter sp.
MSVKKPSISAFVITKNEAAKIGACLDSLEWVDEIVVVDDFSTDATPDICRNKNVSFHQNAFTGFRDQKRFAMSRTAHDWVLEIDADERVSPAMRQSIEDLTVDDFDTVSCFEFRRITNFWGKWIRHASLYPDYKGRLYHKRRGEWSEANIHERFIPSGRTKRVAADIIHDQDLDICSYFKRTVRYGEMSALELFARGKRACWLHLTLRPLYTFFYRFVVRLGFLEGMPGFVISVMGSVGTFVKYAKLFELQIKIKT

SEQ ID NO: 3404 - protein, 253 aa, Burkholderia sp.
MTQPTLGIAIITYNAAARLAQCLAAVSFADDIVVIDGGSTDATAGIAEAHRARVIVEREWPGFGPQKNRALDALATDWVLSIDADEVVSPELAASIRAAIVDPRADVYAVDRLSSFCGEWIRHSGWYPDWIPRLFRRGTARFSDDLVHERLVLSTAAPLARLEGRLMHYSYEDFESVLRKLDAYSTAGALQRHAAGKRGSFSIAVARGLWAFLRTYFLRRGFLDGRSGFMIAMFNAQTVYYRFLKLAHLNAFR

SEQ ID NO: 3405 - protein, 347 aa, Paenibacillus mucilaginosus
MIVKNEAQDLARCLESAGPLVDEIVIADTGSTDNTREIALSYGAKVYDYAWTHNFSDARNFALRQSTGDWNLVLDADEYILNDCGGEIRDFIARHQGIGRIKRIDKFEQNGEVMESQVFISRLFPKGTFYTGIIHEQVVTDLPALKTSIEVYHDGYFRRSKSDRNLKLLRSAVKEHPLDAYFLFQLAKEYRMAGDYRAAAPYFAQCYEHLRREEAFYPLAVVDYLYNIIASRHLEEGLELIEREKTFLPDYPDFHFVCGHYYRELVFSNIEKYIAYFPQIEQSFLTCLALGETSRYDSVRGTGSFLPAYNLGVFYETTGDTAKARMYYETAARDGYKPAADRLAKLG

SEQ ID NO: 3406 - protein, 247 aa, Acidaminococcus sp.
MGSITCIILTKNEEKNLPSALQNAASWADEILVVDSGSDDGTVEIAKKSGASVIYRAWDGDFAAQRNFALTGAHGDWVLYLDADERLTAGAIQKVLAIKKGAPNHHYSFRRENIAFGHHFHHGAFGPDRVVRLFPKAAVHWEGKVHEHAVCTVPLEALSERMDHYTYAAFADWWRKAGQYTTIWADDAYARGKRASYGKAASHALLGMLKVYLLQGGFLEGSMGIIATLQHGIYTAIKYAKLAEKNN

SEQ ID NO: 3407 - protein, 256 aa, Enterobacter sp.
MSRRLSVVMIAKNAADLLPDCLASVAWADEIVVLDSGSEDDTVGIATRAGAKVFSSAEWPGYGIQRQRAQRYANGDYILMIDTDERVTPELAQTLRAVLDAPQPGAVYSIARRNYFLGRFMRHSGWYPDRVTRLYERERYQYNDNLVHESLEAPQAQVIALSGDLLHLTCRDFFSFQRKQLNYAAAWAQERHQRGKKTSLPGIFAHTLGAFCKTLLLRGGVFDGKQGWLLAMVNAQYTFNKYTGLWALNHGYSEKE

SEQ ID NO: 3408 - protein, 271 aa, Acidovorax sp.
MSAAAGDAKVSPTLTVAVLTHNEAHRIEACLRSAAFAHQVLVVDSGSTDNTVALAQGLGAEVHSYPDWQGFAVQRNRLLAHSRGDYVFFLDADEIMTPAFQQELQAIVRSGARGVWTIRWRMVAFGQELRYFLSQSRIERLFVRSMVREFTGVVHEQAQLHPEPGGVAVPRHLVRARLLHYTRNSVRTSLEKLTQYVMLGAAKRAEAGKRGGVLRGLASGGSMFLRLYVFRLGFLCGGAGFLYCLFVALEGFFRYAALHYDRDSLTGRVIR

SEQ ID NO: 3409 - protein, 208 aa, Vibrio maritimus
MFAKRCLVDEIIIVDSGSTDGTQQIAEKYGAKFFVNSEWPGFGKQKQLAQSYTDCDWVLALDADERIDDVLQQEIQTMLIAPPKNAVFSLNELTWVFGRFLKHSGWYYHHVRLYPNSLTQYNDNLVHESVIIPDGVDTKRLKGDILHYSYKDMEHYLVKSASYGRAWADQKQKRGKSASLAQAILHALGCFLKMYVLKRGFWMVSRAF

SEQ ID NO: 3410 - protein, 270 aa, Curvibacter gracilis
MPTPSNAVRADRPTLTIGVLTKNEAHRIENCLRSAAFADQVVVVDSGSTDDTVAIARRLGAEVHLYPDWQGFAVQRTRLLAHATGDYLFYLDADEVVTPALQAEIEAAVRSNERAVWQIEWSVVAYGRELKHFLSQSRLDRMFRRDMIERFDGVVHEHAVLRDGGQPLPRHAFKAKLLHYSRETVRGSLEKLTQYSMLGAAKRAAAGKRGGVLRGMASAFAIFLRLYVFRLGFMGGGPGFLFCFFIALECFFRYAALYYDRDSLSQSVGR

SEQ ID NO: 3411 - protein, 282 aa, Unknown
  Description of Unknown: Alphaproteobacteria bacterium sequence
MALTVIIPVLDEAPHIARCLASIGTLARRIIVIDAGSTDGTADIASSHGAEVLFHKWSSDARQINWAIDTAGITTEWTFLLHADEVVLPPLAARLADLAVLPDGPLGFTVRRRFHFLGRWLRRGGLYPERTLRLWRTGHGHCEDRLVGTRMIVHGRAGAIPADIAAIDLHNIGWWTDRQNDHATREALAQLHDGWPSGAVGGIPVGIRAPAVTLWRYLVRLGCLDGWEGLVYCVLQTGWFRFLVDIKKREVEALMAERQHTLNTVAADEYGIRLIPLGINGA

SEQ ID NO: 3412 - protein, 270 aa, Verminephrobacter aporrectodeae
MSVVADGAALPTLTVAVLAHNEAQRIEACLRSAAFADQLLVVDSGSQDGTVAMARGLGAEVHSYPDWQGFAVQRNRLLAHARGDYVFFLDADEVMTPAFAQELQAIVRSGEQAVWSIRWRMLAYGCELKYFRSQSQIERLFVRALLKEYTGVVHEQARLHPLPGGGAVPRRRIRERLLHHSRSTVRGSLEKLTQYAMLGAAKRAEMGQRGGVLRGLASGGAMFLRLYVFRLGFLCGGAGFLYCLFVALEGFLRYAALRYDRDHLTGRVIR

SEQ ID NO: 3413 - protein, 247 aa, Unknown
  Description of Unknown: Candidatus Amesbacteria bacterium GW2011_GWA2_47_11 sequence
MITDCLVSARFADEIIVVDNASTDATVSMAKSHAAKIVRTKGADYSQRKNDGLKAVSPAADWVLFLDADERIGPLLRQEILQVISRRSTHSAYAIPRQNIFLGQPLFFGGWGNDYVIRLFHKPHLRYWQHPLHEEPVYTGTLGKLVNPLVHFSHRDLASMVDKTILFTGHEARLRLESLHPPVVVWRFVRVMFTEFWHRFIKLSAWRDGTRGVIDGLFQVFNMFIIYARLWELQHNPRLQTSRLIVE

SEQ ID NO: 3414 - protein, 254 aa, Pseudoxanthomonas wuyuanensis
MPTPLPLSGVVISKNEADRIGRCLQSMRSVCSEMLVLDCGSDDDTVAIARQAGARVEHQDWLGFAGQKNEAISRATQPWLLLLDADEWLADGAEQQLRELFASGRVEQADVWRLRRSNWFLGRRLHGYERTERLVRPDHRYLPMRVHERPDLAGKRVLDCDAIIEHNTARSLQAHRAKNDRYAQLWAEQRHADGKRCSALSPWTHAAAYWLKQYLLRGAWRDGRQGWQFHASHARAVVRKYRHLHALGKAGAPV

SEQ ID NO: 3415 - protein, 253 aa, Tenacibaculum discolor
MNISGLVITFNEETNIKDCIISLNRVCDEVIIIDSFSSDKTVEIAESMGAKVYLQKFLGDGPQRVHGLQFCKNDWILNLDADERLDEDSFKFIKSGKYLNEPYDAYNFRRKNFLKDQPINFAGWYPSYTCRFFNKQTAKPATTKVHQSIQATNLKTTKLHLLHFGWKDFHQIIGKYNLYTTWQSEEYFEQNKKVNFFTPIGHGLWSFLRCYILKKGIFHGLDGITFSMMQAFFSYMKYAKLRKLYENNKKGKI

SEQ ID NO: 3416 - protein, 253 aa, Yersinia sp.
MSAKKRLSVVMITKNEADLLPECLDSISWADEVVVLDSGSEDDTLDLARQYGAQVYSNVQWQGFGKQRQRAQQYATGDYILMIDADERVTPELKASIDVVLASPDDDAVYSCGRRNLFLGRFMRHSGWYPDRVTRLYAHHRYQYNDNLVHESVDAGNAKVIPLKGDLLHLTCRDFFAFQRKQLSYAEAWATQRHQQGKSCSYFSILSHTLGAFCKTWLFRAGFLDGKQGLLLAVVNAQYTFNKYAALWALNQK

SEQ ID NO: 3417 - protein, 520 aa, Acinetobacter boissieri
MIVKNEAKNLEKSLPALHGWIDELIVLDSGSTDHSEVLVKQAGGQWYSHTTWPGFGKQRQIAQQYATGDWILALDADEEITIELRDNILKVIAEPSQNVVYGIKRIDCIFGHKIDNPYWPVKAHWRLYPKQFNYNDNLVHESVVLAEAETKKLQGFLLHHTADTPFFWLDKRLSYAKAWAEDRYPKGKKVSILSIFVRSFWAFFKQYIIDGRFLMGRYGLVYSAMFAQYTFNKYAILYDLIENKAEQAFKQSLIDTEQQTTLDAQMKQSTVSLVMIVKNEARHLAACLDTVKDLVDEIILLDSGSTDHTQDIAKSYGAKWYENQDWQGFGKQRQIAQSYATSDYILVLDADERLDSDLRHSILTVLQQPIKTDVVYALNRRDYFCGRVVRQGYFDAYDRLYANHVFQFSDAEVHESLDRNSAKREVLRGVLYHHTNDSLYHFLFKNIHYSHQWAQQNVVRKKSIWLGSAFLRAFVSFCREYIFRSACLGRGYGLIFAMATMGYTLNKYLILWYLKHEKIQ

SEQ ID NO: 3418 - protein, 672 aa, Halospina denitrificans
MAFSRLNPILSAVASLALIGAIGASLTVDSALSSLTFVLALAGLTVIAVARLRGRTALAPADREIKLIGFAMAFFAIASLATWALNGFSYEGFKGLGKHGRLLLFWPLFVVLARALVRESTAFIAILACAGLAGGTALAPLIENGAVARVDGATNAIPFGNLSLLSAMLLLVAAAYGYQTGRKALLGLALIGVALGLSAAYLSQTRNNLLVLPALLLFLVIAAPPRQRIVLVGLGGLILALFTGLESRIGEGLSALWSGRYDSGITYRFEIWQKALALFLEAPISGVGSQQYAQAVLNGVESGELSRGLKRCCLDHAHNDLVQILATRGLIGALSWLLLLAIPFAQFLKLIRHESPRVAHLATAGALVPVAYLMFGLTEAALERGIYVTFYLVTVTTLTYLTWKAVDESLHRHRRQKLSATIITYNEADNIGACLESLVPVADEIIVLDSGSTDDTVAIARRYTEHVTVTDWPGFGIQKQRALERATGDWVLSIDADERVTPYLAREINHTLAASPSAEAYKLPWAVTIYGKRLDFGRSGRAPLRLFQREGVRFSEAQVHEKILLPDGYRIKTLRGRLTHYTHRDYGHALEKSAQYAWLGAKQKAEKGQKTRTLLYPSLRALTTFIHVYILRLGFLDGPVGYLMAVTYAQSSFNTYAGLWTLQRKVLRDDDQ

SEQ ID NO: 3419 - protein, 252 aa, Unknown
  Description of Unknown: delta proteobacterium MLMS-1 sequence
MMPITGIVITLNESAMIAECLHSLRRICDEIIVVDSLSSDDTSEIAAREGAKVIKQTYLGDGPQKAHGVPFAKNDWIFSLDADERLEDDAVALIRELPLDNPRMAYAFRRRNFVGTHWIKAAGFYPDSVVRLYNRNSAGYLPRKHHSKVEAPKVRHTKTHLRHFTYEDLSHWIRRIDELSALDAWAMKSRGVKPSTLRPTTHAFAALLQKLVLKGGLFQGSDGMTVAVTTAFNSYMKYLKLNELYEQDSTQP

SEQ ID NO: 3420 - protein, 253 aa, Burkholderia sp.
MQNTTLGVALITRNAAVRLAECLQAVAFADQIVVIDGGSTDGTAEIARANGARVIEQTDWPGFGPQKNRAVEALTTDWILSIDADEIVTPELAASIRAAIAAPAANVYAVDRLSSFCGQWVHHSGWYPDWIPRLFKRGTARFSDDLVHERLVFDTPAQRLTGKLMHYSYEDYEGVLRKLDAYSTAGARQRYEAGKKGSIRLAIGRGLWAFLRTYVLRRGFLDGRAGLLIAVFNAETVYYRFLKISRLEKTGGR

SEQ ID NO: 3421 - protein, 258 aa, Nissabacter sp.
MSARKRLSVVLIAKNEAELLPECLRSVAWADEIVLLDAGSHDATADIARQAGAKVYQHETWEGFGKQRQRAQSYATGDYILMIDADERVSAPLRQAIEQVLHAPQENTVYSLGRRNLFLGRFMRHSGWYPDRVNRLYEARRYQYNDHLVHESLETQGARIVALPGDLLHLTCRDLYTFQQKQLGYARDWAQQRYSQGKRCGFFSILSHTAGAFCKTWLLRAGFLDGKQGFLLAVVNAQYTFNKYATLWALHHTQPTGE

SEQ ID NO: 3422 - protein, 252 aa, Paraburkholderia sp.
MTETTLGVAIITRNAAARLAECLAAVAFADAIVVLDGGSTDGTVEIARAHGARVVQQTDWPGFGPQKNRALDALDTDWILSLDADEVVSPELATSIRAAIASPVAQVYAVDRLSSFCGHWIHHSGWYPDWIPRLFKRGAARFSADLVHERLVFSTPAQRLSGKLMHYSYEDFETVVRKLDAYSSAGAQQRHAAGKRGSFGKAVGRATWAFLRTYVLRAGFLDGRAGFMIAVFNAETVYYRFLKLERLAAERR

SEQ ID NO: 3423 - protein, 280 aa, Unknown
  Description of Unknown: unclassified Streptomyces sequence
MKRLPIVVAIPTKNEAENIATTVRSVIDHFEAVVVVDSDSTDDTRALAADQGAEIVPYTWDGKYPKKKQWCLDHIHPELDWMLFIDGDETPSPELITELHRIFDPVAADGTRKVAPAAFDIPLGYWFAGKRLRHGYTIVKRALMDRTRVRFPELGDLDAPGMGEQEGHYQPLADGPVVRLNATIEHEDLDPVRTWFERHNRYSDWEAWLELHPEVREEIRQAKTRQGQLFHKAPLKPLVSFAYAYVYKRGFLDGRAGLDYALAMSFYRWQIGLKTREESA

SEQ ID NO: 3424 - protein, 671 aa, Haliea alexandrii
MISSARGQQLLAGLAVAGFAGSLLYSSLLSAAVFLLALAAALPALRRRLHASGWERPRELRLLHFACWFPVAVFLCFWLASGFDYRALKELDGPARLLLFWPLVLALCWSTLGARHLFAGFALMALGAAVHAAASMWLGGPPSPGEPLRAGLWLNPITLGNLSLFAAAVLLSAALYWQRLQQPRYTGLALALAAAALVAALLTQTRSNLLALPLLLAVLLPLMGSRQRVLAVLAGLVFLALTVAGNDRFLETVASLQAGDFDVQTASRLAIWQIAWGEFVGHPWLGGGLNAYHDAVQAAAVAGTLPQPDFVLDCCTSHAHNDLLQSLATRGLLGGLSWLLLLVIPATVFARHLRASEPAVAFVASVGVLLPVGYAAFGLTEAVFSRSLFITFYLLTLAACGAALVTELRRACQRQRSVRVSVIVITKNEEEHIGACLASVAGVADEIIVVDSGSDDATVAIAREHTSHVIETDWPGFGIQKQRALERASGDWVLSIDADERLTPGLVAEINHVLAAPAADAYCLPWAVTIYGTRLDFGRSGRAPLRLFRRAGVRFSDALVHEKILLPEGRRVRTLRGRLLHFTHRDFGHALQKGAQYAWLGAQEKHRQGKRVRSLLYPSARGVLTFVHVYLLRLGVLDGQVGFLSAVLYAQVSFNKYAGLWTRDRPRYGAD

SEQ ID NO: 3425 - protein, 253 aa, Polynucleobacter necessarius
MPTLSVILITRNEEANLGDCLASLEGIAQQIVVVDTNSSDRTLEIARSHGAVIAQPLDWPGFGPQKNRALDLASSEWVLSIDADERLTPALRSEILTAIHHSARVNCFAIPRLSWYCGRFIRHSGWSPDYVDRLFKRGTARFSDDLVHERLIPSGSVARLKNPMLHYSFMNYSQVLQKLDRYSTVSAEQAFAKGKTSSPLKAVFHGAWAFIRTYIIRTGFLDGGQGFALAISNAQGTYYRYIKLWHLNQEARK

SEQ ID NO: 3426 - protein, 288 aa, Bryocella elongata
MQTVGQDGEHSRPSITGVIVARNEADKVMHALASVRPILDELLFCDMESSDATAAIAASFGATVIPVALATGQEPVRPAAVAKASGEWVLMFDADEVIEPRLRETLLRIARQDEADVVSLPRFNYLFGKPMYGALMGANDDRQIRFFKKGAVEVTAALHVQPVVQPGARLKELTFQHDGAIIHFNYVDIDNYLTKFIRYTYMESRKPSAAAKYKLFPTILKMGWEFVNRYLRKGGYRDGWRGFYIAASMSFYRLTIWARVCEMEDVGTREQIQSIYSREAARSVRENH

SEQ ID NO: 3427 - protein, 258 aa, Pantoea sp.
MSQRQRLSVVMIAKNEAELLPEALASVSWADEIVVLDSGSHDATAEVARQHGAQVYQAEAWAGFGKQRQRAQARASGDMILMIDADERVTPPLRHAIEQVLAQPPAATVYSLNRSNLFLGRFMRHSGWYPDRVMRLYPRHLNYNDNLVHESLETQGAPVVRLEGDLQHLTCRDLVVFQRKQLNYAEAWAQERFQRGKRCGIFSIFSHTLGAFLKTLLLRAGFLDGKQGWILAVVNAQYTFNKYSALWALHHTSTQGRV

SEQ ID NO: 3428 - protein, 264 aa, Unknown
  Description of Unknown: Betaproteobacteria bacterium HGW- Betaproteobacteria-16 sequence
MNESPANRLCVGILTLNEERRIARCIESASFADQIVVIDSGSTDATRDIAASMGADVHLFPDWQGFAVQRNRMLPLVKCEYFFFLDADEVITDELKQEIQQAVASGDNAAWKVYWDQVAFGKALSRMAKTAGGVKRLFRTDNILEFKGVVHEYAQLKDESAPTRVFKGRLLHFSRDTVYESLLKLAQYSQLGARRREQAGKKGGVLRGLGSAISNFVRFYVFRRGFMCGPQGFLFCLLVALECFFRYAILEYDPPQGANAVVKR

SEQ ID NO: 3429 - protein, 522 aa, Moraxella sp.
MIVKNEAHNLALSLPSVAEFADEIIILDSGSTDNSRQIAESFGAKWFVNTDWQGFGKQRQIAQSYATGEWILALDADEVVTMALKNSILQTIKNPPANTVYGIKRLDFVFGHQIDNALWGVKAHWRLYPKHFGYDNNLVHESVVLTGANTAKLDGFLEHHTAPTPKFWLEKRLDYAKAWADDRHNQGKKGKFYKVVLNPLWAFIKQYVIDGRFLQGRYGLIYSLLFSQYTFNKYACLYDLSHNQAEQAFLQSVAMTKNLQPIDLSQKKSTLSLVMICKNESKHLKACLDTVHDIVDEIIVLDSGSTDNTRQIAESFGAKWFVNADWQGFGKQRQIAQSYATGDYVLVLDADERLEQPLRQAICDVLRSPLQTDKVFSVARVNTFCGVEVQPRFWYTDKLARLYANQAFCYNDLQVHESLDQKGVPSVVLKGFLPHITNDNLHHFLVKNIRYSHDWASEKHIKGKRIGVIGMVLRSCFSFIREYVLRADFSSGAYGYILAVASLGYTLDKYVMLWQMNQDKQP

SEQ ID NO: 3430 - protein, 286 aa, Unknown
  Description of Unknown: Planctomycetaceae bacterium TMED10 sequence
MTLSSTMSSHSALPRSSAGHPEEKQTLRATISAVLITKNEASQITPCLRSLTDWVDEIVVLDSGSTDATLDIARQHGAKVFVREDWEGFGIQRQRAQDLATCDYILAIDADERISRELRNNIEAVLKNPDDACLYQVVRQNAFLDKDVFHNGWRREKIVRLYAKNNFKFNSRAVHESVDSKGIQTRTLSGFLIHDACRNYEYYLEKHLAYAHSWARNQAQAGKTGSLFDAVLHGLTTFGRLFVLQGGFLDGRHGFLFAVHLSQYSFNKYAALWYYGRQFRRGKNLQ

SEQ ID NO: 3431 - protein, 379 aa, Delftia acidovorans
MPPGNRQVRVRAGLAVASLHLTPTFFSIHMPQTALVIIARDEERSIARCIDSAKDFVDEVLVLDTGSVDRTMEIARSCGAQVHRFEWCDDFAAARNRALDLADANWNLVLDADEWLVEGGAWLAGLPTMERQLGVADVQSLYEMGVTGSVSRSRITRLLPRGVRYQGVVHEQPLSDLPRVLVPLVIRHDGYLPEQMSRKQGRNQRLLQQQLGRNPRDAYVNYQLGVDCELNKEFSKACAYYGVAMDQLEVSSGYEHDLCVRYLYCLGQAGRHEEGLALAQAQMPKWQDSPDFFFALGGVLLDAAIAKLDGQVEHWLSMAQASWERCLEIGEVDAGPHGGVAGRGSYLAAHNLAVMHEQLGNLDEARALRLRHPMPASGS

SEQ ID NO: 3432 - protein, 261 aa, Rhodanobacter sp.
MRRERLSVVVITLNNAATLDACLSGVDWADEIVVLDSGSTDDTLAIARRHGARVAMHPFDEFGPQKQRAIDMASHDWILNLDADEVLSPASRAVIERALVNPRCAGFRLPRRERMFWTVQHPWSWRNAHLRLYDRRRGRMNEVEVHSAMEVDGPVKTLWRADFINDSDPDIASRIERINRYSSALVAHKLRRRQRFTGLRMVLYPPVFFLRQYLFKRYFLSGWAGFIASVVGANYVFLKYAKLHEARRQAKPGSRVGNDPE

SEQ ID NO: 3433 - protein, 400 aa, Sulfobacillus benefaciens
MSVISVALIVRNEEQFIEQCLQSVRDITDDIVVVDTGSEDATIKLAQKEGARVISRPWPGDFARARNWALEEAKNPWILMIDADEVFLADDKDKLIQAVTRPTADAYNLRIVSLTDRAEDLAEARVTRLFRNDPRIRWEGRVHEQIIPSINRAGMVLNPLDVRLMHYGYLNKVMVDRKKLERNLDLLDQSLAEAVQPEWKAYLYWQRAQTLVPLERYDKAIKDVRQAMDLSHPTAPLQPLFWMTLVKIHTAKRDLRKVHQTVREALKLFGDYTDLVYWEGLVFIDEGQWGKAEECFNKAISLGVPKDYLQSELGVGTFKALWQLARVSWLQGNLTLAEAYYLKTIQLKPAFYPAWKEYLAFVANTDAPIVYQRLTMVLAPKQILEVLSAIPNMTLLEDAI

SEQ ID NO: 3434 - protein, 259 aa, Pantoea stewartii
MTATRQRLSVVMIAKNEAALLPDCLASVSWADEIIVLDSGSTDDTLSLAQQAGAQVFQATEWQGYGKQRQRAQSFASGDMILMIDADERVTPELRQAIEQVLEAQPGPTVYSLSRSNLFLGRFMRHSGWYPDRVMRLYPRTLGYNDNQVHESLKTEGAPVKVLKGDLQHLTCRDLMVFQRKQLAYAEAWAQERFQRGKTCSLVSVFSHTAGAFVKTLLLRAGFLDGKQGWLLAVVNAQYTFNKYAALWALNKTSAEGRT

SEQ ID NO: 3435 - protein, 488 aa, Sulfobacillus benefaciens
MDCMAPAATPVTAETMQEITNMLRQEQYPRVQETVVSILEDNPAIAQLWVFLAEALEHLNKKEEAWACYERAWILDPAAAWAPGTKERLKAHVNGQIPKWLKSLLEVPKVSLSAAMIVKNEAQTIADAVKQLLKATDEVIVVDTGSEDDTMALAKDAGAKVYSYTWEDDFGQARNEALSHVSGDWVLFVDGDEVLDDEDVYVPRTVAGLFNQQDPPFIFRIVQVNHMGGTIEPNYDMSRLFPTRFGLRWWGRIHEQIGPPEGGVFAQVYNRPVVRIRLHHTGYEPEVMLQKKKLDRNIELLRKTVEEDPRDVASWGFLGREYYLVGKLEEAVRALYQAEGLAAGNPNYGRVPEVRSYLTEALLKLDRLEEALQVTKRLVKDMPQFPGGWYLKGRVELTIAVKMLEEAKVSFAQSRDQAPSYRGIVSYDSAIPGFRSVVGLADVAKLQGRLNDAVTLYKMALEANPEAKEVEAQLNYLKEQSRQILQRS

SEQ ID NO: 3436 - protein, 392 aa, Bacillus pseudofirmus
MTEEPLISLCMIVKDEEESIEGCLKSVSGIVDEIIVVDTGSSDNTVSIAKENGAKVYYKEWKNSFSEARNESLKHANGKWILCLDADEQLDKKAGQQLRELLKTTRYDVLTFPMLNYYGASVSSDQCVSLGKIKCFRNKLSLKYVTDIHEQLDLSEVDAEQEGEVDIPIHHYGYLDQYVKGKKKTERNLQLVKQQLEKEDNGWMRYYLAAEYYQQKKYIEALKELDTALFQYLKKGLKPPAYIYRLKYTILVERKQWKFVREGIEKVLMLYPDYVDLWFYKGMALYNEKEYDEAIYCFEECIRLGESNLSYYTVKGVGSFNSWFYKGLCYKKLNQQDQAIISFIHSWLLSPNNKILVNEIRKIVKYFHGWMELLESNLSKVESEKVKQFFQQ

SEQ ID NO: 3437 - protein, 259 aa, Mixta calida
MTERQRLSVVMIARNEAELLPDCLDSVSWADEIILLDSGSEDATLSIAQRYGAKVFQSHSWPGYGKQRQQAQAHASGDMILMIDADERVTPELRAAIEQVLNGTPQADKVYSLGRLNLFLGRFMRHSGWYPDRVVRLYPHTYRYNDNQVHESLETGTAQVIALPGHLQHLTCRDFSAFQRKQLAYAEAWAQQRHQQGKRCGVFSIFSHTLGAFCKTLLLRAGFLDGRQGWILAMVNAQYTFNKYAALWALGQSATGGKS

SEQ ID NO: 3438 - protein, 612 aa, Paenibacillus sp.
MTTISIILLAQHAELTDPCLSALQQHTPGQIELVVVNDGDRADTARAIDRYAERVTRVIATPSLTGLAAGYNIGAAAAAGERIVFLRDHVTVTPGWLEGLSRVMDLYPDAVAVGPVSHGVSGAQQLDLPIDGLLRLSADQRSMVLTRGGEAHIRTNRLLSFLLLVDRARFHELGGFDEQFVMESYEDDDYCLRVLQAGYGLYIARDVAVKYTMPPLLFPDDPSWYGRQLATNRELAAAKWGEDVSALLNRQTRPVSVSLCMIVKNEEATLEGCLSSVAGLVDEIVIVDTGSTDRTKAIAARFTNRIFDFEWVHDFSKARNYSFQQATGEYILWLDADDVFLAEDREKLRQLIGSLPYHADAVSMPYHLHRDQHGNVTSSIRRNRLVRKSMGYRWIGWVHEYLEVQGSILASDVAVTHNRVHQSTTRNLELYETRISQGDQLGPRDTYYYANELYDHGRWAQAAEQYEQLLKLPNVWVEDRIGACGKAAECYIQLQQLEDARLKALQSFSYALPRAENCCRLGQIFLSEQRYQEAIYWYETAAQLTMPTDSSALLLHAYWTWLPQLQLCVCYDRIGDYARSYAANERAAVYLPDDQRIIDNRAYLQQRLEAIR

SEQ ID NO: 3439 - protein, 297 aa, Bordetella genomosp.
MTRVPVSVIVMTKNEERNIEKCLRALSDFDEVFVVDSHSTDRTVEMATALGARVVQFEWNRRYPKKKQWCLDNLPFSHDVVLYVDADEVMSPALAREINDCLPRFAQGAGGAFVGFDYVFCGKLLRHGHRVYKLVLLPRARSRFLDYNDLDVANMWEVEGHYQPQVTGPVFLLKHRMAHHDHDGLFHYFDKHNKYSDWEASLRVKGLLNDPREANIGLRSAMKRIFAAMPFKAAAAFVHCYIVRLGFLDGKTGLDYAVARSMYYWQIGIKARELRAAMAAASPAADANADPVRGGTH

SEQ ID NO: 3440 - protein, 523 aa, Acinetobacter indicus
MIVKNEAKNLELSLPALKGWIDELIVLDSGSTDHSRQLVEDAGGQWFENLNWPGFGKQRQLAQSYATGEWILALDADEVVTEQLQQSILKAIQQPPLDTVFGIKRLDCIFGHQIDNAYWPVKAHWRLFPKDYQYDDNLVHESVVLNGAKTEKLQGFLLHQTAPTPKFWLEKRLDYAKAWAVDREQRGKTVGIWGVFFHTLWAFIKQYLIDGRFLMGQYGFIYSLLFTQYTFNKYAILYDLKNNHALATFNQSLENIKKLQPVDQSEKKSTVSLVMIAKNESKHLAACLATVHDLVDEIIILDSGSTDQTEEIAKRFGAKWYVNCEWKGFGIQRQIAQSYATQEYVLVLDPDERLDQALRESIVEVLKQPLQTDKVFSLARVNQFCGVEVQKRFWYADRLARLYANKSFQYSSLEVHESLDQKNVPAVKLNGYLEHLTNDDLHHFLVKNIRYSHDWASDKFKHGKKIGLFAAVLRGIFSFIREYIIRGDFLGGAYGYLLAMASMGYTLDKYLMLWQMNKESNKK

SEQ ID NO: 3441 - protein, 308 aa, Planctomyces sp.
MPVLDEARTQVQAQAPERSADAPRTGRAPVSVIVPVKNESANLRRCLPALDWADEVFVVDSQSNDDTCDVAVEHGASVVQFAFNGVFPKKKNWALENLPFRNEWVLIVDADEVVVPELAEEIRARIAADEAEGFYLNSKYYFLGRRIKHCGYSECWNLRLFKHKLGRYERMPDHTGGRSGDNEAHEHVELQGRVGRLRHELDHHAYPTIAAWVEKHNRYAVWEAAQYERFLSEPIPKSIGRGKRFKRMLKKIYLRLPMRPAVRFLYSYVLRLGFLDGKPGLVFCTLLSFYDFLSWANVYENRVTERDA

SEQ ID NO: 3442 - protein, 529 aa, Unknown
  Description of Unknown: Acidobacteria bacterium sequence
MTKLTAIVLTGDCQEQLPGCLESLGFADKILVVDSGSRDRTREIASAHGARVLQHPLERFDEQRNWAQQQADTDWVLFVDSDERVSPELAQEVVAALASGGEAVAYSMPRRNHFLGRWIRRCGWGNDRVTRLLRRAAVRWEGAVHEKPRIDGSQGSLQAPLIHHSYPTISVYWDKMQLYSRLAAAEDFRRGKRSGFLRLGVQPKLVFLRMYLLRGGWLEGRHGLVLCLLSAFSAFTRALRLWEHQLGASGRSLLPEGPAVEAPHQGGPQLSILVPTHNEAANIEAVLDSTGWADEVLVVDSFSDDGTVETARRRADRVLQHEYINSAAQKNWALPQTRFPWTMVVDADERVTPELAREVRQVLASGPAHQGYVIRRVNHFHGQRIRHCGWNRDRVLRLFNRERSRYQELEVHAEVDVDGSVSTLRHPLLHYTFRSVDQYWPKLRRYTDWGASQAYTDGQRTTLHHLVARPMGRFIKMYLLRLGMLDGTRGLVICWISFFSVFSKYAKLWEKHLDAGSLPGTVKTGSSRA

SEQ ID NO: 3443 - protein, 259 aa, Chitiniphilus shinanonensis
MTSPTLGVALITKNAARRLPECLTALAFADRIVVLDSGSDDDTVAIARAHGALVEVSPDWPGFGVQKNRALALLDTDWLLLIDADEVVTPELAASIRAVLANPAHAVYALNRLSSFCGHWMRHAGWFPDWIPRLFRRGAARFSDDLVHERLLFEGGAGRLDGLLLHYSYEDHADVLRKLDAYSTAGARQRFARGQRGGLGKAILRGGWAFVRTYFIKRGFLDGAAGFQVAMFNAETVYYRFLKLAAMEREGRGARNPKS

SEQ ID NO: 3444 - protein, 260 aa, Unknown
  Description of Unknown: Candidatus Hoaglandella endobia sequence
MSQRKRLSVVLLTRNEAELLPNCLASVSWADEIVVLDAGSHDQTRYIAAQAGARVFQSTDWPGFGIQRQRAQAYASGDYILMLDADERVTPPLRQAIEEVLQQSNNPKVVYSCARRNLFLGRFMRYSGWYPDRVVRLYAREHYLYNALPVHESLEIGEAAIVALPGDLQHLTCRDLPAFQRKQLQYAEVWAQAHHHQGRRCSIFAIIVHTYSTFVKMWLLRTGCLDGKQGWLLAIVKAQYTFNKYSALWALSHAAKENNL

SEQ ID NO: 3445 - protein, 291 aa, Unknown
  Description of Unknown: Acidobacteria bacterium 13_1_40CM_4_58_4 sequence
MHGEFVTGPQQRPRNLSTIPLTVVMPTLNEAARIHESIIALAWADEVIVVDGGSSDGTPERARTSGAKVLQVTGATIAGQRNAGIAAARNHWVLALDVDEHVPEALRAEIESVLAAPKHEAYRLSLRNFYMGGELRHGIWVDDWHVRLFSRERRFVEQRVHEELEPVRDVGTLHAQLEHTSYRDLAHHLEKITRYAKWGAQDLYDRGRRASFLDVTVVPAWRFFREYVLHSGWRDGQRGLVLASLSACAALLKFAHLYALEWQATRPQSIPMVQPQHSLPAIRAREGEPTE

SEQ ID NO: 3446 - protein, 262 aa, Unknown
  Description of Unknown: Burkholderiales bacterium sequence
MARISAYIIAFNEAEKIEAALRSVSWADEIVVADSFSTDQTVEISRRHGARVIQVPFEGFGRLRNSALEALAGDWVFSLDADERCTEAAAAEIRATVERVDAADAYWVPRRNYVFGRWMRHSGYTPDYRQPQLFRRGKMRYTEDSVHETFVLDGTLAYLQEPIAQIPFRDLSQMLYKMQRYSTLGTERLRARDVRASMAGALAHGTAAFLRHYVFKLGFLDGWAGFIIAFANFEGTFYRYAKHLEQTRGLVREPDLPRSFRN

SEQ ID NO: 3447 - protein, 352 aa, Rubrivivax sp.
MHRTALVMIVRNERRCIQRCLLSVKPWVDELVVMDTGSTDDTVALARACGATVHHMAWPDSFAAARNAALDCSTADWRIVLDADEYLQHGGEALAALRQHAPDFVGALDVVSVFHDGTGTPGRASSLISRVLPRGVRYEGVIHEQPVHRWPVRRLPVAVQHDGYLPEYQQGKGDRNQRLLQAALAARPHDPYLLYQAGKDHEVHDRFEPARQAYDAAYALTTASAPYRHDLVLRHLFTLKALGRTAEAIHLADSEMAHWPHSADFHFVLGDVLLDHALAHPASAPELLPMIEASWQQCLALGDTPALEGAVQGRGSYLAAHNLAAFHECLGHVEQAAHFQALARRLREAAQP

SEQ ID NO: 3448 - protein, 303 aa, Beijerinckia mobilis
MTELAVVILTHNEEMHIGRSLDSIAGIASEVFVIDSGSTDTTVAIAKAKGAHVLPHPFVNYAKQFQWALDNAPITAEWVMRLDADEIIEPDLAEEIRSKLPRLGPDVVGVNLKRKHVFMGRWIRHGGRYPLLLLRIWRRGAAHIEDRWMDEHMIVSGGTTVVFEGGFADCNINDLTFFTQKHNKYASREAVDVINQRLNLFPRPDDLSTQATSWQASAKRFVKEKLYNKIPFPLSTTGYFLLRYFVQLGFLDGIEGLIYHFLQGYWYRFLVGAKVLEFERAISHCKTKDEQRAELARISGLKL

SEQ ID NO: 3449 - protein, 307 aa, Unknown
  Description of Unknown: Proteobacteria bacterium sequence
MKAPPCSFGPKRTTMVFVNKSIEKIPCSVVLIARNEAGHIARAVASAAEFAETVVVDGGSTDNTVAIAEAAGARVVKRPWTNFSDQRNYSLAQAQHDWVLVLDADEAITPALTGWVREFFAAGRDKAAPWGYKIRRAEYFIGKRILGACWNPSFQDRFFLRAKASYVGEIHEYPLVEGGMVNAPEEMLIEHNPNITAESFFDKMNRYTTIEAFDRYRAGQRTSLPHLGVVFFATWWKNYFYYKGYRDGAHGFVICLMEAVSRTVRHIKLWQIQEMHRLGKAEHLPDPRRALEGSQSRAMESKAASRP

SEQ ID NO: 3450 - protein, 303 aa, Blastococcus sp.
MGVNSRAGSRTLKTSDFAPRSIPVSVIVLTKNESANIGHTLRQLSPFDDVIVVDSDSTDDTRQIASSQGARVVLFEWNGQYPKKKQWSLENTGATHDWVLLLDADEYPTADLVREIDALVRSGALATGPDAYDIQLSYRFAGRILRFGHRVSKRSLLNKHTVRFPEVGDLDAPGIREVEGHYQPQGCEEPGQAQAALIHDDRDPVSTWFERHNRYSDWEAHLRRNRAVRRQVAALRSDRGARFDSVPGKPVLFFLYSYFVKLGFLDGRAGLDYALALSMYYWQISVKVREKSQGGAETSARRS

SEQ ID NO: 3451 - protein, 267 aa, Advenella kashmirensis
MPAEPGHAPRRVTLAVALIVKNEAQYLAACLDSVAGWADEIVILDSGSTDATEEIARRYTQAFYTSADWPGFGPQRQRAQTHVTADWILWLDADERVTPQLRASIDAVLQDPPANTVYQVARLSWAFGQFIRHCGWYPGYVERLHPRALTRYNDALVHESLVLPPGAQLKTLQGDLLHFTYATVDEHLRKSAGYAIAWAEQREAAGKKGSLLTATLHAGARFIRTYFLRLGILDGKAGFLLSVMAAQSVFNKYACLWSRTRQTRRPD

SEQ ID NO: 3452 - protein, 259 aa, Thiomonas sp.
MPNRPSAGPTVSAVIITRDEAANLPACLESLAWCDEIVVLDSGSTDATPELARAAGARVHITPDWPGFGPQKNRALALAGCDWVLSIDADERVSPELAHEIREAVRAPGAPTAFAMPRLSSYCGQFMRHGDWYPDDVLRLFRRGSARFSDDLVHERLLVDGPRGRLHARLLHHSFRDMHQVLAKLDAYSSAGARAMHARGRRSGVLGALGHGAWTFLRGYVFKRGFLDGRLGLVLALSNAHGAYYRYIKLWLLQREPAC

SEQ ID NO: 3453 - protein, 404 aa, Unknown
  Description of Unknown: Candidatus Rokubacteria bacterium sequence
MISLAMIARNEKERLTACLASARPAVDEIVVVDTGSTDGTLELARAEGARVVPWAWRDDFAAARNESLRHASGDFVLVLDADERLAADAVLRVRALATAGRADGFDCRLVSRLPADQPSPVITHWYCRLFRKRDGVRFTGRIHEQVAPSIWRAGGRIAPSDVTILHEGYVEVSPAKLERNLRLLELEMADRPGDAFVNFNLGMTLLSAGHWARASAAFERALAAPEAALAPHLRAVAWMKLAEMRLRAADWRGAAQAADQALGLEADLAMARYALGRALFEHGAIAGAGRVFDDLATAPADALGMTLHPRVVAVARALVMLRQRRFQEAADVLKPVAADDPTGEAALHFGNACLALGRLSDAAAAYESARARGVNDPHLDRRLALATRLAEAGTTAAANNRQGA

SEQ ID NO: 3454 - protein, 273 aa, Geminisphaera colitermitum
MFSTVILTLNEERNLPACLASIAGCDDIVVLDSGSTDRTADIARAAGARVFVNPFHNFAQQRNHASDTIDFRHDWVFHLDADETFTPALLDEIRVRLATDDLQLIDGYYIAPRMIFRGRWIPHCTDYPAWQARLIHRKRFRFVQAGHGQREAPDMRMGRLRENYHHNLSSESEETIAQKLARYARSEAAHAAATCRPPRQLLRALLSRDALARRRALKELSYRLPARGAIRFIYQYLLRRGFLDGSPGLAYCRLLAGYERESARELRRLRKIS

SEQ ID NO: 3455 - protein, 248 aa, Prevotella sp.
MVINTYNASAHLKRVIGSVTGFDEILVCDMESTDDTVAIARGCGCRVVTFPKDGCDIVEPARQFAIDSASYDHVLVVDADELVPDELRNYLYGMLAGGSCPAGIAIPRRNYFMGRFMHSCYPDYVLRFFDRRVTVWPPVIHTSPRVDGTVVKIPAWRTGLALEHLANDSVSAIIRKTDVYSEHELPRRRHKNYGLFAVVYRPAFRFFKSYILKRGFLDGMPGLIHATLDAVYQFAIVAKLIEERRRKK

SEQ ID NO: 3456 - protein, 268 aa, Alcaligenes faecalis
MASSSTTEVEQRAVTGSGKRLSVILITKNEQAHIRACLESVAFADEIIVVDSGSTDQTVEIARSLGAKVTVTPDWPGFGPQKNRALDQATGEWVLSIDADERVTPELAQLIQQEMAQPRGMAYRIARLSEFAGRWMRHSGWWPDRVLRLFKRGTARFNDAKVHESVQTDHPVLILDGHFLHYPYASLEIFIDKINRYSSDAARQMQAKGKTTSLPGIAGHASWTFVRHYIVRRGFLDGPQGFILACMAASGSLFRYSKLWYYTRQKSD

SEQ ID NO: 3457 - protein, 270 aa, Delftia acidovorans
MPPGNRQVRVRAGLAVASLHLTPTFFSIHMPQTALVIIARDEERSIARCIDSAKDFVDEVLVLDTGSVDRTMEIARSCGAQVHRFEWCDDFAAARNRALDLADANWNLVLDADEWLVEGGAWLAGLPTMERQLGVADVQSLYEMGVTGSVSRSRITRLLPRGVRYQGVVHEQPLSDLPRVLVPLVIRHDGYLPEQMSRKQGRNQRLLQQQLGRNPRDAYVNYQLGVDCELNKEFSKACAYYGVAMDQLEVSSGYEHDLCVRYLYCLGQAG

SEQ ID NO: 3458 - protein, 267 aa, Paenibacillus stellifer
MTDCKPLSVVIITQNEEEKIEQAILSCRPFADEIVVVDGGSTDGTVAIAQRLGCDVYHNPWPGYAKQRIFGADRARNNWIFFIDSDEEVSAELQKSLQDWMTRPEDDIKAYNIYRIGDFMGKWMPKGENIVRLYKKDEVAMKDVLVHEGPDVDSSSVPVLEGVLWHHGYRSIQDHVQRFNKYTDLEARKDFDRRRPFSLMRLLFRPPAKLVYTLFFRKMITKGVAGFSVAFFWMYYEFLKEIKLYELHRTEKKQKPVYIVESEKHPV

SEQ ID NO: 3459 - protein, 321 aa, Unknown
  Description of Unknown: Nitrospirae bacterium CG18_big_fil_WC_8_21_14_2_50_70_55 sequence
MFCLGEPVELWQHFPGRPRGRRPHVVEQPPICCTPKHPGSRLQTADPTSPRPTPGDPQRAELQRVGAPLSVAVLALNEASRLASCLESLRFADEVLLVDGGSQDRTVAIAEEFGCRVVVQPWLGYSRQKQLAVDRCRNDWVLILDADERIPPATAAAIRTLDLGTAAPAAYRLRRRNYFHGRWIRRCGWWPDRVVRLVDRRRGRFCDRQVHEQWLARGPVAELDADLEHRSFRTYADLVQKMQLYSSLSALEMAHQDLRVHPWSAATHGLWSFLNTYLFQLGLLEGFDGFMIATANAGGSFLKYAKLYELNRYGDGREGED

SEQ ID NO: 3460 - protein, 361 aa, Massilicoli timonensis
MKTISLCMIVKDEEAVLSRALDSIKDVVDEMIIVDTGSKDQTKAIASRYTPHVYDFIWCSDFAKARNYAFSKGTMDYLMWLDADDVLKEADRQELLALKETLNDDVDMVMMPYVAAVHEDGSVAFSYERERLFRRDRHDQWQGAVHEVIVPAGKILHSRVHIWHQSIKKTKTRRNLDIYEAIRKTRSLDAREQFYYARELQECGESRAAVQAFITFLQRGDGWAENCIDACRHLAYLEPEEALNWLFHSFIYGKPHAEVLCEIGSCLFQMRRYQEAIYWYRQALHAKRVKGAFIVEDAYGFLPSLGLCVCYDQLHQQKRAYHWHLRSKHYHPEHPSVLHNEAYFQQILGSLHAKQGKTMIK

SEQ ID NO: 3461 - protein, 254 aa, Phaseolibacter flectens
MPRQKLSVVLITKNESELIGDCLKSVSWADEIIVLDAGSTDDTCEIAAANGANVHQSQQTWPGFGIQRQRAQQYASGEMILMIDADERVSPQLQSSIETILQQPQQPNTVYSLNRSNWFLGRFMRHSGWYPDRVIRLYPRHFHWHAHLVHESLNSENASIENLKGDLLHLTCRDLYRFQQKQLAYADAWARQRINHGKTCRLYSVYSHAVAAWLKTLLLRGGILDGKQGFILAMVNAQYTFNKYAMLWALSRSA

SEQ ID NO: 3462 - protein, 255 aa, Unknown
  Description of Unknown: Deltaproteobacteria bacterium sequence
MTKPVTATIITLNEEANIEAVVASAARFCDEVIVVDSASTDRTVELAEAAGARVFVQPYLGDGPQKNYGVKYAKNDWIFSIDADERLEDSAVKTLLELDLEHPDADAYAVRRKTFIGDRWIKLWYPDWVTRLYDRRLCAYEESIGHASVKGGRIKKLPCDLLHYSYADYSDIVKRVDKFAARGAKQLLARGGRISPLSPLLHGISRFFKQYILRGGIMQGLDGLNVSVISAFGAYMKYAMALEAKRNKAARERQR

SEQ ID NO: 3463 - protein, 266 aa, Caldilinea aerophila
MVRLAAVILTYNEAHHIEACIASLRGCADVVVVWDSGSTDGTPARARAAGALVVQRPFDNYAAQRQAALDAINAEWIFFVDADERVTPMLAAEIAQVIEEAERSSQAPVGYWVPRRNLIVGHEMRGGGFYPDHQLRLLRRGTAHYVPDRHVHEIVELSGQDAYLRHPLIHFNYFSWEQFHRKQRFYAAYEARILAMRGIRPRPHNFILQPLREFWRRFVTLSGWRDGWQGVRIAFWLAWYYGLMPYVILLRLRPEQTGYTTAGRMK

SEQ ID NO: 3464 - protein, 259 aa, Oceanisphaera profunda
MSTRPTLAAVLIVKNEAENLADCLATLDWVDEIVVLDSGSTDDTQAVAEAVGARFFVNSEWPGFGKQRQIAQSHVQSEWVLWIDADERVTPELKTSIEAALTKPKANTVYSIPRLSWVFGRFIRHCGWYPDRVLRLYPKALTGYNDALVHEKVHLNKGVKVKKLHGDLLHYTYRDLEHYLVKSAGYARAWAEQRQLRGKQASISQGIFHGLGCFIKMYVLKAGFLDGKQGFLLSVLSAHSTFVKYADLWINTHTHGPKE

SEQ ID NO: 3465 - protein, 312 aa, Bosea sp.
MAVAEHGLDRSGVTTSGIAPTPTPADRPEPRSGCTPGISALIMTFNEEVNLPACLASLAWCDDIVVLDSGSTDRTVEIARLAGARVVERPYDNECNQRNFGLTGIGYRHPWLYIPDADEVTPADLRDEMLAIARDPSRPESFFRARYRNMFMGRWIRRSSLYPTWIPRLVHVDRVRFERAVHMRCMGEGPEGRLEAHFVHYSFNKGLSAWYDKHNKYSQVEAREALRSLRDGRVPWADLFAATPEARRRALKELALRLPFRPTLRFIYMYVIRRGFLDGWPGFTYCRLLATYEHMIVLKTVELERREKGLSI

SEQ ID NO: 3466 - protein, 257 aa, Orrella dioscoreae
MDRASMPRVSVIIITKNESAHIQACLESVAFADEVVVLDSGSTDDTRDLALAWGARVEQSPDWPGFGPQKNRALDLATGDWVLSLDADERVPPELAEEILAVIASPQHDAYDVARLSELCGRPIRHSGWWPDYVLRLFRRGTARFTEAAVHEKVVPQGSVGKLRHHLLHFPYADLEALIAKNNRYSSDAAAQMHARGKRTTPLGMLGHGIWTFIRIYFLRRGFLDGRQGLVLALFAASGSIFRYAKLLLWDETRGKG

SEQ ID NO: 3467 - protein, 304 aa, Bradyrhizobium sp.
MNLAVVILTRNEERHISRALASVAGIAREVFVIDSLSTDHTVDIARAAGATVIQHEFINYARQFQWALDNAPITAEWIMRLDADEVIEADLAATIREELPKLAPDIAGVNLKRKHIFLGRWIRHGGRYPLVLLRIWRRGQGRIEDRWMDEHIILSGGRAVTFEGGFADCNLNDLTFFIDKHNKYATREAIDVINQRRQLFRRDVDLVTQEGSRRAAVTRWIKENIYNHISYRISAPGYFLFRVIFQLGFLDGKEGLVYHGLQGLWYRFLVGAKVEELELAISGIEDPQLIRAELRRLTGLAIDG

SEQ ID NO: 3468 - protein, 250 aa, Unknown
  Description of Unknown: Chromobacterium subtsugae sequence
MAISGLVITLNEAHNIVDCLRSMKAVCDDIVVVDSGSTDGTIALAEAEGATVIVQKPFLGDGPQRSLGLPHCRHDWVLNLDADERLEPDFVEYAQKTDLAALGVDLVETRRRNYIGDRFTPYAGQYPDYVKRLFNRQRADFTPVVAHTYVKAASAKRVPIHITHFSYRNYPDMIAKCKYAEWLSIGLAKSDKRIYPWQPALHGGWAFFRHYVIKLGFLAGLDGLTLSICKGVGSYLKYAHAIELRRSGKA

SEQ ID NO: 3469 - protein, 253 aa, Unknown
  Description of Unknown: Acidobacteria bacterium OLB17 sequence
MKISAVIITLNEEANIARAIASAAWADEILVVDSGSTDATRSIAAELGARVIEQPWLGFGPQKQFAAEAAANDLIFSLDADEEVTAELAGEIKQLVASGRILDGYRVPRLAIYAGRKIRHGGWYPDRQLRLFDRRKGHWSDDKIHESFKLAADATRGDLKNDLLHYTCTDIAEHARMIQERYAPLSAAAMNAKGKRASILAIAAAPAFAFFRDYILRAGFLDGPQGLIIAGFGAYNVFLKNVLLWQIQRAEKS

SEQ ID NO: 3470 - protein, 253 aa, Pasteurella skyensis
MPTISVAMIVKNEQQDLAQCLDTVKDWVDEIIILDSGSTDNTAQIASDYGAKFYTNTDWQGFGKQRQIAQKYVTSDYVFWIDADEQVTPELKQSIIQAVKDDKPNTVYKIGRLSEVFGREIRHSGWYPDYVVRLYKTDFAQYGDELVHEKVHYPENTTIIKLKGDLLHYTYKNINHYLVKSASYAKAWADQREQSGKKASLFQAITHSLGSFIKMYLLRGGFLDGKQGFALAILSSISVFSKYADLWARNINK

SEQ ID NO: 3471 - protein, 309 aa, Unknown
  Description of Unknown: Acidobacteria bacterium sequence
MSLVQGARGTEEVENGGCVHVGQVYGGTLPCDRPFRPAGRPCVPAIVAAVVPLTVAIITRNEAAHIEACLASVAWADDRLVVDSGSTDDTVARAERAGARVIVRDWPGYAAQKNFAAAEARHDWILSLDADERVTPALAHEIRDLFDQPVPPPAPGYRIPRMTWHLGRWIRTTDWYPDPQLRLYDRRRGRWVPRRVHESVAIDGEPGRLVHHLEHYAYRDIAHHLETMNRYTTLAAEDMFEAGRRASPADLVVHPAAAFARNYLLKRGFADGLPGFIVSIMNAHYVFLKMAKLWELGRRTTHGSADPSG

SEQ ID NO: 3472 - protein, 258 aa, Ruminobacter amylophilus
MASLSALVIARNESANIAECIKSMQDIADEIIVLDGGSTDDTVKIAEGLGARVVHHPEWEGYGKQRQKLQNYATCDWCLWLDADERLTDELRHEIREFIKKARQNEVLNISRANHVFGVRIHHCGYFPDRVYRVHYRTYTKYNDSLVHEKLDLPSDAVTVNSKNSMIHYTYATYQNLLFKQTKYADEWAKNRYQKKHKGCCFITPFVKAAFAFFRMYFLQLGFLDGRMGFLISACASSYTFNKYLCLYQIALEHSRKK

SEQ ID NO: 3473 - protein, 275 aa, Sinomonas atrocyanea
MTKIPATVLILTKNEEASVQRAVESAKPFDEVIVVDSGSTDKTQEVARRAGATVVEYLWDGAYPKKKEWSLSAAQNDWVVYLDADEFFPDDLVEEIAAVLVDPTASAFEVPLQYYWMGKRLAHGHQVRKRIGMRRSRCQWPRPNDLHVEHMWEVEGHYQPRVLSGRLLQLSKPLGHDDRDGLYDYFARHNRYSDWEAHMLVDRDAEAVENRSTLGRIAAKLPAKPLIFFIYSYIIRRGFLDGTSGFHYAAALSFYYWQIGVKMSEIRRRDASAVI

SEQ ID NO: 3474 - protein, 259 aa, Unknown
  Description of Unknown: Bacteroidetes bacterium HGW-Bacteroidetes-1 sequence
MEKLSVAIITLNEEKNIERCIASVEGLADEIVVIDSFSTDRTEAICSKFNVKFEPHFFEGYIQQKQYALSQCNYNYVLSLDADEALSERLKAVIMLEKETGFRNSAYTMNRLSNYCGQWIRHCGWYPDVKLRLFDKTEGAWGGQNPHDKFVLYNLQQKVVHLEGEIFHFSYYAIDEHYKQASKFAGIAANELSKKGKHSSILYAAMKTGVKFLRNYLLKAGFLDGRNGFIICKISALETWWKYTRLIQLNKIKKANEST

SEQ ID NO: 3475 - protein, 349 aa, Butyrivibrio proteoclasticus
MYSCAYEQFEIQRLDVPSRRCDVITIILCMIVKNEEACLGKCLDSLKGIVDEMIVVDTGSTDNTIQIAKDKGAQVYNFNWTGDFSEARNYAFSLAKCDYIYSADADEEIDEDNRERFIKLKEDIDELNVDIVQMYYCNQLAFRTVYNYDRELRPKLFKRIREFVWVDPIHEQVLLEPVVCDSDIEIIHNPRENHSGRDLETFRNAVREGRRISRRLLGMYARELFLAGSDEDFLNAKEFFTEATLDNNRSLDEIKEASCVLAHVAVLEKDADAMLKYSLKDAITEMSSEMCYELGNYYYNKKDLDEAIVWYYNAAYECSSILDIRKSRELPRLAIAKCYRELGNEEQGS

SEQ ID NO: 3476 - protein, 253 aa, Actinobacillus porcitonsillarum
MPTLSVAMIVKNEAQDLAACLDTVKGWVDEIVILDSGSTDDTEQIAEQYGAKFYVNTDWQGFGKQRQLAQQYVTSDYVLWLDADERVTPELKHSILQAVKNDEQNTVYKIGRLSEVFGRQIRHSGWYPDYVVRLYRTTFAKYGDELVHEKVHFPKDANVKKLTGDLLHFTYKDVHHYLVKSASYAQAWSIQKAKAGKKASLFDGVTHALGCFVKMYLLKAGFLDGKQGFLLAILSAHSTFVKYADLWNRTRNR

SEQ ID NO: 3477 - protein, 260 aa, Unknown
  Description of Unknown: Chloroflexi bacterium UTCFX4 sequence
MTLTGIVLTLNEAKHIHACLKSLDGTVDEMIVFDSGSADDTVARAQAAGARVIERPFDNYAAQRNAALGAANGEWIFFIDADERATPELGAEIRTRISHSEDAMPPQVLLWIPRQNYIFGKWIRHTGWSPDYQPRVLKKGQAHFDETRPVHELVVAAGAVGFLATPLIHYNYETLTQFRRKQRRYTRFEAEMMAAQGIRPRKISYLSMPAREFYRRFIVLQGFRDGGHGFLLSFLMAYYAFWRQVWAAELVRKADRATAQ

SEQ ID NO: 3478 - protein, 506 aa, Desulfotomaculum ferrireducens
MVGIKVSLCLIVKNEEEHILNCLNSTKHIVDEIIVVDTGSTDNTVRRAREAGARVFFYPWNGNFSDARNYALQQATGSWILVMDADEVLASIDRESFHALLANEQAEGYFLTIHSYQGSGREYMIDHVVRLFRNKPCYRFSGAIHEQVAPSILQESRGKGLQNCSLIIKHYGYLETEIKKKDKFRRNTSILLRELAKCPQDPFILYCLALEYYQRELVGQGLECLKKALQFMNGSEGYFEDVIVATANGLLNLGLSEELLGFTEKYLQILPENNNLHIFRGLGHMQAKKYAQAAEELFRSLGEEENKFLPRHKHLCLLGDAFLLSGNVEQAVKFYLSALTYETGLTYPVIRIVDLLRKNKLTCEKLCAYMSADTLNKAGKQLIAAQQPYYAMLLFIFEIKLLFREPRQDLMLSQSVLEFYQIIHYQPFLQVPSFHYLCLLVRELYLCSLIIEKDYHAFIKIDERVSQLTNGIARLIVRDYCPKMEITGDVLGGDNAEKKSIIRQPG

SEQ ID NO: 3479 - protein, 248 aa, Unknown
  Description of Unknown: Candidatus Curtissbacteria bacterium GW2011_GWA1_41_11 sequence
MNQPEITISAVILTRNEEARIEACLKSLSWVDEVVVIDNGSSDKTVALAKKTGAKVTLSVEKDFSRLRDIGKEKTTGDWILYVDADEIVPEALRSEIIERTKSKGCVAYCIRRKNYYLGNPWPYQDKMQRLFLRNALVGWHGAVHETATVNGPTETLHSPLEHHTHRTLEEMVAKTNEWSVVEARLRLDAHHPPVVWWRLVRVMITGFWESFVRNGGWRAGTVGFIESIYQGYSMFITYAKLWEMQVK

SEQ ID NO: 3480 - protein, 235 aa, Nautilia profundicola
MNKLSVVIITKNSAKFIEGAVKSALFADEVLILDSGSSDNTCETAKAMGARVEFQEWLGFGKQKQKAVDLAKNDWVFVLDSDERITAELQNEIKAILENPEFNAYYVPRINVFWGREIKRLGLYPDYSVRLFDKKKAKFNEKEVHESVECECEIGYLKSPMKHLAYESIEEFIDKQNRYSTLGAKPNKLKAFISPLWTFFKLYFIKLGFLEGWDGFVIARLYSQYTFWKYVKGKK

SEQ ID NO: 3481 - protein, 251 aa, Castellaniella defragrans
MTLSVIVITRNEAAHIGDCLDSVAFADEIIVLDSGSTDATREIARARGARVEVAPDWPGFGPQKNRALALATGDWVLSIDADERVTPELAGAIRQAIGAPAAEAYRIARLSNFCGRWIRHSGWWPDYVVRLFRREAGRFTDAAVHERVEVRGRTGTLSGHFLHYPYATLEVFIDKINRYSTEAARAAFERGRRTTALGPFGHGLWTFVRHYVLRRGFLDGWQGLVLAGMAATGSFYRYVKLYWLGRGSRRS

SEQ ID NO: 3482 - protein, 262 aa, Unknown
  Description of Unknown: Bacteroidetes bacterium HGW-Bacteroidetes-20 sequence
MAKITGIITTLNEEHNIIEAIKSLQLICNEIIVIDSNSSDQTVSLAQTMGAKTYLQTYLGDGIQKNVGIQYASNDWIFSMDADERITPELALLINNIDFENTSFHGFAIRRRNMIGSRWVKSCGWYPDYLVRLFNHKQIRFREVKQHASVPSKNTQKLKGDILHFRYHNLGELFAKPARNYSTRGAKILYLNGKKATAFTPFLHGFSSLFVNLFFKGAILEGIDGFTLALSIATNSYLKYAKLLEYQRDSKVREREDFNSVW

SEQ ID NO: 3483 - protein, 352 aa, Paenibacillus sp.
MLVSVCMIVRNEEANLERALSSIPASYEKVVVDTGSTDATMEIALRLGAKVACFTWIDDFAAARNYSFSQATGQYILVMDADEALDKNIEKQIERFISNDSDCAAAVTLITVINDETHKHRMVRFFPNKHTYQFNGIVHEMLYDNGQPAPFQASEITIYHYGYQEEQYADGSKVQRYVELYNKHLSENPQDGYMFYQLGKLYHSNKELDKALDAFEQCLALNERDQLYYPVMLVMLGYTLKTIGQSALAEELLSAVQAEYPQFPDLPFLLGLLAMDTGNIADIESHFLKALAIGETSKYTSVDGVGSYKASYNLAVYYEITGNKSKAMQYYQTSAIANYAPARERLNQLAVR

SEQ ID NO: 3484 - protein, 315 aa, Unknown
  Description of Unknown: Candidatus Levybacteria bacterium GW2011_GWA1_39_11 sequence
MNKLSVVISAYNEEKNIKDCLDSIKNLADEIVVVDNLSADKTAEIARNYTKKVFEQKNDPKNIDLQKNLGFSRASGDWILSLDADERATPELTREIKSVLSQKPTAKSQQSINGYWLPRKNIIFGKWIKSEMWWPDYQLKLFQKGKGGFDKNQVHRALRVQGETEKLENFLIHNNYVSISQYIEKLNNYTNIEAESLAASGYRVNWLDALRFPVDDFLKTFFLQKGYKEGLHGLILSLLQAFYMEIVFAKLWEREGFKEIEDADFQKKLMKEAKAIRNKFKYWFLSSTIKVTKNPFKKILLRVTRKITSQKLKNS

SEQ ID NO: 3485 - protein, 292 aa, Sporocytophaga myxococcoides
MNKITFIILTYNEEKNIGDLLDNLKGIPGEILVVDSYSKDKTIDIVKERSVCYLQHPFENYSVQRNWAQENNPFKTDWVFHLDADERLTTELRSWLINDFKPSPGIDGYMFGRRAIFMGKWIKSHYNYHLRLFKPEKGGCEAKAYDQHFIVNGKTQVIKKKDMTSEVADNLNNFIASHNKWSFLEAIDVIKNEEGGEVKASFWGSPIERKRWMKNNLFHKTPLFLRSFIYFFYRYFIQMGFLDGKEGLAFHVLQAFWFRFLIDAKVLEIKLKMKENNQDLDTTLETNFGFNK

SEQ ID NO: 3486 - protein, 293 aa, Unknown
  Description of Unknown: Candidatus Shapirobacteria bacterium CG_4_8_14_3_um_filter_39 _11 sequence
MKVSVVVNTYNEEKNLARCLESVHQLADEIVVVDMHSDDKTVDIAKKYGAKVFYYDYTRFVEPARNFALSKASGDWTFLIDADEELPETLVKKLKEIAKENTADFVEIPRQNIIFGKWIQHSRWWPDFLVRFFRKGRVKFSDKIHVPPTTEGNRLTLEAKQEYAIIHHNFQTISQFIERLNRYSDIQADEIIKKGEKFRGMDLITEPSSEFFSRFFAGSGYKDGVHGLVLAFLQAFSELAVVLKVWEKLGFEQIPIKNLGKSAQRAVSDFYYWQSKTSSGILEKIYFRIKRKI

SEQ ID NO: 3487 - protein, 237 aa, Unknown
  Description of Unknown: Candidatus Curtissbacteria bacterium GW2011_GWC1_44_33 sequence
MKLSVTIIALNEEKNLARAIDSVHSLADEVVVVVDPRSRDKTLEVARSLGAKTFVRVFDNFANQKNFASQMAKGKWILAMDADEEIPTPLKDEIKKAIAKDSFDGYLIPRRNFLLGKEIKHTRWSPDKHIWLWKKDKGKWAGKIHEEIILEAKLGELKEAKIHHSYETVADFILMLNSYSQYEAEEKIAKGQRFSFFRFFFDPCLSFFRRFILPGLKFGRNKDDLGSIGTSTSLEDY

SEQ ID NO: 3488 - protein, 251 aa, Unknown
  Description of Unknown: Cetobacterium somerae ATCC BAA-474 sequence
MLSVGLITFNEELRLERTLKAVQGLADEIVVIDSFSTDNTVEIAQSFGAKVEQISWPGYGMQKNNVIERCTKDWILLIDADEVITPELAKEIKEVMKHGDYYVYEIPFNSVCFGKRIRFGGWSGSSRVRLFKKTSGHYSLDAVHEQFLTGDDIGKLHHRIDHYTYEDYYDYLHKFNRYTSEGALVAFNKNKSAGLFNIVLNPIFKFLRMYIFRFGFLDGIEGLALSTFSALYTSVKYLKLREMKRKNDTNC

SEQ ID NO: 3489 - protein, 249 aa, Polaribacter sp.
MTKITAIIPTLNEEIHIADAIASVSFADEIIVIDSFSTDKTIEIAEKLNVKIIKRKFDDFSSQKNFAIDQAKHTWIYILDADERVTPEVEVEIIEAVKNPKDFVGFYVRRTFYFCDRKVNYSGFQRDKVIRLFLKEKCKYNGLVHEKISANGKLGFFKHKIDHFSYRSYDHYISKMNHYAAIRAKELHEKKRKVNIYHVMIKPAARFFIHYVIRLGFLDGFTGFLVANTQAYGVLTRYIKLWFLNNKKH

SEQ ID NO: 3490 - protein, 251 aa, Confluentibacter lentus
MKKLTAIIPVGNEIHNIEAVIASVNFADEILVVDSFSSDGTFELAEKLATKVIRRPFDYPSSQKNWAIPQATHEWILLLDADERVTPELKVEVLGILKNPDPNIVAYWIGRMNHFMGERVHYSGWRNDKVIRLFRRDVCKYEDKHVHEEIIADGPVGKLKNKLYHNTYISLDKYIDKMNTYASWQAKDYDKKTGILTPYHFLIKPFWGFFKHYIVQSGFRDGVVGLTIGYIQGYVVFMRYVKLWLLRKERD

SEQ ID NO: 3491 - protein, 249 aa, Polaribacter gangjinensis
MTKITAIIPTLNEEIHIAEAIKSVSFADEIIVIDSFSTDKTLEIAATYDVKIIKREFDDFSSQKNYAISQASNPWIYILDADERVTPQVEKEILEAVQNPQDFVGFYVRRSFYFAGKNINYGGCQRDKVVRLFLKEHCKYKGFVHETIVANGKLGFFKHKIEHYSYRNFDHYISKMNHYGELRGKEYFEKGKKVNLYQILIKPPARFVIHYFIRLGFLDGFPGFAFAKAQAYGVYVRYIKLWLLNRGVK

SEQ ID NO: 3492 - protein, 306 aa, Unknown
  Description of Unknown: Candidatus Woesebacteria bacterium GW2011_GWA1_37_7 sequence
MKKHNLRPLSHKTLSVVLATRNEEQNIGECLESIKYIADEIIIFDEESSDKTPEIAKKYGAKVFTVKHEPIFHITKQKALSAASGNWILQLDADERVTPKLGEEIKEVVKFENNQIVRDQFERKCNEKNELYELFLRHQKLIEKREGHIGTESGEIVAFFIPRRNFFLGKQLVHAGVYPDGVIRLVKFGKAKFPAKSVHELMEVDGEVAWLFNDLEHHESPTFSRYLERLNRYTDLQAKEFKIKFKSKRSIIHLLYFSFIKPFYLFLLLYLRHKGYLDGMRGFIWSVFSALRYPIAYFKYWQSVKS

SEQ ID NO: 3493 - protein, 256 aa, Unknown
  Description of Unknown: Acidobacteria bacterium sequence
MSKLSVTVITKNEAARISDALASVQWADEIIVVDSESEDRTVEIARTHTARVVVRRWEGYVSQKNFAASLATHDWILSVDADERVTPELASEIRTILSGPSHQGYRIPRATWHLGRWIRTTDWYPDYQLRLYDRRSAAWAGRYVHEGVVVRGSVGRLAGELQHFPYRDISDHLQTIDRYTTFAAREMHEKGTGAGLARLALHPPLAFLRNYLARGGFRDGVPGFIISALNAYYVFLKFAKLRELQQRDPTDVLPAR

SEQ ID NO: 3494 - protein, 251 aa, Gelidibacter mesophilus
MQKLTAIIPAGNEIQNIEAVIGSVGFADEILVADSFSMDGTYEKAQQLATKVVQREFQYPASQKNWIIPQAKHEWILLVDADERVTPELRTEILEVLKNPDAKYVAYWIGRTNMFMGERVNYSGWRNDKVIRLFKRDFCKYEDKHVHEEIIANGHIGALQNKLLHHGYTSLDKYVEKMNRYATWQAKDYDHKTGKLTPYHFMLKPFWGFFKHFIVQSGFRDGVVGLTIGYMQGYVVFMRYVKLWLLRKNRE

SEQ ID NO: 3495 - protein, 294 aa, Unknown
  Description of Unknown: Candidatus Woesebacteria bacterium CG_4_10_14_0_2_um_filter_39 _14 sequence
MAKISVIINTWNEEENIKRCLESVRRIANEIIVVDMYSKDRTTAIAKKLGAKVFFYKYMSYADPAKNFAFRQAQGDWILSLDADEEIPPLLAKMLQDLAQDSKDLAYFRIPRKNIIFGKWIKHSRWWPDYVIRFFKKGAVRWSEKIHSVPLTRGEGRDLEAKEVNAIVHHHYQSISQYLERMNRYTGIQAEELIKTGYKFRWQDMLRKPMGEFLSRFFVGEAYKDGLHGLVLALLQAFSEMIKYIKVWEKEKFIEQDISSYHEVLEENINDYLHWQVKVSGLIGKIRLKIKKKI

SEQ ID NO: 3496 - protein, 440 aa, Clostridium sp.
MLHSVRLSQCMIVKNEEKNIRKALEWGKGTVFEQIVVDTGSDDRTVEIAKEMGAKVFHFPWIDDFSAAKNFAISKAKGSWIVFLDADEYYSAESTTKLIPILEQIENGIYEAKRPHAVRSSLLNLDDKGQVFSTGIQDRIFCNMPTLRYQNRIHESLYISDGSEMLVVDASRELIIYHTGYTKQIYQETGKLERNVRMLRSEVAEHSDDYNAWSYLGDSLFAMESYDEAEEAYLHVIANGDRVLSEGRKEAVFCNYFKLKYLNDSGIEEELCDIYEKAKAIGCTSPDLECWFGYWYYKKEDKKKAVLYFERALQLLDQYHGTSFLDISGALIEIYQILFYIYREFGQVSEMIRYGVLALRMDLYLMPILKDIICLLKTEKGEILTGESTFNFLLKLYNPTSLKNKLFLLKAAELADFSALERRIYGLFSVEEKSILDNSQ

SEQ ID NO: 3497 - protein, 281 aa, Unknown
  Description of Unknown: candidate division KSB1 bacterium sequence
MSAVSVETPQKLDRQAAVQNESTARLSAIVITKNEGENIHECLASLHWVQEIVVVDAESQDNTVALAREFTDKVFVRPWEGYAAAKRFALAQCTGDWVLWIDADERVTPELRQEICDLLSNAPACAGYELARLANFLGRWIMHGGWYPGYVLRLFRRENANFNNLKVHEGVELKGKIGRLQNHLLHYTDRDIRRYFEKFNRYTSLAAEELHRKGKRWQWWDLLFRPFWMFLRMYVFKTGFLDGMPGFILACFSAAYVFTKYAKLWEIEKTQKNSHSPSLAE

SEQ ID NO: 3498 - protein, 302 aa, Unknown
  Description of Unknown: Parcubacteria group bacterium GW2011_GWA1_36_12 sequence
MTPKISTVVSAYNEEEKIEECLKSVENLADEIIFVDNTSHDKTIEIAKRHKAKVFIRPNDPVMLNKNKNYGFSKAAGDWILSLDADERITPVLAKEIKAAVKQKNIKGFEIPRKNIIFNKWIQHSIWWPDYNLRLFQKNSGRFPEKHVHEKIEVSGKVAKLENPMTHYNYQTISQFLRKLDTIYTESETENFIKKGDQIHWYDAIRWPASDFLKTFFLERGYKDGLHGLVLSLFQAFYSLVFFAKVWEKKEKFKDLTPDNFLREVSKEFAKVIKDSKYWFNTVMIDELPAKKLYYKIRRKIS

SEQ ID NO: 3499 - protein, 325 aa, Unknown
  Description of Unknown: Acidobacteria bacterium sequence
MHQLEELAPLEKTTAAVTLPVSVLIPTRNEARNLPRCLEALRGVGEIYVIDSQSADETVEMARLHGAQVVQFHYQGGWPKKRQWAMDTLPLAYDWILLLDADEILTSELAGEIRRVMQVSDCNGYYISLRMHFLGRILRHSGASFWKLSLFRRGKGRYECRLHDQDMSMGDMEVHEHVVVQGRTGRLKNPLIHCNVESLARYIDKHNEYSNWEARVWTRQEEDREELRPSLFGTQAQRRRWLKQKLFRVPGAPALFFFYKYVVRFGFLDGVPGLIYCAFQGIQFFQVKAKIYEQEWARDIAKAHNPTALQDGANEGRNTKCSSSV

SEQ ID NO: 3500 - protein, 262 aa, Galbibacter marinus
MQKSTKLSTSTKLSVVIITYNEIEYIEECIDSVIFAHEIIVVDSYSNDGTWEYLQSRPEVKAQQHAFENFTKQKSYALSQATNDWIYFFDADERVTPELQKEIIQTINDPNSFDAYWNYRSFMFKNQRLYFSGWQTDKVYRLFRKSRCEFVNDRIVHETLQVNGSEGKLKEKLLHYSYKNYQDYKGKMIRYGQLKAKQAHLKGKKWSIFKQYLRPAWKFFNHYLLRMGILDGKKGVIISYLNALGVYERFREQRALELKAKS

SEQ ID NO: 3501 - protein, 256 aa, Unknown
  Description of Unknown: Acidobacteria bacterium sequence
MKISVCLITLNEETNLPRTLQSVMPIVRDGNGEIFVVDSGSTDRTVEIAESFGAQVFIEPWKGFAAQKNSAMEKGPGDWILQLDADEALEPELIQEILNAIEAAGGTVGFYIPRKNFFLGRWIKHGGFYPDPKLRLIRRGAGKFEEYGSHPTIKVKGPTGQLKHALIHNAYPTLRGYIDHMNGYSSSGAEVAVAKGHRSFNLLNIVVRAKLTFIYNYFFRLGFLDGREGFLLHAYHSVYVSWKYAKAWELARTNRK

SEQ ID NO: 3502 - protein, 249 aa, Unknown
  Description of Unknown: Candidatus Shapirobacteria bacterium CG03_land_8_20_14_0_80_39 _12 sequence
MISAVVLAKNEEKNLEDCLSGLKWCDEIVVIDDDSTDKTKEISQKAGAKVIPHSLKNDFAEQRNFALKEASHDWIFFVDADERVSDKLALEIQKKIKKTTSTGFYCWRIDNFLGRWLKHGEIGSTRILRLARRGSGWWKRNVDEQWAVSGKTETLKNPLLHYSHRNLTEFLESINERSTLNAEAFYREGRWITVFEWFKPKGKFILNYFLRLGFLDGLPGFVFAVLMSLHSFLVRGKLYLLWRRRGGWQ

SEQ ID NO: 3503 - protein, 332 aa, Lachancea meyersii
MWESYCSKIREADLAVLSLTFLVVIFSSLYLIVFLLSHSPRKPFEEELLYKTNGLDEEVISGSLVSVKESEKEVDGIELSVVVPSYNEIGRILVMLKDAIEYLQEKMANKWEILIVDDGSKDGTSEYCLDLAHTTFKLQPGQLRVIELTKNRGKGGAVRHGMLHIRGRFGLFADADGASKFADCEKLLSAIKKYDDSGKRAIAIGSRAHMVNTDAVVKRSFIRNFLMYGLHTLVFIFGIRSIKDTQCGFKLFNRSAIGQVFPYLRTEGWIFDVEILILALRKQIEIQEVAISWHEIDGSKMELARDSINMAKDLVIIRLAYIMGIYSDKNEC

SEQ ID NO: 3504 - protein, 269 aa, Maribacter sp.
MGLQSTKITALVITYNEIGYIENCLKSIEFADEIIVVDSYSTDGTYEYLSAHPKVKAIQHPFKNYTAQKAFTLEQASNDWILFVDADEVVTPELRKEITQTVNNSSKTHAAYWFRRKFMFQQRRLRFSGWQTDKNYRLFRKSKVEFSAKRIVHETLEVNGTSATLNEKLTHYCYRDYADYKRKMLLYGRLKAKEAIQKGKSFTIGMLLGKPTFTFVYNYIFRLGILDGMKGIKVCYLNALGDWERYLELRKLEQEQKAPSLKPVQQRGN

SEQ ID NO: 3505 - protein, 618 aa, Paenibacillus elgii
MIVKDEEELLSRSLTSVAGIASEIIVVDTGSTDRSAAIARDFGASVYAHEWEDDFSKARNQALDAASGDWILVLDADEELAPECLPLLSKSLCRSDAFAYALHFVNYYGQLTEYLSFTDSCCRLFRNLPDLRYSGKIHEDIVPSLLKRHLTPIPSRITIRHYGYLENRVRQKRKPQRNAALLAKAIAETPWDSRLQYALGTEYLHAEQYSEAMGVFLPLLKSLEPSCGFYPDLLLKTALLLRVQKSNDEALRLVKEGLRLFPDFTDLWDLLGDLCVERAEYGSARKAYECSLLQTPRSGLYASQTGSGSFATAHRLGQLQEKLLNRAEALRSYRQALDSFPRYEPAWRRWLELTAAEGRWAELLYCLRSWQAKLTPQQWTEAVRCLLRYNELPLAQRIREWVPKSVLASLNPLSLRLSQWLIRCKQGDKAVVLAELQGLNEPKEGTLDIELLRWALQFDLSAAKEDDRQELVRDESAAADERTFLTACTVFLEAACWDGLVRYLRHSVGALRHLPGLLRPPLLQLVVQAPDLALQAILSRCNRDRLSPQELCAYGLLCGALQRWKEADAALRQVQDRLPDWPLPRLILAQAYQSLAFERLGQPQEKAEWLKLSLWLSA

SEQ ID NO: 3506 - protein, 272 aa, Unknown
  Description of Unknown: bacterium sequence
MQKLSVILVTLNEEKNIDRCLGSVRWADEIVVVDSFSSDQTVELARKYTDKVYQHEYPGTSKQVERGITYATGEWIFIIDADEEMSDELAAEVQTVLRGNGDIVGYEFIRKPSAFGKWIEHGVWFPDYQFRFFRKDSYYPEHQEIHGGFNTKGRRGRLNGYLYHHTYGTIYAYVEKMNEYTSLHVSNKLKDNPAADARWHNLILNPLSHFLRMFFSKKGYKDGFHGFVLALLDATYTMLLYAKLWEYRMRQKEGKGVLPPTTNVELNALKRK

SEQ ID NO: 3507 - protein, 254 aa, Muricauda pacifica
MDKAKNDISALLITLNEEDNIDAVLENLSFVNEIVVVDSYSSDATAEKVQNHKGVKLIQREFKNYTDQKEFALSQAKNDWILFLDADERVTPELKNEILEVTNGSNTASAYYFLRKFMFQNQVLRFSGWQTDKNYRLFKKSKVRFDQEKIVHETLIVNGDSATLKNKLIHYSYSNYEDYKGKMIKYGEMKAMEEFKKGNKARFYHFLFRPFYKFFNNYILRLGILDGRKGIIICYLNALGVHSRYKKLKELNNK

SEQ ID NO: 3508 - protein, 276 aa, Unknown
  Description of Unknown: Microbacterium sp. Leaf151 sequence
MKMSDISVIVLTKNEEEGLANTLRELSDFEDLIVVDSNSTDRTVEIAHSLGARVVNFTWDGAYPKKKQWSLDHAGAKNDWVLLLDADEYPTQALKDELRALEGKLAAAPEGAFDIHLLYRFGGRLLTHGHVVTKRSLLNTKRARFPEVADLDAPGIREVEGHYQPSTSAPIGKLRARIVHDDRDPVSSWFARHNRYSDWEAHLEMNRELKKDIASKRTVKGRIFDSVPMKPFLFFMYAFVARAGFLDGRAGFDYAVALSTYYWQIGVKRRELLRVA

SEQ ID NO: 3509 - protein, 251 aa, Lacinutrix algicola
MQKLTAIIPTKNEIDNIEAVIASVDFADEILVIDSFSDDGTFEKATTLATKVIQRKFDFYGTQKNHAIAQAKHEWILLVDADERVTPKLKTEVLSILNQDKIEHDAFNIKRINHFMGERVNYSGWRNDSVIRLFKRDVCKYDNRHVHEALIVNGSVGHLKQKFLHYSYRSFNHYMQKMDRYATLQAKDYDKKTGRLTPYHFFIKPFWGFVKHYIIQSGFRDGVVGLTIGYVQGYVVFMRYIKLWLLRKNRT

SEQ ID NO: 3510 - protein, 258 aa, Unknown
  Description of Unknown: Aquificae bacterium sequence
MLSVLIRTKNEEENIERAIRSVQDLADEVVVVDSGSTDRTVEIAKSLGAKVFFREWTGYSDQLNYGVGLCCGDWVLVLDADEEVSRELKESIKEEIKRPRYEAYEVCRRTCYLGRFLRHAWYPEWRLRLFKKGKVAFEGVLHERVVFEGKVGRLRGDLYHYSFKNLEHQYLKTVKYAKLMAQEAYAKGKKFRLINLLFNPLWHFFKVYLLDLGFLDGKRGLMVAFSGFVYTFLKYKFLYELELKEKGCHAKREDEGPA

SEQ ID NO: 3511 - protein, 284 aa, Unknown
  Description of Unknown: Microgenomates group bacterium GW2011_GWB1_45_17 sequence
MKLSIVLAVYNEEKNLAECLKSIEHIADEIVIVDGGSTDNTVEIAQKFGARVIKTTNPPMFHINKQKALEAAKGDWILHLDADERVAPALAKQIQEAVKGYPIEIVDAKKQNLFIRHQQNIEARDGKIGTDKSEITAYFIPRLNFFLGGYLKHGGVYPDGEIRLVKKGKAYFPCKNVHEQMHIDGRVAWLSEDLIHMADPTFSRYLMRANRYTSLTAKEFEKQHIPKFGISVFMYMFVKPFTTFLSLYFRHKGFLDGFPGFVWAVFSGLHFPLAYMKYWENHDA

SEQ ID NO: 3512 - protein, 405 aa, Phorcysia thermohydrogeniphila
MKISACIIAKNEEKNLPRLLKSLKGKFDEIVLVDTGSTDRTKEIAKSYGCKVVEHEWNGFADARNRAVKEASGDWLWHFDADFELEDLEFKKALSAMQRAPKEVDAFAIGVKNFGRNGEIKAISSHIFIHRAGIEWKGKVHESPKAKLVIGIPVFVNHYGYADPKLLFKKGERNLNLLLEELQELPKGSKEYNYKLFFLVQTYNLLSAKDKSYLSKALSAAEEFLRAAKDNFSDYGFFLVYMYNYYLQLLWKTNRRKEAEKILNHVFSLNINLPEFFFFAYKIFREKGNSAKAFDYILQVAKQLDIINSNPFVSSWGNASECLPAFENEILTPPFSISSKNMEKLREEWKKNKGRNLGLLLYWFEANKTEKIKILRKLSLRYGDSFIYKLFLLNKLQEEKHHLST

SEQ ID NO: 3513 - protein, 258 aa, Unknown
  Description of Unknown: Acidobacteria bacterium sequence
MNRLSVCLITLNEERNLPRALCSVQGIANEIVVVDCGSSDRTQEIAREHGARVIARAWTNFAEQKNSAAAAATHDWILSMDADEEVSPELRESLLAWKQQESQIAVYEIARCAWYLGAWIKHSGWYPDRQRRLYRRDAAQFCGIVHESLRFEGSPGRLRGNLLHYTMNSFAEHEDKVERYTTLAARQMYDAGKRSWRAAMWLAAPWSFFSTFLLRGGFLDGYRGWLISRMAARSVWLKFKKLGRLVATERCGNNMQTP

SEQ ID NO: 3514 - protein, 295 aa, Unknown
  Description of Unknown: Candidatus Woesebacteria bacterium GW2011_GWB1_39_10 sequence
MKDNSSPKLSVVLAARNEEENLGRSLESVKEIADEIVVVDEHSTDKTVEIAKEYGAKVFLESHHDIFHITKQKALEKATGDWVLQLDADEEVTPALAQEIKKVIDMSNEDIKKRFDLDIHEMYHFRKHQRIIEERDGKIGKNTGEVVAFFIPRLNMFLGRPLRYGGVYPDGVIRLVKNGKARFPQKSVHEQIQIDGEISWLFDDLIHYDSPTMKRYLARFNRYTDLKAKELNEDKAPKNFWSLFLYTIYKPLYTFLNIYIRHKGILDGTQGFLWAFFSAMHFPIAFYKYITNGNE

SEQ ID NO: 3515 - protein, 259 aa, Selenomonas flueggei
MSLNVSVLILAKNEEKNIEACIRSASFAGEVLVIDDFSTDRTAELARSLGARVLTRALDGNWGAQQTYAIEQAQCDWVYFLDADERISPKLAECIRKVVTEDDRRYVYFNGRLNYFWEQPLRHGGWFPGYGLHLAPKKGTSVTGFVHPTICHSYKIRKFPSDAYLVHYPYRDWEHHLNKLNFYTTLAAKKRYQEGYRAHMFDIILRPIWASFRMYFLRGGFLDGRIGFILASFHFFYTMEKYVKLYYIDKTNNHVGDFS

SEQ ID NO: 3516 - protein, 249 aa, Polaribacter sp.
MTKITAIIPTLNEEIHIEEAIKSVSFADEIIIIDSFSTDNTVTLSEKYNVKIIKRKFDDFSSQKNFAIEQAKHPWIYILDADERVTLAVEKEILEAVKNPNECVGFYVRRTFYFCDKRVDYSGFQRDKVIRLFLKDHCRYSGHVHEKITTTGKLGFFKNKIDHFSYRNYDHYISKMNHYAAIRAKELHKRGDKVNIYHVMIKPSARFFIHYFIRLGFLDGFAGFLVAKTQAYGVLTRYIKLWLLNRKIN

SEQ ID NO: 3517 - protein, 256 aa, Unknown
  Description of Unknown: Bacteroidetes bacterium sequence
MPGHPFSTVIITKNEAENIRPCLAAIRHVCTDIIVVDAQSTDKTPDICREMGARVFEKAWEGYSENKNFGNARARHDWILSVDADEVLSPALIETLENWTPRPKTVYALDRISSFCGQWIRHGAWYPDWKIRLFDRRVVQWTGDFVHEKPDYPPDFKVVRLKGKLYHYTCKDPSEFYARLDQYARLAALEMFEKGQKPSFFKQFFSPGFRFFRDYFLRKGFLDGRAGRDIARANACVVSRKYARLKELYQTKHRGN

SEQ ID NO: 3518 - protein, 305 aa, Unknown
  Description of Unknown: Candidatus Collierbacteria bacterium GW2011_GWC2_44_13 sequence
MARIKISAVVNTRNESENIFDCLKTLGFCDEIVVVDMESEDNTKEIVKQFTDRIYDHKMVGFVEPARNFAIKKALGDWIFIVDADERVPKTLAAKLIEIADKNEVDFVRVPRKNLVFGHWLQHSRWWPDYNIRFFKKGSVDWQDEIHSVPITYGNGINLDVEQGTALEHHHYRTIDEYFIRALRYSDQQSKELIESGYKFDPVDLIKKPTGEFLSRFFAGEGYKDGLHGLVVAVLQFFSILLIYLKVWQNEGSKPVSERVFTQTWQSVFLEKFKEFRYWFLTSKIQNSKNKTEAFLLKLQRRLLK

SEQ ID NO: 3519 - protein, 270 aa, Unknown
  Description of Unknown: Candidatus Shapirobacteria bacterium GW2011_GWE1_38_10 sequence
MPKLSVIILAHNVEEEIVPALETSKFADEIIVVDTDEGSTDKTVAVSLKREARIVRSPGYNFAKWRNDGAQAARSDWLLYLDSDERIPVKLAQEIRSTISNPDHQAYTISRFEVFLGKHLEHWPDPRVLRLIQKSALKRWEGKVHEQPVIDGTVGDLDKQMVHLSHKNIDEKVTSTMKWSRLEAEMMLKAGHPPMAGWRFLRIMFTEFWHRFVRQGLWRDGVEGWIEAIYQMFSKFLSYERLWEMQRKPSLKDAYKKIDQQVLDEWKQQK

SEQ ID NO: 3520 - protein, 317 aa, Persephonella sp.
MKISACIVAKNEELNLPRLLKSIDGLFHEIILVDTGSTDNTIEIARDYGCKVYKKDWQGMADARNFGILKVSGDWIWHFDADFELENPNDVEKVKEIIQKESPDIISIFYRNLTIYGRDSFVERRMIHRKDKNLYWIKPVHENLILPKGIRIARSDVKIKHYGYFTQDILFEKTKGYLKYLSQNFKDCYDFVYLIKSLFILSFVDKNYINEFFKFHSRFIKVCNPTFLDFLYAVNLLVFNQKIEQAMLLLEMNKSFSGRFYYEFFRAIAEYESGQYDISRQRFLKCKKYPEEDIYIYPFSLLYDPLKIIDYYLQKLQ

SEQ ID NO: 3521 - protein, 255 aa, Succinatimonas hippei
MKLSIIILTRNEAKNLKDCIASTADLADEIIVIDGESTDNTVEVAKSLNAKVVIFDKWQGYGPRRQDAQKHAGGEWILHLDADERLTPQLVELIKNELSKASGNEIFAIPRATYLLSHRINHCGWYPDYVLRLYKNSYTHYDDALVHEKLEVPKNAKIIYLKEPMIHYSYRTLEQYFDKQKTYELAFGENKFKKGKKVNLLSIPFRALFGFIRIYFIKKGFLDGKIGLWLAISVAAYVTNKYLALYMAQNNEKLK

SEQ ID NO: 3522 - protein, 264 aa, Kriegella aquimaris
MHTSSEKISAVIITFNEMGYIQNCIKSVEFADEIIVVDSYSTDGTFEFLQEHPKVKVIQNPFENFTSQKSFALKQAANDWVLFLDADEVVPDALREEIKTTLDNGTDIAAYWFYRKFMFKNDLLRFSGWQTDKNYRLFRKSKAKFSDKKIVHETLDVNGASGIMQEKLIHYCYKDYDDYRAKMLKYGRLKAKEDFYKERTFNYLFMLVKPTWKFFNHYFLRLGILDGRKGMVICHLNALSDLERYRELKKLEKKNELAYYLLMP

SEQ ID NO: 3523 - protein, 299 aa, Unknown
  Description of Unknown: Candidatus Woesebacteria bacterium CG_4_10_14_0_2_um_filter_44 _9 sequence
MNTQPSTRNRKTVKLSVVLATRNEEENLGRCLESVQGLADEIVVVDEYSTDKTRQVAEKYKAKVYLEPHHDIFHVTKQKALNWATGDWVLQLDADEVVTPELAKEIELVVRGQRLEVGNAKKQKLFQRHQELIEQRDGPIGKKTGEVVGYFIPRRNMFLGKALIHTGVYPDGVIRLVKKGKARFPQKSVHEQVQLDGKVGWLSGDLLHYDSPTLKRYFNRMNRYTDLQAEELKMQGVSKNAWFIIQYSLFKPLYIFLNLFARHGGFKDGVRGFLWSLFSSWHYPIAYFKYLTAKSASAS

SEQ ID NO: 3524 - protein, 270 aa, Paenibacillus elgii
  MOD_RES (249)..(249): Any amino acid
MIVKDEEGLLPRSLTSVAGIASEIIVVDTGSTDRSATIAREFGARVYVHEWEDDFSKARNQALDAASGDWILVLDADEELAPECLPLLSESLCRSDAFAYALHFVNYYGQLTEYLSFTDSCCRLFRNLPDLRYSGKIHEDIVPSLLKRHLPPIPSRITIRHYGYLEDRVRQKRKPQRNTALLAKAIAENPGDSRLQYALGTEYLHAEQYTEAMGVFLPLLKSLEPSCGFYPDLLLKTALLLRVRGANDXCCSRPLSCSGCGEPTTKRFGL

SEQ ID NO: 3525 - protein, 255 aa, Unknown
  Description of Unknown: Candidatus Roizmanbacteria bacterium CG_4_10_14_0_2_um_filter_39 _12 sequence
MKLSLCIPTFNEEQNIQTPLDTAYELVDEIIIIDGGSSDKTIEIAKSYGDKVRVISVDNPSNFLINKQRAIEQATGDWILQLDADERLSEELKKELRNLKLEIRNSKPIAGYWIPRKNWFLGKFLMKGGVYPDGVLRLYRRDKAHFALKDVHENVIVSGETAWLQNAIEHMADPTFERYLDRWNRYTTFDAIQLVEKGEKPCFPCYFFGKPLFTFLNIYIRHKGFMDGFPGFVWALFSSIRYWVIYVKSKSYSTD

SEQ ID NO: 3526 - protein, 304 aa, Geitlerinema sp.
MFSIFILTYNEELDIAACIESALLSDDVIVVDSLSSDRTVEIAQRYPVRVVQHAFESHGKQRTWMLETVEAKHEWAYILEADERMTPELFQECLEAIANPQAVGYYVAERVMFMGSWIRHSTQYPRYQLRLLQRGKVWFGDYGHTEREICDGPTDFLKETYPHYTSGKGMSRWIDKHNRYSSDEAIETLRQLEQGQVSWQQLFRGKTEVERRRALKDLSLRLPFRPLVRFFYMYFLLGGILDGRAGFAWCTLQAFYEYLIVLKVWELQHMPVPTLDEQGMPQSTARKTGLSEASAAPSQEINAP

SEQ ID NO: 3527 - protein, 250 aa, Polaribacter sp.
MTKISAIIPTLNEEIHIREAIESVGFADEIIVIDSFSTDKTLEIAEKMNVKIIKRKFDDFSSQKNYAIAHAKHDWIYILDADERVTSELEKEILEAVKNPKDFVGFYLGRNFYFAGKKIKYSGWQRDRVIRLFLKEFCEYNGNPVHETIKTHGSLGFLKNKINHYSYRNYDHYISKINQYAWLQAEDLYKKGKKVNGYHILIKPPVRFFVHYIVRLGFLDGFEGFMIAKTQAFAVLSRYLKLWLLKNNLK

SEQ ID NO: 3528 - protein, 239 aa, Unknown
  Description of Unknown: Candidatus Collierbacteria bacterium GW2011_GWC2_45_40 sequence
MNLSVVIPTLNEEKDLPECLESLKGLADEVIVVDSGSTDKTVEIATRFGVKIVNHPFTSYSGTRNFGDSQVRGDWILSIEADVTISPELSEEITKAINLEKFDAYFIGRVNIIWGAKVLHADWSPKDDFHIWLYRRGIGEWQSLVHEEFVTDKKAGMLINFLMHKNYETVSEYIDKINKYSELAIRQKNYFPDWWFLRDFFKRYFYKLGFLDGYRGLFLSYLQSVYYLTLSVKRYTKTS

SEQ ID NO: 3529 - protein, 257 aa, Unknown
  Description of Unknown: Acidobacteria bacterium sequence
MERISATIITHNEEGNIAEALERLGWVNEIVVVDSGSRDRTLDICALYTDKVFHRDWTGFVDQKNYAVERASNDWILSLDADERPSAELESEIQSLRRGGFKRDGYRIPRVAHFMGRWIRHGDWYPDYQLRLFDRRRGRWQGGRVHESVKTEGSPGQLQGEIQHFTYRRLSDYLKRLETYSTLAAQDYRQKGRRSSVLRLLGDPPATFLKGYFFRGGFLDGVPGLMVAVMAAISVYFKYAKLYELCLNDELRMTSDE

SEQ ID NO: 3530 - protein, 251 aa, Seonamhaeicola aphaedonensis
MTKLTALIPTGNEIHNIEAVIKSVDFADEILVVDSNSTDGTYEKAQKLATKVIQRDYKYSASQKNWAIPQAEFEWILLVDADERVTPELKSEIKDILNNPPSDVVAFWIGRNNHFMGERVHYSGWRNDKVIRLFKRDYCKYEDKHVHAEIITNGNVGKLNNKLYHNTYISFDKYIEKMNRYAWWQAKDYDKKTGRLTPYHFVIKPFWGFFKHYIIQSGFRDGVVGFTIGYIQAYVIFMRYVKLWLLRKNRT

SEQ ID NO: 3531 - protein, 300 aa, Unknown
  Description of Unknown: Candidatus Woesebacteria bacterium GW2011_GWB1_39_12 sequence
MSKQSLAKSKFCNLSVVLATRNEESNISAVLESVKSIADEIVVVDEKSQDRTREIAKKYGARVYEVEHEPIFHKTKQKALNKAKFDWILQLDADERVTPKLAKEIKDVIDMPTAKILARRPGDNKKWALFQKHQKIIEKRNGHVGRPTGEVVAFFLPRKNIFLGKPLVHAGVYPDPAIRLIKNGKAHFPAKSVHEIMQIDGEVAWLFNDLEHYDSPTFSRYLERANRYTSLTAMEFEQKKSSKNIIVLFFYSFVKPIMVFLMLYVRHKGFLDGVRGFIWSAFSALHFPLAYFKYWVGETK

SEQ ID NO: 3532 - protein, 305 aa, Unknown
  Description of Unknown: Candidatus Nomurabacteria bacterium GW2011_GWC2_41_8 sequence
MTNSKISAVITTWNEAANLDECLATLDFVNEIVIVDMESTDNTVKIAKTYTDKVYRTPYTGYVEPARNFSIGKASGSWILVVDGDERIPVTLAKKLVEIAENNSADFVRIPRKNLVFSQWLKYSRWWPDYNIRFFKKGYVTWQDAIHSIPVTEGVGINLDPEPEFAIIHHHYRTIDEYIIRMLRYTSQQSKELIEAGYQFSLADLINKPAGEFLSRFFAGEGYKDGLHGLALAILQSFSMFVVYFKVWQEEGFVPQKDVLSNPSFKKLIKEKFTELKYWLYTIKIHLTGKKSEKFLLKIKRKFNL

SEQ ID NO: 3533 - protein, 332 aa, Lachancea sp.
MWGSLCSRVRDFNVAVVCGTFFAVILSSLYLLVLLLSHWPRKPFAEELSYRTNGNQGGETSGQLVCVKDCKENVDGIELSVLVPSYNEVGRILVMLTDAIEFLQKKIENKWEILIVDDGSRDGTSEYCLKLAHETFKLKPGQLRVIKLAKNRGKGGAVRHGMLHIRGKFGLFADADGASKFSDCEKLLSATQKLDESGKAVVAIGSRAHMVNTDAVVKRSFIRNFLMYGLHTLVFVFGIRSIKDTQCGFKLFNRPAIVQIFPYLHTEGWIFDVEILILALKKQIPIKEVAISWHEVGGSKMELARDSINMAKDLITIRLAYIMGIYSGKTEC

SEQ ID NO: 3534 - protein, 272 aa, Unknown
  Description of Unknown: Verrucomicrobia bacterium sequence
MPESLAIIVLTHNEAENLPRCLKSIAEFGEIIVVDSGSNDGTQEIANNSGARVYHRPFESFAQQRNWALENCDLKTEWVLFLDADEVATPEFRQAVAHAIQNAGDSIAGFYCCWKTMLDQRWLRRSDSFPKWQLRIVRRGRANFIDSGHGQKEGSVEGELGYVREPYLHYALSKGWEAWWAKHNQYSDEEATDRLSRSASLGELFSKDPSRRNRALKPILSRIPGWPLLRFLHMYILKGGFLEGREGFAYCASMGWYEYLIRAKMRDFRTNQ

SEQ ID NO: 3535 - protein, 296 aa, Unknown
  Description of Unknown: Candidatus Woesebacteria bacterium CG_4_10_14_0_2_um_filter_44 _9 sequence
MISAVINTLNEEKNLARAVASVRGLADEIVVVDMESTDNTREVARKLGTKVFTHKKEKYVEAVRNFMISKASGEWILVLDPDEEISPKLAKILKGLPRGGRKDSSGVVVADYYRIPRKNIIFGKWIKHCRWWPDFQIRFFKKGYVSWNEVIHAVPMTQGKGLDLPEKEDLAIIHKNYSSLEEYLAKMNRYTSVQAEELLKNGYVFDWKDLIKKPFREFLGRYFAGQGYKDGVHGLTLCFLQSFSELVLYLKIWQKQGFREQEIKRSEIKNEFGSLIKELRWWLRKELTWLKLPKWR

SEQ ID NO: 3536 - protein, 316 aa, Halomicronema hongdechloris
MSTAAGKIPVSVLIPAKNEEENLPACLESVAAAAEVFVVDSQSEDRSGEICDRYGAQVVQFHFNGRWPKKKNWALDNLPFHHDWVLIVDCDERIPPELWDEIAEAIQSSDYDGYYLNRRVFFLGTWIRHGGKYPDWNLRLFRHAKGRYENLHTEDIRNTGDNEVHEHVIIDGPVGYLQQDMLHEDFRDLFHWLERHNRYSNWEARVYYNLLHGMGNDGTIGANLFGDAVQRKRFLKTIWVRLPFKPLLRFCLFYVFQLGFLDGRAGYIYGRLLSQYEYQIGVKLFELERFGGSLNVNAAKAAPEATVTSEPGPANG

SEQ ID NO: 3537 - protein, 454 aa, Unknown
  Description of Unknown: Lachnospiraceae bacterium sequence
MRRGVRLSQCMIVKNEEENIERALSWGKDIMYEQIVVDTGSTDRTVEIAERLGAKVYHFEWIDDFAAAKNYAIELAKGDWIAFLDADEYFPPEDVAKLMPILRDLQHSKYEVLMTNILHLDKDGKAAESSTYMRIFRNRPGLRYRGRIHEELASDSGTIQFIDGTEDLSIYHTGYLQSAEGDVRKSKRNVPLIEKTLEEEPDNYVMMGYLGDGYVNLERYDEAVDLYQKAIVYLTKEELSEYDARSAATFKNLMRILLKIKGDVSAAENVYQQAVRSLPKNGDFDYVIGEEYIRLGRLQDAAYHLERGIGLLEKFGNTQKTDLLFANLQKAWEDLSLCYYGIGDLSQCVNCTTALLRANPWNMRMLQALLLAFLKDEQDAQTGGKGAYQAASPAQVRDFLGNLYNFQALRDRLFVLKAAMAAEYDGLVQELRQLMAPQELESFDRAMGQEVQEN

SEQ ID NO: 3538 - protein, 303 aa, Unknown
  Description of Unknown: Rhizobium sequence
MTSISVLILTYNEEVHIARAIESVASFATQIVVVDSFSSDRTVEIARSLGATVLQNPFVNQARQFQWGLDNAAISSDWVMRLDADEVVEPELAREIAQKLPTLAADVAGVNLKRKHIFLDRFIRHGGRYPLILTRLWRRGQGRVEDRWMDEHVIVWGGRTVLFDNPFRDHNLHDLGYFTEKHNKYATREAVDVLNRRYGLFAQDAGLTSEGTSLQASVKRFVKERVYNRIPFPVSTLGYFLFRYVIQLGFLDGREGLIYHFLQGYWYRFLVGAKVLEFDRAIRPLSTPEDKRQALAQLTGLAL

SEQ ID NO: 3539 - protein, 251 aa, Mesonia algae
MEKLTALIPTGNEIHNIEEVIASVDFADEIMVVDSFSTDGTYEKAQTLADVVLQRKFDYPSSQKNWAIPQAKHQWILLVDADERVTPELKQEILDVLKNPSNDTVGYWIGRQNYFMGKPINHSGWKNDKVIRLFKRDECRYNNKRVHEEITSDGNIGKLNSRFLHYTYTSFDNHIEKVNKYAWWRALDYNEKVDKITAYHFIVKPFWGFFKHYLLQSGFKDGVPGLTIAFLRSYSIFTRYLKIWLLRKGIK

SEQ ID NO: 3540 - protein, 609 aa, Propionispira raffinosivorans
MKISACIITKNEEKNMESYFAKIQGLVQEIILVDTGSTDRTVEIARSHGAKIYQYEWKQDFAAAKNYALQHATGDWIVFLDADEYFPSESIENLKKYLKTVHNNKKCDAIGVRIVNIDIDKDDQEISSFVNIRIFRNRLNLRYKNAIHEEVYNTKGTVHIFMLENDIKVYHTGYSTSIAREKMQRNLAILLKEIAEEGEKPAHYRYLCDCYHGLDDYANAIKYGRLHIEAKLSSLGAEQTVYDKVIDALINSEADSNEIRAEIKRAIQTFPNSPDFYCAYGRFAWLQKNYEMALQYFLKAISLRAQESKGSYQANSFDGHLTAVYFFMGEIYFLKNQSEQALTYYCKSLLRHKYNAEIFQRVYRLLMNTDPIEVISLFNGIYERTQKDISFIIENLSNCPKNKIFAYYSNILTRDFSVEVDSLWQYQMLGLGNYQKLYVTSMESMMQNSHMLASACIAQNNKQLMNEQYIKALNEAFKTVVLRFYDETLKLNEELFPAYETILKELLLIQSSSLDHYLELAEDFSNENILKITKILEEKKKYSKALNVYRQVYLRLSLSNPSEYYEDIGYCSYKLGLYAEAARYFDKVLEKNPENLKILQFKTWSEARC

SEQ ID NO: 3541 - protein, 328 aa, Leptolyngbya ohadii
MFSIYILTFNEELDIGACIESALLSDDVVVVDSCSSDRTVEIATEIASRFPVRVVQHPFESHGKQRTWMLEAVPPKHEWVYILEADERMTPELFQECLAAIQDDRSGNRYVGYYVAERVMFMGQWIRRSTQYPRYQLRLLRHGKVWFNDYGHTEREVCQGETGFLQQTYPHYTCSKGLSRWIEKHNRYSTDEAIETLHQLEAGAVNWRNLLLGRTEVDRRRALKDLSLRMPFRPLIRFLYMYLLLGGWQDGRAGFAWCTLQAFYEYLIVLKVRELRQAAAATPTPTPALQQCPGAQNASSVSASVATNVSASVSASVTVNTDKDKIYS

SEQ ID NO: 3542 - protein, 255 aa, Unknown
  Description of Unknown: Candidatus Gottesmanbacteria bacterium GW2011_GWC2_39_8 sequence
MEDLSVVIATYNEEKNIARAINSIKDLAEEIIVIDGSSTDKTVEIARGLGAKVTVAVNPTIFHINKQKGLNLSKCKWILQLDADEEVTEDLRNEIRSVIEQKSEYAGYYIPRLNYFLGGPLKKGGAYPDPVIRLFLRGRGKFPCKDVHEQIDIDGKVGVLSNYLIHRPYKTFQDYLIKAERYTDLTSEQYAQDKIPVTLINSIKFIVLKPIYIFFNIYFRHLGFMDGWRGFVWAFFSGLHPAYAYLKYLKKTRPI

SEQ ID NO: 3543 - protein, 342 aa, Zygosaccharomyces rouxii
MAFNDFKQLQNVDLKGFLTTAAIGLIVSGYLIIYLLSHTPRLPFDEELEYQTIDGKGGLVKKRLPNVCRGDSNKNKSNNDNNDEDILLSVVVPSYNETKRISHMLADAIAVLQKEMAHRWEIIIVDDGSKDGTSEYCLNLSEKVFQLQEGQLRVVKLSQNRGKGGAVRHGLLHIRGKYGLFADADGASQFNDVSKLIESIKQLEGPQGKPAVAIGSRSHMVNTDAVVKRSFIRNLLMYGLHTLVFVFGIRSIKDTQCGFKLFNRSAIESIFPYLHTEGWIFDVEILMLALRKKIPISEVAISWHEVDGSKMDLARDSINMAKDLVVIRMAYILRIYRDDKEC

SEQ ID NO: 3544 - protein, 219 aa, Unknown
  Description of Unknown: Acidobacteria bacterium sequence
MNRLSACLITFNEEHNLPRVLGSLQGIADEIVALDCGSKDRTQEIAQERGAKVVTHAWTNFAEQKNIAAAAASYDWILSLDADEELSPELRSALAEWKEKEPEFAAYEFARRTWYLGAWIWHTRWYPDYQLKLYRRDKSRFEVPEHATVKYDGPVGRLEGDLLHYTLRSYEEHAAKVESITTRQAQYLFSEGRRSWRVAMWLASPWNWFNNYILCRGFL

SEQ ID NO: 3545 - protein, 251 aa, Polaribacter reichenbachii
MTKITAIIPTLNEEIHIEEAIKSVNFADEIIVIDSYSTDKTVVLAEKHNVKIIKRKFDDFSSQKNFAIDQAQHPWIYILDADERVTPQVRTEILNAVENPKDKVGFYVRRSFYFVGKKIKYSGWQRDKVVRLFLKEYCRYKGIVHETIKTNGELGFLKGKIEHYGYRSYNHSIEKIHHYAFLKATDLHRQGKKAGLYHILVKPPARFIIHYIIRLGFLDGFEGIILAKTLAYSSRTRYIKLWLLNKGIKEK

SEQ ID NO: 3546 - protein, 250 aa, Lacinutrix sp.
MEKLTAIIPTGNEIHNIKAVIDSVKFADEILVVDSFSTDGTFEKAQKLANKVIRREYQYSASQKNWAIPQATHQWILLVDADERVTPELEQEIKQVLSNPSNNVAYWIGRNNHFMGESVKFSGWRNDKVIRLFKRDLCRYEDKQVHAEIIADGAIGLLKNKLYHNTYTTFDAYIEKMNRYAWWQAKDYDKKTGKLTPYHFVIKPFWGFFKHYIIQGGFRDGLVGLTIGYIQGYVVFMRYVKLWLLRKGRR

SEQ ID NO: 3547 - protein, 251 aa, Algibacter sp.
MQKLTAIIPTGNEIHNIEDVIASVDFADEIIVVDSLSTDGTYEKAKASGVKVIKREYQYSASQKNWAIPQAKHEWILLVDADERVTKELKEEIIETLKNPKDNVVAYWIGRNNHFMGEHVKYSGWRNDAVIRLFKRDSCKYQDKHVHAEIIADGDIGNLKQKLYHNTYITFDKYIEKMNRYATWQAKDYDKKTGRLTPYHFIIKPFWGFFKHYILQSGFRDGVVGLTIGYIQGYVVFMRYVKLWLLRKNRQ

SEQ ID NO: 3548 - protein, 258 aa, Unknown
  Description of Unknown: Acidobacteria bacterium sequence
MNRLSACLITSNEEHNLPRALRSLEGVADEIVVVDCGSWDRTQETARAHEAKVVTRAWTNFAEQKNFAAAAASNDWILSLDADEELSPELRQFLVEWKQKEPEFAVYELARRAWYLGAWIKHSGWYPDYQRRLYRRGAASFQGIVHESLRFEGPAGRLRGDLFHYTILSFAEHEEKVERYTTLAARQMYASGKRNWRAVMWLATPWTWFHSFVVRRGFLDGHRGWLISRMAARGTWLKFKKLGKLIEAERHGPAMKTP

SEQ ID NO: 3549 - protein, 254 aa, Tatumella ptyseos
MNTRQRLSVVMITKNEAELIPECLASVDWADEIVVLDSGSTDQTCEIARQAGAKVFRNTQWPGFGPQRQQAQQYASGDMILMIDADERVTPELRQSIETLLSQPPQAHQVYSIARSNWFLGRYMRHSGWYPDRVTRLYPASFTYNSHLVHESLEHPGAAVIRLSGDLQHLTCRDLHHFQQKQLAYANAWAQQRARQGRRCGLFSVYSHSVAAWLKTAILRAGFLDGRQGWILALVNAQYTFNKYAILWALTRTK

SEQ ID NO: 3550 - protein, 251 aa, Formosa agariphila
MTKITAIIPTGNEIHNIEAVIESVKFADEILVVDSFSTDGTYEKALPLATKVIRREFDYFASQKNWAIPQAKHEWILLVDADERVTPELQTEIIEILKNPDPNIVAYWIGRLNHFMGERVHYSGWRNDKVIRLFKRDFCVYEDKFVHEEIEANGNVGHLKNKLYHNTYTTFDKYLEKMNRYAWLQAKDYDKKTGKLTPYHFVLKPFWGFFKHYIIQSGFRDGVIGLTIGYIQGYVIFMRYVKLWLLRKGRK

SEQ ID NO: 3551 - protein, 251 aa, Mesonia aquimarina
MEKLTALIPTGNEIHNIEEVIASVDFADEILVVDSFSTDGTFEKAKELADKVLQREFDYPSAQKNWAIPQAKHDWVLLVDADERVTSSLKEEILNVLKNPPTDIAGYWIGRQNYFMNKPINHSGWKNDKVIRLFKKDECQYNNKRVHEEIITEGNLGKLTHKFIHYTYTSFDNHIEKVNKYAWWRALDYKDKVGKLTAYHFIIKPFWGFFKHYIMQSGFRDGIPGLTIAFLRSYSIFTRYLKIWLLRKGIK

SEQ ID NO: 3552 - protein, 342 aa, Unknown
  Description of Unknown: Acidobacteria bacterium sequence
MKAEKFPSTTEADDRKQTQTGADRLSVVILTYNEQANLPACLESLKGLDCEILLVDSGSTDATIEIARRAGATVFTHPFENYAAQRNWAQKNLPFHTNWVLHLDADERLTPALVKEITRVLKAPPDAMNGFLLRKRTIFMGRWIRHGGHYPSYHLRLFRTDHGICEDRLYDEHFLVRGKVGLLKSDYSDIITSDLTIWTLRHARWAELESQEIMRPSNSHLRVSPDPLGTPVERRRWMRTGVYLRLPLFVRAFLYWFYRYFIRVGFLDGKEGLIFHFLQGFWYRFLIDAKLYEAQQRISRQMAEKRRGSQRMLTFKSPGQRQVSEMVPCTAGLSLKRNAAFV

SEQ ID NO: 3553 - protein, 319 aa, Cyberlindnera fabianii
MDTNTVLSYFAAFLATAVALVYAVVLIFSHSPRPPVDSEKTFFTTTKTGLDPDHKPLPERGILQPIEDIILSVVIPCYNETSRLKIGLDETVEHLKAEYGDNWEILIVDDGSKDGTTKYALELAVEEYKLQPGQMRVVQLVKNRGKGGAVTHGMQHVRGKYAVFADADGASKFSDVQKLIESIEEYGDEPAVAIGSRAHMVESDAVVKRSFIRNFLMYSLHTLVFVFGIREIKDTQCGFKLFNRSAIANIFPYMHTEGWIFDVEILIIAIRKNIPVKEIAISWHEVDGSKVDLARDSINMAIDLVVTRLAYILGIYKDY

SEQ ID NO: 3554 - protein, 281 aa, Maritimibacter alkaliphilus
MPDQTRPKLGVVTISYNEERDLPGFLANLIDWVDEIIIVDDGSSDTTEDLAKAAGPKVRFLRSPRVEGEYFSHQRNKGIDAATSDWLLHMDVDERVTPELARQVQEAICDDGKDGYRYRRLNYFMHRPMKGGGWRDWNLVHLARRDKFRFGGMFHEDCLLDAPESRVGQLSALMVHFNEDNLEKRFRKSGQYMEEVVKGVEGRGRPVRFIDIAGRPIYEFFRKYVAKKGFQDGIPGFISAVHSATAIFRANAIVWDRQNAITRSQIDADFQDQWTRGGGAG

SEQ ID NO: 3555 - protein, 249 aa, Polaribacter dokdonensis
MTKITAIIPTLNEEIHIEAAIESVNFADEIIVIDSYSSDNTVQLAEKHNVKIIKRKFDDFSSQKNFAIDQATNPWIYVLDADERVTPEVEKEILEAVKNPKGKVGFYVGRSFYFVGKHLKYGGCQRDKVVRLFLKEFCVYKGVVHETIYTEGDLGFFMNRIQHYSYRGYDHYISKMNHYGALRAKQYFSEGKKVNFYHLLIKPIARFFIHFFIRLGFLDGFRGFIYARAQAYGVYVRYIKLWALNQKPD

SEQ ID NO: 3556 - protein, 252 aa, Polaribacter sp.
MTKITAIIPTLNEEIHISNAIKSVSFADEIIVIDSFSKDNTVALAEKHNVKIIKRKFDDFSSQKNFAIDQAKYPWIYILDTDERVTPEVENEILEAVKNPKDFVGFNVRRTFFFCGSKINYGGCQRDKVIRLFLKEHCKYSGVVHERIVANGKVGFFKNKIDHYSYKSYDHYISKMNHYGQLRAQQFFEEGRTVNLFHILIKPPARFFIHYIVRLGFLDGFPGFVFAKTQAYGVLTKYIKLWLLNRNATNER

SEQ ID NO: 3557 - protein, 249 aa, Formosa algae
MTKITAIIPTGNEIHNIEAVIASVNFADEILVVDSFSTDGTYDVAKKLATKVIRREYEYSASQKNWAIPQAKHEWILLVDADERVTPELKAEILNTLKNPKDVAYWIGRMNHFMGERVHYSGWRNDKVIRLFKRDLCAYEDKHVHAEIKVNGSIGKLEHKFYHNTYITFDKYLEKMNRYAWWQAKDYDKKTGKLTPYHFVIKPFWGFFKHYIIQAGFRDGLVGFTIGTIQAYVIFMRYIKLWLLRKNRV

SEQ ID NO: 3558 - protein, 249 aa, Lutibacter sp.
MNITAIIPTFNEELHIENAIESVSFADEIIVIDSFSTDRTVELVKKHDVKLIQRVFDDFSTQKNFAISHAKNDWIYILDADERVTPELQLEILETVRSPKDFVGFYVYRTFYFLNKKIRFGGWNRDKVVRLFLKSNCQYDGNLVHEIIKANGELGFLKHKLEHFSYRGFDHYISKLNQYSGLQAQQLDKQGKAVTLFHLLVKPPVRFLIHYVLRLGFLDGFSGFVLASTQAYGVYTRYIKMWLIRRNSK

SEQ ID NO: 3559 - protein, 253 aa, Polynucleobacter necessarius
MPTLSVILITRNEEANLEDCLASLEGIAQQMIVVDTNSTDRTLEIAQKYGATIAQPTDWPGFGPQKNRALDLATQEWVLSLDADERLTPTLRSEILTAIHHNGHIDCFAIPRLSWYCGRFIRHSGWSPDYVDRLFKRGTARFSDDLVHERLIPQGQVAKLKNPILHFSFMNYSQVLQKLDRYSTASAQQAYSKGKTSNPLKAVLHGLWAFIRTYIIRAGFLDGAQGFALAISNGQGTYYRYMKLWQLNQEARK

SEQ ID NO: 3560 - protein, 251 aa, Unknown
  Description of Unknown: Flavobacteriaceae bacterium PRS1 sequence
MTKLTAIIPVGNEIHNIEAVIASVNFANEVLVVDSFSTDGTYEKAKELTNNVLRREYQYSALQKNWAIPQAKHEWILLVDADERVTPELKAEIIEILNNPKDDIVAYWIGRNNHFMGEPVRYSGWRNDTVIRLFKRDFCSYQDKLVHAEIIANGTIGKLKHKLYHNTYITFDKYMEKMNRYATLQAKDYDAKTGKLTPYHFVIKPFWGFIKHYLVQSGFRDGVIGFTIGYVQGYIIFMRYVKLWLLRKGRK

SEQ ID NO: 3561 - protein, 298 aa, Unknown
  Description of Unknown: Candidatus Woesebacteria bacterium GW2011_GWB1_44_11 sequence
MAKISVVINALNEEKNLPQAIASVKGMADEIVVVDMQSQDKTAEVARSLGAKVFTHEKTGYVEPARNYAISKAGNPWVLVLDADEEVPAKLAQKIKQILKSPKADYYRIPRKNIIFGHWMKHSRWWPDYNIRLFRKNAVSWNEVIHSVPMTQGIGGALDDREEYALVHHNYDSVEAYLERMNRYSTLHAGLLSKEGYKFSWKDLILKPSNEFISRYFFGEGYKDGIHGLALSLLQAFSELTVYLKIWQKEKFTDQGPKLDEVVSIIREQEKDLHYWLSDSLFKQSGSLGDRIRRKLKI

SEQ ID NO: 3562 - protein, 298 aa, Bordetella genomosp.
MSRIPVSVVVMTKNEERNIEKCLRALADFDEVFVIDSDSTDRTVELAQSLGAIVVPFQWNRKYPKKKQWCLENLPFSHDIVLYVDADEEMTPPLAREIAASLGRFDEGKGGAFVGFDYVFCGKPLRHGHRVYKLVLLHRHRARFLDYNDLDVAHMWEVEGHYQPEVEGGTFVMKGRMGHNDHDTLFHYFDKHNRYSDWEANLREKGLMNDPREANMGMRSLLKRIFQALPFKGPAVFLHTYVFHLGFLDGKVGLDYAVARAMYYWQIGLKSREVRAARKAANEAAQADRVSSVSQSAR

SEQ ID NO: 3563 - protein, 261 aa, Unknown
  Description of Unknown: bacterium sequence
MNGISVLIIAYNESENIVGAIESVRFAEEIVVVDNCSNDNTVEIAEQNGAIVFRTDDNLGYSQAKKFGLEKCNYSWVLWLDADERASLELAEEISNIIKNGEVDSSIAGFYIHRKSFFVRKWMKHCGWGNEKVLRLFRKNCAQISDDLVHESIIIAGQTRTLSNPILHYTAPDFITFFQKQMKYASLSAQQMISQNKSIGLGKIFFNPLATFFKIYFVKLGFLDGLEGFFLSVIQSTYVFAKYVQAYYIKKKMASKNRKEI

SEQ ID NO: 3564 - protein, 311 aa, Unknown
  Description of Unknown: Acidobacteria bacterium sequence
MQDDTSIQECRVSVLIPTFNEEVNLPDSLASVCGWAKDVWVVDSFSADRTVEIAREAGVNVVQHAFEGYAQQKNWALENVPFRGKWVLILDADERVSPELAAEIRRLITADGSGCNGFYLNRKLIFYGRWIRHCGWYPSWNLRLFRRGHGLYEQREVHEHLLLDGQAGYCKHDLIHEDLRDMSFWIAKHNRYSSQEAGELDRLRRGASTAGLQASVFNGSLERKRFIKERIWPHLPGRAFLAFFYWYFFRLGFLDGKHGFLFCQMHAIFEQFTAAKLWELEHYKRDARDGAINSAKVFQSTVTVDAEHSKK

SEQ ID NO: 3565 - protein, 305 aa, Unknown
  Description of Unknown: Microgenomates group bacterium GW2011_GWC1_44_9 sequence
MAKIKISAVVNTRNEAENIFDCLRALKFCDEIVVVDMESEDNTKEIAKEFTDRIYDHKKVGFVEPARNFAIQKALGDWILIVDADERIPKTLAAKLIEIADKNEIDFVRIPRRNLVFGEWLQHSRWWPDYNIRFFKKGAVQWQDEIHSVPVTYGNGLNLEDDAKFALEHHHYRTIDEYFLRALRYSNQQSKELIKSGYVFDPADLIKKPLGEFLSRFFAGEGYKDGLHGLVMALLQYFSMLLIYLKVWEAEGHKPIKERALTPLWQTVFREKFREFRYWVLTAKIQYSGSKTEAFLLKLQRRLLK

SEQ ID NO: 3566 - protein, 250 aa, Unknown
  Description of Unknown: Flavobacteriaceae bacterium sequence
MHKLTAIIPTGNEIHNIEDVIASVDFADEILVVDSFSTDGTYDKALELATKVIRREYEYSASQKNWAIPQATHQWILLVDADERVTPELRSEILEILKQPEDKVAYWIGRMNHFMGKRVHYSGWRNDKVIRLFKRDHCSYEDKTVHAEIIANGPIGNLKNKLYHNTYTSLDAYIIKMNRYASWQAIDYDKKTGMLTPYHFIIKPFWGFFKHYIVQSGFRDGVVGLTIGYIQAYVVFMRYAKLWLLRQKKA

SEQ ID NO: 3567 - protein, 299 aa, Unknown
  Description of Unknown: Candidatus Woesebacteria bacterium GW2011_GWA1_40_43 sequence
MVSKISVVINTLNEEKNISRAILSVKGFADEIVVVDMESNDKTCEISEKLGAKIFTHKKTGYVEPARNFAISKATGDWVLILDADEEIPQTLAKKIKDIVKSPKADYFRIPRKNIIFGSWIEHTLWWPDYQIRLFRKGKVTWNELIHAVPITVGSGADIAAEEKYAILHHNYDFTEQYLERLNRYTSVQSNLLVKDGYNFAWTDLIRKPLKEFSNRYFAGEGYKDGVHGLVLSLLQAFSELTVYIKVWQKSGFKEEKAGILEVVSEMKKGEKELHFWQNDSLYKKTGNIKYRIRKKLKI

SEQ ID NO: 3568 - protein, 312 aa, Unknown
  Description of Unknown: uncultured bacterium sequence
MSNTSNPPLSVVTAILNEEKLLPSFLAHIENFTDEIIIVVDSRTVDNSADIAEKHGCKVLLDKGESKGIVFNNKNWGANEAKNDWVLILDADERMDETLQKEIISIVSGTYPKKADIYQTGFLNYEFGKIFDKSDQKNKPFVRLFRKGSFSYQTARTAEGFGIQSNSLQSPNRLSRLVLKVPLLRTWYLNKMKGIVTLRGHLVHLSHPTISDFVRKIDHYSTREAKILFEKDPSISKPILVLKMIFLPKKEFLYKYFVWKFYKEGTHGFIVSIVYTFYHFLIYSKYFSLIYTDKHRKETESLLKKYGFTEQE

SEQ ID NO: 3569 - protein, 251 aa, Unknown
  Description of Unknown: Bacteroidetes bacterium sequence
MNRLTAIIPAGNEIHNIEDVIASVSFADEILVADSYSTDGTFEKATELATKVIRREYQYSASQKNWAIPQAKHEWILIVDADERVTPELKAEIIETLNNPNDNVVAYWIGRNNHFLGKRVNYSGWRNDVVIRLFKRDYCKYEDKHVHAEIIANGNIDKLTEKLYHNTYTTFDKYLEKMNRYAWWQAKDYDKKTGKLTPYHFVIKPFWGFFKHYIIQSGFRDGVVGLTIGYIQGYVIFMRYVKLWLLRKGRE

SEQ ID NO: 3570 - protein, 289 aa, Unknown
  Description of Unknown: Verrucomicrobia bacterium sequence
MNQPPKVPVSVLVPIKNEAGNLPRCLDSIRWAGEIFVVDSQSTDGSTEIAQQYGAQIVQFQFNGTWPKKKNWALENLPFRNEWVFILDADEVLPPEAEPEFARAIAEAGELAGYWINRRFMFMGKWLRHSYYPNWNLRLFRHSLGRYEKLTDADTRSGDNEVHEHVIVRGATGRLGCEIDHYAFPSVEVFIEKHNRYSNWEARVSADQRLSGSAAQISSGEVGRRRKLKQFSQRLPFRPLLRFLYIYAWQKGFLDGREGYYFARLHAVYEFLSVAKTYELMRTKAAPND

SEQ ID NO: 3571 - protein, 299 aa, Jiulongibacter sediminis
MSSEKSGSKLPITAIILTYNEEKNIRDCIESVYHWLDEIYVVDSFSTDRTLEIISEYPDVKMVQHDFENYSTQRNWAFQNLDIANDFIFNLDADHRAMPELADELRNHFSIGIPQNINGFMASRRTMFLGRWIKKGGHYPVYHAIIFRKGHGECEQKNYDQHFIIHGESIVLKSNVIDIITESLSTFTERHNKWATLEAAEAIAYSKEMEAGRVKADKEGNPMEYRRYQRMKYYSYPIFLRVFLYFGYRFVLKGGFLEGKQGLVFHFLQGFWFRFLVDAKIWEMKYNQELNESKTGVKR

SEQ ID NO: 3572 - protein, 299 aa, Unknown
  Description of Unknown: unclassified Achromobacter sequence
MNRIPVSVVVMTKNEERNIEKCLHALADFDEVFVIDSNSTDRTAELARDLGAIVVPFSWDGKYPKKKQWCLENLPFSHDVVLYVDADEEMTPPLAREIAANLPRFDKGAGGAFVGFNYVFCGKPLRHGHRVYKLVLLHRQRARFLDYNDLDVGHMWEVEGHYQPEVQGDTFVMKGRMGHNDHDGLFHYFDKHNRYSDWEANLRVKGLMNDPREANMGMRSLLKRVFQALPFKGLTVFLHTYVFHLGFLDGKVGLDYAIARAMYYWQIGLKSREVRQAQRAAGQAARSDAVTQSVSQSAR

SEQ ID NO: 3573 - protein, 253 aa, Unknown
  Description of Unknown: Thiomonas sequence
MASLSLIIITKNEAHNIAKCINSTQGIAEEVIVFDSGSTDGTQEICRQLGARVYETDWPGFGPQKNRALQEAAGEWILSLDADEQLSPELKEEIITILNGEHNNAVSYSIPRKSSYCGQFMKHSGWWPDRVVRLFKKSAGKFTDDIVHERVIFSGKLAELKGCIIHNSIVSIEQSIEKMNSYSTSGSMRLTELGVRTSITRAIFKGLWAFFRTYILRLGILDGRMGFILAVANAEGVYYRHVKTWVRQRDQSK

SEQ ID NO: 3574 - protein, 224 aa, Unknown
  Description of Unknown: Candidatus Woesebacteria bacterium GW2011_GWB1_43_14 sequence
WVDEILVIDGGSKDKTVSISKKYGARVVDYREGKDFSDRRNKGMREAKGDWILYLDTDERVTPSLRDEILEVIKIHEFEAFAIPRRNFVLGSELKHGGMWPDYQKRLFRRDKLRGWKGELHEEPQFEGRLGHFKNSMIHLKHDKISEMVEKTNLWSNIEAKLMHDAGHPKMNIPRFGSAIFREFWLRMIKQGAFLDGAVGIIYGLYQVYSKFVSYAKLWEMQMK

SEQ ID NO: 3575 - protein, 248 aa, Unknown
  Description of Unknown: Elusimicrobia bacterium CG_4_10_14_0_2_um_filter_63_34 sequence
MRLSAAIIAQNEEWDLPGCLASLAPLNCEIVVVDGGSRDRTREIVRDAGGVLVERPFDDFASQKQAAVDACSGEWILSLDADERLTPELAAEIPAALEGAADAYDIPFEVWFLGKRLRFGGLGREHHVRLFRKSRGRFKGARLHEGITVDGPTARLKGRIRHEPYRDLAEYREKAAVYTDRAALKRFENGKRFTPLHRLLPAWEFFMRAVLKGAVLDGYPGLLWAWLSAQHTRLKYAKLRELQRKAAR

SEQ ID NO: 3576 - protein, 279 aa, Pricia antarctica
MIRKNTQSVLKIGEHQKISAVIITYNEMGYIEHCIASVGFADEIIVVDSYSSDGTYEYLSAHPKIKVIQHPFQDFTKQKTFALKQASNDWVLFLDADEVVPAGLRKEIIAVTNRPSPHVAYWFYRKFMFKNAHLRFSGWQTDKNYRLFRKSKVAFCQERRVHERLEVEGTSGVLNKRLLHYSYKKYEDYKEKMLRYGQLKALQCHENGKQVLPLKLMAAPIWKFLYNYTIRLGMLDGRKGIIICYLNALSDLERYREFRQLNRKSTELHDTAVLSPVRE

SEQ ID NO: 3577 - protein, 251 aa, Unknown
  Description of Unknown: Flavobacteriales bacterium ALC- 1 sequence
MNKITAIIPTGNEIHNIEHAIESVSFADEILVVDSYSNDGTFKKAQELADRVIRRKYEYSASQKNWAIPQAKHEWILLLDADERVTTELKKEIQEILKSPPKNIVAFWMGRNNHFMGERVKYSGWRNDKVIRLFKRDFCMYEDKYVHAEIIANGSIGKLKAKLYHNTYISIDKYIEKMNRYASWQAKDYDKKTGLITPYHFVIKPFWGFFKHYILQSGFRDGFIGFTIGYLQSYVVFMRYVKLWLLRRKRN

SEQ ID NO: 3578 - protein, 252 aa, Halorubrum halophilum
MSTPVSAIIIAHNEEENLRDCIATLDWCDEVIVVDNESTDSTHEIASELADKTIVREVPPDQESFEILRQYGIDEATNEWILRIDADERIPESLAETLQQIIKREEHDVIKVPRKNFILDSWYEFSWPDYTTTLWKKGTVVVTDRLHQGIVAREDSDVYQLPAIESNGLIHYTHTSYTGFLKKFWNYTGLQAKHTEPSLRGLILEPGYHFIDLFLIQRVWMNGFKNILPALGRILTPPIVAMRSIIRQIQDN

SEQ ID NO: 3579 - protein, 257 aa, Unknown
  Description of Unknown: Candidatus Aminicenantes bacterium sequence
MEISAVIITFNEEKRLEPALKSLAGIASEIIVVDSFSSDGTVKLAKKYTKDVFQRKWTNFSDQKNFANNRASFPWILSLDADERLSPELREEILQIKNEEPDCSAFSMPRQVFYLGKWIRHSGWYPDRKIRLFQKDKARWEGEYIHEKLVVEGNVQKLKGVIHHFTYRNISDHLARVDKFSELGAQKLYTQKKKCRLYHLVFLPIFRFAKSFFLKAGFLDGYAGFIISVLHGYAIFIRYAKLREIWKKGERIESFPD

SEQ ID NO: 3580 - protein, 252 aa, Unknown
  Description of Unknown: Candidatus Ulvibacter alkanivorans sequence
MEKLTAIIPVGNEIHNIEAVIASVDFADEILVVDSYTTDGTFEIAEKMATRVVRRTFDYPAAQKNWTIPQAKHEWILLLDADERVTPELKEEVIEVLKNPPTDGTVAYWIGRKNHFMGQRVHYSGWRNDSVIRLFKRDACRYEDKYVHEEIIAKGKVGKLRSKLYHNTYISFDNYIQKMNKYASWQAKDYDKKTGRLTAYHFVIKPFWGFFKHYFVQSGFRDGVVGLTIGYIQGYVVFMRYVKLWLLRKGRQ

SEQ ID NO: 3581 - protein, 259 aa, Selenomonas noxia
MALNLSVLILAKNEEQNIEDCIRSVSFAGEVVVIDDFSTDRTAELARGLGARVVQRALAGDWGAQQTFAVQEAGCDWIYFLDADERVSPRLAERIKEIVAADDRRYAYANARLSYYFEQPLRHGGWFPDYVVRLLPREGTYVTGLVHPKICHPYQEVKLPKKEYLVHYPYRDWVHYLGKLNTYTTLAAQKSYNAGRRANLADMILHPVWASFRMYFLKCGFLDGRIGFVLAVFHYFYTMAKYVKLYYLDKTNRHTGDFS

SEQ ID NO: 3582 - protein, 330 aa, Komagataella phaffii
MVRTLILVALGLVVVALLVLYLLVLLFSHSPRNPFESELYFITTEKDGSKSAPLPLPVANSPSDGTIELSVVIPCYNETSRLKLMFDDSINYLKETLPDRFEILIVDDGSKDSTDSYALDLAHNTYNLKPGQLRVIKFEENRGKGGAVIHGLQHIRGEYGIFADADGASSFKDMSKLLAQVKNVENKNNDKIPAIAIGSRAHMVNTDAVVKRSFIRNFLMYGLHMLVYVFGIRQIKDTQCGFKLFNKSSIALIFPFMHTEGWIFDVEILIIALRKGISVSEVPISWHEVDGSKMDLARDSMNMAIDLVVTRMAYILGIYKDSVVTKTKVE

SEQ ID NO: 3583 - protein, 246 aa, Unknown
  Description of Unknown: Nitrospiraceae bacterium sequence
MLIPASIAIVTKNEEANIEAALDSVRDAAEIVVIDSFSSDRTVEICKKYTDKVIQKEWEGYARQKQAAVDLAAGPWVFILDADERFTPELKAEIINAIEENRHDGFNVPRKNFFMNRWIRHGGWSPDYTLRLFRKNAGRVEDREVHEKIVVSGSVSYLKNPLMHYTYNSVSDYLKRADTYSTLAAKELKKTGAAPSAPDFLLRPIATFIKMFFLRLGFLDGKYGLVLAVLYSYYTFLKYAKAWEMR

SEQ ID NO: 3584 - protein, 251 aa, Algibacter alginicilyticus
MTKLTAIIPTGNEIHNIEAVVASVSFADEILIVDSFSTDGTYEKALELDVKVIRRDYEYSASQKNWAIPQAKHEWVLLVDADERVTPELKNEILDTLKNPKDHIVAYWIGRLNHFMGEPVHYSGWRNDSVIRLFKRDFCKYEDKHVHAEIIAQGHIGKLKNKLYHNTYITFDKYIEKMNRYATWQAKDYDTKTGRLTPYHFVVKPFWGFFKHYIVQSGFRDGVVGLTIGYIQGYVIFMRYVKVWLLRKNRQ

SEQ ID NO: 3585 - protein, 252 aa, Mesonia mobilis
MKKLTALIPAGNEIHNIEEVISSVDFADEILVVDSLSSDGTYEKAVELADKVIQREYHYSSSQKNWAIPQAKHEWILLIDADERVTPELREEILSILKNPPTDDTVAYWIGRKNHFMGKPVNHSGWKNDKVIRLFKRDFCKYEDKKVHAEIIAKGKVGKLKHKFYHNTYITIDKHLEKMNRYGWWQASDYDKKVGKLTPYHFVIKPMWSFFKHYIIQGGFRDGVVGLTISYIQSYTVFMRFVKVWLLRRDRK

SEQ ID NO: 3586 - protein, 271 aa, Unknown
  Description of Unknown: Acidobacteria bacterium sequence
MRDEISSLSSLIPHPSSLMKITATIITFNEAENIRAACESVSWANEILVVDSESTDRTREIAAECGARVITRAWPGFAEQKQFAAEEAKHDWIFSMDADERVSDKLRHSIEDLLYTNEAQLANGYRIARRAFYMGRWIQGGGWYPDYQLRLYNRSHGHWQGMYIHESVKMKEGARVETLKGDILHYTIPTASYHQRMIGERYAPLAARQMFESGRRTSPARIATAGAAAFVRSYILKGGFRDGLAGYAIARFAAHNAFLKHLMLWEMQKKQ

SEQ ID NO: 3587 - protein, 298 aa, Unknown
  Description of Unknown: Candidatus Woesebacteria bacterium GW2011_GWB1_45_5 sequence
MNKVSVVINTLNEEKNLPRAVASVKDLADEIVVVDMESTDKTAEVAKKLDAKVFSHKKTGYVEPARNFGIGKAANSWILILDADEEIPGKLVERVKQIVKNPKADYYRIPRKNIIFGRFMKHSRWWPDYNIRLFKKGSVSWNEVIHAVPMTAGVGEDIEDREDFAIIHHNYDSIEQYLERMNRYTSQHAILMAKEGYRFNWKDLVAKPSNEFLSRYFFGEGYKDGIHGLILSLLQAFSELTLYLKLWQKEKFADTSPDLREVISVMRDEEKDLHYWQNDSQYKQSGKLTDRIRRKLRI

SEQ ID NO: 3588 - protein, 252 aa, Unknown
  Description of Unknown: Flavobacteriales bacterium 32- 35-8 sequence
MMQKFTAIIPTGNEIHNIEAVIASVDFADEVLVVDSFSTDGTFEIAEKLATKVIRRPFDYHALQKNWAIPQAKYEWILLVDADERVTPELKAEILEILKNPDPNIVAYWIGRMNHFMGERVYYSGWQNDKVIRLFKRDFCKYEEKHVHEEIIANGLVGKLKNKLYHNTYITFDKHIAKLNRYATLQAKDYDKKTGALTPYHFIIKPFWGFFKHYIIKSGFRDGVVGLTIGYIQGYVVFMRYVKLWLLRKNRN

SEQ ID NO: 3589 - protein, 251 aa, Polaribacter porphyrae
MTKISSIIPTLNEEIHIEAAIKSVDFADEIIVIDSHSTDKTIELAEKHNVKIIKRKFDDFSSQKNFAITQAKNPWIYILDADERVTPDVKKEILEAVQNPKEFVGFYVRRSFFFAGKRIKYSGWQRDKVVRLFLKDKCKYQGIVHETIKTDGELGFFKGKIDHFGYKNYNHFISKIHQYGELKAKELHARGKKVNLFHIIIKPTYRIFSHFILKRGFLDGYTGLILSITQGYAVLTRYIKLWILNRGLKED

SEQ ID NO: 3590 - protein, 299 aa, Unknown
  Description of Unknown: Candidatus Woesebacteria bacterium GW2011_GWB1_39_10 sequence
MASKISVVINTLNEEENLPRAIASINGFADEIVVVDMESTDKTVEVSKKLGAKVFFHKKMGYVEPGRNFAISKASNPWILVLDADEEVTQGLSLQIQKILKNPKADYYRIPRKNIIFGKWLKHSRWWPDYNIRLFKKGSVSWNEVIHAVPMTQGIGAELESEEELAIVHHNYDTVEQYIERMNRYTSQHALLRINEGYEFSWKDVITKPSNEFFSRYFFGEGYKDGLHGLALSFLQAFSELVMYLKIWQKEKFAEKDLTISEVNLLMRDEEKELHYWQGDSQFKESGKLADRIRRKFKI

SEQ ID NO: 3591 - protein, 254 aa, Polaribacter sejongensis
MTKITAIIPTLNEEIHIADAIKSVSFADEIIVIDSYSTDKTLEIAEKLHVKIIKRKFDDFSSQKNFAIDQATHNWIYILDADERVTPEVEKEILEAVKNPNGFVGFYVRRTFYFCEKKVNYSGFQRDKVIRLFLKEHCNYKGVVHERIAANGKIGFFKHKIDHFSYRNYDHYISKMNHYAAIRAKELHERGVKVNIYHVMIKPSARFFIHYFIRLGFLDGFTGFLVAKIQAYGVLTRYVKLWLLNNKKHLNGRI

SEQ ID NO: 3592 - protein, 256 aa, Unknown
  Description of Unknown: Calditrichaeota bacterium sequence
MNKISAVIITYNEEANIGRCLQSLQGVVDEILVVDAFSADRTVEICREFQAQVVQKSWEGYSRNKNFGNAQARFDYILSIDADEALSPELAHSILAAKSNLRGAYTMSRLTNYCGRWIRHGGWYPDVKLRLFNRQDARWVGDFVHESLEFVRRVPRIHLKGDLLHYSFHSLADHLQRVNTYSDLAAREILHRNPTGILFKMLFSPPAKFIKGYVFQRGFLDGFHGLCIAAISAFDVFIRYAKVYELQQARKAEEKP

SEQ ID NO: 3593 - protein, 296 aa, Unknown
  Description of Unknown: Candidatus Woesebacteria bacterium GW2011_GWA1_37_8 sequence
MISVVINTLNESARLADAISSVKKFADEIVVIDMESDDRSVEIAKDLGAKVFTHKRMDYVELARNFGISKASGDWILILDPDEQLCPSLSVKLKEEVKNNTADYFRIPRKNIVFNKWLKYSRWWPDYNIRFFKKGSVEWSEMIHSVPITTGRGADVDEREDNAIIHHHYDSISQYLERLNRYTNAQSAERVKKGEKFSWKDLLIKPSNEFLSRYFLGQGYKDGAHGLALSLLQGFSELIVFLKIWEINKFEKQNTPLSNVLTTLKIIEKDFHFWEADSMVKENGGLVYRIRRKLKV

SEQ ID NO: 3594 - protein, 251 aa, Psychroserpens burtonensis
MIKLTVIIPTKNEIDHIESVIASVDFADEILVIDSFSNDGTFEKAQTLATKVLQREFDFYGVQKNYAISRAKYEWILLIDADERVTADLKTEILSILNDGKICHDAFRIKRINHFMGQRVNYSGWQNDNVIRLFKRDLCQYNDRNVHEALQVNGTIGELKHSFLHYSYRSFDLYMQKMNHYANLQAKDYDDKTGRLTPYHFIIKPFWGFFKHYIVQSGFRDGIVGLTIGYIQGYVVFIRYVKLWLLRRNRN

SEQ ID NO: 3595 - protein, 253 aa, Aquimarina sediminis
MIKLSGVIITYNEERKIEQCLASLQGVVDEIVVVDSFSTDKTEEICKKYNAKFVKQKFLGYKEQKNFVITQASHDYIISLDGDEALSPELRESIIKLKSNWVHDGYYMNRYNNFCGQWINHSDWYPDKKLRAFKKGKGEWKGINPHDSYKLYNPKKCGKLKGDILHWNYPTYSAYNTQIEKFSTISAHSYYELGKNATLWKILFNPTWAFFKAYFLRLGFLDGLNGFLICIQTANLTFLKYVKLRELIKKNKE

SEQ ID NO: 3596 - protein, 256 aa, Thermocrinis sp.
MSLSVLILTKNEERNLPRAINSVKDIADEIVVLDSGSTDNTVELAKSLGAKVFYHPWDGYANQLNRGIELCSKDWILVLDADEEVSKELKHSIAEALRSKKADVFMVCRRTYYLGGFLKHAWYPEWRVRLFKKGTVRFEGELHEKTIFKGKAKKLKGDLYHYSYGSLYEQYEKTIRYAKIMAEAYQKEGRRFRVYNLVFNPLWSFFKVFILQRGFLDGLRGFSVAVSSFIYTFLKYLFLLELEMKEKYKEKLWKRS

SEQ ID NO: 3597 - protein, 276 aa, Bacteroides ovatus
MTVIILTKNEEANIERCINSVRGWVERIVVVDSGSTDRTVELAENLDAEVYNHTPFENHGKQFNWALDNLQIDSNWIFRVDADEVVTPELAQEIIESCRLHKDDDVNAFEMRFKVYFLGRFLKHGGAYPFCKINIFKKSKARFNERPLGDNIELSEGRYLQLKNDCLHYDYKNLSTFIHKHDWYADLEVQSYYSKLDNLEANISKAANVRKVLRNGIYYKLPRYFRAKMYYWYKFYIKLGFLDGEAGHVWAFLQAYFYRFVVDAKIAEQELMKNKN

SEQ ID NO: 3598 - protein, 477 aa, Paenibacillus sp.
MPTQHEHIISLIQDLKFAEAETELKQAISHTPLDGQLWVMLGETLLLQSQGQAAKRVFDRAWLLDPQAQWIKPIYKALQQVAQGDNRNDIDELLTVPKITVAAAILTRNEATNISKCILALQGAVDEIIVVDSSTDDTPRIASQYPKVKVIRITWEDDFAAARNKGLQHVQSDWVVWVDADEVLVPEDVPSIREVAGVFQHLDIIPALHIWQVNHVNGIVHHDFSQIRMFPVRRGIRFHGRVHEQVGTNKGIYHNDIYRRAVKIRLNHHGYEPSILQSRRKLERNLRLLKLMIQEEPENPGHWLYYGRESIGVGEQEQAYTALLEAERLGLLLPTFGRMSDVYKLLFQIMMVRKNYSEAEAYCLKSIAHNPAFPDAHYMLSQVRIKQADELLRLAEASIKQSLTCLPNYRGSVSADYQIAEWKAELTLGELAMRSGRLSIAKSIFAKHVKHSGGMYNLKDKLATIEAERQRLNDQSK

SEQ ID NO: 3599 - protein, 262 aa, Unknown
  Description of Unknown: Acidobacteria bacterium sequence
MKISACIITFNEQKNISRAINSVKWADEILVVDSESTDRTREIASELGAKVIVQKWLGFGAQKQFAVEKASNDWILSLDADEEISTKLQEEILFLKNSGPSADAYRISRLAIYMNRPIRHCGWYPDWQIRLFNRNKGRWKDFIIHESVEMQPNSSVEKLRGDILHYTVESLAHHSRMTTERYAPLAAQQMFENGRKTSILKIVTAGPTAFIRTYFLKLGFLDGFPGFCISYFAAHNATLKHMLLWELQNSQNLNKRLSQTGT

SEQ ID NO: 3600 - protein, 251 aa, Unknown
  Description of Unknown: Aquificae bacterium sequence
MLSVLILTKNEERNIERAIKSVQGLAKEVVVVDSGSTDRTVEIARDLGAKVFFREWEGYASQLNYGVEQCSGDWVLVIDADEEVSQELRESIRKELKNPAHEVYMLSRKTYYLGGFLNHAWYPEWRVRLFRKRKVRFEGVLHETPIYTGSVGKLRGDLYHYSYEDLEDQYVKTVRYARKMAELMKGKGKRFRLYNLILNPLWHFVKVYFVQMGFLDGLRGFLVAFSALFYTFLKYKFLYELELKDRKPDLW

SEQ ID NO: 3601 - protein, 250 aa, Oceanihabitans sediminis
MEKLSAIIITKNEIHNIESVIQSMQFADEIIVVDSFSTDGTFEKAKSLNVTVIQREFKYHAEQKNWIIPQAKHDWVLIVDADERVTPKLEEEIIETLNSNPKHIAYWIGRNNHFMGKRVHYSGWRNDKVIRLFKRDLCRYEDKLVHEEIIAQGSVGFLKEKFYHNTYTTIDAYLEKMNRYATQQAAEYDKKTGKLTPYHFVLKPFWGFFKHYIVQSGFRDGVVGLTIGYIQGYTVFMRYVKLWLLRRGIK

SEQ ID NO: 3602 - protein, 314 aa, Unknown
  Description of Unknown: Firmicutes bacterium sequence
MIVRDEEENLPRCLESVRGLVDEIVVVDTGSRDGTAEVARRYGARVLHQPWADDFAAARNRSLDEAGGEWVLVLDADEELGPEGREALPGLLARPEVEGYLVRIVNFLGEGPHPPQEETAGLRLFRNRPEYRFAGAFHEQIAPSILAARPGARLEPSPLRILHRGYQPAVRRRREKHRRNLRMLERMRAEAPDDPFLLYLLGVEHLAEGEAGAALPYLEEACRLAPPDRAWRPKLVKSLAAALAEEGRWADLLAWLGPELERYPDYTDLHYLAGLAAQGLGRHQEAAAAFRRCLALGPAPSPPYGSVDPAAGGA

SEQ ID NO: 3603 - protein, 279 aa, Unknown
  Description of Unknown: Candidatus Amesbacteria bacterium GW2011_GWC2_47_8 sequence
MLSVVITAWNEEKNIGRAISSISRLANEIVVVVDAATTDKTAETAKKLGAKVFPHAHTGIVEHIRNFSISKAIGDWILLLDADEEVPPALAKKIKELIKDSAVDYYRLPRKNIIFGKWITSDHWWPDYVYRLFRRGTVTWEDTVHSIPVTQGRGADLPAKEEFSLVHHNYSSISQYLERIDRYSEAAIPTSFTPADLVTKPIAEFLSQYFARRGYTQGLHGLALAGLQMFSEFIRFLKAWEHQGFAETKFSQADLTHELKSKAREYRWWNSPTWLRRWI

SEQ ID NO: 3604 - protein, 332 aa, Lachancea lanzarotensis
MWDALWSQVRETNATVMLGTFLVVVLSSLYVVVLILSHWPRKPFAEELLYRSNGFQGDEISGQLVSVKDSEENVDGIELSVVVPSYNEVGRILVMLTDAIEFLQKKLENKWEILIVDDGSRDGTSEYCLKLAHSTFKLQPGQLRVIKLGKNRGKGGAVRHGMLHIRGNFGLFADADGASKFSDCEKLLGAIKKSDENGKGAIAIGSRAHMVNTDAVVKRSFVRNFLMYGLHTLVFVFGIRSIKDTQCGFKLFNRPAILQIFPYLHTEGWIFDVEILILALKKQIPIKEVAISWHEVGGSKMELARDSINMAKDLVTIRLAYIMGIYSGKSEC

SEQ ID NO: 3605 - protein, 295 aa, Bordetella sp.
MNRIPVSVVVMTKNEERNIEKCLRALGDFDEVFVIDSHSTDRTAELARGLGAIVVPFQWNQKYPKKKQWCLDNLPFSHDVVLYVDADEEVTPPLAREIAEALPRFEQGLGGAFVGFDYVFCGKPLRHGHRVYKLVLMHRQRGRFLDYNDLDVANMWEVEGHYQPEVEGGTMVMKGRMIHSDHDGLFHYFDKHNRYSDWEANLRVKGLMNDPREANMGMRSLLKRIFQALPFKAPAVFLHSYLFHLGFLDGKVGLDYAVARAMYYWQIGLKSREVRDTLRRAEQAARPSSVSQSAR

SEQ ID NO: 3606 - protein, 596 aa, Nitrolancea hollandica
MPEADNAPLPLAIIVLTLNEERHLRGCLASAAGLAGRLLVIDSGSQDRTPEIARMSGAEVLDRPFTGFASQRNAALDLVDQPWVLFLDADERITPALRREIREAIQQAPDNIAGYWVPRRNWMFGRELQGGGWWPDYQLRLLRHGRARYQTGREVHEVVDLDGDAGRLTEPLRHLNYDSIADFREKQLRYARLRVDVLHAEGKHPRNRTFVGQPVREFGRRFVSLGGYRDGLLGLFLATSMAWYELRSWLWLRQRLAEARIGGSATESEQDRNWAGLGPALDNLDLSLIIVSYNVRDLLIACLESIQAALASSRLRYEIIVVDNASNDGSPASIRQLFPGVRLIENTENLGFAAANNRGLRDAGGDVMVLLNPDTTIPSGTLEALFDYLNEHPDTGIVGPRLIYPDGSTQPSRRRFPTVLTGLLESTIVQDYWPENPAARRYYLADRPDDVTQDVDWLVGACLMARREVFEQAGVLDEAFFMYAEEVEWCHRVRKAGWRIVYLPEVTIVHHEGASSRQNVPARQINFDTSRVLLFERLHGRQIARFLRGYLLATYIARIGIEGSKGLLGHKRPLRRTRVALYWQALTSGLRPGQHR

SEQ ID NO: 3607 - protein, 251 aa, Lacinutrix himadriensis
MTKLTALIPTGNEIHNIEAVIASVSFADEILVVDSLSTDGTFEKAQALATKVIRREYEYSASQKNWAIPQAKHEWILLVDADERVTPELKAEIQTLLNQPEIEHDAYWIGRMNHFMGERVHYSGWRNDKVIRLFKRDLCTYEDKHVHAEIIVNGTIGNLESKFYHNTYITFDKYLEKMNRYAWWQAKDYDKKTGKLTPYHFVIKPLWGFFKHYFIQAGFRDGLVGLTIGTIQSYVIFMRYVKLWLLRKGRE

SEQ ID NO: 3608 - protein, 251 aa, Bizionia paragorgiae
MIKLTAIIPTKNEIHNIEAVIATLNFVDEILVIDSYSTDGTFEKAQTMATVVIQRKFTSYSDQKNYAISQAKHEWILLVDADERVTPELKTEIKSILNLEKIPHTAYRIKRQNHFMGQRVNYSGWRNDSVIRFFKRDYCKYNNKHVHESLIVNGSVGSMKGKFLHYTYRSFNLYMEKMNRYANLQAIDYNDHTGTLTPYHFVIKPFWGFFKHYIIQSGFRDGLVGFTIGYVQAYVVFMRYVKLWLLRKGRK

SEQ ID NO: 3609 - protein, 258 aa, Unknown
  Description of Unknown: Acidobacteria bacterium sequence
MNRLSACLITLNEERNLPRALRSLEGVADEIIVVDCGSQDRTQEIARAYKAKAIIREWTDFAQQKNFAAASASGDWILSLDADEELSHELQQSLLAWKQQEPEFPVYEVARRAWYLGGWIKHSGWYPDYQRRLYQRDVASFQGIVHESLAFQGKAGRLRGDLSHYTMNSLAEHEEKVERYTTLAARQMYEAGKRRWRAAMWLATPWTCFSTFVLRGGVLDGSRGWLISRMAARGVWLKFRKLGDLIETERHGRTIEAP

SEQ ID NO: 3610 - protein, 295 aa, Unknown
  Description of Unknown: Acidobacteria bacterium sequence
QSSFVDLPISVIIPVRNEAQNLPRCLESLHGAGEIIVIDSQSSDETCEVARRRFAQVVQFHYHGGWPKKRQWAIDNLPLKFDWVLLLDADEALTTQLKQEIRAAISCPEINGYWIKLQMHFLGRRLRHCGATFSKLSLFRHGKGHFECRIADQDSSMCDIEVHEHVMVDGQTARLQSAIVHNNVSSLSRYLEKHNEYSNWEARVWTETADNAGSLPPALFGTQAQRRRWLRKHFFMLPGSPLFLFLYRYLFRFGFLDGKPGLFYCALQAIQLFQVKAKIYELRLRQAAPARVEPC

SEQ ID NO: 3611 - protein, 251 aa, Unknown
  Description of Unknown: Bacteroidetes bacterium sequence
MKQKITAIIPTLNEEDFIEDAIGSVSFADEIIVVDSFSTDKTVEIAEKNKVRVIQRKFDNFSNQKNYAISKAKNDWIYILDADERIPVELRQEILNAMENPNDIVGFNIYRKFYFLKIKISYGGWQADKVIRLFRRDRCEYNGNLVHETINFNGAIATFKSKIDHYSYRGYDHYVNKLNLYASFQAQELYENKKRVNVFLITLKPPFRFFVHYVIRRGFLDGYPGFILATLHAFGVFTRYVKLWLLYKNEK

SEQ ID NO: 3612 - protein, 251 aa, Gelidibacter algens
MQKLTAIIPTGNEIHNIEAAIASVDFADETLVVDSLSTDGTFEKAQELATKVIRRDYEYSASQKNWAIPQAQHEWILLIDADERVTTELKSEILEILKNPDPKIVAYWIGRTNIFMGEQVNYSGWRNDKVIRLFKRDFCNYEDKQVHAEIIANGDLGTLKHKLIHQSYTTLDNYIEKMNRYATWQAKDYDKKTGTLNPYHFVLKPFWGFFKHYIIQSGFRDGVIGLTIGYLQGYVVFMRYVKMWLLRKNRS

SEQ ID NO: 3613 - protein, 284 aa, Geminocystis sp.
MELSVIILTHNEEANLPTSLSSLKKLEAEIFIIDSGSSDRTVEIAKEYNCQVFNHPWENYAQQLNWGLKNLPITTPWIMRLDADERLTPELVAEIKEKLPLTPKNVGGYQMKRRVFFMGRWIRHGGYYPTWLLRIWRNGIGICEQRWMDEHIILSEGKIIDLQNDIIDENQKGLSFWVNKHNSYADREVKDMLAMEKAEENQQNILDNSQTSQASQRRWVKKNLYVKSPLFFRVFIYWLLRYTVGLGFLDGIEGMMFHFLQGFWYRFLVDAKIYELKHQSRLTQ

SEQ ID NO: 3614 - protein, 245 aa, Unknown
  Description of Unknown: Flavobacterium seoulense sequence
MSRLTVIIPTYNEIDYIEDAIKSIEFADEIIVIDSFSSDGTKEKAIELGCIVLDRKFDNFSSQKNHAIAKATGDWVLFIDADERVSQKLKIEILSVIKNGKHQGYKLQFPHFYMNRFLYHKVDKVVRLVKNDSISFSGDVHEKLLFKGTVGTLKNFMIHYTYKGLFHLIQKKDSYAWFQANTSFKKGKKATYFHLIFKPFYRFFSSYILKRGFMDGVPGLALASINAYGVFSRYAKIILIEKGLK

SEQ ID NO: 3615 - protein, 258 aa, Unknown
  Description of Unknown: bacterium HR17 sequence
MPLSVIVLTRNEATNIERCLNSVAWADEIVVVDAESEDETRAIAEQMGAKVIVHPWQGAGAQYALGIAHATGDWVLVVDADEEVTPELADAIRCVIVNPDALDGYRVKRVNYVLGRWLRYGGWQEWVVRLFRRDKVISPPTLHPRFQVQGRVGYLPYPLRHYMAPDLLDWWQRSFRLARTEAAVEFLQGVRFSGWALLGGFWKFVRRFIFKGGFLDGWAGFYACLHRFLYIAVKQAHLLELERGKSSRAQRPETAPFK

SEQ ID NO: 3616 - protein, 256 aa, Sugiyamaella lignohabitans
MSVVVPCYNETGRLGLMLDECVPVLNEEFGNSWEILLVDDGSKDGTDQFALKWAMDHKLPPLSLKVTKLEKNRGKGGAVTHGMKYVSGKYAIYADADGASNFSDIKKLLVKIKDDKLGVAIGSRAHMVNTDAVVKRSFIRNFLMYGLHTLLYVFGIRTIGDTQCGFKLFTRDALKLIFPFMHTEGWIFDVEVLILAMKKNIPIYEVPISWHEVEGSKIELARDSIKMAIDLVIMRFAYLLGIYQAHKVTIDNKKDR

SEQ ID NO: 3617 - protein, 250 aa, Tenacibaculum sp.
MTKITAIIPTLNEEIHIEEAIKSLGFADEIIVIDSMSTDNTVELAKRLNVKIILRKFDDFSSQKNFAIDQAEHKWIYILDADERVTPEVQKEILEAVKNPGDYVGFYLRRNFFFMKKNIKYGGCQRDKVVRLFLKEFCRYDGKKVHETIVANGKLGFFKHKIEHFSYRNYNHYIAKIHRYAALRARQYHEAGKKVNVYHMLVKPPVRFVIHYFIRRGFLDGFEGLIFAKVHAYSVFTRYVKLRLLNKGIK

SEQ ID NO: 3618 - protein, 309 aa, Unknown
  Description of Unknown: Candidatus Woesebacteria bacterium GW2011_GWF1_40_24 sequence
MRTSIVIQLGMSSRISVVINTLNEEKNIKRAILSVKKLADEIVVIDMESDDKTREIAESLGAKIFTHKKTGYVEPARNFAIGKATGDWILILDADEEVPQGLIPEIQKILKSSKADYYRIPRKNIIFGRFIKHSRWWPDMNIRLFRKGFVSWNEIIHTVPLTQGVGEDFPEKEDIAIIHHNYDSIEEYLERMNRYTTHHAKIKIDEGYKFSWKDIMVKPMAEFLSRYFYGQGYKDGLHGLALSLLQAFSEFIVYLKVWQTGKFEEQDLKLSEVASLFREQEKDLHYWQSNSFVNEGGGLLDRIRRKLKI

SEQ ID NO: 3619 - protein, 294 aa, Unknown
  Description of Unknown: Candidatus Daviesbacteria bacterium GW2011_GWA1_42_6 sequence
MLKISAALATHNEEKNITDCLKSVQGLVDEIVVVDGNSSDKTAEIARSFGAKITQIPNDPMFHNMKQKAFDLATGDWILYLDADERVSGKLGEEIKMVITMDNTRVDEYQKGLKDKDLFLKHQKILELRDGQIGNGTDEYVAFFFPRLNYFLGKYLRFGGAYPDGVIRLFKKGKAYLPCKDIHEQMVVDGKVGWLQNELLHISDPTFGRYMERNSRYINLIADELRRGKVGKNPWQLLNFFFVKPIWWFLLTQIRHKGVLDGLQGIIFSFFSALRFPRAYFRYLRSKGEIKVLP

SEQ ID NO: 3620 - protein, 259 aa, Unknown
  Description of Unknown: Candidatus Omnitrophica bacterium 4484_70.2 sequence
MSKIAAVVLTKNEEVKIEKCLRCLQSFVDEIIVVDDNSEDKTVEICKKLGAKVIINESGGNFDKQRNIGIEKASCDWIIQMDADEIIPSETAVKIKEAIKNPSDYVAFKLRRKNFLFGHPLRYGGAYNWGIKLFRKGKAYYTGSSVHETLKVDGKVGRIDADIYHYPFTSMRDIFERTNFYTEVESKLFVENKRSVSFKEIKYRLTWKSLKLFWKLYVKKKGYKDGMYGLVWCILNVIGPQIRWLKIWEKALKEKKIEE

SEQ ID NO: 3621 - protein, 320 aa, Kluyveromyces lactis
MEVSKMPFDADLKVLLASCLVGLVLSLYLVVLLLSNNPRKAFANELQYRSIKDGSVVHEPLPNIDDDSSDGIELSVVIPSYNETSRIKIMLEEAISFLQNEMKGKWEIIIVDDGSSDGTSEYCMDLAKNHFKLNDGEFRVVTLEKNRGKGGAVRHGMLHSRGEYLLFADADGASKFSDVAKLLANTKVDAPEVSIGSRAHMVNTDAVVKRTIIRNFLMYSLHALVFIFGIRSIKDTQCGFKLFNRKAAKEIFPKLHTEGWIFDVEILIVALRKNIPINELPISWHEVDGSKMDLARDSINMAKDLVIIRLAYILGIYSDK

SEQ ID NO: 3622 - protein, 261 aa, Unknown
  Description of Unknown: Kiritimatiellales bacterium sequence
MEKKQDSIKPAVTACIVSFNEERNIRRCLESVKWCDEIIVVDSFSSDRTVEIAREYTDKVIQREWPGFRAQKEFARLQGGNEWSLQLDADEEISPKLKAELIEAMKCNDGSVNGYEIPRMVNYFGKWIRHGDWYPDRKLRLYRKERGRVVGGEIHEYVAVEGKVKRLRNPIFHYTYDDLTHHLQTLNRYSTISAEEMYKRNRRTYWPDILLRPFWKFVRGYVFRMGFLDGSAGLVIALLSSFGVWMKYLKLRNLQRGLILS

SEQ ID NO: 3623 - protein, 325 aa, Unknown
  Description of Unknown: Acidobacteria bacterium sequence
MAERSHPFFEAPDHDLRSRALSAEQLPVSVIIAARNEAANLPRCLESLPGMGEIYVVDSQSTDRTVEIAQSFGAKVIQFHYAGGWPKKRQWALDTLPLSFDWVLLLDADEVVTPELSSEMRHAIRDSSVTGYYIGLDMVFLGRRLRHGGAGFYKLALFRRWQGRFECRTQQQDSSMCDMEVHEHVIVDGATRRLNHRLLHHNVENLDRYIHKHNQYSNWEACVWTSADQQESQIRPRLFGSQAQRRRWLRRRFFWMPGSPVFFFLHKYLFCLGILDGIAGLIYCGFQGIQFFHIKAKIYELKHVPSRGRSLPSELSARELTHVRN

SEQ ID NO: 3624 - protein, 249 aa, Unknown
  Description of Unknown: Flavobacteriaceae bacterium CG_4_10_14_0_8_um_filter_31_99 sequence
MTKITAIIPTLNEEIHIADAIKSVSFADEIIIIDSFSIDKTLEIAATYEVKIIKRKFDDFSSQKNFAIDQATHSWIYILDADERVTPEVEKEILEAVQNPKDFVGFFVKRTFYFCGKKINYGGCQRDKVVRLFLKESCKYQGIVHETIVSVGKFGFFKNKIEHYSYKNYDHYISKMNHYGALRGKELFEKGKKVTLYHFLVKPPARFLKHYIIRFGFLDGFAGYIFAKTQAYGVLTRYVKLWLLHKKIN

SEQ ID NO: 3625 - protein, 253 aa, Aequorivita capsosiphonis
MENPTKISALAITLNEAHNIEAYLKGLWFADEIVIVDSFSSDETVALASKHEKVKVYQRKFDNFSSQKNFAISKANNDWVTFFDLDEEITPAVAMEILQVSKKPKAIAYFVKRDYNFMGKRIKYSGFQTDYVIRFFNKNKCRYNSNLVHETIDANGKTEKLSHSVPHHTYKSFDHYTGKLHQYSELQAKMLYEKGKKPTLYHFLFRPWYRFWHQYVIRLGVLDGKEGFILAYVSAFSVFKRYVNLWLLYRKIN

SEQ ID NO: 3626 - protein, 265 aa, Unknown
  Description of Unknown: uncultured nuHF2 cluster bacterium HF0770_13K08 sequence
MNLSVTIIGHNEVDHLRELLPQLKWATEIVYVDCESQDDSLEFARDLGCRVFSRPNNTNLNVNKSFAVDQASGDWVFYMDPDERLPELLVMEIEETLENTVNTAFRLNRRNHYFGHWLRHGSQYPDTQLRLFQRGSASFPNQHVHEKLVVEGSIGSLQNDMLHFPYLNISQFLSKFEFYSGVEAGYLRDADVQVTAGNSIRFLLLKPFSRFLRRYLFKGGFRDGFPGLFCAIFDALNFVVRYFKLWEQTNNPPAKREQQGPDSRP

SEQ ID NO: 3627 - protein, 299 aa, Unknown
  Description of Unknown: Microgenomates group bacterium GW2011_GWF2_45_18 sequence
MNVRNAEDTLERALRSAQALADEIIIMDMESTDRTVEIAQAFTSKIFSHSNLQYADPARNLAIKEASCDWVLVLDADEWLTPSLIEKIQHITQDSHSADCYSFPRKNYIWGKWIQHTGWWPDHQLRLFRNGQAKWQGDIHQKATPLGSHIELEATEENAISHDNYPTVEQFLERLNQYTSIQASQEKKTQSFTSSDALLRFFSEFMRRYFALEGYKDTQRGTSLSLLQGMYELVVALKSAEAKELLDSSEKSDTAQTLHRISLELMYWSHHMQAQQGKSIQKIWHTLLKKLIALFIKFS

SEQ ID NO: 3628 - protein, 284 aa, Unknown
  Description of Unknown: filamentous cyanobacterium ESFC-1 sequence
MFSIYILTYNEEVEIAACIESARDLCDDIVVVDSLSRDRTVEIAQQYNVRVVQHAFESHGRQRTWMLEEVPTQHDWVYILEADERMTPELFAECVQATQSGEDIGYYVAERVLFMNHWIRHCTQYPRYQMRLFRKGKVWFDDYGHTEREVCDGPTGFLKETYPHYTSGKGFARWFDKHNRYSSDEAQETIRQLEKGQVRWGQIFLGQTEVERRRALKDLSLRLPFRPLVRFFYMYFFLGGWLDGSPGFTWCTLQAFYEYMIVLKVWELKDSPESRSTPPKIESS

SEQ ID NO: 3629 - protein, 251 aa, Gelidibacter sediminis
MIKLTAIIPAGNEIHNIEAVIASVDFADEILVVDSYSTDGTYEKAQQLATKVIRRDYQYSASQKNWAIPQAQYEWILLIDADERVTPELKNEILKILQQPDPHFVAYWIGRTNMFMGEQVNYSGWRNDKVIRLFKKDFCRYEDKQVHAEIIAHGAVGVLQHKLIHHSYTTLDNYIAKMNRYATWQARDYDKKTGSLTPYHFVLKPFWGFIKHYLLQSGFRDGVVGLTIGYMQSYVVFMRYVKLWLLRKNRN

SEQ ID NO: 3630 - protein, 280 aa, Leptospirillum ferrooxidans
MIPLNSVGPSVNEDDNASFEKERLSVCLITKNEEQNLKRCLDSLIGLADEIIVVDSGSTDRTCEIAKDFGAKVFQHPFDDFTRQKTRSIEKASSSWVMVIDADERVTPELKAEILQYLIHPETIRSINGFYLNRLNFFLGTPIHHSGWSPDWLLRVFRKESGGLDGRAVHESIVVSGQTMRLHGLLLHDTHPTIERFVTKNLAYARLWAKERSSTRGPSLMGVLFHPPAMFLKMYILKMGFLDGFLGFVLAVLYSYHVFIKYLMLYKVNIPLTDRDGVDS

SEQ ID NO: 3631 - protein, 276 aa, Unknown
  Description of Unknown: Verrucomicrobia bacterium sequence
MISVIILTHNEETNIARCLDSVSWSDDILVVDSFSEDRTVEISKRHGARVIQRAFEDFSSQRNFASEQGNLKHEWVLHLDADEVVTPELRAELARAMFGDKDAYRVSSKLIFCGKFLRHAGLFPWYQVRFGRKQALRFKQVGHGQRETLEPGRIGTLKSSLLHFNFSKGLCDWIEKHNRYSTAEARQNVYGYADDDVRILDLFSITTDRRRRAAKKIFRRLPCRATLRFIYMYLFRGGILEGKAGFTYCRLLAWYEWLIVWKEREIRERARGKTQR

SEQ ID NO: 3632 - protein, 251 aa, Unknown
  Description of Unknown: Microgenomates group bacterium GW2011_GWC1_38_14 sequence
MTISVVLATFNEEKNLEECLKSVKELADEICVVDGTSTDRTVEISKRFGARIIVRENPPMFHINKQKAIDMATKDWVLQLDADERVTPELEKEIREVINDQNYNGYWIPRKNWFLGRFLMKGGQYPDYTLRLYRRGKGNLPQKDVHEQAVVDGKVGYLKNPLVHIADPELKRYLMRWNRYTDIMASDIIKEGKRKDPIFALKNLFILPSWWFVLTYFRHKGFMDFWQGFLFSFFSSIRFPASYIKSWISKK

SEQ ID NO: 3633 - protein, 304 aa, Unknown
  Description of Unknown: uncultured bacterium sequence
MAKVKISAVVNTRNESENIFDCLKSLGFCDEIVVVDMESEDNTKEIAKQFTDRIYDHKAVGYVEPGRNYAIRKALGDWIFVVDADERVPRTLAAKLIEIADKNEVDFVRVPRKNLVFGQWLRHSRWWPDFNIRFFKKGSVEWQDEIHSVPITYGTGINLEEEVGQALEHHHYRTIDEYFLRALRYSGQQSKELIDSGYKFDPADLIKKPTGEFLSRFFAGEGYKDGLHGLVVALLQFFSILLVYLKVWQAEGSKPRNEREFTPIWQAGFREKFKEFRYWFLTSKLENSESKTESFFLKLKRKLL

SEQ ID NO: 3634 - protein, 289 aa, Unknown
  Description of Unknown: Candidatus Amesbacteria bacterium GW2011_GWA1_47_20 sequence
MKISVVINTLNEVKNLPRAVASVKDLASEIVVTDMGSTDGTIEVARKLGAKVFSHKKLNYVEPARNFAIGKAQGPWILILDADEEIPQNLVKKIKQIVGVPEADYYRLPRKNIIFGKWIEHTRWWPDYNIRFFKKGFVSWGDEIHSVPFTQGKGFDLPQKSDFAITHFNYEGIIQYLERMLRYTEIESKELMKNGYVFSWRDLVRKPLGEFLSRYFAGQGYKDGVHGLALSLLQSFSELTLYLRVWETQGFSDQKISRREISLELGKSVKDLRWWIRKEFSWLRFLMSR

SEQ ID NO: 3635 - protein, 251 aa, Arenitalea lutea
MQKLTAIIPTGNEIHNIEAVVASVNFADEIIVVDSLSTDGTYEKAKELGVKVIRRAYEYSASQKNWAIPQAKHEWVLLVDADERVTPELKSEILKILKNPPEPIVAYWIGRNNHFMGERVNYSGWRNDAVIRLFKRDFCKYQDKHVHAEIIADGDVGRLKEKLYHNTYITFDKYLEKMNRYAWWQAKDYDKKTGKLTPYHFIIKPFWGFFKHYILQSGFRDGVVGLTIGYIQGYVVFMRYVKLWLLRKNRQ

SEQ ID NO: 3636 - protein, 291 aa, Unknown
  Description of Unknown: Candidatus Woesebacteria bacterium CG06_land_8_20_14_3_00_39_ 27 sequence
MISVVINTLNNEEEVSRAIASVKGLADEVVVCDMESSDKTVDVAKKLGAKVYNHKKEKYVELVRNFMVSKVEDGERSRTNWILILDPDEEITSKLSSKLKEIIKHPQADYFRIPRKNIIFGKWIKHTNWWPDYNVRFFKKGFVSWNEVIHSVPMTQGKGIDLPEKEEYAIIHKSYKTISNYFEKILRYTDAQRDNLLNAGYVFSWKDLVKKPLAEFLSRYFASEGYKDGVHGLVLSLLQSFSELTLYLKVWEKQGFDDKILKKAEIKKELNKGTSDLKWWLRKKFSWLKFL

SEQ ID NO: 3637 - protein, 253 aa, Polynucleobacter asymbioticus
MPTLSVILITRNEEVNLEDCLASLEGIARQIVVVDTNSADRTLEIAQKYGALIAQPTDWPGFGPQKNRALELATGDWVLSLDADERLTPALRSEIQTAIHHNAHVDCFAIPRLSWYCGRFIRHSGWSPDYVDRLFKRGSAHFSDDLVHERLIPQGQVARLKNPLLHFSFMNFSQVLQKLDRYSTASAEQAFAKGKTSSPLKAVLHGIWAFLRTYVIRAGFLDGTQGFALAISNGQGTYYRYMKLWHLHQEAGK

SEQ ID NO: 3638 - protein, 260 aa, Unknown
  Description of Unknown: Chrysiogenales bacterium sequence
MEPGGIKISAVIITYNEEDRLPDALDSLQGAVDEIIVVDSYSTDRTPEIARQARATFYQNRFEDYGQQKNIAMQKASHDWILNLDADERVSPELKRSISDLKEGNIPIKASAYAIKRKTYYLGRWIRHSGWYPDRKIRLFKKNAATWQGRIHESLKVTGVVASLPGEILHFTYRDIGDHIRRLERYSTFLSEEIISQKKKCLILRLLVLPPVTFLRHYFWRLGFLDGFAGLVIASVSSWGTAMKYFKAIDLKRSAPRQAK

SEQ ID NO: 3639 - protein, 249 aa, Polaribacter sp.
MTKITAIIPTLNEEIHIEAAIKTVSFADEIIVIDSYSTDDTVLLAEKHKVKIIKRKFDDFSSQKNFAIEQAKHPWIYILDADERVTPQVKKEILEAVENPKGKVGFYVRRSFYFAGKKIKYSGWQRDKVVRLFLKEFCKYQGIVHETIKTNGEIGFFKGKIDHFGYKNYDHFISKIHQYAELKARDLHAKGRAVHAFHLVIKPIYRVFSHFILKRGFLDGYTGLILSITQGYAVLTRYIKLWLYNRNVK

SEQ ID NO: 3640 - protein, 428 aa, Xenopus laevis
MFQQISVDEPPPEGCSAFVAVHGMHTCKPSQIKKLLKEAPERPRPYIYKTDHTFPTLTKTAPVAILYAEVGTKDFAKFHKTLTEKAETGEIIYVLRHYIQHPDERKMLLSGYGVELAIKSTEYKAMDDTQVDANNSSPKPDNGIAEEVQGFYFDKLMQMYPDLKENLGEFRKHLIESTNEMVPLKVWELQDLSFQAASKIISTPVYEALKVLRDMSQNFPIKARSLTRVALNQEMKKEIEVNQKHLSETFGIHPGDASLYINGLHIDLDVHNSFRRNLLIWTGNIMSWYFFKCYIISITFIKIHTTHFCFLETIKTEGKTLNGLSALGINNQDLSKYLRIQVHSSDENYALDIRHSSITWINDIETDHMYSRWPSSVQELLRPAFPGVIRPIRRNFFNLVLFVDPVQENAADYVKLAELFYRHNVPLR

SEQ ID NO: 3641 - protein, 288 aa, Wuchereria bancrofti
SDARQYDLAVRLAGYLLEEARVNLLKFALSLRAHSPTVLLFQRLGTERKKSCAAFADVHGTLTCDVNEFKKSYRKGPVPTVYSIDHIFPATKEHNVTLIVYGELATPSWRKFHLTAKALSRSGKVKYVLRHFVKDVRDDKPLLSGYGVELAIKSTEYKAVDDSNAVTDKVAVEESSEEYVDNEEDNYGFNFSTLRRLHSDLKESIGQFRLHLLERDELTPLKVWQVQELSYQAAQKIVQADPQKAINIMVDSSQNFPLAARSLSRQIVRKEFISEVVSNDFYFQNRFL

SEQ ID NO: 3642 - protein, 443 aa, Perkinsus marinus
MLEDLSPTPQELSEVIKNGQAWARAKALPFPAVVVNGRVSGDLSELAVFITEDFGALGSAWYTRVVERQKKKETGLDFDEDEITDVIRELIFPEKRVKFLSAVYHPALFPDEEQPRVLLPIDSLRQVANLEIAPNSGGPRVPLHVLVVVGGTEEELDENFLVVEKVAAALKGRSGAIITVVGVNSEVNAKMIGCVNSLDGLRSFNIDKCSQTPAAVDPNVNEAASRLVRSAHAEDSRGVVLVINGRRTEVDVNESKPILVDLLTSLLAPYEQAGAQEDACVGLDPIACSVAFTLVQSLATTENPHREVIEEGLDNVFDKAPLAGFDVPARGRLIAEITGSVDPLTDAGRRALATINHISEALEGFGARLVLAPQEQYTEYPLKSWHRMVVTAESAEFDLMPTRNTLTLGLDVLPNWQVSSLKAEVDLDNIRLTPVDQERVEAQ

SEQ ID NO: 3643 - protein, 228 aa, Protopolystoma xenopodis
MLRSSCETEVEPTLDLKEPATKQNFYRFVWEPRLFSPGMQAEHSDLVNRASINPFSSSMSFSSQDLDHPDEVLSSAQQKLPRGLFINLPGEPLLTLSLDAPHGWMVTPVQAVHDLDNLRLSEVKPELSNGNMMARVDAVFELEYLLLEGHCAEEGSMKPPRGLQFTLGTRAQPNQYDTIVMANLGYFQLKARPGAWYLNIRSGRSRDLYKITRSALLFSCNFTLSFFA

SEQ ID NO: 3644 - protein, 392 aa, Helicosporidium sp.
GVARGGCALVTNGRAVYFSKGEALVAGDLSLATLFAQSKQFAGSVAALVAGAEENEETEETEETKEAKEAKEKEESEEKENDLLSENGSLAAAQPSRPTSSSVHRVADLILRVSSLLASSPVEESERGGISFFRTLRKLESGMLTFAVPGRTLPGSSENAPGPGSSSPLLIQALLDPLSKEAAYTSALLSWASRELGADVEVTLSPRLSLAAMPLKAFYAYASPPSVFGHLDEEAERRPSDVLGPLNPHAQLLELPQQATLTLGLHVPELWLVGARSAAADLDNVIPAREADLEARFALEALLVTGSAVDLVALEAGPRNSTYPRGVQLELARSAPLADSQDSRVDTLVMSNLGYFQLKALPGTWSLALAPGRSRDLFDVEAAVASAGPAAA

SEQ ID NO: 3645 - protein, 313 aa, Cervus elaphus
IAADEPPPEGCNSFFSVHGKKTCDFDTLETLLLTASERPKPLLFKGDHRYPSSNPESSAVIFYSEIGSEEFYNFHRQLVSKSNAGKINYVFRHYVSNPRKEPVYLSGYGVELAIKSTEYKAKDDTQVKVNTTVIGESDPIDEVQGFLFGKLRDLHPDLKGQLKELRKHLVESTNEMAPLKVWQLQDLSFQAAARILAAPVELALVIMKDLSQNFPTKASLFDILRNEARVMEGLHRLGIEGLSLHNVLKLNIQPSEADYAVDIRSPAISMYNKVRTGERLKVEHVVTVLEKKYPYVEVNSILGIDSAYDQNRK

SEQ ID NO: 3646 - protein, 579 aa, Verticillium longisporum
  MOD_RES (568)..(568): Any amino acid
MTRLCRSPLGLVAILWAAVNVSAGPSVNVHMQAAFPAGPYLLELLETAAGENATSYFPLLDRIASGHFKASSTHKALYDDFLQLLQDDGHVSSPDALSTFKLALSMRLSAPRIEAHYQYYDTAVAPHVTGGKQQDCEIWLQFAGSQYCSPTLEKPEVRVSSIVKLLPFDRVIGTGTDAVLYADPASSAFGAFHQALAQKARNGEISYRLRYRRAVGALQEPLPVNGYGVELALKRTDYIVIDDREAQTDGPQKSIATEVVLDEEEEVADLKPLSTSDLAPLGLKAASFITQSQDPWDALLKLTQDFPKFSSSLATHEVSEDFLAEHDKNRAEMAPSGLNALWMNGVQLTERQIEAFTLIDMLRRERKLIDNIRNLGLTGQQAALLLGHPKVASAKNGDEPPRFDWRDKIEEGKVIIWLNDLEKDARYEDLPSELTSLLQRTYPGQLPSIRRNIFTLVVPVDLTNPGDVTVISNLFTFVERLLPVRFGLVPLTPSDDKAAQTKVVYYLMQNYGPEAMIAYLQQSVEDAKISKPDQIIFDRVVAESVALPEASTASFDDVMQSEEQAERXTFMVPSRRRQP

SEQ ID NO: 3647 - protein, 1343 aa, Electrophorus electricus
MAASSKIRLQTMRTLCFLVTLVQLRYAYSSPKGVTTSLKAKWPVSPLLLETSEFIGEGSDEKFWQFVDTVKELSVYKNGESVRSYYNLILKKAGQFLTDLQVSLLKFALSLRAYSPAVHAFQQVASDEPPPEACLAFVAVHGQHACSTKDMKRLLKTAAGRPRPYLYKNDHRYPGVNGTDLPVAILYAEIGTKTFNTFHKVLSERAEEGKIIYVLRHFVAEPRRESMLLSGYGVELAIKSTEYKAVDDTQVKDSKSATTSEDDDTDEVQGFLFGKLKESHPELQEQLRDLKKHLLEGSNDMAPLKVWELQDLSYQAAARIMSVPKFDSLKLMQDLSQNFPSKARSLTRVAVNQEMRKEIEENQKRLSETMGIHPGDSSLFINGMHIDLDVHNPFSILDIIRGEAKILEGLHNLGIKGPNVSKFLRLPVTSVEDSYALDIRHDSIMWINDIEKDSTYQSWPFSLQELLRATFPGVIRQIRRNFFNLIMFLDPAQEDSAELVKLAELFYKHKIPLRIGFVFVVNTDEKVDGYGDAGVAFFRVLNYITEEYDITQAFLSMISMYNKVDVGDSLSVDAVTAYLKKKFPKANAAKILGVDSSYDDQRKAGGVFYRKTGLGTLPVALFNGIPLSPEEMDPDELETLLLQRIMDATSFFQRAVFMGQISDSMDVVDFLMEQANVVPRINPLILSADRRYLDFTASPVADDWNDSTMFSFLDAKDKTAVVSKRMKYLTKHGEMVYGVTIWIIADLEQARGRKALLGALKHMKSSSSSSRVAVISNPGAKPTEDNSKFYRAIWASLLTQSSKNTLDFTLKLLKEETVQLLTQGTKIKDLLLQGMDQDAFEKKFNTLEVDFLRSQHLFCQEVLKLKAGQRGVVSNGRILGPFEEGEEFSTDDFHLLEKITLSTTADKIRAKVKQMNLPPKKAADLIMKVDALLSAAPKDEARKDVQFAKDKFSVLHLAPREDEVFYDVVAIVDPLTRDAQKLAPLLIVLGRVVNVRVQVFMNCRAKLSETPLKSFYRFVMEAEISILGNDTLSPGPVARFTEIPESPLLTLNMITPESWMVEAVRSPHDLDNIHLQEVNGVVNAEYELEYLLLEGHCFDLSTGQPPRGLQFTLGMRQQPLMQDTIVMANLGYFQLKANPGAWTLRLRKGRSEDIYQIQAHDGTDSPADAGDILVVLNSFHSKIIKVRVQKKPDQVNEDLLSEATENKGLWESITSVWSSLEKSLTGSSSAEEGDSKKEDVLNIFSVASGHLYERFLRIMMLSVLQHTKTPVKFWFLKNYLSPSFKVKCVCVCMCVYPSTSLSCAGADGWGLFLIYIYHSSYYCCIGVSPLGQNKPLTSLVFLA

SEQ ID NO: 3648 - protein, 215 aa, Protopolystoma xenopodis
MVDIAVSQELRDEVKSLHLSLQENYKILPGTNLLSINGLIVSPKVDISSLLDIIWRESWILTRLHRLGIRGPALYSLLSLPLDQVGSEFSSTGIESDGATAQSLFGSRPTSLTVTQPPINLGQHVRLSLTGRFMLDLRGAPLIYLNNLESDPAYAGWKKSVRGLFTMDFISGSSGLKQVAKNLFNVVLVIDPANPNCTDILRFTESFILHRVGIR

SEQ ID NO: 3649 - protein, 569 aa, Neolecta irregularis
MRIFNLAIVLLPLLEAATPVNLHLDATFASPPFLLELLEAAATEKPECYFQLIPHLVSLPRNTDRELYNAALPLISSCLGDPASVELFKLSVSLRSATPKIEAVYQYYDHSEIEKPPCDSWFLIEGTGLCELPKNMPESSRKDRKLLRMDRIYPTLNHEKPAVIYYADLTDPTFLDHHESLIALSRQNKIRYVLRYKSPKIRSVRKVSLSGYGVEMALKKMDYLVIDDREDGGEPRSLPGKDESTSTIQPLRISELAQLGPKAISYIINSENPLNKLLETSRNLPSLTSVLSKYNSSSKVIQEIDKLNGHAYPPGQNMLWINGRQIDSADITIYSLLQFLRYERDMISSLSSLGLSTVKSRDLLTNPAIATYYETISSQRFDFRDSVIIYFNNIENDKLYASWSQSLSTFLTPIYPGQLHTVRRNFHTLVVSINLSDDDEVNGILGRLWSIVQRKIALRIGIILETDTPRSRAFVWIYQEKGLDKALEFLSNVLPDNTSDKKAFENVVGRWGKPKFDDAIVSQNVNDHFSKNNDWLSRFSFQHGGVFFNGRFIQKSDVFPCGYIAEIDI

SEQ ID NO: 3650 - protein, 553 aa, Necator americanus
MFWRFVHEVASRCSRLDWKNADEEQKYEFAVDVASQILTESSFDMLKLSLSIRMFSPAVQMGAEYTVACTAFFDVHGITGCSVEELENAVNSEQKRDVPELLPIDHIYGKETVPKTVAIVYADVGSPEWLQLHIKASELVSARKIQYVLRHYVKETDAHTLSLSGYGVELAIKNTEYKVVDDSFVKNDSDETDLHGFNFRLLRLGKVMFIKTVVCILLLLVFFLITRALYPDDSESFDGFRMHLKDIEELTPLKQWQVQDLSFQVSPIVVFMSIARETVSRELRDEIEGNQKDHLSGAGLDPGESMLFLNGINLDIDSLDMFQLVDVIKQEERVACGFFNMGFKREYLSILVGMDFPDDKTKYAIDYRDAYPMASFLKKKKSFRILFLNNLDTDRRYQHWRNSVKLLLEPYYPGMIRPIARNLFNLVFIVDPADRESRNLMKIAHSFFKHEIPLRIGFIFVVSNDENVTGVNDSGVAILNLFNFLAIDTSYHEALRIVNEMLDHYRVQDKIEPVDIKSWFESNYGDADYYDVFGPKSDYDNGRKVNFASHYFS

SEQ ID NO: 3651 - protein, 436 aa, Blyttiomyces helicus
LIGPIPLEKELTVSDFQLISKIELQNRVSNLAEKVVKLADAVKSRREINDEWYSNTILKLSSFVGVAVAGSKSAAGGGAADAGNVRLPADAFDPLARAHTAISLGNATTAVIRVTAIVDPIAEATQKTAALLAVIGTFDGVHLDLILIPSEEAESGGEQLPIKRFYRYVLQAEPAFDKITGDLVPPTASFLQIPVAPLLTLGTDVAGSWLVFPTESIYDLDNIKLSNLDRAAQKEGVRAEFALQNILVEGHARDSRTNGPPRGLQFTLGTQATPSLVDTITMANLGYLQLKANPGVWDLRLREGRSRSIYEFEAVVDSHAAQYRRRRRDNNTDLLGDAGARVVVNSFEGVTLYPIVRKKAGMEEMDVLEPDVEHGKESGGIWNQIKTNIFGGEAKSEPTINVFSVASGHLYERFLSIMMLSVVKNTKSGLGVDMMC

SEQ ID NO: 3652 - protein, 446 aa, Jaapia argillacea
MLLRRIIVLPWLLVATRAANSPPLKVSLRTSWSAPPFLLEVIETIAIENPASFFPLVDALTDPSLPPPSSPEATYHLALQTALKDGWLTDPSAKEMVEINMALHAATPKLEAMFEWYRDTQSRSWEGGDVDVDKECGSWVDWYGERLCEVEELVRLAGHETIDAPSSGSQISGTSSSKPKPKILPFDHIHPKTLARPPHTAILYTSPSSSNFRALHSYLYSLSSEVNPRVEYILRWAPPSSKDGAGAEERSYLSGYGVTLDLKKTDYLALDDRRSGSKSSDTESGGRAIDESSEEVVDSIMELIESYPVPENYTRDSSHPLVEDELLAIGIQATQLITSSTNPLTTLTKLTQNFPSYASLLARRVVVDQELDQEIRNNQVGKVQGGISAMWLNGGVVGEGEVNPFGLLRLLHRERPLVLSLTSEPLSLTPRQAITLLTHPTIATAQ

SEQ ID NO: 3653 - protein, 377 aa, Oncorhynchus mykiss
MWQHCALLLSLSLLPVVSGGADSKGVTTSLTTKWASTPLLLEASEFLAEESQEMFWDFVEANQNIKGEHDDTDQAYYDLIVKRASALLSTVQLNMLKFALSLRAYSATVQSFQQIASNEPPPSGCSAFFNVHGEKSCDTEKLTALMETAAERPKPYLFKSDHRFPGSNPDIPVVILYAEIGSSEFTMFHQLMLSKANKGLATYVLRHYLASPSSHRVYLSGYGVELAIKNQEYKAKDDTQVQGAEVNATLMGENDPVDEVQGFLFGKLKTLYPELKEQLKELRKHLVESTNEMAPLKVWQMQDLSFQTAARILAAPSSDALNVMRDLSQNFLPRLGPSLKQWSALRYVKRWKRTRSSLRELWDCSLETLLSSSTDYT

SEQ ID NO: 3654 - protein, 807 aa, Colletotrichum higginsianum
MMRLSRLPMGFALTLWAAGNVIAVPSVTVDMKAAFPSGPYLLELLETAAGENATAYFPLLDRIAGGYFNEAKTDKEVYDRFLHILNDDGHITAPEALSTFKLALSLRTAAPRIEAHYQYYRTAVEPKLGSDAPDGCEVWAELGGKQYCTPALDTPKESSLDGAKVLPFDRVLGSGSETILYADPTSSAFGPFHSTLVQKARSGEIEYRLRYTKRAGSYEEALPVSGYGVELALKRTDYIVIDDREAHHDESQKVVNAEEVLDAAGEVADLKPLAKSELQELGLKAASFVMQSQNPFEALLRLTQDFPKFSTSIAAHNVSSDFLAEHQLNRQQLVPSGMNVLWMNGVQLIERQIEAFTIIDLLRRERKLIDGVRDLGFTGGQAVSLLGHPKVAESKADEEPPRFDWTDDLEEEKVIMFLNDLEKDERYKDFPDQLMSLLQRVYPGQLPPIKRDIFNLIVPVDFSKIEDLNVVAQLNSFIQRKLPIRFGLVPLTPTENAVGISKVLYYLLDNYGLEAFIDYLDAAMQDSKTEKPDQSVFEKATRDREALPDSKLLPFDDVLRSEELDNVVKFAEKWAKRLNANTPIPPVFINGIPVPRENNWLQAMSMKATNDLQSIQRAVYLGMIDEEGWVPDFFLEKAVKRRNTYIYPEDDKSLKILDVNKIYTEHDSLFGKVPVIEAFAESTKENWAVLTVVGDFTSDEGANLLVSALAFRRSNPGVRLDVVYNPLTPASASAVNAALKNGGDKFTEAESLPEIRSILDNAAGEPDGIFAAALNEFLSFAAIKPGSNVLILNGRVVGPFTEAEPFQ

SEQ ID NO: 3655 - protein, 603 aa, Friedmanniomyces simplex
MKTPSCRLALIAGLTSLLLGVSAVPSVDVTVRTAFAAPPYLVELLETAADENATCYFPLLDRIADGYFDQALTAQELYTVFRSLLQEDGHLTQAEDLSSFDFALSIHSAAPRVEAHYQYYRTAVKPVLEFEDDGDCSTWAHVPFSGQGYCSADMVASSAHEMGRPSAELHQLPFDRILGAPDSDRPSVLYADIDSTSFRQFHKTMRQTARDGKTSYRVRYRPAKESTNKSLAVSGYGVELALKRTDYIVIDDRQADEGKADDAALAAEGTLSEEEVSDLRPLSSSELVRLGLKAASFVMTSDTPFDMLLRLSQDFPKHSSAIAATNISTAFVQEHRANRDLLLPPGFNVLWINGLQIMPRDLDAYSLLEYLRRERKMINSVRELGLSGPEAINLLSHEAITASAVDQEAQRYDWRDDNEGGNIIMWMNDIEKDKRYMEWPSSISALLQRTYPGQLPPVRRSIHNLVITVDFSNYADVVTVIESLQNFVKRKVPIQFGLVPRFASDAGRQQAKTVYYLLDRYGLGAALAYLTNSVAGAGRKFSAPQEKYFAQAIEGRKLRRDKTVMSFAHVPSDATLDERLLSAQAYVRRLGAGQATPPILING

SEQ ID NO: 3656 - protein, 405 aa, Miniopterus natalensis
MFQQVAADEPPPDGCDAFVVIHKKHTCKVNEIKKLLKKATSRPRPYLFARDHKFPTNKENLPVIILYAEMGTRSFGKFHTVLSEKAQNGEILYVLRHYIQKSTSRKMYLSGYGVELAIKSTEYKALDDTQVKTVTNTAVEGETETNEVQGFLFGKLKERYSDLRDNLTAFQKYLIDSSKEMTPLKVWELQDLSFQAASQIMATPVYDALKLMKDISQNFPIKARSLTRISVNQHMKKEIQENQEDLRSRFEIQPGDACLYINGLRVDIDAPDPFSILDMLKLEGKIMNGLRNLGMSREHMTEFLKLNSRVWNNNYILDIRHSSIMVSAHVITVLKPLVDLRLNIKPDIVRLSNKFKEFERGCIAELRRESKNTDSSPLTLVSSFPILVFSAFPHENPYSLVQYPF

SEQ ID NO: 3657 - protein, 357 aa, Limosa lapponica
MGKCRRGGKLKFLESVMESEFLSEEGQEKFWNFVEASQNIKTSEQDGSNYYHEMLKVACQSLSPLQQNLLKFSLSLRSYSATVQAFQQIAADEPPPKGCTLFFAVHGEKTCEFDSLGNLLQAASERPKPFLFKGDHKYPVSNPESPVVILYAEIGSEEFYRNHKRLVSKAEAGEITYVLRHYIANPSKEKVYLSGYGVELAIKSTEYKAKDDTQVKDVNATVIDENDPIDEVQGFLFGKLRQLYPDLTEELKELRKHLVESTNEMAPLKVWQLQDLSFQTAARILTAPPVDALMVMKDLSQNFPTKARAITKTVVSSELRAEIEENQKVLIVDPTHETTAELLNVAEMFFSNHIPLR

SEQ ID NO: 3658 - protein, 417 aa, Necator americanus
MKTSSSRVAAKKINVALDPDTNSHVTASRWFARFASGYERRSQRRCSLPSELNDDDAMNVANILPGQRALVANGIIVGPFDEAEEFLASDIELLEKIVETRGAAVISSHIKNWNIRTENGFSSDVVMRSFALISKYAVSRKRTWIVLGENEKSTVTLVAEDPNRPVVDVVVVVDPLSRTAQKLAHILDLLRKTINCDLKIVLNPKPKLSELPLKRFYRFVAAPELQFDKSGKVVATQARTKTSPTSFDKVGVEIMEKVYDTKGHLTVKWDKCVDGVISRIKMQKPLIIELFYSPSAWMIENVFAEVDLDNIRMELAPSNVFAYFSLEHILLEGHCFDEVSGSPPRGLQFVLGTRANPTEFDTIVMANLGYFQLKANPGAWLLQLRDGRSKDIYQLSNYGSIEESTNDSVRVLIGDRS

SEQ ID NO: 3659 - protein, 572 aa, Orbicella faveolata
MMQTGPIQHAVFSGAIYRYSNVYEYVMSQPNVVPRVNSMIQSMERPYIDLTGSHRMPDVEINDPEAFGTLDSSQMASVIVKDLKYFTKQGEELTLKPITNWVIADLANKEGRALVKAALQQMKSSSSARVGLIHNPAVTQTDHQPEALHIARTVEAVLASKSHVTPAMLTFMEKLLDESNDFEKLSSDSKAMEDLLAKASGLKAEAIKAKLIDSNAFKGKLFSHQAFCKRVVNLQPGQAAVITNGRVFGPLFGNTLFTEDDFKLLENFDMDLYARKVRDQIDEMSFEGLSADDDTSEFRSDVIMKVSSALISREKRSRQEIVFKGSEHSVMNIKPNVDGPSFDVVAVLDPLSQAAQKIAPILAVFQEVTNVNIKLAMKSREKLSELPLNRFYRYVLEPEVTFDDAGSMAEGPLALFSDMPQSVLFTMNMDTPLGWMVEAVYSPHDLDNIKLQEVENQVMGKFELEHIFIEGHCSDFHTRQPPRGLQFTLGTPRNPGMFDTIVMANLGYFQLKAYPGAWSLRVREGRSSEIYEIESVSGSVKEGDTHFTVVVDSFIGKLMKVKVRLGLASVLC

SEQ ID NO: 3660 - protein, 449 aa, Verticillium longisporum
  MOD_RES (356)..(356): Any amino acid
MTRLCRSPLGLVAIFWAAVNVSAGPSVNVHMQAAFPAGPYLLELLETAAGENATSYFPLLDRIASGHFKDSSTHKALYDDFLQLLQDDNHINSPDALSTFKLALSMRLSAPRIEAHYQYYDTAVATHVTGGKQQDCEIWLQFAGSQYCSPTLENPEARVSSIVKLLPFDRVIGTGTDVALYADPASSAFGAFHQALAQKARNGEISYRLRYRRAVGALQEPLPVNGYGVELALKRTDYIVIDDREAQTDGPQKSIATEVVLDEEEEVADLKPLSTSDLAPLGLKAASFITQSQDPWDALLKLTQDFPKFSSSLATHEVSEDFLAEHDKNRAAMAPSGLNALWMNGVQLTERQIEAXTLIDMLRRERRLIDNIRNLGLTGQQAALLLGHPKVASAKNDDEPPRFDWRDEIEEGKVIIWLNDLEKDARYEDLPFELTSVSKDLSLRNQKPG

SEQ ID NO: 3661 - protein, 1168 aa, Symbiodinium microadriaticum
MHASSCIDGRRFIPHVSRSCLHEFQQRSIGVGVQCPPPLPGGMSKSGVVKNWVEDKGFGFIGPDDGSEDLFCHTSCLQGCKGLGKGDKVRFDAEYDDRKGKMRAVNVSLEGGGGGGGGGRGYDRDDRRGGYDRRDDRRDDRRDRRDDRRDYDRRDDRRDDRRDDRRDDRGGGGKGKGGKGERFGGDNRGDDISNGGNRHLTAREIFMRHQQEKGGRDDRRDDRRDDRGGGGKGKGGKGERFGGDNRGDDISNGGNRHLTAREIFMKLAFLTLSFKHNRSEKEPAPFFAGVLTAIPVAQTYLLAALASHLLAPSRDVSSGQAYTSHLAVLVDESGPVLTQLGACVRGLMKLKAPDSEPEEIRSIHRLPYLGWAVSAPMAAHELLARLESQPSFAELHVDASLSRKDLLEQVAGAPKSRQLRLWLDNGVFQSATELAELLQACYEHLGAVARREKLPIFEDMSVLPNLGAGSGRAPPCQFRGEKFDHVVLGGTFDRLHVGHKVLLTVAAVMAQRGLAIGVSGPPLLREKAGASILQDWGERAATVVDFLAVLRPDLQVRVEELEDAFGPALWPEMGALVVSAETEAGGAAVNARRQEKNSPQLHVVAVPLVASAGGKVSSTTARELDSLAAAIEACWAMVPEAGRARRWLPLLLALARQAVQGERDLAQSLTALGAAKASGPSARWAAAARCLELAPPGLGLLQALAADLGWDESTVTRIRHELGADVPSRLQKLSFLKFLGLALPTALRADPDLSAGRVEELCRLAVEKKLDLQLRPTAEASLASGAAPEERQLLASLTSEGSVPAAVWVCNGRRIDLQDTGPPISARHVHALELLEGQYDIAKPEQGDPEDEEEPAAGKEPDQTRALSDWLASDEQSAALPASAYGLVAALRSEVLSHAKHDRFTQPAKIFNRAPAAFQVKIPPAKPDAASPITVYGILDPLSTTAQSASTALALFGMAFNAEVNLVLNPALKLSEYPLKRYYREVVRWPQHLADGRTLAELKDGVAVGGGRAEFTLATEHTLTAAVHVLPTWLVTAQEAEHDMDNLRPVDVLQRGSNCDTTYVLRQLYVEGQAMILGDEGWPVAMAKGMQFEITGTGALEASDDTIVMGNLGYFQVRGNPGFYQASLKPGLSNETFQLAVSEDLEAVGKGGYPSNGAARVALVFRSR

SEQ ID NO: 3662 - protein, 501 aa, Cryomyces minteri
MRVGLWSIGPEALLLLSALQPFHASAGPEVDVALKASFNSAPYLVELLETAAEENSTAYFPLLDHIADGYFDHASTDESLYNTFMRVLQDDGHLTTPEALSSFQLALSIHSAAPRIEAHYQFYRTSAEPSSEKSEQGECDTWVSFDGKQYCSPELDSAKGLIQDQKKVKLPFDRVLGASPGKVEFILYADITSTSFRRFHQVISRTAKDGASTYRVRYKPSLGLATKPLLVSGYGVELALKRTDYIVIDDRHAEKGEEGKESEENVAAETALQDDDIADLKPLSSSELLKLDLKAASFVMNSEDRLDVLSKLSQDFPKYSSAIAAYNVSSDFLMEHLANRRIMLPPGYNVIWINGVQVQTRELDAFALLEHLRRERRLVNGVRGLAFSGPEAINILSHSAVAEAQADDEPQRYDFRDVSEGGNVIMWLNDIEKDKRYSDWPVVLNSLLQRTYPGQLPPVRKDVHNLVVPIDFSDYKDVLMVAENLQNFVKRKVPIRFGLVP

SEQ ID NO: 3663 - protein, 644 aa, Odocoileus virginianus
MAGIHHQMLHDVHKTSKNSASPVKLNLRKRGARRNLFGKPRERRVSAAHWRSCCRLRHCPAPPRRCRRCRRGPSAAPGMGWKGDESGACAAAARPVTGACRKMGLLTMLTGLWLFSSVKADSKAITTSLTTKWFSTPLLLEASEFLAEDSQEKFWDFVEASQNVGSSDHHGTDYSYYHAILEAAFQFLSPLQQNLLKFCLSLRSYSATIQAFQQIAADEPPPEGCNSFFSVHGKKTCDFDTLETLLLTASERPKPLLFKGDHRYPSSNPESSAVIFYSEIGSEEFYNFHRQLVSKSNAGKINYIFRHYVSNSRKEPVYLSGYGVELAIKSTEYKAKDDTQVKGTEVNTTVIGESDPIDEVQGFLFGKLRDLHPDLKGQLKELRKHLVESTNEMAPLKVWQLQDLSFQTAARILAAPIELALVIMKDLSQNFPTKARAITKTAVSSELRAEVEENQKYFKGTLGLQPGDSALFINGLHIDLETQDIFRSLDFIQKYFKGTLGLQPGDSALFINGLHIDLETQDIFSLFDILRNEARVMEGLHRLGIEGLSLHNVLKLNIQPSEADYAVDIRSPAISWINNLEVDSRYNSWPSSLQELLRPTFPGVIRQIRKNLHNMVFIVDPTHESTAELINTAEMFLSNHIPLR

SEQ ID NO: 3664 - protein, 576 aa, Mesitornis unicolor
MKEETVGWQEDGCIDTAIEFVAIQKAGATFYKKSGLGPLPQALFNGVPFNREEMDAAELETVILQRIIDATRFFQRAVFMGLLNDHMNAMDFLMDQHNVVSRINPTVLGAERRYIHFRSTSVPFDAEDFSTFSFLDSQDKSAVISDNMKYLTKKDEDALYAVTIWIIADFDKPSGRRLLSNALKHLKTSSHTRLGILSNPSSKIKEDNTAIARGILAAFLTQNNSNLKSFLSKLSKEETAKSLAAGTKIVKFLVPGMDDDTFEKKYNTLGVDLIKTHQMFCQEVLKLLPGQMAVVSNGRILGPLFYAEDFNLLEKITYSTSAEKIKAIVKEMGNSSKSGSDLIMKIDALLSSLPKTEIRQDAELLKEQYSVVKVGPQQNEPFYDVIAIVDPLTREAQKMVHLLIVLKDVINMKLRLFLNCRSKLSEVPLKSFYRFVLEPELTYGINKRLPSEPMAKFTELPESPLLTLNMITPESWLVEAVNSSCDLDNIHLQDMKGTVVAEYELEYILLEGHCFDVTTGQPPRGLQFTLGTKSNPVMVDTIVMANLGYFQLKANPGAWTLRLRKGRSEDIYQVFS

SEQ ID NO: 3665 - protein, 1130 aa, Thermomyces dupontii
  MOD_RES (121)..(121): Any amino acid
  MOD_RES (124)..(124): Any amino acid
  MOD_RES (182)..(182): Any amino acid
  MOD_RES (223)..(223): Any amino acid
  MOD_RES (271)..(271): Any amino acid
  MOD_RES (458)..(458): Any amino acid
  MOD_RES (498)..(498): Any amino acid
  MOD_RES (505)..(506): Any amino acid
  MOD_RES (556)..(556): Any amino acid
  MOD_RES (594)..(594): Any amino acid
  MOD_RES (635)..(635): Any amino acid
  MOD_RES (674)..(674): Any amino acid
  MOD_RES (820)..(820): Any amino acid
  MOD_RES (972)..(972): Any amino acid
  MOD_RES (1048)..(1048): Any amino acid
  MOD_RES (1084)..(1084): Any amino acid
GSDSSVNVALQASFDAGPYLLELLEAAAAENASSYFPLLDRIAEGVLDDAVTEKELYDRFLTIVQDEGHINDAADLSSFKFSLAIRSAVPRVEAHYQYYNTSVEPRLGTAQDAACPVWVHXDGXQYCSPTLERAQQAVSADLEARDLPFDRKLGDPTAPLAILYADVASPAFGEYHRKLSAXAKEGQVSYVVRYRPPPSASFRPLFLAGYGVELTLKRTDYIXIDDREAEESNEKQTNKRKVGSPSADELEEESPPDLKPLSSSEVARLGXNAASFILDSPDPFATLTKLSQDFPKYSSAVAAYNVTQEFLDEYYANRAASLPGGRNVLWINGLQIDSRQVDAYSLLEHLRHERQFIGQFRKLGLSNIEALDLLLHPNLTDGQSDAETQRYDWRDEVEGGDVIIWLNDLTKDKRYSDFPSDIDALLQPTYPGQLPAVRRDVHNVVIPIDLTNEDDVYXVVQHIQTFIKRLIPVRFGLVPLVHSEPAKSQAKIARYLQXTHGLAAXXKYFQRALEKDKLARPDQALFDETIASARVLRGKAQSFEEALSSTTLEEVXDKTGRYIKRLDLGGRSPPVLANGVLLGRGDNFLQELSXRVAIDLQLIQQSIVQDAVEEDTWLPSYFLSQAALTRNELIXPQDPSKIRIVNLVQVAESHDLTSLLRISAEGPGTNSLLXAVVGDFDSEAGLNLLISALKFRLAHPEIEVVPLHTSDDETNTHVSSQLYQLLRTERVDASEILEKIQIIKSTSDIGATATSKELAYWAQTKQLAADLGYPSGTRGVLLNGRAVGPVPSTSTLAEDDLEILLAYEFSKRLGTVAKVXKDLNLGHKVAGSVEFAKLTSLVALSTTSDIPEGIFESRSKYRQSAIKTWNGAHSAITVSHSDDASINIVATIDPASERSQRWVPILRTLSKLNGVNVKIFLTPVRILQELPIKRFYRHVLEPEPSFDEHGALNRPGASFSRLPEDALLTLGXDVPPSWLVSPKESVHDLDNIRLSSLREGSDVDAIYELEHILIEGHSTDVTTRSAPRGVQLLLGTDKNPHFADTIVXANLGYFQFKARPGFWKINLKPGPSQRIFNLDSVGGXGYQPKPGDETNEVALTSFQGRTLFPRLSRKPGHEEDDVLETGPKPG

SEQ ID NO: 3666 - protein, 471 aa, Ustilaginoidea virens
MLLLPTSWLLIAFWAIAKHASAAPAVRIGLTAAFDGGPYLLELVETAAGENSSAYFPLMDRIASGYFTTASTDVELYQSFLQVLQDDGHITTPQALSTFNLALSLRSATPRIEAHYQHYVAAVEPFIELKNCATWILLNGKQHCRWDLGTIVKDRSLSSVVKSLPFDRTLGVGREAILYADPTSVEFRTSHQTLSQAARDMKLKYRIRYRSSGAHVREPLSMSGYGVELALKKTDYIVIDDRQEGNGDGKGCFRSEDVLDGESETFDLKPLSSSELAGLGIKAASFIQKSEEPFKKLVKMTQDFPKYAAFLATQNISHHSLSAYQQNLAEKVQGGINFLWINGAQLIDRQIEPFALIDKLRTERKLVDGIRDLGFDADQAVALLGHKALSSAKADEEPLRYDWTDRQEKGRAIIWLNDLEKDDRYSSYPKSLSSVRLPPDILSRFILTAIDSSYNGHFPVKFLRLEGIYSM

SEQ ID NO: 3667 - protein, 1164 aa, Rhizopus stolonifer
MHSWTQQQVYDKAVERVSFLDKDGIDLFKLSLSLHEAAPRIEAYNQYYHQAVVPSLTQYDDQCDVWVQIDNKQICSLQALIDAVKHVENPAAVDLLPFDHIIRPVKKDTTQEATLVLYTDTFSPKFKEFYTWLKSIAEEREIFFVIRYRPSTTNSIRNSLYLSGYGVEMALKKTDYLVIDDRDVQDDKSKSGIKEKISSIGKKLNHVLFDASEKATIEPLISSEIETLGLKAAQYIAKSSDPLETMSHLAQDFPKYAKSISDVVVDEEFKQEILKNHQMSFQGGSSAVWLNGKALEMSQVDPFHISRVLRSEKKLIKSIQQLGFSSKEAIELISDSVLSGGDDAKDTVSDVFDVRDTPEAPFITWWNDLEEDSRYDGWPSDIMEILKPTYPGQLHPIRKNIYNLILVEDLASQDSLSRITNEIRTMIKRTIPIRFALVSFFSEDNSVSALAAQALHHINQNIDKDTGMDFLETMLDLMVSNGLTRATDEVVEIAFNHILSSSNDLEQKLSLGEVNELHKPFTDATRSFITRMGIKEHNPKEGAMFFNGKLLEYSEEKPWAHTLMPHLNEQTRVVQTMAYNNEINTEFDFYNHVLSQPNVATKRNPFIQSSHINPLRIKVFDTTSTLKELRYFQSDENIIPSTNLWIISDFNTFNGLKLALEAVLFAEFNPKTRIALVHKSYTTDQQVIENKIGPKFSDVLCKLIYSDETTLATLKEILQHTNIIPETENDNDVLPGEITTQSNNEFEPIPILPGTPVVEIDAREQSKRWSVIDKALQEDGLETDFFGIVINGRIIGPLSSEDNLQFTKQDFDMLFEYEKTNRISLIEQTILHREKVLPKETTADVIMKLTAIVENDKAQVIQDVMEDHLPVNRNRVYENTVATNYTKIVINERSDNTFLEIGLIINPLNEMAQKLAPIVQTLSKLEGVSVVIHLNPISELEELPLKRFYRYVFDKEPHFDSQSGEQQIPTAYFANLPMEPLYTLGVETTNSWHVTVKEANMDLDNILLSSISEDQPTVSAVYELQSILVEGHCIDSLTKSPPRGLQFELASHSGTDKGDTLVMANLGYFQLKALPGVWSLGLREGRSSMIYSIQDVGANGKWNWNADGAGLQSDVLALTSFEGMTITPLVRKKPGMEREDVLEPAQPKENENSKTGLWSSINQK

SEQ ID NO: 3668 - protein, 276 aa, Piromyces sp.
MKYWNIFSIFIYILIVLNVKCENSKKDSPPVKISLQTPWDNTPLILEAIEFISKEKPSAYFSLLSKVSKEENFPKTTFGQYQYIMKLPEVAELEIESLLKLSLSLRSEAPLIQSHYHYYNASVIPSHKVNSNFDTTCQNWLDWYGSQFCDLEKFKNVAQISLVDGKYSMKESGKKSPIPIPTDHVKKPNSGKENGLVIFYGDILSKDFDKFLTELLKMNEEAGLSFIVRYKKSLDKQYNNNPITISGYGVEMAIKNTEYKVIDDRKLKKNGTNLLL

SEQ ID NO: 3669 - protein, 209 aa, Ensete ventricosum
MQSSLVDLPLKSYYRFVVPSLDDFSNVDYSVNGPKAFFSNMPLSKTLTMNLDVPEPWLVEPVVAMYVACRHDLDNILLENLGDLRTLQAVFELEALLLTGLALILGTKRGSHLVDTLVMANLGYWQMKVSPGVWYLQLAPGRSADLYALKDSGDGSPGNRSTKLITINDLRGRLVHLEVAKKRGKEHEELLNASDDQLLEKRKVCGLNT

SEQ ID NO: 3670 - protein, 269 aa, Emiliania huxleyi
MLAVAALSRGAQAAAAAGGALELTAVLDPLSKEAQRAAPPPLGLSVTLHLNPSLQIDKFPLESFYRYVVSLEPSFDNAGRSLSPQLDRALFSSLRTPQVLTLHVDAPEAWLLECTEAAYDMDNLRLAELGERRRPSRRRDGDRRTVSAVYELASLLITGSCEDVGSRHPPNGLQLLLGTTAQPHATDTLVMRRRTGEPRRRPSVGWTVFTLRTAPALLAAGHSTRAFRGGMQRIDPATLTDAAAVRVTMADFTGANILLLAQKRPGLES

SEQ ID NO: 3671 - protein, 1215 aa, Rhizoctonia solani
  MOD_RES (176)..(183): Any amino acid
MRSLSALGTLGVAASLAAAESAFSPPVKVSLTTSWAAPPLLLEIIETAAAEHPGRYFEILDALADRSSAGFLGPITDPFHKPQYVYSTALALLQARGFLIEPNALSAFEKNMALHSATPKIQAFYQLFGDSSKAPDCESWIEWSGKQACTPEEASKILAETSSGSHIQTFPFDHIXXXXXXXXALRATLSSQNFHGLHLYLRSKSETSGFCYVLRYAPPKDAVIAGEHSRNTLSGYGVALDLKKMDYLALDDRGLREKGGINDDTTEESAQWEDYVSSLLSEHPHEDLDLTTPLTEEEISSLPLRATHLVMSSEDPLKALSHLSQNFPKHAVSVARRWDPGRTEDLKAKHESVEAEVQANLHMVAGAGNMVWLNGVALPETDMNPFGLLRLLRREHQTVSSLLKANLNSEQAIHVLTDPAIGKASTASGPTDGVFDASDREEGGGAIVWLNDIEKDQRYARWPTSLTVLFRQLYPGQFPTIRRNFLNVIATLDLSRTSSISFIAQLANNLVSRMLPFRFGYVPLTETAESRQVARLMKWMIDAYGLEKASQYFSMALTPEDTVNFKALEGAYLQFTAQIPPPSGIVPDFSTFAADPLQIQVVGHEFVPDEELQPAAAYAKRLRLGAQDGAGKGHVFINGKHLAYDDNFLRHLQTEMGAQINFLQEQLYTGALADAPETDISVFMYDLPTTAKRRNKFIYPSGNMKIYALDNLFDSVGATKQLKDSFIYPAGENPTPLTIWIIGDMDNGETLTLATEGLRGMSDDAKYRLGFIHTPSVDPSNVPSTQQPLVPPMLARLAATGNYAEFPPSELAQILEEAKQLVVDAAELNIQDNPVLLNLNNRLTGITNEGVDLEELKSTNAASNALAKAVGLKSGERAIIINGRVIGPLAGSDFVAEDFGALVNYEAAKRVTPVVAALTTVREDLAELDRPTYADLVAQVSSITSSVSVPDPSEEGLFQSKSLARQRPYNELNGKDCTFEIGDNSTALFHVGLLLDPLSESAQKWTSIVEWLATVPQTYIHVRLNPAITLTEMPLKRFYRYNIQSRLAFDQDGFESRKPVEFHGLPVEPIYTLAMDVNPAWLVRPYISEVDLDNIHLASLSDPKAGVDAIFHLDHLVIEGHAREENNAPPRGVQLQLASLDGTPTADTQVVANLGYFQFRTGPGAFRLEIRPGRGCDVYTIESAGNEGWNSGHVNITGTEITLTSFEGHTIYPRL

SEQ ID NO: 3672 - protein, 268 aa, Piptocephalis cylindrospora
MLISPTLALTGWLFLLGLPGGSGTGTTPVHTSLRASWPTPDILLEIGEFIHQEHAPSYYPYLSAISPHLAEATTQEERYRLALDLIQSKHLLPSFSPTLRSLLSLSLSLHTVSPAIEARLQQYRLLEASRPLRVAQCDSWVEWSGGEGKVACDLDSLSSILDNLPSHSDSSSPILLSTDRVYVATGAQEGKEAKAHPPLFILYSSLSSSSFPSFHEALMKMADTGAIRYTLRYKPSLTTSPSPRMPMAGYGVELALKNLEYLVVDDRG

SEQ ID NO: 3673 - protein, 226 aa, Cryptococcus neoformans
MSSNDSLKALTHLSQDFPKYSAALARTVEVPENILAKGRSIAVRGQGTQAIYINGKPFGTDLNAYSLLKTLREERQLTFALTSLGLTPAQAVTLISDPDIGSAQVGEDVGEGFVDASDRTEGGDVVVWWNDIEKDHQYRNWPSHLQGYLRPLYPGQFHTVRRNAFNLIFTLDISQISSLEIIAGSLAQMVQRGIPIRFGIVPVFEPGTNDLCECHEREIWDHADDR

SEQ ID NO: 3674 - protein, 499 aa, Diversispora epigaea
MAKNILECSTIRNLWQLVEEFLKQGLFSSKLTNYEIYKSALDIIEKKKFLYTPTTKSLFEFGLSLHKTAPTIQSYYHYYNSTIIPTRNSSSEEFNPDRDVWVDWYGNQACNAESLTKFIDTKLDISNPTPNLLSFDHIRKSKIYPPKDNQESLYLSGYGVELALKNTDYIVIDDRKVEAETDNVDKEKESINDSEASNDHLFDQNISEIKPLKAGEIKSLGVKTAQVILESQDPLKTLTQLSQDFPKYSHYISQVPLSYPLGKEIEMNQEHSHLESNLFWLNGLVMNPLSVDPFSLLKLLFRERQTISSFLNLSLNPGQAIGVLSLPIISEAQSLQDSSRGVFDVHDISPNSNVIVWLNDIEKDSRYSSWPNRIHDLLRPAYPGQLRMIRKNIFSILFILDFLSPDNLDIITDQVKTFISRNIPLRFGLIPLFSKDQPDAIAISRIFYYIVDQFDSSIVMKFFEMISEIRKSSKIEFLKIFEQEFNPRMRNWLIHLKKS

SEQ ID NO: 3675 - protein, 201 aa, Ancylostoma ceylanicum
MAMIYFASFVREVLGASSGQRAFVANGLVVGPFDDEEEVIDSDVELVERIVETQGAGVIASHIDKWDVKKEDGYSSDVVMRSFALVSKFAVSRKRTWIVVGEDEHSTVTLVAEDSNRPVLDVVAVVDPLTRSAQKLAPILDVLRKTVNCDLKIVLNPKPKLSEMPLKRYYRYVVAPELQFDKAGKVAANQARYLFSFFNWI

SEQ ID NO: 3676 - protein, 476 aa, Trichoderma harzianum
MNAAFPAGPYLLELLETAAAENSSAYFPLLDRIAAGSFASASTDAALYSEVLNVLQQEGSISSSEALSTFKLALSLRSAAPRIEAHYQHYTTAVAPAVDDSECVNWVLLEGNQYCTPELDKVNRDGLLSLQAKHLPFDRTLGTGKEAILYADPTSSTFGEFHKALSKAAREDSLSYRIRYRRTEATHAAALPMSGYGVELALKRTDYIVIDDRVHDDAAHPESPISSTNLDDSEDVADIKPLATSDLSSLGMKAASFILQSDEPLGTLIKLTQDLPKFLTSVVAQNVSTQFEEEFQNNGIKGVPDGVNALFVNGVQVNERQIDPFALIDRLRQERKLIDGFRTLGLSGKQAVSILGHQAVSMAKGSNEPQRYDWTDRLEDGRVLIWLNDLENDEAYEDYPKTLAAVGHKRMHGERPKANVTSCYEEHIPDNSPLLQKMSSLLWRLSIFQTQKTYRSLRNYYHSFHVALLSDLVSFL

SEQ ID NO: 3677 - protein, 821 aa, Paxillus involutus
MDYLVLDDRDQHQGDSAAHDTSSGDNVEDADKRPSSEEIISCVFDSLPYIDEEAEARARTGEPLSSEEIANLGLKAIQFMMSFSSRPQAGPLYIHQCWDNHHQVPFPAVDLFSTLSTSFPLYATSLARKIKVLDELRDEVHENWAKAAPGVNMVWVNGRVINENEGSAGSIFGLLRTLQRERGLVKSLVDLGLTSSQAIELLMYPAHSATQNPSIPLETPRKGTTRGSAKAFVVQDDGVEIAEKKTFAISPKFTEFLDGLIDASDRQEGGGVVLYWNDLEEDQRYAAFSPSLQGLLRVHTMSLFSPMLRIRLNLVNVIFVLDLSETRSLSLLGSLSETFVARGFPVRWGFIPDFQGDSLKMARLVYYLKQKYGRDRMMAFIQGISHTHAERRLSSLSWQIVHETFNTLSAGDDFAAIARGDVPIIHEATGEDVLVRAQRYARRLGVGLQGATGKGHAFVNGRYFPVDDNLFRQMSTEVMAQLQILQEMVYTGEIMDTDASLMSTFFYDLPSTFSRRNPYIFVKSAPGGGHLLDAMGLRMFNLPELFSKAGFEEKDGSFILPSDSDALPITMYVIADFDSPEGLELAKEALRFVTNSVRTRVTFIHGPGEMTTGVVSTFISTLVHSGRLSEVPPSRMLEVLADRLDEQLGAFKDELMAGKQLTNAKLFRILQTNRLVARELGLKPGQRCILVNGRLVGPFESGSDFDAEDFEMLEGFEIKQRVGRVMEAIDAVLDGGDALDVFRRAHLVSMASSIIYADQQPDPSEAGLFDSAPKPRTQNYRSLSAGYTWVSHSVTLQRVHASRLAHPFSPCQVSERAEGIK

SEQ ID NO: 3678 - protein, 285 aa, Gymnopilus dilepis
MKLAFTLLGAATAVLQASAGTSPPVRAALRSSWPAPPFLAEILMLLTTENRETVALEHPNGFFTYLEALTAPSSHISPSLSPEALHQAALQAAADNGLLNEPGSLEMVQMQLAMHAAAPKLEAFYNYYADQHNGSSGTQCGSWVDWYGEVVCDVEALAQLAGKEAIDAPDAPPPQPRPQILTFDHIFPPPQDILDRPPRTAILYASLTSKNFRELHTYLLKLTNRPDSHVEYVFRHIPPPSASENKEKNYLSGYGVALDLKKTDYLAVDDRQLGRFDSYFWTALC

SEQ ID NO: 3679 - protein, 612 aa, Beauveria bassiana
MSRNITALPFDRSIGAGKHVVLYVDPASPHFRKFHAPLRIAAEAGEYNYRVRYRRPINASNKALHVSGFGVELALKRTDYIVIDDRASQSDAKAQKPLDTEAIFEEQELTDLRPLSTSELATLGMKSSSFIQSSKTPFETLVKLMQDFPKFSASISAHNVSANFSEEYQRGHIQRVPRGINALWMNGLQLIERQIEPFALVEMLRDERKLIDAVRNLGLNGDEAISLLGHESIAATQSDAGGTMRFDWTDKPEDGQAIIWLNDLENDDRYDQYPDDLSSLLQRTFPGQFPPIARNIFNVVTAIDPSDADDLTILGQLMALIGRGIPIRFGIVPAASSPASSNLAKIVYHLIRTYGFESLRNYIESVGQEPNAALGEAKFSQIINGLTPVAGNHPLKFLEVMENNDFNSQLEMAGRWISRLKATDKSSPIFFVNGVSTPRVANWLQRMSMQVSEDLQTIQRGIYHGVISDDVWVPGIFLEGALLRRNEYVSIDDAHPLRVLDVSKLYGDHKDLFGIIPVRNCDPQTERESWAAVTVITDAMTSRGVQLLISALKFKQSRPGVRLDIIHNPATTERASDLNKSSRAEASLLGLGMSEECERRRRVPRPVHMPLP

SEQ ID NO: 3680 - protein, 335 aa, Punica granatum
MKTPLRSGFCLVIVLVCLGLLVGVHGETRRPKNVQAAVRAKWSGTPLLLEAGELLSREWKDLFWEFVEVWIQNEEDHTGSYTARDCLKKILSHANSLLSDSLAPLFEFSLYLRSASPRVVLYRQLAEDSLSSYPDAEEISSGDYGPGVTGKFDNTESRKVDSLLVGKNPESPRGKCCWVDTGASLFFDVADLKSWLHGHSKHDGDVAGQPELFDFDHLYFDANIASPVAILYGALGTSCFKEFHLTLAEAAKKGKVRYVVRPVLPTGCETKAGVCGAIGAGDPVNLGGYGVELALKNMEYKAMDDTTVKKGITLEDPRTEDLSQEVRGFIFSKIL

SEQ ID NO: 3681 - protein, 242 aa, Lithobates catesbeianus
MEHKRKKQHNVLTRSMMIGESSVIERPRPYLYKGDHVFPTLTKTAPVVILYAEVGTKAFATFHKTLIEKAESGEITYVLRHYIQTPSSRKINLSGYGVELAIKDTEYKAMDDTQAAVTNSTTSSYEGIDEDVQGFYFDKLIQMYPDLKNNLVEFRKHLIESTNEMLPLKVWELQGTFFLIFSNITGHLTSFYILTLLCCYLPNLKLPCKVTYQLLSLCLLAVHYIFYTVPSFTMHQRELTAL

SEQ ID NO: 3682 - protein, 268 aa, Paroedura picta
MAVLVPALLAGALLLSVAPRAIQGSPRKRVAARLAAKGPATPLLLEASEFIAEESNQQFWQFLETVKELSIYKESADEPPPKGCAAFVVIHGKSTCKANEIKKFLTKAAARPKPYLFKGDHKFPTLSETGPVVILYAEMGTKDFAKFHNVLSEKAQKEEIIYVLRHFVQKPSSKKMYLSGYGVELAIKSTEYKAVDDSQAKAASNVTEEEENKESDVQGFLFDTLKQNYPDLKDNLTELRKYLVESTDDMEPLKVWELQGGYSEDESP

SEQ ID NO: 3683 - protein, 211 aa, Apostichopus japonicus
MHALLTALITFRSALERHPSLASELGQFKQSLLDASDAMAPLKVWQLQSIAFQAAQRVLLAPEADRLKVLQDISQNFPLLAHSLVRTQVKPEFRNEIQKNQREFAMNYGLDPGDCMVIINGLVIDADIADPFMLFDLLQSEGQLMEGLHALGLHGNALNQALKTKIAKSEGDFALDIRDNAVLYVNDLETDPQYRGGNRTSKNYCVPSFLE

SEQ ID NO: 3684 - protein, 234 aa, Coniophora puteana
MLCVPGYRPSVRGFGNVNTRDLNCSPPPPLALPLFRPSIAFLDGGALSSEMTLSGLYAAAPRLAVGAQRHEERFQQEASGRFAGKRCTSWIDWYGEVLCDAEELKEKGSSSPGNSDYAAFKPLPFECAHAIPPSLNEPPFKIVLYADHMADSFAPIHAALLLLEPGVEYALLWARTARSGEGKGSLTDGYGVALDLKKTGYLVIGDRAHRSDDAASSTGNEDAGGNNNPHKSLP

SEQ ID NO: 3685 - protein, 346 aa, Drosophila persimilis
MLRLLCVFVLLQSAAPILANAESSQSYPITTLINAKWTQTPLYLEIAEYLADEQAGLFWDYVRGVTKLDTALNEYDTESQMYNAALETGSRLIENNTRTVVLYADLGSAQFRSYHKLLEQEANNGKIRYILRHHLAKKEKQPVRLSGYGVELHLKSTEYKSQDDAPKPEAGSTLDEDLDNESDVHGFDFKVLKNKHPTLKRALDQLRQRLLQGNDEIAQLKAWEFQDLGLQATAAIAEIQGDETLQILQYTAHNFPMLARTLLAHKVTETLRAEVKHNTDTFGRSLNVAPPDGALFINGLFFDADTMDLYSMGGEPCASEMRVLESLHSNNVRGRAWPSSLLAPGS

SEQ ID NO: 3686 - protein, 414 aa, Poeciliopsis prolifica
SEFLAEESQDKFWDFVEANQNIEGEHDDTDQAYYELIVKKASALLSSVQLNMLKFALSLRAYSATVHSFQQIASIEHPPSGCSVFISVHGEKSCSPESLATLLKTAMERPKPYLFKGDHRYPGSNPDTPVIILYAELGTPDFQKFHQILTSKVNEGSAAYVLRHYVAKPNENKVYLSGYGVELAIKNQEYKAKDDTQVQGAEVNATVIGENDPVDEVQGFLFGKLKTLYPELKEQLKELRKHLVESTNEMAPLKVWQMQDLSFQTAARILAAPAVDALNVMKDLSQNFPTKARSITKTVVKSEIRKEIEENQKFFKGTLGLQPGDSALFINGLHIDLDTQDIFSVLDVLRSEARVMEGLRSLLIETPYIHDILKLNVQPSDSDYAVDIRNPAICWINNLETDHRYSSWPYNVPP

SEQ ID NO: 3687 - protein, 280 aa, Ancylostoma duodenale
MASNERELLSTDHIYGKETSPKRIVIVYGDIGSKEWLQLHTKASELASLHRVQYVLRHYVNDRANPNPLSLSGYGVELAIKNMEYKAVDDSNVKKDSVEPDLHGFNFKLLKELHPDASDSLDAFRMHLKEIEELAPLKQWQASQRIVSEGAYNAIETLKELSQNFPTHARSIARETVSTELREAIELNQKEHLSDTGLDPGESMLFLNGISLDVDSMDMFQLLDIIKQEERISSGFLNMGLKREYLSILSGLEFADEKTKYAVDYRDAYPMASLFSLMFL

SEQ ID NO: 3688 - protein, 207 aa, Poeciliopsis prolifica
SEFLAEESQDKFWDFVEANQNIEGEHDDTDQAYYELIVKKASALLSSVQLNMLKFALSLRAYSATVHSFQQIASIEHPPSGCSVFISVHGEKSCSPESLATLLKTAMERPKPYLFKGDHRYPGSNPDTPVIILYAELGTPDFQKFHQILTSKVNEGSAAYVLRHYVAKPNENKVYLSGYGVELAIKNQEYKAKDDTQVQGLYSLRNS

SEQ ID NO: 3689 - protein, 534 aa, Sphaerobolus stellatus
MRVINLHSLGVLGAALSLAWLGNASPPVKVRLRSSWPAPNILLEILETAAVEQDAAFFQILDTLTAPESFSKSSASLTNAKVYETAIDTLLKHGYLSEPGALDTFELSLALHTASPNIEAYYEFYGDNALSETPLSEGEEPERCTGSWVDWYGRRVCSVETLRRLVGVADEDSASEFQNVKLLSFDHVYPPASGSLNPPPRTAILYGNLTSPNFRSLHDYLYKLAMETPSRIQYVFRHIPPENAQAEPSYLSGYGVTMDLKKMDYLALDDRKTGREGGSSSSSNNAKTEEVEQAYSVLDVLGVDDTVDLLTALTEEEIANISIQATQLILQSPEPLKALTDLSQNFPKYATSLARRVTVDEELHKELQGNHHKVQDGFTAVWLNGLVLQNTDVSVFGLLRLLRKEREIIGHLKALGLSAPQAIEFLTHDVLISSQAGNPITEGLFDASDRREGGDTIVWWNDIEKDTRYSRWSPSLQTLLQPTWPGQMPSLKRNAFNTILVVDFSERTSLAWNAGPIATIIQRAFPWRFGVVPI

SEQ ID NO: 3690 - protein, 209 aa, Merops nubicus
MANSFLFLNSEFIAEDGNEKFWQFLETVRELTVYKQGDSEYSYYNLILKKAGQFLSNLQVNLLKFALSIRAYSPTIQMFQQIAADEPPPEGCSVFVVIHGKHTCKTNEIKKLLKKATKRPRPYLFKGDHKFPALKEDGPVVILYAEMGTKDFVRFHKILSEKAQREEIVYVLRHYIQKPSPRKMYLSGYGVELAIKSTEYKAVDDTQIK

SEQ ID NO: 3691 - protein, 246 aa, Fulmarus glacialis
MFQQIAADEPPPEGCSAFVVIHEKHTCKTNEIKKLLKKATKRPRPYLFKGDHKFPTLREDGPVVVLYAEMGTKDFVKFHKILSEKAQKEEIVYVLRHYVQKPSSRKMYLSGYGVELAIKSTEYKAVDDTQVKGANETKEEEEEEEEESDVQGFLFGKLKQMHPDLKNNLREFKKHLIETTNNMEPLKVWELQDLSFQAAARIMSTPVYDALKVMKDIAQNFPIRARSLTRVPVDKKMRNEIEENQK

SEQ ID NO: 3692 - protein, 407 aa, Nematostella vectensis
YNSILQHARKLLSSNGLSLLQFSLSMRYYSPKIELFNKVSKEVSGISECSSFVQIGEKVTCNTEEAEHLITSAEKVSAPDSYPFDHHYTDSDSNDITVILHGLIGTSDFNAFHDMLVAKAIAGKVHYILRHYVQKPLEKKVRLSGYGVELAVKKTEYKAVDDTKVKEDSSHSKITSKKEDDDEVEGFLFGKLKKLHPHLTEQLNQFRSHLKDNFREMAPLKVWQLQDLSFQAAQRVVSSDPRSALKVLRDLSQNVPKLARSLVKTKVKPELRKEVLQNQKLLLKVGVDVGDSALFINGRMVDIDDLNAFELLDILREEWTVLDKLASLGAKGEPLTALSVMSLSEERDSYVLDTRDDSVVFVNDLENDRHYASWPSHIQEILRPTFPGMLRYIARNIFHVVMFVDPV

SEQ ID NO: 3693 - protein, 304 aa, Mesitornis unicolor
MQLPPTERADQTQRHKGNLLGKGEGLTKVTGMPQRYQRNSPSLTTEFIAEDGNEKFWQFLETVRELTVYKQGDLEHSYYNLILKKAGQFLTNLQINLLKFALSIRAYSPVVQMFQQIAADEPPPEGCSAFVVIHEKHTCKTNEIKKLLKKATKRPRPYLFKGDHKFPALKEDGPVVILYAEMGTKDFAQFHKILSEKAQKEEIVYVLRHYVQKPGSRKMYLSGYGVELAIKSTEYKAVDDTQVKANDTKEEGDDDDDEESDVQGFLFGKLKQMHPHLKNNLEEFKKHLIETTNNMEPLKVWELQ

SEQ ID NO: 3694 - protein, 1513 aa, Rachicladosporium sp.
MAPTWIWGLGLVLGVAAVPSVNVALHASFGAPPYLVELLETAAEENVTSYFPLLDRIAEGHFDAAKNDEELYKRFRQTLQDHGHLSRPEDLCSFDLAMSLHSTAPRIEAHYQHFQTAARADAEHEVDCEAFIDVPYSAYRFCSPTLDREKAIYMGGAGQDARALPIDRVLGSAEAKSSILYADITSTAFRKFHGTLSKLVKDGKSTYTLRHKPRKGATPKPLAVSGYGVELALKRTDYIVIDDRKDDASAEESAAQSAETTLKEEELSDLRPLSSSELRRLGLKAGSFVMGSEDPFETLLKLSQDFPKHSSSIAGTNVLEDFLSEHYRNSEQMPPGYNVLWINGVQIMARDVDAYALLEHLRRERKMVNSVRELGLTGPEAIDLLTHEAITAAQTDTDVQRYDWRDEIEGGNVIMWLNDIEKDKRYEEWPETNTALLQRVYPGQLPSVRKDIHNLIIPIDFADFTDLGLIVESIQNFVKRKVPIRFGLVPVVKSPASAEQAKVVYHLFDTYGIAAALSYLEQSFEGSGRKHSLPVEKYFAAAIEERRTRKGRSIQSLAEVSEDTEAALRISATQAYLVRLGGGSGPASILINGVPIARSDEWLQVMSQRVAADLRVLQQAVYEETVGEEDHLPDLFLAQATARRNIRMVPEDDKTVRHIDIGDLPFNALKPTLPSSPDTIESELVHLTLVLDLQATGSLQLIAEAAAFRDEHDNVEISIIRIVGDGQDERQSLSAHGVELSSEMIKEIRDHKKPTSGQAAVGETASEGSIPDPDMKYGSLSSIPNGLPANDIAEAIGMTAGQKAVVLNGRIVGPMNASVPVTVDDFEALLSHERKKRLLPASAAIKALGLSAKASTPLAFAKISNLIALSLVSDIPEGIFEAAPTVRSAVYKKWTLDHTAIKVGSAETATIQIIASIDPASETAQRWVPIIKVLSELEGVYTAIYINPKDRIEDLPIKRFYRYVLDSKPTFDQTGAVQGQSAHFAGLPAEALLNMAMDLPPSWLVAPKESVHDLDNIKLSAVKTGADIEAVYALEHILIEGHSRDVTLGPPPRGAQLVLGTESEPHFADTIVMANLGYFQFKANPGVYNLTLQKGRSEEIFNIDSAGNQGYTSVSGDTSTEIALISFRGATLFPRLSRNAGKEEEDVLELPKSAVSSLASQADKLLTQAGLSRSGHAASKYLSKAAKLTSGIFSTPETTSLAQQPHADINIFSVASGHLYERMLNIMMLSVMKHTNRTVKFWFIEQFLSPQFKAFLPSLAAEYGFRYEMVTYKWPHWLRAQKEKQREIWGYKILFLDVLFPLDLDKVIFVDADQIVRTDMYELVQHDLKGAPYGFTPMCDSRVEMEGFRFWKQGYWKNFLRGLPYHISALYVVDLKKFRQIAAGDRLRQQYHQLSADPNSLSNLDQDLPNHMQMNLPIHSLPQEWLWCETWCSDESLKDAKTIDLCNNPQTKEPKLERARRQVPEWNVYDEEVAALARRIKGKREGVEVGESIQERLQAEDAERERGKVRDEL

SEQ ID NO: 3695 - protein, 1607 aa, Saitoella complicata
MLIRWAKALAIAAVFGHALAASPPINVELKAYFGSSDLLLEILENVALHNTSAYAHLLDAIIASPVQLSTPAEIYDYAFALIREGGLLDDNQITNVEFNLALRSASPRVEAAREVCRGKKGIWSEGDDVVVTVAGKKSNHDLASDYYAYHSGHIASLILDESDSASQLEPTDRTLGQAVDGKQTAVIHASSILSDTFRKWYEVLRKLNKEGAANIALRYCPGPASAGESVDLSGWGVELALKKTDYIVIDDRSVASADEPSTSEEETFETSDITPIPSSAIPNLALLATHEITHADDPLSRLVELSQNFPMLAPALAQKKVTGLQHTVREVKRLGQELRLPAGHSQFWINGKSVPETEVWGHKLIEMMREEGNVMKSLMKLGLSPAQAREILAHPKFVEAAEEAAPIRFDFRVEADENDNSPIIWLNDLEDRTHEYYGRWTRSVQTLLRPLRPGQIHPIAKNIHTAILPVDLENPADLAILGREIGTYIQRGLPVRWGILPYNHGPITKVWKYLREEVSDAAAWAWVRTIVLEGVKADASLYKQIVQGKPDAKKFDDIVKGCVSSFASAEWMEKLGINHDIDSTSANIVIANGRVVPRDEAWPGRMYGYIQEDVARLMEAIAEGWINDETDVVDYLLQGSFKTRNTRIFPADESGVVNVNQLELEERLSVAGVSPSSLPTIRASEYDGPVCSHTVIYVIADFLSGQGWAHALEAQKFIRTVSEESEGSRALVRLVHNPYPTNPHGSASADWLSALQSLGVELESTDTTASDWKLTSGFVNKLGLKRGQAAVVINGRVIYGDETEILHLVADEDGNWVKQPWFSEEDFDTLYSVELSKRIEPTRDVVDEMGLSHEIVPAISSIIAKTSAPKSASAMFGPQTPDIRGRSYVNVNGTLTTFDTGNMETAMYEIVAVMDPLSQTAQKWSAILKVLSEMKGVYVKVILNPNTKLTELPIKRFYRHVLEARLNFDGNGNIVTPSADFSDIPTDPLLTLGMDVLPAWHVTPKISEHDLDNIRLASLSSSQTARGVEAVYELRYILIDGHARDVTTNTPPRGMQLVLGKEGDLGVEWEQDTMVMANLGYFQFKARPGVWRLGVKEGRSQEVFDIESVGGEDGHDKVVMASLEGRTLFPRVKRKAGMEKEDVLAEPEKSLTQQLTNIVKGWFDRGGNKVSKKKQATINVFSVASGRLYERFLGIMIRSVLDHTEETVKFWFIENFLSPSFKDFLPHLAEEFGFEYELVTYKWPHWLRGQSEKQREIWGYKILFLDVLFPLDLDKIIFVDADQVVRADLKELIDIDLQGAPYGMVPMGDSRAEMEGFRFWKQGWWKSHLRGKPYHISALYVVDLNRFRTLAAGDRLRQQYQTLSADPNSLSNLDQDLPNNMQHQIPIYSLGEEWLWCETWCSDETLRRAKTIDLCNNPLTKEPKLERARRVVGEWVELDERVAEVARKVREGGLNVEKEGHDELQGPAIPMSVKVRARFLVLRASTWRQPRKYPAARKNWEMVVEGFLSGALAGSVFDLIYCVCFETVCGVVYEPRRTLPGTREPLILFRTTHRVSRHLRTHHWGHTSIRLALAKSWAMSQVKVMRVLLCVLCGYEFGCGSGLRGIG

SEQ ID NO: 3696 - protein, 1513 aa, Nannospalax galili
MAQTRAMKALRLILGYSALWLVLFLCNSAAASKAVTVQLAAKWPDTPLLLEASEFMAEESNEKFWQFVETVRELAIYKQTESDYSYYNLILKKAGQFLDNLHINLLKFAFSIRAYSPTVQMFQQIAADEPPPEGCNAFVIIHKKCTCKINEIKRLLKKATSRPSPYLFERDHKLSTKNENLPVIILYAEIGTRAFAEFHRVLFEKAQNGKILYVLRHYIQKPSSRKIYLSGYGVELAIKNTEYKALDDIQIKTVTNTTIEDETEADEVQGFLFGKLKKIYSDLKDNLTIFQKYLIESSKEMMPLKVWELQDLSFRAASQIMSTPIYDAIKLMKDISQNFPIKARSLTRIAVNQLMREEIQENQKDLQNKFEINPGDAHLFINGLLVNMDVYDPFSILDMLKSEGKMMNGLRNLGLNEEDRSKILKLSSPVWDSDYILDIRHSSIMWINDLENDGLYVTWPTSCWEFLKPVLHGTIPSIRRNFHNLVLFIDPAQEYTLDFISLAELFYYNEIPLRIGFVFILNTDNEVDGTKDAGVALWRAFNYIAEKHDVSEAFVSMIHMYQKVKDQNILTVENVKSVLQNKFPYADILDILGTHSKYDGSRKAGTSFYKMTGLGPLPQALYNGEPFDHEEMSTEELKRAVFEKMMDAFIYLQRDVFMGTLNDRLNAVDFLMSKNNVVPRINPSILHAEPQHLNLIPSSVTADIEDFSTFSFLDSQDKSAVIAKNMHYLTQEDDIISTVTLWIIADFDMPSGRKLLLNALKHMKTSVHSRLGIIYNPTSKINEENTVISRGILAAFLTHKNHLLRSFLGKLAKEEIATAIYSGYKIKTLLSTEMDKNAFEKKYNTIGVNIFRTHQLFCQDVLKLQPGEIGVVSNGKFLGPLNEEVYKEDFHLIEKITFSNSVEKIKDIAESMEFNSKSISDLIMKIDSLVSSLPTRASRYNVSLLKENHSVIKINPQENDVFFDVIAIVDPLTREAQKMAQLLVVLGKIINMKIKLFMNCKGKLSKAPLESFYRFVLEPELMSGTDNNPSHGPVAKFLDIPESHLLTLNMITPEGWLVEIVQSNCDLDNINLKDIERTVTAEYELEYLLLEGHCFDMTTEQPPQGLQFTLGTKSKPVLVDTIVMANLGYFQLKANPGAWILRLHKGKSEDIYEIVGHEGTDSEPDVGDVIVILNTFKSKILKVQVQKKSDKIKEDILADENENKGMWDSIKRFTERLHKDDRKENGVLNIFSVASGHLYERFLRIMMLSVLRNTKTPVKFWFLKNYLSPTFKEVIPHMAKEYGFQYELVQYKWPHWLHQQTEKQRIIWGYKILFLDVLFPLAVDKIIFVDADQIVRHDLKELRDFDLGGAPYGYTPFCDSRTEMDGYRFWKTGYWASHLIKRKYHISALYVVDLKKFRKIAAGDMLRGQYQVLSQDPNSLSNLDQDLPNNMIYQVAIKSLPQDWLWCETWCDDESKQRAKTIDLCNNPKTKEPKLEAAARIVPEWAKYDTEIRKLLDHLENKKKSTISVHDEL

SEQ ID NO: 3697 - protein, 1452 aa, Paroedura picta
MRLPGSRQQAGSGSKSVRDRRRRSGWSRKGAWRWLTGAAGAQAQAGRRRVCPAVLPPPSVPGTERYFYSKAVTTSLTTKWFSTPLLLEASEFLAEESQEKFWNFVETCQDFGSSNHDGTAYSYYNAVLMAASQNLSPLQQNLLKFALSLRSYSSTVQAFHQIAADEPSLKGCSTFFVVHGEKTCEFDKLKILLQTASERPKPFMFKGDHKYPVSNPESPVVIMYAEIGSEEFSRYHRKLVSKARAGEITYFLRHYIDNPSKEKVYLSGYGVELAIKSTEYKAKDDTQVKGADMNTTVIGDNDPIDEVLGFLFGKLRQLYPTLQEELKEFRKYLVESTNEMAPLKVWQLQDLSFQTAARILAAPTVDALMVMKDLSQNFPTKARAITRTVVSSELRSEVEGNQKFFKGTLGLQPGDSALFINGFQIDLDTQDIFSLFDVLRNEARVMEGLHSLGIVGQSMHNVLKLNIQPSDSDYAVDIRSPAIYWINNLEVDSKYSSWPSSVQELLRPTFPGIIRQIRKNFHNFVLIVDPSHENTVELLSLAEMFLSNHIPLRIGLVFVVNDSEDVDGLQDAGVALLRAYNYVAQEVDHNYAFQTVLSIYNKVSTGEKLKVEHVVSVLEKQYPYVEVTSILGVDSAYDQNRKEGHGYYKQTGVGPLPIVLFNGMPFQKEQLDPDELETVTMHKILETTSFFQRAVYLGELSNDQDVVEYIMNQPNVVPRINSRILMADREYLDLTATNNFFVDDFARFTFLDSKDKTAAIANSMTYLSKKGMAQDRDVLKLKKGQRAVISNGRIIGPLEDGELFNQDDFHLLENIMLKTSGQKIKTHVQELGVEEDLASDLVMKVDALLSAQPKGETRMENLFFEDKHSAIKLRPKEGETYFDVVAVVDPSTREAQRLAPLLMVLSKVINMNLVVFMNCQSRLSDMPLKSFYRYVLEPEITFTPEKLFIPGPVATFLDMPQSPLFTLNLNTPESWMVESVRTTYDLDNIYLEEVDNVVAAEYELEHLLLEGHCYDITTGQPPRGLQFTLGTSTSPVVVDTIVMANLGYFQLKANPGAWILRLRKGRSEEIYRIYSHDGTDSLPDASEVVVVMNSFKSKIIKVKVQKKLDMINEDLLSDGTSENESGFWGSLKWGFTGGQKKEELKQDKDDVINIFSVASGHLYERFLRIMMLSVLKHTKTPVKFWFLKNYLSPTFKEFIPYMAEKYSFQYELVQYKWPRWLHQQTEKQRIIWGYKILFLDVLFPLAVDKFLFVDADQIVRADLKELRDFNLDGAPYGYTPFCDSRREMDGYRFWQSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLEAAVRIVPEWQDYDQEIKHLYSRFLKEKVTGEPSKTNETKQSSQEGVSAHIEL

SEQ ID NO: 3698 - protein, 1576 aa, Papilio xuthus
MNSTGLIISLIVILVHVFVFVSTDTDPPKRDEKKAKGVTTFVTAKWESTPIVLELAEYLSGESSDLFWSFVDGVNSLKSPLQDLATDKDVYDACIGIASTLLAPAQLRMAKLALSMHLTSPAVRMFDEIAAQNGAKDVQCEEYVHIASRKICDTDTLRDILKVYKEHDPEEHRLETYLLDHSYPSSDNKTLTAILYGELGTVEFAKKHKILATYADMGAVNYVVRWNVKSRGGPKLRLSGYGVELQLKSTEYKSQDDTTPKEADAGEAVEPSIEEDENDPQNQIDGFNFGRLKNLFPALRTPLERFRRHLSESSEELAPLKVWQMQALSMQAAAAVVDANDAGGDEALKVLTSIAQNFPMQTKSLIHVNVPRSFRDEVLYNQDVWASSLGLRAAEPLLLVSGAQYDAEEVDVMALLAALREDVGPMNTLHALGLPKNLINSLMSLELGEAYTWEEYGLDIRDSAVTWLNDLETDDRYRRWPSSFMELLRPTYPGMLRNLRRNIYNYVIVIDPTSTLSGPPLKLGETLLKHATPVRVGLVLAPGSDAALSAAIRSAFNYIAQDKNSNKEAFYFLTQLISSCENDEMTLEHVKKQLKKYASSGTNVDEIVYEDSEYNFGHQLAEEFLFKIASEKYPLVLINGVPLWDDGSPTPATSSVELLEEALVSALARHTARLQRAVFRSELSDTDDAVDHLMKQPHIMPRLNRQVLASEPTQYLDLSGVPSSPELFTEERLHRLMHLTGRDALATALPILKYFLKSGKPEKITQTIWVVGDLNVKESRDLLRNAITFMKETGGVRVAFVPNVEGGSADQSLNKVVLAALATLEAPKATKYVTTLLEDEGCHERQDCDILPELVPVLNKLEWVLKATRVLCARGMRLRAGARALVHNARLIGPFEDKLGFSMDDFLLLDRFSNQVYGDKIAEVLLKKKTTVENDVFDESITVDIPELSADEYLKVISVLASRSSKSRTALPQGLRTEHSLVNLPPQYPDEAAIEIVAVLDPASTAAQRLAPLLLVLRRVVNCRLKLFLNPQDKNSDMPLKSFYRYVLEPELQFTAGGALSGGALARFSRLPQAPLLSLELRTPPNWLVECVRSVYDLDNIRLADVDSLVHSEFELEYLLLEGHAWDTTLGTPPRGLQLILGSRDQPELMDTIVMANLGYFQLKANPGAWTLRLRPGRSEDIYEIVGHENTEMTAGNSDIQVLLGSFRSHVVKLRVSKRAGSQHLDLLADNEDANAGGIWNSIASSFGGGGGGGEEAEGAEETINVFSVASGHLYERFLRIMMLSVLKHTKSPVKFWFLKNYLSPSLKDILPYMAQEYGFEYELVQYQWPRWLQRQRDRQRTIWGYKILFLDVLFPLHVKKIIFVDADQIVRADLKELVELDLGGAPYGYTPFCDSRTEMEGFRFWKQGYWRNHLQGRSYHISALYVVDLKRFRRIAAGDRLRGQYQALSQDPNSLSNLDQDLPNNMIHQVAIKSLPQEWLWCETWCDDNSKQYAKTIDLCNNPMTKEAKLSAAMRIVPEWREYDGEVRALQARVRRGLYQHTDTDQEQHPHHAGNTNTRTQSYTPTLASQYLHSN

SEQ ID NO: 3699 - protein, 1589 aa, Crucibulum laeve
MKYALSRALGIALAVLASKAASPPVKVSLRSSWSAPPLLPEILETVALEHPDAFFTYLDRLTDPETLTLPGKLSPEAIHLAALEVAVSNGLLQAPGSLTAVEMNLALHAATPKLEAFYQHYEDHHNNSAGTKCGSWVDWYGEVVCDVDTLAKLAGVETIDPAEKLLSDSSYTRPTILTFDHIFPPQDHILERPPRTAVLYGSLDSPNFRGLHTYLLSLANRPDPHVEYVFRHVPPTTREDKRNYLSGYGVSLDLKKMDYLALDDRYAHKSKDEAEISNNETEEIFDPILSLIHAHPENTSAPDAKTPLTSDELTVIGQQASQLIADSENPLTILTLLSQNFPKYASALARRVVVNESVITELHANSLRAQGGINMFWLNGASIDVKDAGNPFTLLRMLKKERSVMQSMTGLGLERTQAFEILTHPSIAASQKDKGMLDGLFDASDRPEEGGVVAWWNDIEKDGRYAKWSPSIYSLIRIYPGQLPSVKLNLFNVILVLDLSQSTSITFLAGPMASIIDRSIPFRFGVVPIAETEESKKMAKLFYYLRQTYGRKKTMTFIKQLREIVPETSATVPWSAVRSAYDDLFELEESSETPPASLDDIVNGNIPAAPLGKVAAYTERLGATLAASPFGHAFFNGKHFDMGDDFLRQLQMELGQQLQYFQEKVYSGEIKEDSATDMENYFYNMPTTAKRRTRYIYPSTGGGSLRIMNLPELFEKTGLRLSPSSYIYPADTESVPMSVYVVADLDSEVGLELVKEALGSITKDSRTRLSFIHNPTDPAVSDRGKPASSRLFGHLMSTHTLSNASPNILLSALGLNPLTLTGDSAQAPITQEEALNQVTGGVESNAFSMEAYADYTKSSRLVVRDLHLTPGQLALVINGRVVGPIDVGEFHSADFRALEEYELRKRTEPIVAALKSVVPDVVDGDRASFANLVAMTSSIIASTQQPDPSEIGLFDAPQRPRQRNYQLLDSKYTAFEFGSNATALYHIAVLVDPLSETAQKWSSILRWLANVPDVFIQVYLNPARYADVPLKRFYRYNILPSLTFDNSGYEVPAQAVFENLPIDPIYTLAMDVPSPWLVRPREALYDLDNVQLGHLSPGDTSVDAVFDLDYIVVEGHAREIDTNGAPRGVQLELVASDGTSIDDTQVVANLGYLQFKAKPGVFKLEIREGRGRKIFKMDSVGNEGWESPTVEEVGSDITVTSFEGLTLYPRFSRLPDMEAADVLQEDDSPPGGFFEELGSKLMSMFKHKKEEAKTALTPAKQQAEINIFTVASGLLYERFVSIMILSVLRNTNSTVKFWFIENFLSPSFLEFIPHLAEKYNFQYELVTYKWPSWLRAQTEKQRIIWAYKILFLDVLFPMDLKKVIFVDADQIVRADLKELVDLDLRGAPYGYTPMGDDNYDMEGFRFWKTGYWKDFLQGRPYHISALYVIDLVKFRQMAAGDILRGQYQALSADPNSLANLDQDLPNNLQKEVPIFSLGEDWLWCETWCSKDRLHRAKTIDLCQNPLTKEPKLARARQIPEWEEYDAEIARFARQLVEEGKIHSRMATADANVLAGGNGAVAETESSTPELTEEVVEVTEEEDVPGRDEL

SEQ ID NO: 3700 - protein, 1542 aa, Ceratitis capitata
MPLQIVCRVLALVFLVSASFKESGASSAPSQSYAVTTLINAKWQQTPLYWEIAEYLADENPALFWDYVNDILSEQKSIKEYASESNQYLAAINVVRNRLTSLQLPLLKLVVSLHSLTPRIQTHLQISNDIYNKSQCDVETFVQIGSDVICTIDELEKKLNSKTDVHEEVVTYSFDHIFPGSKNDSQTVVLYGDFATDTFSAYHKLLSNEALSGNIRYITRHFIPSLTNRKTVRLSGYGVELHLKSTEYKSQDDAPKTNDDIVKDNTTEDFEVKGFDFKILKSRFPSLSHSLDQFWYNLLKGNEEITQLKAWEFQDLGLQAAAAISEVQGDEALQILQFIAHNFPMQAHTLLHHKVSDALRSEIKHNIDVFGRSLNIIPPDGALFINGLFFDADTMDLGAIVETVRSEVHVIESLHKNNIRGSLATALLALDLSGASGKEFAIDIRDTAIMWINDIEADAQYRRWPSSVMDLLRPAFPGMLRNIRKNIFNLVLVVDPLKPASRNLIKLAESFVIHQAPVRLGLVFDIRSANKDSLKDYHSLICAYNYVTQNKDGRSALSFLTDVFAAADAAENVRHQHIKSQLKKAFSNLSGSKIDDILDEDSDYDYGKQLAQEFIERLGFASSPQALLNGVPMQQSILSSDSEFEEAIFSEIIQQTSTFQKSVYKGDLTDSDTVIDYLMNQDHVMPRLNQRILNADATKFLDFTGNEYKDLPNVRDLIQLSNRDMTAVLLGNIKYFGGKHATERIGNAKLNFLTIWVVADVEQPEGRELLANALRYLKSGSSVRVGFIPNIEGLSVSNKLNLNRLVWAASQALPPVEATDLVLKWLKNPDKINEVPDSFNDILTSTELHIKMLRVYAQRVLGLPKEGRLVIGNGKIFGPLSTGEQFTIEDFGLIDRFNAFQYGDKIRKVLQQNSDSDEDTSADSAITSDTLLKLYASLVPRQSKTRFKIPDDIKKHNSVVTLAPKMPSMPHFDISAVVDPASRSAQKLAPILILLRNILNCKMHIYLTPVGQHSDMPVKNFYRYVLEPEVQFESNGKLAEGPQAKFTGLPVNSLLTQNLQVPENWLVEAVHSVYDLDNIKLSDIGGPVHSEYELEYLLLEGHCFDSNSGAPPRGLQVTLGTQKSPAIVDTIVMANLGYFQLKANPGVWELRLREGKSTDIYDITNAEGPNTIHQNHLTKVVISSLRSHVIKLRVTKKPGKQNADLLGDDEEDSTSGLWNSIANSFGGGSAASAPGNVGDEDSQTINIFSLASGHLYERLMRIMMLSVLKHTKSPVKFWFLKNYLSPQFTDFLPHMAREYGFQYELVQYKWPRWLHQQTEKQRTIWGYKILFLDVLFPLNVRKIIFVDADAIVRTDIKELYDMDLGGAPYAYTPFCDSRKEMEGFRFWKQGYWRSHLMGRRYHISALYVVDLKRFRKIAAGDRLRGQYQALSQDPNSLANLDQDLPNNMIHQVAIKSLPDEWLWCQTWCNDNSFKKAKVIDLCNNPMTKEAKLTAAQRIVPEWKDYDQEIKNLMIKIEDHENIDHHPVIATNEHDENLKHEEL

SEQ ID NO: 3701 - protein, 1632 aa, Moniliophthora roreri
MLPWLLLVASTALAASHPPVEVSLRTSWSAPPFLVEVIETVALESPSSFFPFVDAVTDPSTLELPQNSPPEAIYRASLEVAVVNGYIADVSAISAVEMNLALHAAVPKIEAFYHHYNTTNHGRQINCGSWVDWYGTIVCDVETLARLVRVETIDPTEKPASTSTYNRPKILPFDHIYPPSRAGRYPPRTAILYASLSSPNFRELHEYLYKLAKNTDGVPLVEYVLRHVPVKESNSKTYLSGYNVALDLKKMDYLALDDRHVANNGRDEDSTNSEDLDTPQEEDVVLSLIKEYPEPAISTDGAPQELDEEQQKAYLSSLGAQAAQLIYDASHVNPIKILSGLSQNFPKYLPLLGNPQSQTPRIPISPELEAELHANQLRVQGGVNAMWLNGITVSESDTSPFGLLRLLKKERDILKTLTTLGPLASDGSRWLGNGQALDLLTHPKVAAAQNDGVNSVVDDLVDASDRVESGDDKGGKVVVWWNNLESDTRYANWQPSLHAILRPLYPGQYPSVKLNLFNIVLVVDLSQTSSINFITGAVGNIIQRNFPFRWGVAPIVGSSSDDSTKMARLFYYLVQNYGRKKTMDLLKKVSQIQVPPHHQTPSIIWDTVRSAFAELIADDDKAVDLDAILKGTAQGEDDALSHVEGSIEKARAYAQRLGLEGKGQGQGFAFVNGKYFDMSDNFLQQMQLELRNHLQYLQEALYEGRITPPSLDEAAHPDKPFSMTYHFYDLPTTAKRRNKYIVPPSNDKLKLVNLAEVLENSAFQIANGGYLYPESEDDVPLTMYVVSDLNSRDGLALVKEALLSIEGNPLARVSFLHNPVKAEIPEILKSPPVSALFAHLILNEELGSKESRMLLGALGHQTEAPGSGEQVPLTQPDYLRAVLGGMKPSSLDYTNHTKYVDMGRKFLSEVDMKPGEKGIIVNGRVIAPLGTDDFHAEDFKALQSYEMRKRVQPVVDALEEVATDMKKMDRTTRTHVISMTSSFIAAIQLPDPSEVGLFETSQRPRQRTYRSLEGTYSCFEFGDNTTALYQIGVLLDPLSETAQKWSSLLDWLSNVPNVYIEVHLNPAQYTEVPLKRFFRYNLRPALTFNENGEENRAEILFEGLPVEPIYTLAIDTPSSWLVRPREALYDLDNIQLRNLSPEDTSVEAVFELDYLVVEGHARDTLTNSPPRGVQLELVSGRDDNLVPVDDTQVVANLGYFQFKAKPGVFRLGIREGRGRDIFEMESVGNEGWDSPSVKEVGDEITVTSFEGLTLYPRLRRKKGMERADVLSEDDEDDDDGGFFGNIMDSIKSIFSSDDTEDSLVPKNGQAEINIFTVASGLLYERFVSIMILSVLRNTKSTVKFWFIENFLSPSFLEFIPHLAEAYNFQYELVTYKWPSWLRAQKEKQRIIWAYKILFLDVLFPMDLKKVIFVDADQIVRADLKELVDLDLHGAPYGYTPMGDDNYDMEGFRFWKTGYWKEFLQGRPALYVVDLVRFRQIAAGDILRGHYQALSADPGSLANLDQDLPNNLQREVPIYSLHEDWLWCETWCSKDRLHRAKTIDLCQNPLTKEPKLSRARQIPEWEEYDAEIAKFARKLAQEGKIKSRIATADANVLASAGSTSKPETSADASPPLEPTHHDGAADDQPRDEL

SEQ ID NO: 3702 - protein, 1321 aa, Trichoderma gamsii
MLYRHNKHLSFDRVTGTGREAILYADITSEGFGDFHKALSNAAAEGSLSYRIRYHRTQTTPYAALPMSGYGVELALKRTDYIVIDDRLQNEEPRHENTGTGAGLDGSEDVADIKPLTASDLSSLGLKATSFILQSDDPLETLIKLTQDLPKFLTTIVAHNVSTQFEKELKLNSLQGVPDGLNMLWLNGVQLIERQIEPFALIERLRQERKLIDGFRALGLNGKQAVSILGHQDVSAAKEGSEALRYDWTDRLEDGRVIIWLNNIESDDIYEEYPKSLKSLLQPSYPGQLPPIGKNIFTLIAPVDFSNLEDVSYIMQLISFISRGISIRFGLVPLISTPEAIVKAKIAYHIFENYGVKGLFAYLGQLEDAPQLVNEELFSRITGDHALLVDSDQMSLAEVLEADTYEQQLGLAQQWIKRLKVDTPTRQVFFNGLPILRDENWIQELGMQIGEDLRVVQKAVFLGMITDDDWAPGIFLSKAISRRNDYITPDDEGKSLTVLNVNKIYIEHADLFSNVPVIDFVAESPKEDWSAVSVIADLTTTSGKGLVLSGLEFKRRSPGARIEIIHNPVSSDGAASINAALLANQGLLSDIQDISKLTDLIQTPSKDESRDSYFGALERFLTASKVPLGAQMIMLNGRMIGPISEDSEFDADDFQQFLEVEQARRILPVYKAVEELGLGDKLSTPLDAAKITSIAALSTISDFPEGIFESATSARTSLYDQWPATHTIEKGDPETASVHIVGLINPVSEQGQRWAPILKVLSELHGVHLKLFINPPEKIEELPVKRFFRYVLKSQPTFNDKGEVAGLRATFNGLPSEALLTTAVDVPPAWLVAPLLSIHDLDNIKLSAVKTDIHATYELKHILIEGHSREGRGAAPRGAQLVLATEKDPLITDTIVMANIGFFQFKANPGVYSIQLKEGRSTEIYEIESIGAQGWNPVPGDNGTELALIDFQGVTLYPRLQRRKGMETEDILQEKDVQDNNIISKGIKLAEGLFGGKSKKKSPSEQEHAEINIFSVASGHLYERMLNIMIISVMRHTNHTVKFWFIEQFLSPSFKEFIPHMAEQYHFKYEMISYKWPHWLRQQKEKQREIWGYKILFLDVLFPLSLDKVIFVDADQVVRTDMISLMNLDLEGAPYGFTPMCDSRVEMEGFRFWKQGYWANYLRGRPYHISALYVVDLRRFRELAAGDRLRQQYHTLSADPNSLANLDQDLPNHMQFNIPIHSLPQEWLWCETWCSDESLSEARTIDLCNNPLTKEPKLDRARRQIPEWVTYDEEIAALHQILKVEERLSNDDEETAEAGTEDKNTKSRRLESDETHTKDEL

SEQ ID NO: 3703 - protein, 1518 aa, Dufourea novaeangliae
  MOD_RES (1261)..(1261): Any amino acid
MWSTIPFYLLLLCITHLEADKRVNKYVTTLIDAKWKETPLVLEAAEYLNDENPIYFWKFVDTFSNNDFRNATERDNYNAIIAFAEKYLSSSEVALLKLGLSLRIYSARVEMFTQMAENKNISNFECYNIADIGGTYTCSLEELETLVNQETWSNPDTYSVDHRYHTSPQTERIVILYGQVGTPNFSDFHNKLKELAETKGFNYILRHYLKDRIDKNVQLSGYGVELQMKSTEYKATDDSDIKDNAGKDSESASDSMEEIDGINFVTLKNLYPDKQAELDRLQTHLLETSHEIGALKVWQFQELSHQAAERIMNSPMSEAVNVLTDISQNFPMQAKSLIRTKVNSEMKKEMKLNQAIFTSNLNIQPTDTALFVNGLFFDLEAVDVLSLLESLRNELRVMESLRKIGFSNTQMSKLLSLDLSTNMDKQEFAIDIRDSAIIWINDIEQDSTYARWSASLTELLRPTFLGMLRNIRRNLYNLVLIIDPLSTESTALINLAQSLYLHAAPLRVGFVFVTNYDTTITGLTDPSVAVNNAYHYFAEVKGSEHALQFLIDLRNYIGPEGATVEDVKKAIKAQDASANVNYILGEESEYDVGRHLASDFVKRSGFKKFPQALMNGVPLSPDQLNADSFEEAVLSTIVSQTPALQKAVYRGEIAEQDDVVEYIMNQPNVMPRLNERILKAEKHTWLSLIGTVPSDEDYTKWSPQDFSTWLMNRLQYLFVPRRSNVHHLYTFWVVADLQTSAGRMLLRESLGYIESNADIRITIIINPTTDTNDMDSATDINRIALAGLNSLPAEKAMHFVRNVIQEDVANTIASGSFNIEEEAVREQLKKQIDELRVHRQYVKTVLSLERGARAIVCNGRLIGPLNDDEEFTSDDFSLLERFSQSNYGDKLFKKLIKERLLEDDEYEKNEITDNMIMKITSLLVSHPQTRSRFDVPFYGDDYSAIKIPAAHPDEVAFSLIAIVDPVSRGAQKLGPILKTLQQSLNCNIKVFLNCLDKNSDMPLKSFYRFVFEPHLQFSIDGRINGAMAKFTKLPTSSLLTQYIHAPENWLVEVVRSVYDLDNIKLDNVAIGVHSEFELEHLLLEGHCFEAVIGNPPRGLQFTLGTEKQPLMVDTIVMANLGYFQLKANPGEWVLRLRQGRSAEIYDFTTVGGQDVIQNGNDVKVVISSLRSHVLKVKVSKKPEKIGMDLLSEDDKSSGLWNSISRTFATGDDSDDQDEKLNIFSLASGHLYERFLKIMMLSVVKHTSSPVKFWFLKFRLLXDFLPYMAKEYGFEYELVQYKWPRWLHQQTEKQRTIWGYKILFLDVLFPLNVKKIIFVDADQVVRADLKELATMDLGGAPYAYTPFCDSRKEMDGFRFWKQGYWRNHLQGRAYHISALYVVDLKRFRRIAAGDRLRGQYQALSQDPNSLANLDQDLPNNMIHQVAIKTLPQEWLWCETWCDDTSKNYAKTIDLCNNPMTKEAKLQAAVRILPEWVGYDDEIKALQQKLDNENRQTEKEEHETFEEDATDGDSAKHEEL

SEQ ID NO: 3704 - protein, 1489 aa, Trichoderma arundinaceum
MKQHRWRPWNLTLGLMLALQAHSSPSVNVGMNAAFPAGPYLLELLETAAAENSSSYFPLLDRIATGYFASASTDAALYAKFLDAVQEDGSLSSPEALSTFKLALSLRSAAPRIEAHYQYYDTAVASAIQDAANPDCLNWVLLEGKQYCTPELDEANKDGLLSLEAKDLPFDRTFGAGEEAILYADPTSTTFGSFHRTLTNAARQGSLSYRVRYRRVETTSAATLPMSGYGIELALKKTDYIVIDDRLHDDGSHVESSSSSTSTNLDDSEDVADIKPLATSDLSSLGMKAASFILHSEKPLATLIKLTQDLPKFLTAIVAHNISSQFEEEFHSNGLNGVPDGMNVLWINGVQLIERQIEPFALIERLRQERKLIDGFRALGLSGKQAVSILGHQDVSNAKEGNEPLRYDWTDRLEDGRVLIWLNDLENDDIYEDYPKSVASLLQRAYPGQLPPIAKNIFTFVAPVDFSNTEDVLFVMQLFSFISRGLSIRFGIVPLVSSPEATARAKTVYHLIENYGIEGFSAYLGLLRDASATTTDEERFIEVTKDHKLLDDSDKMLFAEVLETDIYEQQLRLVQRWIHRLKVDTPVRSLFFDGLSIPRDENWMQALGMQIGDDLQMVQRGVFHGILTDDDWAPGIFLSRAVTRRNSYVTPDDERKSLRVLNINKIYIEHADLFEVIPVVDSIQGSRKEDWAAVTVLADFTTTNGKGLVLSALGFKRHNPGVRIDFIHNPATTIGAASVNAALRTNQGLLSDIQDIGELTDLIQNPSEEISTDGYVEALGKFLSASKVPAGAQIIILNGRMIGPISEDSQFDIDDFQQFLEVEQTKRILPVYTAIEELGLGDRLSTPLDAAKLTSITTLSTISDLPEGIFESAPSARTSLYDNWQSTHTAIEIGDQETASIFIVGLVNPVSEQGQKWAPILKVLSELQGVHVKLFINPMEKIEELPVKRFFRYVLESQPSFNEEGGVEGLTATFNGLPSEALLTTGVDVPPAWLVAPLISIHDLDNIKLSAVKSDVHATYVLKHILIEGHSREGKGSAPRGAQLILATAKDPLITDTIVMSNLGFFQFKANPGVYYIRLKEGRNAEIYEIESIGAQGWNPVPGDNVTELALIDFQGVTLYPRLKRRSGMEQEDVLQEKESQETNIISKGIKLAEGIFGGGSKKKSVSAQEHAEINIFSVASGHLYERMLNIMIVSVMRHTKHTVKFWFIEQFLSPSFKEFIPHMAKEYGFKYEMVSYKWPHWLRQQKEKQREIWGYKILFLDVLFPLSLDKVIFVDADQVVRTDMMSLMNLDLEGAPYGFTPMCDSRVEMEGFRFWKQGYWANYLRGRPYHISALYVVDLRRFRELAAGDRLRQQYHTLSADPNSLANLDQDLPNHMQFQIPIHSLPQEWLWCETWCSDESLSEARTIDLCNNPLTKEPKLDRARRQIPEWVTYDKEIAALNQLYREEAGIAGRERLPGDGERSVPATQDKNTKSRRLEEQVSHTKDEL

SEQ ID NO: 3705 - protein, 1693 aa, Phellinidium pouzarii
MRTPRRTRAAVWAWLGIAGCVHVAASPAVRVDLRTSWSEVPLLLEVIESISAEEPGTFFPLLDALATSDALPPLDTLSPEAIHQATLQTAVALGFLQEPGALASVELQIALHAAAPKVQAFYQFYRYADQRGGPSFSSEAGREAGEEKGKKGESSLDPNCVSWVDWYGERVCDVETLARLAGHDTIDADGEHIFNSTFVRPKLLSFDHIHPDPERTLTPPLRTAIFYASPSSPNFRVLHAYLYKLANAPEPHVEYVFRHVPLDGQATRRKNYLSGYGVALDLKKTDYLAVDDRHSASSDYAGDDAPSEGSYIEDDIVSYLIDQYPESVDADVSTPLSEEELISIGIQATQLITNSSNPLETLTQLSQNFPKYAASLARRVALNESIVEEVANNHMKAPAGVSAFWINGLMVHEGDITPFGLLRVLRKERAIVRSLTAAGLEPAQAVDLLTHKAIQVAQTEGGGVLDALFDASDRYEGGGAIVWWNDLTKDSRYARWNPSITGLLRQVYPGQMPSVKQNLINVVLITDLSQMASLNFIAGPLNNIISRGVPIRFGVVPGVETEDGRKMARLFYHLIDTYGRAKTMGFFAQIAQIQMPIHLLGPTVDWALVSRAFIELQRLNPRDTETESNLNIISIDAIINGGDEETKEDVGDEVDGGTEVSLADHVKRAHAYALRLDATPASCPTGHAFVNGKHYDLDDLFLKLLQTELSTQIQYLQEKVYLAELSDADLGSIDTYFYDLPEAYIHRNRYIFPSPAKPGVGSASGSGDLRVANLPEVFRKMGFAPASGAYLYTEGRPDSDEALLTTLVVADLDSESGIALMKEALLSLDIGNSSRVTFIHNPAPLDTASPAPHRRVSPIFSHLIMHGLLAQVSQKELAVVLNPEITLLDDSEGFGEQVTLSENSVVYQLLRDVGVVMDRLGESKVHTHYVGACGLAAREFGIAPGEIALVVNGRIVGPIEPYAFASRNFASLRSYEMRRRVEPVIKALTNLTITPDSFDKSAYIDLVSLASSVIASVQVPDPSEQGLFNNPPLQRQRTYSQISGNFTSFSFGDASTAAYHIGVLLDPVSEAAQKWTALLKWLSTVPSVYIQVYLNPGRYSEVPLKRFYRFNLSPSLSFDENGNEIDAQTVFDNLPIEPLYTLAMDVPPSWLVRPREALYDLDNIQLSMLAPEDRERGISAAFELDYLVIEGHARDALTNAPPRGLQMQLTSLDGVPVDDTQVVLNLGYLQFKATPGVFRLELREGRGRDVYALESAGNEGWHSENVSIAGDEITLTSFEGLTLYPRLRRRAGMEKADVLDEFVVGEQQQRSLLDNLASRVASYFRPKEAAVKTIAPRQADINIFTVASGLLYERFASIMILSVLKNTDSTVKFWFIENFLSPSFLEFLPHFAEAYNFDYELVTYKWPSWLRAQKEKQRIIWAYKILFLDVLFPMDLKKVIFVDADQIVRTDLKELVDLDLHGAPYGYTPMGDDNVDMEGFRFWKMGYWKEFLQGRPYHISALYVVDLARFRQIAAGDILRGHYQQLSHDPNSLANLDQDLPNNLQREVPIFSLPEDWLWCETWCSKDRLHRAKTIDLCQNPLTKEPKLVRARQIPEWEEYDAEIARFAHTLADTGKIQSLIAAADANSLASAGSGGLVGMSAKIASVDEGDGKTDDGTQYRSEPAAGPAEPADTEHALGGNGESAIIHSKDEL

SEQ ID NO: 3706 - protein, 1182 aa, Manacus vitellinus
RAITKTVVSSELRAEIEENQKYFKGTLGLQPGDSALFINGLLIDLDTQDIFSLIDVLRNEARVMEGLHSLGIEGLSLHNVLKLNIQPSDSDYAVDIRSPAISWINNLEVDSRYNSWPSSVQELLRPTFPGVIRQIRKNFHNFVLIVDPTQETTAELLNVAEMFFSNHIPLRIGLVFVVNDSEDVDGLQDPGVALLRTYNYVAQEMDNNYAFQTVMSIYNKVKTGDQLKVEHVVSVLEKQYPYVEVNSILGIDSAYDQNRKAARGYYEQTGVGPLPVVLFNGMPFQKDQLDPDDLETMTMHKILETTSIFQRAVYLGELSNDQDVVEYIMNQPNVVPRINSRILTSDREYLDLTGMNNFFVDDFARFTMLESKDKTAAVANSMTYLTKKGMSSKEIYDDSFVRPVTFWIVGDFDKPSGRQLLYDAIKHQKSSNNVRISMINNPSEDPNSQNTVVAKAIWAALQTQTSNNAKNFITKMAKEETVKALEAGADILEFAVGGMDTNIFKEAFESPKVDFILSHAMYCRDVLKLKKGQRAVISNGRIIGPLEDGEMFNQDDFHLLENIILKTSGQKIKSQIQQLGFEEDLASDLVMKVDALLSAQPKGEARIEYHFFEEQYSAVKLRPKEGETYFDVVAIVDPVTRDAQRLAPLLLVLNQLINMNLRVFMNCQSKLSDMPLKSFYRYVLEPEISFTAENNFAPGPIAKFLDMPQSPLFTLNLNTPESWMVESVRTPYDLDNIYLEEVDSVVAAEYELEYLLLEGHCYDITTGQPPRGLQFTLGTSTSPVIVDTIVMANLGYFQLKANPGAWTLRLRKGRSEDIYRIYSHDGTDSPPEASEVIIVLNNFKSKIIKVKVQKKLDMMNEDLLSDGTSENESGFWESLKWGFTGGQKNEDVKQDKDDVLNIFSVASGHLYERFLRIMMLSVLKHTKTPLKFWFLKNYLSPTFKEFIPYMAKKYNFQYELVQYKWPRWLHQQTEKQRIIWGYKILFLDVLFPLAVDKILFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAMRIVPEWQDYDQEIKLLQSLFQKEKEMGTPAE

SEQ ID NO: 3707 - protein, 1529 aa, Pneumocystis murina
MKLNIFRKAWCIIFIYFLGIFFQLCLGSPVINAYLTSSFKAPPFINIFLETVSTYGETYFFELLDIISKIRNVTLTELNLDNYNYLRKIVYDNEIIKDNISLSLLDYELGLQLLAPRIESYYHYYNYTVIPEMMNKNFILECRNWILFNGQQYCDLEEFLKAKDCRYEEIESVVLLPFDHIFDTHKNYDSPVAVLYADLDSDDYKTYHSFLFAEAKAGNLKYVFRYKPGNSGSHLLYLNGYGVQVSLKKTDYLVIDDRNIVDDLNEKTFMGNHNLNVDSDDLLSDIQNDEIKPLTNAELKRLGFSIVQFVNYSKTPLETLNSVLQDLPKYASYLSSIKVTRNLMEKLELNHQYIDPGMMLFSINGVEIDPSKINGFSLSKYLRNVYDFVMSLQKLGLSAKEAKFFVNESIYNIFNKFFDNRFDFRDKYENSMAILWLNDIENDPNYSHFSNDIYKYFDDVPFQQLHMVRRNLHHIIIFLDFSGKVDFLLLRTMLLLIRSSYPIRIGVVPIWDDSEDMFMVKLFYLLYDIYGINVAFEYLSYIDSGTRKNRNVLYRNYKIISSKYSFGKNIQYLDIDEIMKFKKLNKYVLKTKEWVLRLNIKNDNYIIVNGKFVEKKNWQYSILYIFPNDVNIIRKKIIEGSFTNNANILDYLLEDAIFTRKFYMYPTNKLIKSQNLIDFIKSYENMEFSSINENLNTEQSIWLIADFDTKKGIKYLKSALKYIIKHPYTSLRFLHNPRVNNKGEFDHFSSFLFLLKERDIDVAHPTLNYVRKIFNNYDSGGIDKKIEYPHFILNTYNSTQLALSSVKARLYWKKIGNLLNKFGFLPGEFGLLINGYIVGPMSEFDDFLLDDFESLGNFCNLSMVSKLKVIVNELSIKNSEKLKIFFPLLSSVILSYLVLEKHDDFGYSSQDKRSNLQNFFRELSPSFAYGDENDCLFNVKAILDPLNEISQKLVSILKVLKQMESVCLKVYLNPLREVTDLSINRFYRYVLHSSLKFDSNGNLIYPNAVFEELPKLHLYTVDYDILESWIVTQKESIYDLDNLLLQDLSSKKISKVRIVYELKHILIQGHAEDITLKNVPAGIQLALKTKNNSFVSDTIVMNNYGYLQFRANPGIFKIDMIKSHSSIFKISKISEKFESNDNKFSKEIILDSFEGLTIFPKLVRNPGKENVSIFEVKDLDSDNFTPNTVLNSTNSQQTDEFKLNSFMQKPYAEINIFSIASGHLYERFLYIMTLSVLKHTKHTVKFWFIENFLSSSFKNFLPYVANEFGFQYELITYRWPHWLRPQKEKQRQIWGYKILFLDVLFPLDLDNIIFIDADQIVRTDLKELVDMDLKGAPYGYTPMCDSREEMEGYRFWKKGYWESYLNGKPYHISALYVVDLKRFREIAAGDLLRQHYQTLSEDPGSLANLDQDLPNNLQHLVPIFSLPQNWLWCETWCSDETLKDAKTIDLCNNPMTKESKLKRARRQIPEWNKYDKTIADLIARVLEQRKTNESGEYVVDNIAIPVDMMQNIQFNFDEKNKKKDTHDEL

SEQ ID NO: 3708 - protein, 556 aa, Acropora digitifera
MRIKPTHDGPSFDVVVIVDPLTKAAQKIAPILTVLQNVTNVNIQIAMNSREKLSELPLNRFYRYVLEPQLTFDKDGGLSEGPLALFLDMPQSVLLTMGINTPLGWMVEAVYSPHDLDNIKLQEVEKQVMANFELEYIFIEGHCSDFDTRQPPRGLQFTLGTQRNPTMFDTIVMANLGYFQLKAYPGAWSLRVREGRSAEIYDIESVSDSREEEDKHFAVVVDSFVGKLLKVKVRRKPGMEGKDLLGDSDSQSGGIWDSLSSIVGSDSKEKTAQDETINVFSVASGHLYERFLRIMMLTVIKNTKNAVKFWFLKNFLSPSLTVFYSLSFCCCCCLYEIYEVCHTVRYKILFLDVLFPLHVKKIIFVDADLIVRADLKELNEIDLHGAPYAYTPFCSSRSEMDGFRFWNSGYWRSHLGGRPYHISALYVVDLDRFRRLAAGDRLRGQYQGLSQDPNSLSNLDQDLPNNMIHQVPIRSLPQEWLWCETWCDDASKSAAKAIDLCNNPMTKEPKLKSAVRIVKEWQDLDNEVRRLQESVAAANKTESKQTDTAREEKDEL

SEQ ID NO: 3709 - protein, 575 aa, Emiliania huxleyi
MAFRPESLGCGAACVQLAGSGPGKALELTAVLDPLSKEAQRAVPILMALHESLGLSVTLHLNPSLQIDKFPLESFYRYVVSLEPSFDNAGRSLSPQLDRALFSSLRTPQVLTLHVDAPEAWLLECTEAAYDMDNLRLAELGDRRTVSAVYELASLLITGSCEDVGSRHPPNGLQLLLGTTAQPHATDTLVMSNLGYFQLKAAPGVWDLSLAPGPSSEVFTLRTAPALLAAGHSTRAFRGGMQRIDPATLNDAAAVRVTMADFTGANILLLAQKRPGLESWWSGGEKGDASETVHVFSLAHLYERFLKIMLQSVLQRTKRHVKFWFLKNFLSPAFIGSLPAMAAALGIERGRGHALGFEYGLVQYQWPSWLHKQTDKQRIIWGYKILFLDVMFPLSVVNADVGELWDMKLPGRAAVAMTPFCQADANPDTTGFRFFAQGYWRDHLQGRPYHISALFVVDLHKFRRRAYGDQYRVFYDSLSKDPNSLSNLDQDLPNYAQHVVPIHSLPEEWLWCETWCGNTSKPRAKTIDLCNNPLTKEPKLSQATRVIGERWSALDAVAKGIEEAESPAQPSRDEL

SEQ ID NO: 3710 - protein, 1674 aa, Trypanosoma vivax
MHRLTPRGGVLLEAGMTSRMLRVFFVLYVTVIALVAPPAEARGIRVQLLAPWNETPLLQEGCEWASRSHERAASSSSEYGFYDCLRGVWSIAEATNRTGGAQELTQKVQYDLLLDTMRAAGQPSNRVALLKMSLASRLSSPAVEAHWQLARRAIRRVGGCADVGRPFVLLSGRAFCEEAPLKGALLKISGTGHDSDTEEVEEETQSDELALVIPSFDHIYPHSGGRVVVFLYGIVGDSRTMRLWNLLEPYAESVRLIFRHLPVTGSRWENALAVQGYGVTVDVKSSEYKVVDEKSNAGYATRRGGVAAPDDDGEERQTISGFNATRLQERYPDLKVKLDDFFSVLEEAAEKVKVDLHNWEKESMGLAAVQYVMDATEGHLDALLDLLSRFPARATRISRASATILSRIGDETIAALNGIANAVGQGQLGMFLNGCRVSPEEMNLFHVLHKIEEYEQLLGGLSNVLTSHSPPSDRGEDATYERAEALRFGVDGLTKLLTEKASLFGSRGKGMPRIWLPKEDVFWLSNVETSPFLQRLPRSLQALAQMNAYGNIMLPRRNLFHVVVVVDLTTTAGQETLGLLVNHLQGRQPFRLGLVLADPKWAPTVGLANDGAGFAATPSASKAVMGTSAAIWEILRADPEDVQPIVQLLRGLMTRMLQSGAITDLDAHEVVQTVLSGEGKRTMGDIMADPDFVMYYQKTQEMVHTVGLDGSLTLVNGDIYPQGLMYALQRGIVSEIMYVRQLIVDGVLRDDDENLYDSIMDAAGAKRRYLASLYNESIYMDWGSKSVLSFLQNRWFFLPPQAADTLPLISAVLALHHPVTVQSLQAVVTASESLLSCSEGGKNCGRVRLAVLTCGGHMRTERPTLMRDLERLQWHIFEGDKLSNERRLGLLHEFVRAIVKHSDEQRHLNDPDVYEGILKHVQLPEDIRKLITSPLPESETREGSSSRLQASLAQGFCREMNRGADASSDAIRVHAGKVYYYFNGRRLEYKEQFTEKDFETAALQELEVAEKVWYLLEQIDIMKLNPRLDGSEVGNDFYASRVAAVASLLHRDAIHNDRSEEQKRGFPISPGPASFVAGPVAGREARHRLLVSLDPTSRESQQAAAICDYVSRAPIGATCIVYLNPSRKMQASVRNFHNFVSTTELSFDVSGDVVPPRALFHRLPANHLLTVGVVEPEQWTVFPMEAECDLDNIVLSKLPSETNYIGATYRIHSILLTGSAVELGTSSPLSGLPLQLRSSPHNTIRFRNNGSVESTEVTRDTLVMAIKAYFQLQAAPGLWYLTIQPGDIARAFYISHINKMLLRDSANRAKDNQHDYASGQNVPVMISSFTGAFISVGVSKVAGYEATHIRELIASSIESSRIQWPPSGPRNKRPDRPTLNIFSVASGHLYERFLRIMMKTVMDSSFDVHGANTTRIKFWLIENFLSPHFKEHVMLLAKHYGFEVGFVTYRWPWWLHKQTEKQRTIWAYKILFLDVLFPLEVDRIIFVDADQIVRGDLHELYNMDIGNAPMAYTPFCREYPNTATTNFRFWDRGFWMTHLRGKPYHISALYLVDVAQLRTALGGDKYRAIYSQLSQDPNSLANLDQDLPNFMQDDLPIYSLPEEWLWCETWCAQESKSRAKTIDLCNNPLTKTPKLDNVRRIIDGWDEMDSNLETLVQRLLKEKQEGESVQNNMT

SEQ ID NO: 3711 - protein, 891 aa, Homo sapiens
MDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTSSTRSMAASASGEASRSFYSWWKAKQEQVSYIGGTGPRERRGRCHTLLNNQISH

SEQ ID NO: 3712 - protein, 1519 aa, Nothobranchius furzeri
MKRVVVLSLVLLSVHPGASTPPKGVTASLKAKWSMTPFLLETSEFIGEDGNEKFWQFVDTVKELTVYKHGESVRSYYNLIIKKAGQFLTDLQVNLLKFALSMRVYSPAVHASQQIASDEPPPEACPAFISVHGQHSCSTKDIKKLLKGAAGRPKPYLYKNDHTYPGANRTDVPVVILYAEVGTKKFNSFHKVLSEKAEEGALLYVLRHFVAKPKPQNMLLSGYGVELAIKSTEYKAVDDTKVKDSKTVISAEDDDNDEVQGFFFGSLKKSHPELQEQLGELRKHLLESTNAMAPLKVWEMQDLSFQAAARIMSVPKFDALKVLRDLSQNFPSKARSLTRVAVKKEMRKEIEKNQKYLSETIGVHPGDGELFINGLHIDLDTHNTFSVLDIIRTEARILEGLHNLGIKGEHQGKLLRLPMSTVGDSFALDIRQPAIMWMNDIENDPMYRNWPASVQELLRATFPGVIRQIRRNFFNLVLFLDPLQEESVELVKLAELFYKHKIPLRIGFVFVVNTKEEIDGFSDAGVGFYRLLNYIADEYDLSQAVMSIVSLYNQVEEGQMLSAEMISAYLKRKYPKVNPEKVLGVNSEYDYGRKDGALFYRKSGLGALPLGLFNGVPLNPDEMDPEDLETIILQRIMDTTPAFQRAAFMGQLTDSSDVVDYLMEQANVVPRMNPLILGTDRKYLDFTRTPALDDWEDTNMFSFLDSRDKTAVVAKRMKYFTNSDEDGVAAVTVWIVGDLEKISGRKLLLNALKHLKSSRGVRVGVIDNPGEKPSEDNTVVYRAVWASLLTQKNKAAAAFVQKLLKEESIQLLLQGTKMKDLLLQGMDVDAFEKKFNTLEADFIHSQQLFCRDVLNLRPGQRAVIGNGRILGLFEEQEEFTMEDFHLLERITLSGSAEKVKTKVKEMGMKPKHASDLVMKVDALLAAAPKGEVRRDFHFKDANSVLQLAPRENEVFYDVVAIVDPLTREAQKISSLLIVLSQVVNVRLQVFMNCRAKLSEMPLKSFYRFVLESDVTFLANETVSSGPVARFTELPESLLLTLNMITPESWMVQAVSSLHDLDNIHLQEVKGVVAAEFELEHLLLEGHCFDLSTGQPPRGLQFTLGMSRDPLMYDTIVMANLGYFQLKANPGAWTLRLRKGRSEDIYEIITHDGTDSPADAGDVIVVLNSFHSKIIKVKVQKKAENINEDLLSETSESKGIWDSIVSITGGGARKDDGDKKEDVLNIFSVASGHLYERFLRIMMLSVLRHTNTPVKFWFLKNYLSPSFKETISHMAKSYGFQFELVQYKWPRWLHQQTEKQRIIWGYKILFLDVLFPLAVDKIIFVDADQIVRADLKELRDLDLEGAPYGYTPFCDSRREMDGYRFWKSGYWASHLGHRRYHISALYVVDLKKFRKIAAGDRLRGQYQALSQDPNSLSNLDQDLPNNMIHQVAIQSLPQDWLWCETWCDDSSKATAKTIDLCNNPKTKEPKLMAAARIVPEWVEYDNEIKELLGRVQGEAGATHNPSPSQHHKADTRRDEL

SEQ ID NO: 3713 - protein, 1597 aa, Neocallimastix californiae
MKFLNIFNIFNIFISSLIVINVTCEEIKKNSPPVKISLQTPWDNTPLILEAIEFISKEKPDVYFPLLSKISKEKDFPKTTYGQYQYIMKFPEVSELDIEALLKLSLSLRSEAPLIQSYYHYYNASVVPSHQINSNFDTKCQNWLDWYGTQFCDMENFKKSAQISLVEGKYSMNKSDKQAPIPLPIDHIKKSDVENGVVIFYGDVFSKDFNSFLNELLKINEEVGLTFIFRYKKSLDEEFNNKPITISGYGVEMAIKNTEYKVIDDRKLKKDEKENIQKSQKKIPNIPSKEFGLDKLSEKFPKQKDDFSAFNDLLQQQEIPVLKKLLANETEDIGTKIIQYITTSSNPLYVLSQLSSNYPKISHIINQMPLIEEYSKEVKFLQRLFYAPDFNSVFINGIEINAKDLNPFNVLRIFSSENRAITKLNSLRFSNKDAVNLLNSATDDSDNGKNGDTEYYDVRDDIVSWWNNLESDSRYNKWPKNIKEILQPLYYQGQMHRIAKNIYNSLFVVDLTKKNVLEALSEIFIFVERGVPIRFGVVPVVDTENKTELSTSVGVIFKVFIKEYSKKNAKNFIVKLFEASAKGEITKEKLTKITEDILSDNKLKILDDDVLLSTYDDILEYGIKKYYNSLKEFNEKFAITSDSQALFVNGAYSEFSKDWKQSMMTSIVSEMDNIQRKVYYGEITNKDNVYDKILDSPNVRKRKNIYIYPSDENPIKFIDILSIKNLDDMKYFSNAGKLGSHDSIWVISDLSTHNGIKLALEGLRFIDGKSSQNSRLSIVDSADNDKKNAIVLRNIINQVAMVTVPKDTDYTVSGYLVELLEARLAMDEDANEELILKKAYEINEKYGNLMIQKDVDYINQKPAVDFKQIVELTINNKKNTQAIVINGRLIGPWDENVSFTQEDIKLASDFEYEHRIRMLIGKVRAYGKAQEWGDIPIREWYSNLIMKTSYIVSSCDTAEKVKTEFNDSTKERTGTGYIKKFKSSLTTFKYGDIENAKYQFTAIIDPTSKTGQKISSFLMIISKMKDVYIEVQLYSPKPNEDVPELDRFYRYVFDIDMTFDEDKNEILPMAEFENIPIDPLFTVGIHAPQAWLVTPVVSIYDLDNICLKSVEDSGVNAIFELKNILIEGHARDMRLNTPPRGVQLILGTKSYPSMVDTIVMANLGYFQLKANPGVWELQLRSGRSSELYQIINVGNNIHSWLEDRNEDLVKIYEENGITIALTSFEGSTVFLRADKKKGMEKEDVLSEEGDVTKKDKEDDKIWGKLKKKLGMGNSSSTNSSETKKSADKINIFSVASGHLYERLLSVMTLGVMKHTQTPVKFWFIENFLSPSFKKFIPHLAKEYGFEYELVTYKWPHWLRAQSEKQRTIWGYKILFLDVLFPLDLEKVIFVDADQIVRADLKELVEMDLHGAPYGYTPFCNSRKETEGFRFWKTGYWEKHLHGKPYHISALYVIDLVKFRQMAAGDRLRGEYQMLSADKNSLANLDQDLPNNMQDTIPIFSLPQEWLWCETWCDDESLKTAKTIDLCNNPLTKEPKLDRARRLLPEWSVYDNEVAEFEKKVEAMLNGEQINDNVTSKQETVAQSKPESDDKTKEKDEL

SEQ ID NO: 3714 - protein, 1558 aa, Musca domestica
MMWLNNKMGKALIYYLASCYLLVLAHSGNAETAKSKSYPITTLINAKWEQTPLHLEIAEYLADENPNLFWDFVKDAADLDTPLTSYDTESQSYNAVLKLVRKGLTEIQLPLMKLVVSMHSLTPRIQTHFQIASDALAKGSCPETTTFVQLDRELICSFDELRQKLSTANEKPPVVSVETYAFDHIFPGSENNTRTVVLYGDLGSSAFAQYHYLLSAKALSGNVRYLTRHYLPEKQRDARKRVRLSGYGVELHLKSTEYKSQDDAPKPADGSAEDASSTTGEMEVQGFDFSVLKERFPTMAHSLDKLRQSLLQGNDEIAQLKAWEFQDLGLQAAQAIAEIDGEEALKILQFTAHNFPMQARALLSHKVSQQLRDEVKHNTEIFSRSLNIVPPDGALFINGLFFDADSMDLNSLIETLRTEVRVLENLHNSQVRGRLASTLLALDFSGSGSKEFAIDIRDTAISWINDIEKDMQYRRWPSSVMDLLRPTFPGMLRNIRKNVFNLVLVVDPLQPSSRNLIKLAESFVLHLAPVRLGLVFDARKANDGSQEDYLALTCAFNYLVQKKDARSALSFLTDIFANVDAKQSVKRKHIKSQMKKTFEKLSGSKIDAILDEDSDYDYGRQLALEFVERLGFSDSPQALLNGVPMPSNILSSDSDFEEAIFSEIIQQTTTLQKAVYRGDLTDSEEILDYLMNQPHVMPRLNQRILGNNENAKFLDLTGTPHNDLSNVKALALLSNRDMTATLLKNIKYFEGKHSYETIGDSKLHFLTLWLFGDLEKANGRELLKNALQYVRAGASVRVAFIPNVEGSDVARKDNLNRLVWAAQQTLKPKEATDTVLKWLKQSSDKWEIPKAVSEFIASTELHMKILRVYSQRVLNLKTSERLVIGNGKIIGPILDTELFGIEDFGLIDRFNAIQYGDKLRKSLTSNSHELEEDFNSDTLLKLYASLLPRQSKTRFKLPEDAKHAHSVVKLKPNRDDLPSFEINAIVDPASRSAQKLAPILILLRNTINCNMQVFLTPVTQHSDMPVKNFYRYVVEPEVQFLPSGEMAEGPFAKFTGVPANSLLTQNLQVPENWLVEVVRSVYDLDNIKLSDINGPVHSEFELEYLLLEGHCFDSSTGAPPRGLQVTLGTRENPVLVDTIVMANLGYFQLKANPGVWTLKLREGKSADIYDITYAEGPNTVHKNENTQVVISSLKSHVIKMRVTKKPGMSQMDLLEDDNSQQQSGIWNSIASSFGGGGGGSAGDEDSETINIFSVASGHLYERLLRIMMVSAMKHTKSPVKFWFLKNYLSPQFIDFLPHMAKEYNFQYELVQYKWPRWLHQQTEKQRTIWGYKILFLDVLFPLSVRKIIFVDADAIVRADLRELYDMDLGGAPYAYTPFCDSRKEMEGFRFWKQGYWKSHLMGRRYHISALYVVDLKRFRKIAAGDRLRGQYQALSQDPNSLSNLDQDLPNNMIHQVAIKSLPDEWLWCQTWCSDSSFKNAKVIDLCNNPMTKEAKLTAAQRIVPEWKDYDSEVKQLMARIEDHENVEHDELQTTLPSSKETTPTPAAAAADGAKHSEL

SEQ ID NO: 3715 - protein, 1509 aa, Epicoccum nigrum
MRGSAPLLGAKALLALSAISRIGALADSNINVALKASFSPAPYLVELLETAADENATAYYPLLDRIAEGWLDDLDTEQKLYNKFVDILQSDGHITDPETLASFNLALSVRSAAPRIQAHYQFFETSVEPSLFGDQGRSCGVFVTLNGEQYCTPDTNDGDPRGKVGNEHTDELPFDRVLGNSSALPTIVYADITAPRFKLFHRTVSKSAREGKTSYRVRHRPSMWASSTPLVVNGYGVALQLKRTDYIVIDDRQEANSGNDASQKPLATELDEDTSDLQPLAKDDVADLAEKAASFVLQSDQPMDTLLKMVRDFPKYTSTIAATNATSDFLTEHYSNRELLLPTGYNVIWINGVQIPARDVNPYALLAHLRRERKLINGIRSQGLSGPDTISLLSHSAITQGQTGDEPQRYDFRDEAEGGKVIVWVNNIEKDSRYQSWPEELRALLQRTYPGQLPNVRRDIHNAILPIDFTNPAHVSTVIDTIVGLVRRGIPLRWGLVPQTPTASAEEQAKVVYYLQHTYGLSAVTKYLFTSSEAKKLAAPDKASFETAVKAGTLRTDREGNARETLEFEDILVSGALGEKVEQAKHYLDRLAANKPNAPAFVNGVPVALGDNWLSELSQRVSTDLRQIQQAVFEGNLKEDSWVPQQFLLQAASKRNPLIIPENEKEVKLVNMADFEDKHGKVFAQYPRVEAEKTASKSEWAHLTVFGDFDTESGATLLKSVVQYRQANPNVEIVMLQNSDAGQSGISDKLLDAYVNAKSQLDSNTLLEILSEQVEKSPTTERSTLLRKSSGALFEYLDLKTGQLAVLINGRLVGPIPEDKVFSSEDIEALVSYETNKRIEPLSKALADLQLAEMIATPFDAAKIQSLVALSTISDVPEGIFETASTLRTSVFGNWSADHTAIIKGTKENAIFHIVASIDPATETAQRWVPILNTLSEMEGTYLKLFLNPKQTLQELPVKRFYRYLLGSKPRFNADGSVDNFKAQFKGIPKKALLNLGMDVPPSWLVAPEESIHDLDNIKLSSLPAGADIDAVYGLESILIEGHSRDTTNGGQPPRGAEVVLSTEKNPHFADTIIMANLGYFQFKANPGFYKIQLKNGKSQDIFSLDSAGAKGWAAQPGDESNDLVLMSFQGTTLFPRLSRKPGQEDADILAEEGSVVSELATKGTEKVNKLLGKMGINFNSEKVFKKGAELLAGSKPASTQADINIFSVASGHLYERMLNIMMLSVMKHTKHTVKFWFIEQFLSPSFKQFLPHMAAEYGFEYELVTYKWPHWLRQQSEKQREIWGYKILFLDVLFPLDLDKVIFVDADQIVRTDMYELVTHDLHGAPYGFTPMGDSRTSMEGFRFWKTGYWANFLRGKPYHISALYVVDLVRFRQLAAGDRLRQQYHSLSADPNSLSNLDQDLPNNMQFNLPIHSLPQEWLWCETWCADEDLATAKTIDLCNNPQTKEPKLDRARRQIPEWNVYDEEIAALARRIGGEKETVQQVVDVQAEEQVREKQEKDEERKRDEL

SEQ ID NO: 3716 - protein, 1591 aa, Ramazzottius varieornatus
MDNTWMLLVCFVVLVSCCSCADDERAIKLKPVTAALHTQWAQTPLIMEAAEFFYDENPGMFWSFVDRLRDVIGTKSRTWTEKEQHDVAISIGLQLLSPVKQNFLTFAMALRYYSPRIEMYRQILLSEVSTPKGCKDVLVDFGGGLVSCGVKEFADTLQTFDASKTSDRKNPKVISVDHQYPGSSSSATTVMVYGNLLSPVFYQVHELIMSENTDFRFVFRHHLDAISSSHYSKVRIPGYGVELAIKSTEYKAQDDRKIKEGKAGDQAKPEEEAVDDELDTDIEGFDFGKLKSRFPQKKDQLEQMKSFFLQSTGTELQQLKAWQFQDLSLQAAERALKVAALHTGSATDALRTVRDISQNFPSQAPTLLRIPVQELVKAEIERNREYFAHYHNLEHGSAALFINGIQYDTDLLDTFALFDKLREENRLMESLHSFGIRGSDLSAVLELDLRPTESAKYGVDIRHPAVVWINDLEKDKRYADWPSSPRELIRQSFPPTLLKPIRRNFYNLILVVNPANVSDSRDILKLTESFYVHRLPIRMGVIFVTNSDAKIDGTTDASVAIYNSFKHITEQKNGATALSFLTDLYTKAVKDGQVVADEVVKYFKQKYPQENPDAIFGPDSVYNSGRNDGRQFIEKLNIGEPPLVLLNGVQLDKSKLTADEFENEVLQNLVGVYSVLQRDVMSGQLTDHSNVIEYLMAKPHIVPRLNSLILDPPEFRFLEFGGKSLDPEKYTFSYFEALKAEDRTATMVATSFYLVKHEEEEAHPVTMWVVADAETPAGRELMYNMVKHSKTSKNVRVAFIFNPSETESIEKGMQLTKAIQVALETQSMSLARNFITKLLKEENVAEIATGTKIWEDFEVNGMDMKAFTSGLKELSSDFLKIHGLFAREELNLSPGENVLIANGYIVGPVKSDFGMDDIALLEKYIESYGATKLSNELHRLNIFRTADQLSDAVMMTSTLLSGLGSQEEAKKRTKVQYSEMAHSVINIEQRDTDSPSFDITFIVDPVSREAQKIIPVLMVLHEALNCRVRVFFNCKDKLSEMPLKSFYRMVLEAKLTFTENGSIAPNYALARFPALPQTALLTMNLQAPDNWLTEATSAVYDLDNIRLTELVDGWGIHGGFELVNLLLEGSAKDAATDQPPRGTQFVLGTRNQPEYMDTIVMANLGYFQLKANPGAWILKLREGRSHEIYSIASAEGAEKEGSDEEQQRVVIGSFNTKMMKIYVKKRPGMEREDVLSEKKDAVESEAGIFNSISSYWSKDEHKSASASDDVINIFSLASGHLYERFLRIMMLSVVKNTKTPVKFWLLRNYLSPQFKEIIPYMAEHYGFEYELVEYKWPRWLNQQSEKQRIIWGYKILFLDVLFPLSVKKIIFVDADQIVRTDLKELRDFDLEGAPYGYTPFCESRQDMDGFRFWKNGYWASHLGNRKYHISALYVVDLARFRKIAAGDRLRAQYQGLSQDPNSLSNLDQDLPNNMIYQVPIKSLPQEWLWCETWCDEASKAKAKTIDLCNNPLTKEPKLASAMRIVPEWNTYDQEIKRLIDEFYAVRQLTGENAGEPVLREAVPEDTFGGNDADNEIPVHSTGHTHEHGDEL

SEQ ID NO: 3717 - protein, 1431 aa, Hirundo rustica
MGGAGGAASKSWKEKHPGSKPFTIAAAVCMEDGNEKFWQFLETVRELTVYKKGDSEYSYYNLILKKAGQFLSNLQINLLKFALSIRAYSPTVQMFQQIAADEPPPEGCSAFVVIHEKHTCKTNAIKKLLKKATKRPRPYLFKGDHKFPALKEDGPVVILYAEMGTKDFVKFHKILSEKAQKEEIVYVLRHYVQQKPNSRKMYLSGYGVELAIKSTEYKAVDDTQVKGANETKEEEDEEEEEESDVQGFLFGRLKQMHPDLKNNLMEFKKHLIETTNNMEPLKVWEMQDLSFQAATRIMSAPVYDALKVMKDTAQNFPIRARSLTRVPVDKKMQNEIEENQKVLFVDPVQEDTGDYMKLAELFYHHDVPLRIGIVFILSTKEEIDGNEDAGVALWRTFNYIAEESDTSQAFMSIINMYHEVKGGNVLTVDDVKHVLRSEYPHADVQSILDVHSEYDEGRKAGATFYKKSGLGPLPQALFNGVPFPREEMDAAELETLILQRIFDATGFFQRAVFMGLLDDHVNAVDFLMDQNNVVSRINPRILGAERSYIHFRSTSVPFHVEDFSTFSFLDSQDKSAVISDNMKYLTKKDEDALYAVTVWIIADFDKPAGRRLLSNALKSLKTSSHTRVGILNNPSSKIQEDNTAIARGILAAFLTQNNSNLKSFLSKLSKEETAKSLAAGTKIVKILIPGMDGDTFEKKYNTLGLDIIKTHQMFCQEVLKLLPGQMAVISNGRVLGPLDENEFSAEDFNLLEKITYSTSAEKIKAIVKEMGNSSKSGSDLIMKIDALLSSLPKTETRQDVELLKEQHSVVKVKPQENDPFYDIIAIVDPLTREAQKMTHLLIVLKDIINMKLRLFLNCRSKLSEVPLKSFYRFVLEPELTYGINKHLPSEPIAKFLELPESPLLTLNMITPESWLVEAVNSSCDLDNIHLQEIKGAVTAEYELEYILLEGHCFDVTTGQPPRGLQFTLGTKKNPVMVDTIVMANLGYFQLKANPGAWTLRLRKGRSEEIYQVFSHEGTDSVADLTDVIVVLNNFRSKIIKVQVQKKPDKVNEELLTDGTTGKKGSVESVARFSEEIPADEKKKESDILNIFSVASGHLYERFLRIMMLSVLRHTKTPVKFWFLKNYLSPTFKDVIPHMAQKYGFRYELVQYKWPRWLYQQTEKQRIIWGYKILFLDVLFPLAVDKIIFVDADQIVRSDLKELRDLDLNGAPYGYTPFCDSRREMDGYRFWKSGYWASHLGKRKYHISALYVVDLKKFRKIAAGDRLRGQYQALSQDPNSLSNLDQDLPNNMIHQVAIKSLPQEWLWCETWCDDKSKKKAKTIDLCNNPQTKEPKLKAAARIVPEWVDYDSEIRNLIQQIEREKKNLTSLFQKEYLNTLQNSIRVVTLLVNSSCSILGKPCSPLVPFAIVSKNLSSKQKESMNSNHALIIFY

SEQ ID NO: 3718 - protein, 1508 aa, Madurella mycetomatis
MIRLSQLPWSLAATILAAACLSSTPAAASPSVNVALKAAFPSPPYLVELLETAAADNTTAYFALLDRISKGHFAEAKTDKALYDRFVEVLRDDGHMGAEALSTFKLALSMRTAAPRVEAHYQYYETAVEPSLSGAQDACEQWFLVDGKQYCSPSLDAAHGEVKQSSQERTLPFDRKFGTGSRDIVLYADITSQDFPAYHEAAMEISRKGEGSYRVRYRRSRAHPSEPLTVSGYGVELALKRTDYIVIDDRDTGAGKAPGDEAQKPLGSSEVVLDEEEEITDIKPLEKSELAALGMKAASFIMQSESPFDTLLKLTQDFPKYSTSLDAHNVSAEFEAEHRGNRALLVPEGMNVLWMNGVQLIDRQIQPFGLVDLLTRERKLINGVLDLGLTGQQAISLLGHEKVAQAKSGEEEPRRFDWRDQTEEGRVIIWLNNLEKDKRYEDFSPSIWSLLQHFGHGLPQIRKDIFNLVVPVDFTKPEDIKLITTQLLAFMKRLIPVRFGLVPLTPTGEAVDQAKVVYHLLENYGLAATAFYLEKSLELKKTAKADEGVFNQAIKDRALRPESTPLPFKDIFTSEEHEKQIHLAKRWVERLRADGEVPSLFFDGFAIPRDDNWLKAMNQRLMMDLQAIQQAAYFGMVNDDIWIPGHFLQNAITRRNTFIFPEDSKQLTVLNVNKLYTEHHDVLSNIPVIEADKESAKEDWAALTVVADLGSIEGQKLLFYALQFHQEQSGVRLDIVHNPKDLSRSPSQINARIKMQGGSLSTVSRLLDLETILESGEAEADPAFDAALADFLASTNLKAGDNVLMLNGRIVGPILSADHFKKEDFEQFLEAERTSRILPVYKAIEDLGLADKVSGPLDAAKLTSVTALSSISDLPQGIFDSASPIRIAAYREWNSTHTSFQVGDASTATIFFVAVINPASEVGQKWAAVLKVLSELEGVHLQVFLNPVDGIGELPVKRFYRYVLESSPSFDENGKVKALSASFERVPPDTLFVAGMDVPPAWLVTSKISVDDLDNLRIKDIKAKRGTDQIKAVYELENILIEGHSRELPTGQPPRGVQLVLATEMDSHFADTIIMSNLGFFQFKANPGVYNIRLKEGRSSDIYSIESVGARGWTPVPGDETTEIALMDFQGTTLYPRLRRKPGMEEEDVLGEAKAETSGGAAMDFVSKGLKFAEGILGRGNKPTETKSLSDTEHAEINIFSVASGHLYERMLNIMMVSVMRHTNHTVKFWFIEQFLSPSFKDFIPTMAAEYGFKYEMVTYKWPHWLRQQKEKQREIWGYKILFLDVLFPLSLDKVIFVDADQIVRTDMYDLVQLDLKGAPYGFTPMCDSRTEMEGFRFWKTGYWANYLKGNPYHISALYVVDLARFRELAAGDRLRQQYHALSADPQSLANLDQDLPNHMQFQIPIHSLPQEWLWCETWCSDETLADARTIDLCNNPQTKEPKLDRARRQVPEWTEYDEEIAALAKRRREQQQQQQEQEPEETVQKNTKSRRLDEGGAAETGHVIDEL

SEQ ID NO: 3719 - protein, 1557 aa, Lobosporangium transversale
MRPLGSPLRTSVLALALVTLQVMTHADHSPPIQVSIHTPWAAPPLLLEILEAVAVENRTSYYPLMRQLTSPDFLKTVSSPQDLYGKSLEIIQSQGHLHRQAISSLKWSLAMHTTAPWIEAHYHLYNSTIVPDRASKGGFDPNCNVWVDWYDHQVCTASELEAIVAKGLDQYSKKASSKPTTMDLDHVQSSRNDPSLFTILYADVYDGEFTKFRKYLDTLAIEHGLQYSIRYRPSVTNASERPLSLAGYGVELALKNTDYIVIDDRDLGHNDDDSAFGQTVFSADTEQILFEGEGPPSVEPVSEQDLPSLDQLTAQFVLQSEDPLKALVAVSQDFPKYQRKLSKITLNETLSRAFYKNMETASGQNSPKIWLNNQPVPHHKMNPFNLIRLLRRERDAIGSFATIGVSTKKAVDLLTDFTSAAKGDSGAEVPTGVFDVRDKSEEKDLIVWLNDLEKDQRYRGWPGLEALYRPLYHGQFHQIRKNIINSLLVLDLSSPRSLEVIGFEIFNFIQRMVPFRFGVLPLVKSDNGEDVKMAMLWRHLVSRHGVRGGIEFVKQTIILHVQAGDDIPSAARKAFEASSKLPKLKTSETPELMYDEVIAPDSIYRVWLKSVRAMEEQIGITAPSHFVNGKFFAWHEDHSQHLMSQAPRQTGFLISRLMQGELNDSVDVYEYLLTLPGVHPRRNPYVFVSDDAPPKIIDLVQGQKSPFVDSLSYFTADGSTDQALTLHIAADFDSKQGLAIGLAALSALEANEYPVRLAFIQNGQYSEETLPSLANFVRQSCIDRKILPLGFWRTLLQGINDGQPFSESFVIASGDHPEIAAIAFEGTKGLEEQSDRARHLFLKDTLKANEGEAYIIANGRVVGPIHDTFDADDFRLLINYEKEQRVEKVKKTLEDAQIATTSSNIMKASSILLRAGQQPDQGLYDINQPLVSRERFFEELDFEHAGFTVNPTVYADNDPILFHFTAILDPASELTQRWAPILMVLSRLEDVRIDVILMPHLKLNEAPIKRFYRYVAEPELKFDTNGEIVPPSAYFAGLPEATLLTLGVDVNPAWVVMPKVCIHDLDNLKLSSLTGSARKSGVKAEFELRHILIEGFARDLTQQAPPKGAQFILGTKSEPHVADTLVMANMGYFQLKANPGVWEMVLRPGRTTEVFSIESIGSEGWVIGAGIKNDKRDLVIANFEGLVLYPRLIRNPGMEQANIQDESSNRSGGIWDSIKTTLKGFTGKNVKTRAKETADINIFSVASGHLYERFLSIMILSVMKNTESRVKFWFIEDFLSPSFKDFIPHMAKKYGFDYELVTYNWPHWLRAQTEKQRIIWAYKILFLDVLFPLDLDKIIFVDADQIVRTDMKELVDLDLHGAPYGYTPMCQDRKEMEGFRFWNQGYWKEHLQGKPYHISALYVVDLVKFRQMQAGDRLRNHYQQLTRDPHSLANLDQDLPNNMQAEVPIFSLPQEWLWCETWCGDEGLAKAKTIDLCNNPLTKEPKLDRARRQIKEWESLDNEATEFAKEVNAKLKAARQTQQQQASLEDINISNNQGQQTMPFKDTEGSHTTKDEL

SEQ ID NO: 3720 - protein, 1492 aa, Aspergillus japonicus
MVSGSTFVAFWRLSTVIVASALSCLVHATTPSVNVALQASFDSAPYLIELLETAAEENSTSYFPILDRIAEGAFDDAVTDKELYDRFLEVIHTDGHLRTPEALSSFKLSLAIRSASPRIAAHYQYYNASVQHSLAAAQDAVCPVWVHAEGKQYCSSSLERAQQGVMGPSDPPELPFDRVLGDSSLPPAILYADLASPMFKDFHQSLTALARDGQFSYRVRYRPPQHWSSRPLFVSGYGVELALKRTDYIVIDDRAAEERTSDASGSKKTVNGEGDDLDDLRPLSSSEVSRLGPGTVGYVLDSESPLDALVELSQDFPKYSARIAAHNVTKELLQDIQSSRLRMLPPGFNALWINGVQIDARQVDAFTLLDHLRRERKLIEKFRSLGLSASESVDLLSHKFLAAAMAQDGPQRYNYRDEIEGGGVIMWLNDLEKDARYESWPSDLGGYMQRVFPGQLPSVRREANNVVIPVDLAKLDDATLIVKSIQVFVKNKIPVRFGLVPITSSPGSIAQLKVAHYLQDTFGLASLMSYLETSVSKNKLGSPDKTAFQTATADRTARPDKQSLSLDEVLKNDAVDTIVSRTSEYLKRLGVTGEASHSFVNGVPILRNENWAQELSARVSRDIQAIQQSIADGELAEDTWLPSLFLSDAFDRRNPVIVPEDPKDVRVVNMAQVAETYGELLGSLPRIPSIQEDVLASSHVIVAGDFSDEPGFNLLSAALGSLKNHGEAEVLLLQNNGANSSIWTGSYTIHRYLKKKDDADAAKLLEELTGTDLWSTSDKQEAENFWCAHQPLVKGLGLSTGANAIIINGRVIEVPVDVALTSDDVDQLLAYERQKRIAPVAKAAEALGFGAKLSGPLTLAKLTSLAALSTVSDVPEGIYESTPDIRVNLFERWDNARSTITVSNSEDPVITIVASIDPTSETAQKWLPILKVLSDLANVRMRLVLNPRDELQELPTKRFYRYVLDSEPSFSQDGSVARPTASFSGVPVEALLTLGMDVPSSWLVAPKESVYDPDNIKLSSVKEGTNVDAIYALEHILIEGHSRDLTMKTAPRGVQLILGTEETPQISDTIIMANLGYFQFKAQPGLWTINLKPGRSERIFQLDSLGNEGYSLHPNDDTSNEVALLSFQGKTLFPRLSRKKGQEMEDVLETGIKSGSAMDYVSKGLNFASGVLSSVGINGSPKDVAGGKQADINIFSVASGHLYERMLNIMMVSVMRNTEHTVKFWFIEQFLSPSFKSFLPHLAAEYGFSYEMVTYKWPHWLRAQTEKQREIWGYKILFLDVLFPLSLDKVIFVDADQVVRTDMYDLVALDLEGAPYGFTPMCDSRHEMEGFRFWKQGYWKNFLRGQPYHISALYVVDLSRFRALAAGDRLRGQYQMLSADPGSLSNLDQDLPNHMQHHIPIKSLPQEWLWCETWCSDESLAQARTIDLCNNPLTKEPKLERARRQVPEWTVYDEEIAALEKRVRSEVRQEEIREQDQEVEAEAGAEWDKDEL

SEQ ID NO: 3721 - protein, 1581 aa, Tulasnella calospora
MRLGPRTAALGGGLLLTSARAATSPPVNVRLTTSWNTTNLVAEIIETAALEDPNLFFPLLDLLVHPGTFEYPLVTEPPENIYKYALDAIKESNLLSGDGVLSSFEKSLALRAASPRLEAFHSYYTQRYGDSTPTKKQDPSCVAWVDWYGQRLCRPDDVYAAAGYSCPGWVVFMGHRVCGVEDIDQTPTDESKFRDPPQLLTFDHVFPTSAPPTAKTAILYGSVSSPNFFSLHYALYQLAKREDHPIKYVYRHLPPLSSAPANPAYLTGYGVSLDLKKMDYLALDDRRTRGAASNKAGNAQKVMSDKDEVTPEEDPILSLLPEATTPIDLGKPLTNEELTALGFKTSQVILESSDPLTALKQLSQNFPKYATSISHRVNPLNESIVVALGENMRKVQSGANMVWLNGRPVQPTDMNPFALLRLMRKERQLIDQLTKAGLSRSEAIEVLTHPSLTKPSAGQLLEGIFDASDRKDGGGVIIWLNDLEKEERYSRWPSTLDTLMKPSYNGQVPPLRRNLFNIILALDLSKTTSVSTLNLVTSIVQRGYPFRFGIVPIAETEDGTGNQWHSGIWTLMRDSTNIAKVFYYLNEQFDPLQAAGIYMKAADARRPIVSVESLERVFTALAVSESEDPKVPWKTFEEVTSSWDSADLISRLTKYCERLALTNAASKGGHLFVNGKYAPLSDDWTKNLQQEVAEQTQFLQESLWSGEITDSEELDISTWFYDLPISGASRNAHIYPSSSGASALRVIPMIDLGLPNSFVYHPESKAAPLSMWIVGDLDSQGGIELMMEGLQAMTPASSFRISFVHVPNPSNTAPPKIAPALLDVLLSNPLPSLDDVMYLISSLSTDSEVVEDVLRKVRGENGQELTIQRALEIVGKGKKLAEKIGFKAGDLGIIVNGRVVGPLPPSSFTASDFHTLASYEKNKRVAPIEEALVLALNEEGADVSSILLADQMPESGMVDMTPSPRARQYLQLESANASFAIGNNETAMFHFGVILNPVSDTAQKYSSLLEWLADDDLVHAVVYLNPPHQVEEMPLKRFYQYNLTPRLTFNSEDKSLSQAKVEFTGLPPDPIYTLGMDVPQSWLARPSESVHDLDNIQLSSLGESEQAIGVEAIFRLDYLVIEGHARDAATRAAPRGLQLQLTSESNTVADTQVVANLGYFQLRAKPGVFQLEIRPGRGQEIFGMTSAGNEGWDSPSVEKAGANITVASFEGITLYPTFHRLEGMENADVLAEAPEESSFFGNIASKVGSVFGSSKTTEIVKRQADINIFTVASGHLYERFASIMILSVMKNTKKTVKFWFIENFLSPSFLEFIPHYAEEYGFEYELVTYKWPSWLRMPTEKQRIIWGYKILFLDVLFPMDLKKVIFVDADQIVRADLHELVTLDLQGAPYGYTPMGADSEDMDGFRFWKTGYWKEHLRGRPYHISALYVVDLVRFRQLAAGDRLRGQYQGLSADPHSLANLDQDLPNNMQAEVPIFSLHEDWLWCETWCSKDRLHRAKTIDLCQNPKTKEPKLSRARQIPEWEKYDSEIANFARKLADSGLIRSHVAAENVDALAGESKQSETTTEQDGSKESHGKAHEEL

SEQ ID NO: 3722 - protein, 1349 aa, Zygosaccharomyces rouxii
MKLITAGIVFLTVLKTVVCLSVSLQSASVSERFKIWTIAQHLFRGDKKGILATVYPLVMQLDEDLEDTPVANLCEVVSARLSELGELDLASLMPLYCQWYPMGLPFPSSYDHLKSETYFVLNNKRYDHSDDVFYLKSGELKKQAQMPDEAVVAVNDVIIGNNPEAPIVYFYGCPDDDEATFEEFNRNLYSEATETGKLRFIWRSTCHVRNDTEIGPFPVELSIRDGKSNIDVLPIDHLGVPHQFDKSKYGLINPTTNQLSDLDLKVAHLIAQKYNSSKDFNSTLDYARGIINNFPLLVPELITMKNNTEAIMDSNTNLTESGVDHKLLGLFINGENWRFSSLDQYTLLNALESEYRRLKQLLSGLVKMYSKSTLVTAKDLITKFSQISIPNLQQSQPIKVDLHRISGFSESVIYFNDIEIDDQYRELTTDINKFFEKSKFGEIPEYRHNWNELIFVIDFNNLEDPDTKLALDGLKRAIGVITQGYPQRIGLLPLNTGASDDIIRKIYELKDRDLLELEDFLGNELIRGRTISSDYTNTPGVAKLLRNLQINETSIIINGEIYPFRKNTWHYLIAKTIKKDVGYLKRELRKYIRHDGEKAQPIIDVRGVLHMKSSETRHMKYTPDYFADSTYTTLDNSALQVWDERILEYVKGKEYNLLHTITLVDDFNTLQALKRLHNLIGIKFVGVKFRIIHSGALESNWKILKKISSKPSFLKELKSLIKKSARVISTNELNRNVLQSWLVDLKPEFLSAKSFMLINGRFIHFEENEIPQIKLFETTIKREAQRTIDALEALETILPGVTSNKIDPEFMENISATLTKMFYQGTELYGNGPVFTTESTLSRFDMSEILQVNNFTIFESSNDGDKPIDVVLVIDPLEERSQRLLSLITDIQQLPFLNVKIVIYPTADLKFMPIDRIYVPNFPDELGGKLTDIESKFDVAVEVPRNFVLNDNKNVGGYLVEVHAFDERQPVSEGIIDGLGNVCLELVDSTGKSVDKTVTMMTFGYGQFIVPKLGSNFTIKSCDPRYKVVSFSSDARADYMPMESVNVTSLNPVVTYVKLQKVDEVAKITVEESVINIFTIPKNEHSFEQEYQKMVLHILHSPQHGYMGVKFWLLDQPFISQSLRKFIDVINLDPKLDGNIELVKYEWPPWLRPQRFLERRMDAYKILFLDLLFPQSVSRIIYMDPSISQLPDPFKLNEKVKTKLPFAMYKMVGHGYWETHYWAQRLGDRNLKFHSVHPAFVVNLQQLREYNGGNKLRIHYQRLSADVLSLAKIDQDLINDAQEEVPIRTLSSSTIVFLNTKNQNSVNAWLTNFQKLAAKEETAGFATDENPGIKQEGTRETIDLMHDEL

SEQ ID NO: 3723 - protein, 1520 aa, Megachile rotundata
MQLIILFYFLLLCSTHLKADKRINKYVTTVIDAKWRETPLILEAAEYLNDENPNYFWKFIDTFANRDLRNVTARESYDIIIEFAEKYLSPSEIALLKLGLSLRIYSARVEMFNQMAENKNVSVFNCYNVVNIGGVLTCSLEELENLIDKETWPKPDTYSIDHRYHTSQQSEKVIILYGQVGTPQFSSFHNALKHLAETKGISYILRHYLKDREGKNVRLSGYGVELQMKSTEYKATDDSDIKDNADKDSEMANDNIEEIDGINFMTLKNLYPDKQVELDKLQTHLLESSHEIGALKVWQFQELSHQAAERIMNSPTNEAINVLTDISQNFPMQAKSLIRTKVNSEMKKEMKLNQAIFSTSLNIQPTDTALFINGLFFDLEAIDVLSLLESLRSELRVMESLRKIGFSNKKMSKLLALDLSTNMDKQEFAMDIRDSAINWVNDIEQDSAYARWSPSLTELLRPTFPGMLRNIRRNLYNLVLMVDPLSRESTPLITLAQSLYLHSAPLRVGFVFITNYDTSITGLTDASIAANNVYHYFAETKGSEHALQFLIDLGNYIKPDGATVEDVKKALRSQDSSANVNYILGEESEYDIGRHLASDFVKRSGFKKFPQALLNGVPLSSDVLNAESFEEAVLSTIMSQTPALQKAVYRGEITEGDDVVDYIMNQPNVMPRLNERILKSEKHTWLNLIGTLPNDEEYTKWSPEDLSTWLMTKLNYLFVPRRTNVHHLYTFWIVTNLNDAKGRQLLREAFEYIESNADVRITIIINPATDTDNAVNAIDINRIALTAINVLPTDKALHFVRNIIKEDVVTDIISGKFDIQEEAVKEKLQQETEELSVHQYYVKTVLKLAKGVTAIVCNGRLIGPLDENEEFTSEDFSLLERFSQSSYGDKLFKKLIKGQLLEDDEYEKSEITDDMIMKITSLLVSHPQTRARFDVPFHGDEYSAIKIPTTNPDEVAFNLIAIVDPVSRGAQKLGPILKTLQQSLNCDIKVFLNCLDKNSDMPLKSFYRFVFEPQLQFNSDGHINGAMAKFTKLPTSSLLTQYIHAPENWLVEVVRSIYDLDNIKLDNVAMGVHSEFELEHLLLEGYCFEAVMGSPPRGLQITLGTEKRPLMVDTIVMANLGYFQLKANPGEWILRLRHGRSAEIYDFTTVGGQDVVQKGNEVKVVISSLRSHVLKIKVSKKPDKVEMDLLSEDDKSSGLWNSISSFSKFWTFTTSDDSEDMDEKLNIFSLASGHLYERFLKIMMLSVIKHTKSPVKFWFLKNYLSPTLKDFLPHMAKEYGFEYELVQYKWPRWLHQQTEKQRTIWGYKILFLDVLFPLNVKKIIFVDADQVVRADLKELANMDLGGAPYAYTPFCDSRKEMDGFRFWKQGYWRNHLQGRAYHISALYVVDLKRFRRIAAGDRLRGQYQALSQDPNSLANLDQDLPNNMIHQVTIKTLPQEWLWCETWCDDASKKYAKTIDLCNNPMTKEAKLQAAVRILPEWVEYDEEIKALQSKIENENRQLEKEAHETLEDSTKHEEL

SEQ ID NO: 3724 - protein, 1457 aa, Blumeria graminis
MIGLNLQCVWTGILLVTTCILQNRQLGFVQAGPSINLELKTAFSSAPYLLELLETAAEENSTSYFPLLNRVADGYFADASSDQKVYERFLKILQDDGHITEPADLSAYQLALSMRVSAPRIESHYQYYRTAFCANIDERNIHELEFDRILGNVSAQTAILYADITSPTFGEFHHMLMNQALDGNLSYRIRHKNREFTSVSKPISTSGWGVELALKSTDYIVIDDRGEEKDEGKIENENSENTDTEFKSKVKLNEDEVEDLRPLSASELSPLGVKAGSYVMQSKSPLDTLLSVTRDFPKYSSQLVSHKVAPQFLDEHRYNRNQLVPEGHGIIWMNGIQLIDRQIEAFNLLDVLRKERHLISGIRALGLTAADAIRLVSHPLVSTAQSTNEDQRYDWRDEKEGGNAIIWMNNLEEDPRYAEWPRALSAMLQRVHPGQLPTIRRDSFNLVVPIDFSEPEDIALVVNTLLSFVTRRLCVRIGIVPITLTPSAVNQAKIIYHLTNTYGLQSAVTYLVRSSEAKLEEGFSSLTFDHATRVGKPINEKPQLSLKEVLESDEIRKQIEASKKWLHRLSAEDSIPPVFMDGVVIPRLDSWLQTAIFHGVFEEEEDQVWLPSIFLDEALSNRNPLIIPENPRSLKVFDLHVLLSKYQDLVNELPRLEADPSSIHSDSAYIILIADLNSIAGQKLAITTADFGEKTLSIDLRIAHNPLSCTSSGLSDNIYAHLRDRGFSGWERNGSLKNVLTSESVSRDEALQTESAKFWKSLSPFIETLGLLPGQNAILINGRLVGPIPDSSASGWSLEDLITLLSYERRKRITPTHAAMIDLGLGHKIQSVVEAAKFSSKVALSTLPDPTEEFFEQPSISRMNKFDMWKSNHTAIEIGNPETSDIQLTVILDPASHQGQRWVAILKVLSELQGVYMKLFLNPKERLTELPVKRFYRFVLESKPSFDSNGDVKAPRAIFKDMPQSALMTIGMDLPPTWLVAPKVSVHDLDNIKLSSVKIDVEAIYELEHILIEGHCHEAIGGRSPRGVQLVLGTERDAHVGDTIIMANLGYFQFKANPGYYRIRLQEGRSSEIFHIDSVGAHNWKEFIEENSDVIMMSFKGTTLFLRLSRRIGMGTEDVLEPSTDSNRGLVSQGLKLAQDLFNWKGQQPTNTQADINIFSVASGHLYERMLNIMMVSVMKNTNHTVKFWFVEQFLSPSFKDFIPYLANQYEFQYEMVTYKWPHWLRAQTEKQREIWGYKILFLDVLFPLSLDKVIFVDADQIVRTDMIELVQHDLNGAPYGFTPMCDSRTEMEGFRFWKKGYWEKFLRGLPYHISALYVVDLRRFRRIAAGDRLRQQYHALSADPGSLANLDQDLPNHMQNVLPIHSLPQEWLWCETWCSDDALVNAKTIDLCNNPLTKEPKLDRARRQVPEWTIYDDEIALVAKQRQQVPREEDRSMEKIDLEVEVQKAQQQRDEL

SEQ ID NO: 3725 - protein, 1445 aa, Uncinocarpus reesii
MPFTYPSSSWPLGLFLGTLLLPSVRAGPSVNVALSASFSSPPYLLELLETAAAENSTSYFPLLDRIANGVFVDSRTDKDLYDQFLRILQDDGHISDPSALSSFKLAMSLRSTAPRIQAHYQYYNTSVEPSLMGAQDAVCQVWAHYAGEQYCSPSLEHAQQGVSGEQVRYRPSSSGHANQLFVSGYGVELALKRTDYIVIDDRAAEQSPNSENAKATPPAAKDLKEESPADLKPLSASEVSTLGLNAASFAVNSENPFETLLKLSEDFPRHSSVIASINATTEFLEEFGQNQEHMFPPGYNVVWINGVQIDSRRVNAFSLLDHLRSERKLINSFRELGFSASEAVELLSHPIIANSQAAEVGPRYDYRDDTEGGGVIIWLNDIEKDKRYQGWPSSLNALLQRMYPGQFPQVRRDIHNVVVLLNLADGPDVQMLVSQIQTFITRKIPVRFGLVPTVVDQASMQQIRIASYLHQTYGLKTLLTYLETVLEKSKSQTISPDKNSFNAAIHDREHREGENILTFEEILSSDEFEPIITKTKAYLRRLASEEPAPLMFANGAVIPRDDNWIQPLTARLSQDLVNIQQSVFAGLYEDDFWMPNHYLEGAVLSRNSLIIPEDPSMIQILDLNAAYRRYQSELETLPRIPASGDSDMGKWGNLMLIADFDSDDGQKQLSTILEFREKNPEIEVLLLHNSSTNTHGRVSAELFDVVKSTRDVDESTLKSILQPDSERLVKQESEMEPVRNYFGSLSSLAKDLGPLRDRTNIVFNGRVVGPIPSTSLFEVQELEQLLAYERERRLEPVVKAVSSLALKDKIRDPFAFARLTSLVARSTASDMPEDIYDSGRVTRTSTYKKWNNMHSGFSLSNTDDPLIQVVATIDPASETAQRFIPILKVLSELNGVSLRVFLSPTTSLKELPIKRFYRQVLESEPSFNGDGSLRRPGASFTGIPEDALLTLGMDVPPSWLVAPKESIYDLDNIKLSSLKEGANVDAIYELEHILIEGHSRDTTHGSPPRGVQLLLGTERNPHFADTIIMANLGYFQFKAQPGYWQITLKPGPSERIFHLDSVSGTAFGAGPSDGNNEVALLSFQGTTLFPRLSRKAGHEEDDVLEAGSKPNSAKNYFAKGLNFASDMISGMTGTRQDKQADINIFSVASGHLYERMLNIMMVSVMRHTKHSVKFWFIEQFLSPSFKSFLPHLAKEYGFSYEMVTYKWPHWLRAQREKQREIWGYKILFLDVLFPLSLDKVIFVDADQIVRTDMYELIKTDLEGAPYGFTPMCDSREEMEGFRFWKQGYWKKFLKGLPYHISALYVVDLNRFRQIASGDRLRGQYQSLSADPNSLSNLDQDLPNNMQHSIPIKSLPQDWLWCETWCSDGALKTAKTIDLCNNPLTKEPKLERARRQVPEWTEYDDEIAELGKRVAREQQRIRGKKGQEEDVDGEEDGATIMEKDEL

SEQ ID NO: 3726 - protein, 1501 aa, Neofusicoccum parvum
MRVRNWLLTSQTALLLGAFGPQAVCASPPINVALKARFSSPPYLVELLETAADENSTAYLPLLDRIADGYFDGKASEQDLYESFLQLLQDDGHITDPDALSSFQLALSIHAAAPRIEAHYQFYNTSVEPSLEAEQSEECDSWVLLNKKQYCSPELAKEHGAVKDARGDDLPFDRPMTQERRLVPSVLYADITSPSFRKFHKTISKTAVEGRSTYKLRHKPSKTSRHEPLAVHGYGVELALKRTDYIVIDDRQAEEAAKEHATDGAQTVLQDEEVTDLKPLSESELKGLGLKAGSFVMGSEDPLDTLLKLSQDFPKHSSAIAAHEVSEEFLKEHKSNREAILPPGYNILWINGVQIMPRDVDAFALLEHLRRERQIINGVRKLGFTPPEAISVLSNNAIAKSKDNDEPQRYDWRDTTEGGNVIMFLNDIEKDKRYAEWPTSLRALLQPTYPGTLPSVRRDIQNVIIPLDLTNALDATLLIETLQTMVKRKLALRWGVVPSTKNMVAEQQAKVVYYLLEYYGLGAVMQYLEMSLKLKEISEPSKTAFQTVTDSGKIRGTRVAKTFEEVFEDSSIAKRVDGTGKWLSRLAADGNKPPFFVNGVAMPRNDEWLSSMSMRVSADLNTIQKGVFEEKFDQDGDDWLPDVFLANSTLRRNPIVIPEDEKDIKHVNLAQIYADHGDLIESLPRFAVAEDSEWFQWAQLFVLGDFDSRAGTDILADAYQFSGEHGDLETIFIHTGDVTPDSYRMAYLLFRNAGKVVGTEDIPEDFEPSAEEINACAEYWESMKPLLLALKGDLGRESLVLNGRTIGPLRKRRPFTEADFETLLAYERKKRIEPAARAIMDLHLEDKVKSPGAVAQLTSLVALSTVSDIPEGIFDAPPTMRRDVFKFWNDTHTCIKTGDRETATIQIIASVDPSSEVAQRWISILKVLSELNGVHMKLFLNPRERLDELPVKRFYRYVLASKPSFDESGSSRSLQAQFNGIPSEALLILGLDVPPQWVVAAKESIHDLDNIKLSQLKGRSSIDATYELEYILIEGHSRDMTTGMYPRGAQLDLRTTTNPRYADTIIMANLGYFQFKANPGFFNIELQPGRSQEIFSIDSAGTGGWNPSSGDRTKEIALMDFKGVTLYPRLSRRSGKEDEDVLEAPTSMVEDLAAKGAAFADGILSKVGLKGVKTGSSRHADINIFSVASGHLYERMLNIMMVSVMKHTKHTVKFWFIEQFLSPSFKSFLPTLAAAYGFDYEMVTYKWPHWLRGQKEKQREIWGYKILFLDVLFPLDLDKVIFVDADQIVRTDMHDLVTHDLGGAPYGFTPMCDSRTEMEGFRFWKQGYWEKFLKGKPYHISALYVVDLQAFRRLAAGDRLRQQYQQLSADPNSLSNLDQDLPNNMQTVLPIHSLPQEWLWCETWCSDESLKNARTIDLCNNPQTKEPKLERARRQVPEWTVYDEEIAALARKAREEGKEGAAGGEGVAAVVEDKEDEALLEEVKKQAEEVEGEKKKGHDEL

SEQ ID NO: 3727 - protein, 1585 aa, Laccaria amethystina
MLPVLALLAASLTLLAANAASPPVRVSLRSSWAAPPLLAEILETVSMENPDEDAFFTFLERLTDPEIFPSPEKMTPEAIHQAALGIAVSHGFLSNPGSLQAVEMNLALHAATPKIEAFYNFYEDHHKDSKGTLCGSWVDWYGEVVCDAKTLLRLAGREALDPSTGALPLRPRPKTLTFDHIFPSPKDLLERPPHTAILYGSLTSPNFRELLTELLFLTNRLDPHIEYVFRHIPSHAETRNYLSGYGVALDLKKMDYLALDDRNSHSKKLSETIDNDSVDKPATVDPILALIQAHPENVTAPDAKEPLSPEELQGLGMQAAQIIAESPEPLKALAHLSQNFPMYTTALSRRVIVNESIITELHDNSLKAQGGVNMFWLNGAAIELKDTQPLSLLRLLKKERTTISSLTALGLERSQAFDLLTHPEVSESQKGGAILDGLFDASDRVEEGDVVVWWNDMEKDSRYAHWNPSLFVLLRPMYPGQFPSVKANLFNVILVLDLSKTYSVNFIAGAMANILERNFPFKFGLVPVVETEESAKMARLFYHLVNTYGRKRTLTFLKTISQIQIPPQYQSPTVQWETVRTSFEELVNAEVAANPEAIKFNFDTIINTDSDAPLEKINAYVERLGATLATAPRGHAFLNGKHMDMNDDFLRQLQVETQQQQAFLQEKLYEGSLTDENKGDMATYFYDLPTTAKRRNKYIYPANNAPGSLKITNLPELFGKTRFRLEAGSYLYPEESNSVPLSLYVVADLDNDSGLALAMDAIRSITTTSKSRLTFIHNPTVLVTPAQSALSRFVAHLIYKGLLSEATSASLLQALGGGEVVDDSPSRDAVIRKLAGDIEPAEYEALVYDDYVKSTRHIAREFGVQPGQSALVVNGRLVGPFEKGDTFHAADFNALEEYELTKRTEPVLKALESIRPSLAENKVEFSNIVSMASSIIAAIQLPDPSEVGLFDAPQRPRQRAYQLLDSKYTAFEYGNNATALHHIAVLVDPLSETAQKWSSIIQWLSTLPDIFIEVHLNPGRYTDIPLKRFYRNNLIPSLSFDDAGNEIPAQAVFESLPIDPIYTLAMDVPHAWIVRPREALYDLDNIQLGNLSPGDSSVDAVFELDYIVVDGHARESATNAPPRGVQLELVTSDGSPIDDTQVVANLGYFQFKTKPGVFKLEIREGKGRKIYGMKTVGNEGWNSPSVEDVGSEITLTSFEGLVLYPQLDRNPGMERADVLDEGIDDYESGSGNLFVDMSARLMSFFGQSKEKTVDALVPVKPQADINIFTVASGLLYERFASIMILSVLRNTNHTVKFWFIENFLSPTFLEFIPHMAEKYNFQYELVTYKWPSWLRAQTEKQRIIWAYKILFLDVLFPMDLKKVIFVDADQIVRADLKELVDLDLHGAPYGYTPMGDDNEDMEGFRFWKTGYWKEFLAGKPYHISALYVIDLVRFRQLAAGDILRGQYQALSADPNSLANLDQDLPNNLQTQVPIFSLHEDWLWCETWCSKDRLHKAKTIDLCQNPLTKEPKLARARQIPEWEEYDAEIARFARDLAEEGKVQSRMAAADTNVLAGAAVPAAEKGEKGPAGATEGLEERGLGHDEL

SEQ ID NO: 3728 - protein, 1490 aa, Talaromyces stipitatus
MMRASLFALATSLLVLLQQPQSVVASPDVNVALRASFDAGPYLVELLETAAQENSSAYFPLLDRIATGTFEDATTDKDLYETFLQVLIEDNHLQSKESLDSFKFALAIRSAAPRIEAHYQYYNTSVQSTLGTAQDAACPVWVHMDGKQYCSSTLERAQQDVSGDRDPRELPFDRTLGDRFATPAVLYADIASPMFADYHRTLKGLANEGQIAYRVRYRPAHDGVSRPLFVSGYGVELTLKRTDYIVIDDRQAEEKDTTKSNAKTPSAQDLDAEEDESPLDLKPLSSSEVAKLGMSAASFVLDSSDPFATLVKLSQDFPKYSSSIAAYNASEQFLEEYKRNRQAGLPGGRNAMWINGLHVDARQIDAFSLLEYLRRERRLLAEFQKIGLSASEAVDLLSYPALAEVQGNSEVQRYDWRDEIEGGGVLVWLNDLEKDKRYTNFPTTLQALLQPTYPGQFPAVRRDVQNVVVPVDLANTDDVQFVAKYLYAFIKRMIPVRFGLVLTTNSEESKAQAKIAHYLHQAYGLASMLQYLETSLSAEKVSRAHKPSFTAAIAERSLRSGQENLSFEEVLQSDALDTIISNTEKYLNRLDLKGSSPSTLVNGVAMSRGGNYMQELPMQLSRDLQIIQQGLIEGAFSDDDYVPDYFLSKAAQSRNEWIVPEHDSDIVIADICGVADLHNDFAEILRFPADPKHTASNVQLIVVADFNTEHGLALLLSALKFRQTHPGSEIVPLYSSDAGEKVGSIPSKLYELLRHPEPVDFADVLTQIQSRDNTHQADKKEEEQAYWTLVQQLVTDIGLPAGSSSLIFNSRVVGPLPSSVIFKEEDIEALFSYETSQRLGPVSTALKDLGIESKVAGPLNFAKLTSLVMLSTNSDAPEGVFEQRSKYRVDVWKRWNSTHSAVDASTNTKDASINIAAAIDPTSEISQKWLPILKTLSKLAGVNVRIYLAPNGQLSELPIKRFYRHVLESEPTFDENRALARPEASFHGLPQDALLTLGMDVPSSWLVAPKWSIHDLDNIKLSAIKDSSDVDAIYELEHILIEGHSTDMTLRSPPRGVQLLLETEKGSFFADTIVMANLGYFQFKAQPGFWKIELKEGRSRDIFQLDSIGGGQESSGTNEVALLSFQGKTLFPRLSRKPGQENEEVLETGPRPGSAMDYVSKGLNFAQGVLSSVGVKQTDKSESAEKHAEINIFSVASGHLYERMLNIMMVSVMKNTKHSVKFWFIEQFLSPSFTSLLPHLANEYGFTYEMVTYKWPHWLRGQREKQREIWGYKILFLDVLFPLSLDKVIFVDADQIVRTDMYDLVTLDLEGAPYGFTPMCDSREEMEGFRFWKQGYWKSYLGNLKYHISALYVVDLQRFRELAAGDRLRGQYHTLSADPESLANLDQDLPNNMQTMIPIKSLPQDWLWCETWCSDEALKTAKTIDLCNNPLTKEPKLERARRQVPEWTVYDEEIAELARRVASSSSTSPENESEEEEEGEGKVYERKDEL

SEQ ID NO: 3729 - protein, 1677 aa, Albugo laibachii
MTKVVTNKAPIRAVLMRLIVPLIPLFVAFLPQCDSRAIHVNVTASWRSAITYPLTEISEFLAQEDPRLFWQWIDLLGAGDVFSTKMNDAADAETEVVLDVSGDAKSAVTAQSKSWSEMIENKHAMIERIVSKAMELTDTFLASHHSIIKLALLTRSYSPKVEMFRQMALDSVYHTSCDNRISAWAVVSNSKCVLAYACSIKELDALLQKSYEETSACIGPAENDRELPVDHVFVGSGDRDTASQKLTIILYGAIATNSFFDLHETIKPFAKIGRFTYIVRHYNRDSSLPTLLQGYGVSLDIKNMEYKTIDDDEHEKADDDHDDSELDNIDGISSDQKSALSEGLQQLEKESLQKQVDDTSHDEEQSEEWNLNDLGMVATFEILQSKNPVRHIKSLSQDFPKHAKRLAMAKNLLPSDIRETLRQWRISVVSYDYLDTLVVNGIPISATRGSFNAFDLLKLIQQEWSLVKKFSTLGLQEQDIIQLRQIGVAPIAEARYGTEKVVRIMIRGPVDGITPIYLTNIETDPSLARLPKSINALKSPSWHLIQIRRNMYEIGVIFDPTTQSGVEVLREMHFLYSRGAPIQFGILPTSKALLNTVDPQERVELIRLWKRVTLGEQATSFHFSKIIFLIRGQALGDLADESLHSQFTKFLSLMLTLDVGYTVSQLIGIYQKTIADMVETKDEVLAILKSDRLDEEVLSITEFISRKHLPFECHLFNGIIQPGLSLQENLMDNFGREQHVYQSLAREAKLSGKRDLIEQLLEHQDTYNSYFTIYSDSANKVDFHSFVSESNAASSLLNNDLDETLERMLTDHVTYLHPIGSATVTKKETLVFHLSVFSPSACGHAYQGVAELLRTDSNHSSTARVGIVHLHENTPSNLEEDRKKVGQLILDVLSKANTTDEKIMLEAIAHTFKCQMEYKSYEDTKQSLLGLLETFESNYATEWKELVKAHVSLPILKVDPDKQRLSNLLAVSTGQCGNSAAGKLTLSTSHLFLNGRCVDLSDYILGEFDIKDLIAYDLETRTEDAAKVVLKDDDSEMSVQDAGLKSLYLMKVCGLLDQYRHWDRYNALDLLTESGTKNRSMIHIDGDSTLNVVAFLDPLTEATQRMSSILETLQTQLNATIDIILVPDSEYSEFPLRRFYQYVFGNAPLHLGNSILNGAAFRSLPIKPILTMNIDTVEEWNVHTHESRYDADNLMVDPKNEAEVRGTKTVSYILNNVLVYGRCVDVTDGRMIPPNGLQLILHQRFGNEKLSHDTLVMRNLGYFQLQATPGIWSLHLARGRAANLYEIVMNHGDSSTETEVVYSIPVFISDFNTRKTNLVVKKRVGKEQIALLDSDEHDDANYVDEETKEAGTPGSVLTSYWNSVSSLLTGRKSAISTSSDEALKNSKETIHVFSLATGHLYERFLKIMMLSVVKRTKSDVVFWLLENFLSPNFKRSVPALQAEFGIEIRLITYKWPKWLRRQTVKQRIIWGYKILFLDVLFPLHINKIIYVDSDQVVRADLKELWEMDLKGAVYAYAPFCGSRNLGFQFWREGFWKSHLQGKPYHISALYLVDLKQFRKVAAGDTLRGIYEQLSSDPNSLANLDQDLPNFVQHNIPIFTLPQEWLWCESWCSDETKAEAKTIDLCNNPKEKEPKLEMAKRVISGDLFQESWIQLDQEIRESEKRYVAGLQSSDAGTI

SEQ ID NO: 3730 - protein, 1524 aa, Aureobasidium melanogenum
MVRYQHLAVNTALVLGLQAICTNAAPSVNVALKTSFDSAPYLVELLETAADENATAYFPLLDRIAEGHFDHASTDQDLYNLFKKTLQEEGHLAKAEDISSFEYALSIHAAAPRIEAHYQFYNTTVEPTLKSRLDTSCETWLHFNGQQYCDPDLSSSSANSVDQERLLDLPFDRIMGDKQSKTPAILYADLMSPSFRQFHKTVSLTARAGKTSYRVRYRPSLSIPGFPLAVSGYGIALDLKRTDYIVIDDRKAEDSDDTNVDASGAKLTDEDVADLKPLSSKELLRLDMKASSFVMDSSDPFDTLLKLTQDFPKHSAAMSTHEVSEQFRKEHLANREVFLPSGYNVIWVNGLQILARDLDAYAMLEHMRRERKLINSAGELGLTGKEAVQLLSHSSISEAASTQEPQRYDWRDELEGGKVIIWMNDIEHDKRYAEWPDQIRALLQRTYPGQLPPVRKEIHNLVLPIDFADYKDVEMVVESLQSFVKRKVPIRFGLVPKTSSAGSSEQAKAVYHLLDTYGLGVALEYLQKLSSNQGRKLSGPVQSVFENTIKGRKLRKDRVSAPLQEILKNDDFDARVASARKYLVRLGASGPNPPFFVNGIPLPMSDEWLQEMSQRVSTDLRTVQKAVFEELLDDESYVPEVFLSRASARRNPWIIPEDENSIRQVNLASMSDLSEGAVGSIPSLPASKDTISSELIHLVIIADFDSEAGQTMLSDLIALRKEEYDQVEILLVHNADKELSTSSFAVDLFKTMMLGPVVSLDALEALMSKKKVDVSEEDVVAAQAFWSSADRFINDIGFRRGEQGILVAGRVVGPLPSFEGFDRDDFMTLLSYERMKRLMPAAQAIKGVNILDKANTALSFSKLSNLIALSSKSDTPEGMFDASPPARADIFNGWTGSHTLIERGDPETATIQIVAAVDPASEIAQRWVPILKVLSELSGVHLRLYLNPKERLDELPVKRFYRHVLESKPRFDKQGSLESSLAHFEGLPADALLTMAMDMPPAWLVAPKDSIHDLDNIKLSSTQGRDIEATYELESILIEGHSRDVTIGTAPRGAQLVLGTNKDQHFADTIVMANLGYFQFKANPGFYNLTLQKGRSEEIFKIDSAGTLGYIPQKGDETTEIALTSFRGATIFPRLSRRAGMEDEDVLESAKTTTDHITDKADKLLAKVGLGSVKSSDVLSKAQKFGSGLLSGSTGSTTDISTLPHADINIFSVASGHLYERMLNIMMLSVTKHTSHTVKFWFIEQFLSPSFKAFLPIMAEEYNFRYEMVTYKWPHWLRSQKEKQREIWGYKILFLDVLFPLDLDKVIFVDADQIVRTDMYELVTYDLQGAPYGFTPMCDSRTSMEGFRFWKQGYWKNFLRGLPYHISALYVVDLVRFRQMAAGDRLRQQYHQLSADPNSLSNLDQDLPNHMQHVLPIHSLPQEWLWCETWCSDETLSTARTIDLCNNPQTKEPKLERARRQVPEWTIYDDEIAALAQRKVGDGKSPIAGDASGKGIQAEMQEADARAQKEENERKEKQKKHDEL

SEQ ID NO: 3731 - protein, 1616 aa, Cuscuta australis
MGRNWTPFGFGLWAVIVLVLFSGHSVSAANSRPKNVQVALRAKWPGTSILLEAGELLSKEWKGLYWDFIDTWIGLAEGDYECKSAQDCVKKMVEYGKSFLSESLASVFEFSLTLRSASPRIVLYRQLAEESISSFPLVDDNTSDSTIVEPRSFKEKKCCWVDTGGSLFFDVPELLLWINSPKAVTGETFQQPELYEFDHVHPDSSIGSPTTILYGALGTECFKKFHHILVNAAREGKVCYVVRPVLPSGCESKSGSCGFIGTRDSVNLGGYGVELALKNMEYKAMDDSTVKKGVTLEDPQTEDLSQEVRGFIFSRILERKPELKSDIMAFRDFLLSSTVSDTLDVWELKDLGHQTAQRIIHAADPLLAMQGINQNFPSVVSSLSRMKLNESIKDEIIENQRMIPPGKSLMALNGALINIEDIDLYLLIEIVHRELSLADQYSELKIPPTTIKRLLSTLPPSDGNSLRIDFRSHHVHYVNDLEVDVMYRRWRSNINEILMPVFPGQMRYIRKNIFHAVYVLDPASIHGLETIDMIISLYENHLPIRFGVILYSAKFINQIESNEGELLFPQKKEDSQVQEDISNLIIRLFIYLKENHGNAMAFKFLSNVNKLRIESSAEDAPEMHHVEGAFVETVLPQAKSPPQDTLLKLEKEHTFKEAAEESSLFVHKLGLSKLQCSLLMNGLVNDPSEDALMNAMNEELPRVQEQVYYGQITSHTDILDKFLSEGGVQRYNPLIISDGKAKPRFVSLSAALLEKESILNDISYLHTPETIDDLKPVTHLIAVNISSKKGIKLLREGIHYLMEGTRNARLGVLFSDVQDTHWPSILFIKIFKITASSYSHKKKVLEFLDQLCLFYEREHMQLLTPPTEDNRLFINKVFEMANENGLPSKGYESALPGLSDDMIKTYMSKVARFLFRQVGVESGGGVVITNGRVINLDEGTTFLSHDLQLLESMEYKQRIKHIVDIVEEVKWEDLDPDMLTSKFISDIILSISSSISSRDRSSESARFELLSATYSAVLLENENASVHIDAVIDPLSASGQKLASLLYLLSKSIHPSMRLVLNPMSSLVDLPLKNYYRYVAPTMDDFSRTDFTVYGPQAFFANMPPSKTLTMNLDVPEPWLIEPVIAVHDLDNILLENLGDTRTLQAVYELEALVLTGHCSEKDHDPPRGLQLILGTKSRPHLVDTLVMANLGYWQMKVSPGVWYLQLAPGRSSELYLMKKDGGVQGSILSKRITIDDLRGKLVHLEVVKKKGKEHENLLVPTDADSHSQDSKKGNQNRWNSNFLKWASGLIGSSDQSKNESTQELARGGRHGKTINIFSVASGHLYERFLKIMILSVLKNTNRPVKFWFIKNYLSPQFKDVIPHMAREYGFEYELITYKWPTWLHKQKEKQRIIWAYKILFLDVIFPLALEKVIFVDADQIVRTDMGELYDMNLRGKPLAYTPFCDNNKDMDGYRFWKQGFWKDHLRGKPYHISALYVVDLVKFRETAAGDNLRVFYETLSKDPNSLSNLDQDLPNYAQHTVPIFSLPQEWLWCESWCGNTTKSRAKTIDLCNNPMTKEPKLQGAKRIVAEWPELDLEARSFTAKILGEEISQEPSLLPAKTSNDPIEDAESKAEL

SEQ ID NO: 3732 - protein, 1318 aa, Echinops telfairi
TVKADSKAITTSLTTKWVSTPLLLEASEFLAETSQEKFWNFVEASQNIGSSEDHGSDYSYYRAILEAAFRFLSPLQQNLLKFCLSLHSYSATIQAFQQIAAEEPPPEGCSSFFSIHGKKTCNFDDIETLLRTASERPKPLLFKGDHRYPSSNPDSPVVIFYSEIGYKEFSTFHQQLISKSNAGKINYVFRHYISNPGKEPVYLSGYGVELAIKSTEYKAKDDTQVKGAEVNTTVIGENDPIDEVQGFLFGKLRDLHPALKGQLKEFRKHLVESTNEMAPLKVWQLQGSGNYFKGTLGLQPGDSALFINGLHIDLDTQDIFSLSDILRNEAWVMEGLHRLGIEGLSLHNVLKLNIQPSEADYAVDIRSPAISWINNLEVDSRYDSWPSSLQELLRPTFPGVIRQIRKNLHNMVFIVDPAHETTADLINTAEMFLSNHIPLRIGFIFVVNDSEDVDGMHDAGVAVFRAYNYVAQDLDDYHAFQTLIHIYNKVRNGEKVTVEHVVSILEKKYPYVEVNSILGIDSAYDQNRKGELSHDQDVVEYIMNQPNVVPRINSRILTTEREYLDLTANNNFFVDDYARFTVLDSQGKTAAVANSMKYLTKKGMSSKEIYDDSFIRPVTFWIVGDFDKPSGRQLLYDAIKHQKSSNNVRISVINNPSEDISYENTQISRAIWTALQMQASNSAKNFITKMVKEETAAALAAGADISVFSVGIIGPLEDNELFNQDDFHLLENIVLKTSGQKIKSHIQQLQVEEDVASDLVMKVDALLSAQPKGDARIEHQFFEDRLSALKLKPKEGETYFDVVAIIDPVTREAQRLAPLLLVGTNAGLVSLNYFYRYVLEPEISFTSDNSFAKGPIAKFLDMPQSPLFTLNLNTPESWMVESVRTPYDLDNIYLEEVESIVTAEYELEYLLLEGHCYDITTGQPPRGLQFTLGTSANPVIVDTIVMANLGYFQLKANPGAWILRLRKGRSEDIYRIYSHDGTDSPPDADEVVVVLNNFKGKIIKVKVQKKADMVNEDLLSDGTSENESGFWDSFKWGFSGGQKTEEVKQDKDNIINIFSVASGHLYERFLRIMMLSVLKNTKTPVKFWFLKNYLSPTFKEFIPYMANEYNFHYELVQYKWPRWLHQQTEKQRIIWGYKILFLDVLFPLVVDKFLFVDADQIVRTDLKELRDFNLDGAPYGYTPFCESRREMDGYRFWKSGYWASHLAGRKYHIRLLDLPNNMIHQVPIKSLPQEWLWCETWCDDASKKKAKTIDLCNNPMTKEPKLEAAMRIVPEWQDYDQEIKQLQTRFQKEKETGPLSKENKTKESSQGHQTREEL

SEQ ID NO: 3733 - protein, 1502 aa, Alternaria alternata
MMRASASILSAKALLVLSAFRHSGAHAGPSVNVALRASFNPAPYLVELLETAAEENATAYYPILDRISEGYFDEKDTQQELYTAFRDLLQSDGHITDPAALASFEFALSIQSAAPRIEAHYQFYKTSVEPSLEATQTKACDIWTSFHGKQYCDVHLEESFGGIESERTYQLPFDRILGNSSALPAILYADITAPRFKKWHKTLSKTAKEGKTSYRVRHKPSSNAPTTPLIVNGYGVELQLKRTDYIVIDDRQAEQGQKSDAQKPIGTGLDDDEDVADLKPLSKDEVSELALKAADFVAQSEQPMDTLMKLVQDFPKYSSVIAAHNASDEFVEEHLANRNQLLPAGYNVIWINGVQIPARDVNPYSLLAHLRRERKLINGIRSQGLSGSEVVSLLSHASIAESQTEDEPQRYDFRDTTEGGNIILWLNDIENDPMYEGWPSELRALLQRTYPGQLPSCRRDIHNAIVSVDFTSTEDVSLALDTIMSLIRRGIPLRWGLVPQTATSEAIDQTKLVYHLQDAYGLPAVIEYLQVSAAKPDKAVFDTTVKRTTLIEGKEALAFDDVLKSEALDQRISGAKQYLKRLAAEGPKAPIFVNGVPIPATDEWLQTLSQRIGMDLRQIQKGVFNGVFNDDSWVPQYFLFQAAAKRNPLIIPENEKNITLINMAEFEEVHGEAYSKMPRLDASESASKSDWIHITLVADFDSEAGFALLKALADFHEANPNVEAVLIHNDKAGAEQSNASEDLLETYIKSGRKLTSEALSGLLGKEVNYGPTPANSTLFWKVAEPIYDAVGLKPGQNGLLVNGRYVGPIPEDYTFSQDDMETFVTYEITKRIEPLNKALADLQLMDKIASPLDVAKIQSLVALSTVSDVPEGIFETASTLRMSTYNDWKSKYTAIVRGDEDKAVFQIVASIDPATEQAQKWVPILKVLSDMDGVHLKLFLNPKGMLQELPVKRFYRYVLEARPQFTHDGSVGRLGAHFGGIPKEALLNLGMDVPPSWLVAPEESIHDLDNIKLSTTPAGTNIDAIYGLESILIEGHSRDTTNGGQPPRGAEVVLATERDPHFADTIIMANLGYFQFKANPGFYNIKLKSGRSQEVFNLDSAGPISWAPQPGDETTEIALMSFQGATIFPRLSRKPGQEDTDVLAPEESLASELVGKSAQKVNKFLGKMGLNFDSEKVLQKGADLFSGGKTAKKGIQADINIFSVASGHLYERMLNIMMVSVMKHTNHTVKFWFIEQFLSPSFKSFLPHIAAEYGFEYEMVTYKWPHWLRGQTEKQREIWGYKILFLDVLFPLDLEKVIFVDADQIVRTDMFELVQHDLEGAPYGFTPMGDSRTEMEGFRFWKTGYWANFLRGRPYHISALYVVDLNRFRQLAAGDRLRQQYHSLSADPNSLSNLDQDLPNNMQFNLPIHSLPQEWLWCETWCSDEDLAKAKTIDLCNNPQTKEPKLDRARRQVPEWNVYDEEIAALARRVKGEERKEVVDVQEEEQRREKKEKDAEIEHSEL

SEQ ID NO: 3734 - protein, 1208 aa, Allomyces macrogynus
MDTACGFHAAPGRGEGPQPRQGSCLRPRARLARANRAISMLVVVCAAFLILTHQVAPTAAAVDGQATADGTTRETSGFRVTLNARWQSDPWLEYFEDIARHNTSALDRLLPSVTQFDSIDAAHRHLETTGALARETVQLINLGVQYRETLPRVAALLDVYNSTVHAHTDLQSCSMFVLIDDKWTCDLDEALAWLSSDHDHGHDTHFDAAIDTAPMGDANAWQKAVVYGHPRHTSFAPFWQRLRKLPVRVALRYVPATSSVVPARQRLNGYFVHLNIKDLEYKVTDDRTSEGEASAAPDTPTRLESLDAASLETIAARVAQNVTTLDDLARITAAYPVTLPEIAASTAAPSAQLCANLDANREMVEARVGRADKMLWANGKLLPASSVTIYHLLETLRGEVELAQDAKRIGLPWAQAVSVLQHNINSEAADYFDTCAIEPVVWLNDLESDAQYKSWPKSLRNLLTATRGMKAIRRNIFTLLFFMDAANSKHVAMALEFVTMVENNIPLRFGLVPLVNTDPASKTSRLGVEFWDIYVAKGRDAALQWLASNPALSLTHPDEAAHATLLAARNQLAVHDDGEMFFNGRPIDIGESYQHQVMAEYQQQVEQLAMMVYYGQLDDSTNMNKYWCIKPTTWKTRSELAFAKRKPEHRWANFDASALPEDVDLAAQDQYPFVHVTVRGHVRDAALEAIKAAQSTARFVLDVVADATTDQGIVVNGKLIRHLPAEMTVDDVKTLVHVEWVRRLKQLRLSPTCVAMDPPTFWKASSLWWKNHVAAKKNENGFRSGPGHRMNPFDIVSCDKGKCLTVPAATESGGTDDLPVVQLVALLNPVSTNAQRLVPLLQEVHRALPYVSVTVVWLALPVTKGARPQSVLVDSFLGVTLYPTVHKRAGKEDMTVLDEDRPQQSWWQQVVQSVMGQRKETVHVFSVASGHLYERFLSIMMQSVVDRTQNPVKFWLIEDFLSPSFKATLPALARTFQFEYQLVTYKWPEWLTAQSVKQRTIWGFKILFLDVLFPLNVDKIIFVDADQVVRADLAELVSMDLEGAVYGYTPFCDSRAEMDGFRFWKHGYWLSHLRGKPYHISALYVVDLNRFRQVAAGDILRQQYQGLAQDPNSLANLDQDLPNSLQHMLPIHSLPQEWLWCETWCDDTSLTRAKTIDLCNNPLTKEPKLDRARRLLPEWEVFDERAEKVRHNVLLELAAKSRPDHEEL

SEQ ID NO: 3735 - protein, 1477 aa, Colletotrichum chlorophyti
MVRLSQLPMGLALVVLAAVHVAAVPSVTVDMKAAFPSGPYLLELLETAAGENATSYFPLLDRIASGHFTEFKTDKEVYDNFLQVLQDDGHITTPDALSTFKLALSLRTAAPRIEAHYQYYRTAVEPKVGSDPQDGCEVWAELGGKQYCAPSLDNPRNLELEGSKVLPFDRVLGSGNEAILYADPTSSAFGAFHSALAQKARNGEVEYRLRYTKPAGSHDEALPVSGYGVELALKRTDYIVIDDRDAQTDDAQKTVTSDEVLDVEEEVADLKPLAKSELQELGLKAASFVMQNQNPFEALLRLTQDFPKFSASVAAHDVSADFLAEHQQNRQHLVPAGMNVIWMNGVQLIERQIEAFTLVDLLRRERKLIEGVRDLGFSGGQAVSLLGHPKVAESKSDEEPPRFDWTDDIEEGKVIMFLNDLEKDERYQDFPNNLMSLLQRVYPGQLPPIRRDIFNLIVPIDFSNLEDITQVAQLNQIIQRKVPIRLGFVPLTPNEEAVGISKILYYLLDVYGLDAFIEYLDVALQESKTDKPDAGFFEKAIKDREALPETKTLTFDAVLQSEELDKVIKLAQNWAKRLNANTPVRPAFINGLPVAREGNWLQAMSMKASTDLQAIQRAVYMGQVEEDMWIPDYFLEKAVKRRNTYIYPEDDRSLKILDVNKIHTEHDGLFSKIPVIEAYADSTKENWAALTVVGDFASNEGTNLLLSALAFRRNNPGVRLDLLHNPAAPASASAVNTALKNSVDKLSEVDSLSDLQAIVDGASGESDGIYTAALNEFLSFAALEPGANVLVLNGRVIGPFSQAEPFQVDDFQYFLEFEQKTRILPVYYAVEELGLTDKISGPLAAAKVTSVTALSTISDLPEGIFESAPSIRISAQDTWNSTYTAIETGNYETSSIHLIGLLNPASEQAQRWAPILKVLSELDGVYLKLFLNPKDKIDELPVKRFFRYVLDSQPSFDESGKVRALEASFKGLPSEALLNAGMDVPPSWLVAPKVSVHDPDNIKLSSIKSNVYASYELESILIEGHSREGKGTTPPRGAQLVLATEKEPHFADTLIMANLGYFQFKANPGFYNIQLKQGRSSDIYTIDSIGAKGWTPVPGDDGTEVVLMDFQGTTLYPRLSRKPGQEEADVLAEAEDNSIVGRGLKFAEGLLGKKKSASDEEHAEINIFSVASGHLYERMLNIMMVSVMKNTKHTVKFWFIEQFLSPSFKDFIPHMAKEYGFKYEMVTFKWPHWLRQQKEKQREIWGYKILFLDVLFPLSLDKVIFVDADQIVRTDMINLVNHDLEGKPYGFTPMCDSRTEMEGFRFWKQGYWANYLRGQPYHISALYVVDLRRFRELAAGDRLRQTYHSLSADPNSLANLDQDLPNHMQFQIPIHSLPQEWLWCETWCSDESQRDAKTIDLCNNPQTKEPKLDRARRQVPEWTVYDDEIAALDRKRKGLPVEVPKKEGEQKPVVEKNTKSRNWEEPPAKETHEKDEL

SEQ ID NO: 3736 - protein, 1641 aa, Scleroderma citrinum
MLHPLLVLAGLAFGALSASGSSPPVTVTLQSSFASSDPLLEALETVAIEDAPTLFPLLSHFPLHEKPRTQRDAYETVFNLASAYLDVSALASARARLALHAATPRLAASAEHYDLRVTDVSGPTASSGEDCASWVDWYGQIVCDADSLLRLANAAPAENPDVSLKKLRRFPFDHVYSVRPRLDEPPYTAIHYADPTASSFAPLHAALFGLKPKVEYVIRWARGTGEKKAGELSSYLSGYGVALDLKKMDYLVLDDRNQGGAAGLGSSDVSAPSGSHADNENGKVPEEILSCIFESLPYVDEHAEARAKAGEPLSPEEITDLGIKAAQFFASFSSEPHMGSLYEHPCWDSHHKQPMPVETLFRTLSTSFPLYATSLARKVHVSDELRDEIYENWARATAGTNMAWVNGRVLNEHQGASGEIFGILRTLRRERALVNSLVGLGLTREQAIELLMHPAHSSTGSPSGSSSNRGMMARESAERQQKKSFVLPPKFAEFLEGLIDASDRREGGGVILWLNDLEKDVGFRPSLMGLLRVHSMALFSPMLRLQHNLMNVVFILDLSQLRSLSVISHLHDNFVMRGYPVRWGFVPETAGQSLNMARVLYYVERKFGRDAMTGLIQGILATHGQRGLTTLSWSIVHELFDGLNAPDDFVSVTGSDVLIVDEATGDSLLSRAQQYCKRLGLTTRDEVGNGHVFVNGRYLPVSDNVMRQIATEGNAQLQILQEMVYVGEISDSDSSLMSTWFYDLPSTMLRRNPYISAKNTDRHASDGKGLEIFNLVDLFYNAGFTLEDGSFAVPSNGQESVLPLTMYIIADLNTHEGIELVTEALKFISDPAEARVTFVHNPTTFTQDTGSSASQLLITAVQAATLSRVPPRRLLTVLIDEGEPGLRVLRDELLSGTDVVDIDTSSFSSSMRLVARQLGLQPGERAILINGRVVGPFDSNAEFLAEDFKMLETYEITKRVGRIMHAFDGVLAGEEALDVAKRSNLIAVASSIIYADQQPDPSEVGLFDSSPRPRTGNYRLLSGDYTIEFGDRSTARTHIGLLLDPLSEAAQRWSTVLEHHSSLFPEVFIELYFNPVQHGDIPLKRFYRYNIIPALQFDENGQEIPAQVTFTALPEDPIYTLGMDVLQSWLVRPRDALYDLDNIQLGLLQGEERSRGVQALFALDYLVIEGHARELQSNNPPRGVQLQLFGINDRSVMDDTQVVANLGYLQFKGRPGTFRLEIREGRGSAVYALDSVGAEGWNSPSVVEAGDEFTVMDFDGLTLYPRLVYQSGMEGMDVLHDIGPVEEPSGILGSLVSRVSSFFKPANAGETGVLLKEGKQAEINIFTVASGLLYEASRFASIMILSVMRNTNSSVKFWFIENFLSPSFLDFIPHMAKEYGFQYELVTYKWPSWLRPQKEKQRIIWAYKILFLDVLFPMDLKKVIFVDADQIVRADLKELVDLDLHGAPYGYVPMGDDNYEMEGYRFWKTGYWRDFLAGRPYHISALYVVDLVRFRQMAAGDILRGQYQMLSADPKSLANLDQDLPNNLQREVPIYSLGKDWLWCETWCNNDRLHRAKTIDLCQNPLTKEPKLARARKIPEWEGYDSEIARFTRNLAAEGKIHASMATADTKVLAGGGAPAGPEHTPRAPDTNNSSNLHDEL

SEQ ID NO: 3737 - protein, 1426 aa, Candida duobushaemulonis
MLISRFWTIAAATAVSIKLTADWSEASFPEQLIEAASSYKDSLYVSAVRALYQNEESLDWEDDDFDDVEIGSETGSRTDKQIYDSFVGSLSPEEKGMADLNLVNKIYTPRIEAHYRHYQNEVDESKVLKACAKDSFGNEIEDPLGAWVKYGDRIYCSDADLYALQLSRTSEEIKAFDRVIGNDEKKPLLVLYGSSKSPRLGQMFETLYQFAESDKLRFMWRYVPTEGPKSEIPGFGAILTPKKPLNGTKSSKIKYTGDIKKYLADIRKRGQPLKALEEDSYQELSVKITALVLAQPEAEQHELLQEILNNLPLYGPYIQLIRDISGLESTRAAAKVNENRGASAESVGLYLNGASVHKLEMDLPHVINKLNTELRLAQRMSELGFSKAQSKFIFYKFALMSAFREVQYRTGDQENRYAVYKHAFDPTDNTSGGVVYFNDIEKDDPYDLFDVNRREAYLGVEAQRLQFGQVPALRENSHELIFAINFSSSIQVKIFFTFAKIILDRNLPQQIAVVPLVDSDEDELVTEKFYHIMEVSDSKEAFALLYQYYEAPTQEEKHEILSKVEVSEDKQGTFRNYEKTVREFSLDSPSVIINGVIHDMKSPWQAAMTKQMGNDVRLLQQKIKKMEDRGRDLKSVLFQDAKESRNSRVSPKDLSNIRYKEVTKELIDNSSAFKKINKPNDAPGTFWLIGDFNSRLILAQFSKLLELLEIYSDMSLEIRILNISDDDSLLNKLSAKYGAKPLTHETITDLKSEVLKAKSKVYSKVSPKKAQLLQDHQIQLHQPGMLFNSRYLKLNDLFDTEELIELVGFEHRRRLSIFKDITDTYPDMFSWKGIMFFRKSGYDNFEWFDLVSSVVAKSFFLEDSQIQTDVDRFDFSSLNFVNSLNITGANGASVDILAIVDPISDVSQKIVSIVSALKDLPFVNVKLLIQPLKDVAEHTSLERFYAHNFVSSYPQFDEDGTFSISNYGAQAQGLVPKYKFSSDLDIPSRWLVVKDKLPKADHEEFTVDEIEELSYKLDKLVVEGYAKDVKTAQSIATLTFDITNEQVVEDGIVMHTLGYVQFQLKPDVWSLSIQRGSRGEQIYNLLSASDNKYDTNDQPIDTAEVSLFSLHGSVIHPRLLEKSEKDQAKAKKKVSTTKNADINVFSLASGKLYERFVSTMMLSVKKHTKSTVKFWLLRNFLSAEFVDSLPQLAEAYGFQYELITYKWPLWLRQQKEKYRQVWGYKILFLDVLFPNSLDKVIFVDADQTARTDLKELVDTDLKGKVYGFPPMCDSRKEVEGYRFWKQGYWKNVLQDDLKYHISALFVVDLNAFRQEYAGDRLRSHYQKLSSDKESLANLDQDLPNNMQRSIPIHTLKQDWLWCETWCSDESKKKAKMIDLCSDPFRKETKLERVQRSIPEWKGYDDQIQRLQKGESDTGANVGHDEL

SEQ ID NO: 3738 - protein, 1635 aa, Coemansia reversa
MGTTLRFLGRLAALVAFCGGLCSAAAVSESPSIRTRLLASFAAPPLVLEVVEGVAAHNSSAFFPLLTKLAENDKLFKQTEADVYEQLLQWIEKDALLESFALALLKLELSAHVYAPVVVAQYQLYNSTVVPDIKTARGTENFDESCRIWAQYKDKQACSISALSELLDIEKFYGSTYVEEALVETTELAFDHVYPSESAAAPKLVVLYADPRAAGFVEFHNHLKQLAENQEIAYIFRYKPWVTDIEDTTRPLGLSGYGVELALKSTEYKVIDDRDLDVGGNHAAVNSDSKFVNQASGDRVAELLFESEIEPVVKGLKGKQLPALGIQATQMIISATDKLSVLRQLSQDLPRYAHLISEIPVNYTLAEDIDSPWRHNRKDEVLINGLAINEDDMDPFHLLEHIRKDSSIIQGLESAGLNPKQALGLLLNEAAEDDIDRSNSITFDMRERPLEKRAVMWLNDLEKDNRYSEWSSDVNNLLRITNPGMIQRLRINVVQVIFTIDLSSPESWIMIFEDIVANIEHGMPVQFGFVPLIDYANPNLHSEANQMAKFTLYLRRSLKKAEWHSLTKGALITHLRSQHTKPIGFIDSMRTAYETYAKSHKTRDNEDFLEWNDIVGTKAPWLMERWKSIVEYCSRLDLSPTSAPMGLAFVNGIQLPLTDGYQQQIFREFQIQTWLLSKQLREGEFSVKNNIQDYVYGRLAVGSRNALVYASDEAPLRFLPFGEQSVQGWMDKIYYLGFSGLAADASTSESKKENKEKLISTWVIGDFGSQRVRDIAAGAVLAAKSETRMRVALVHVSHTTETQHTDRAEGEDADDTPEDYDVDAPQIIYQLLSSQSAFSNASDALADFVPEFLVDQDTSKASLADMGANGKLLKSLLQPDDNRMDEAEHVFTQNRRNLSRLGAIPTGRDDCNVVVNGRILPPITPAVSFSADSFVLLARHELLERVNPVRKALSDVAIDIDAKILPELVMKATAIVEYGRLLFSGDTILQQRQRTSRMDMARQHPTDTETYLKFGDPNSARLRVQVVLDPLSENAQKWVPILETLLSLPNVSLELWLNPKYKVEVLPVRRFYRYLWPSGLEFDSVGDIADPEVVFSSIPADPLLTLNMDVPTAWLVTAVDSIHDLDNIRLSSLHGQHRDISAIYKLVNILVEGHLVDRNSRSPARGLEVQLGTSLEPAATDTIVMANLGYLQLKANPGVWRFGIRPGRSADIYRIDNVSSNRWNYAAAAEAADNKHDIQHTVLVTSFSGATIFPLVSKRPGREKDDVLQSSDVDSTDSTAPASKSGSGIWGKIRGSLGGGSNGDGNSGVVSSDERPHFDVFAVASGHLYERLMSIMMLSVLNSTESSVKFWLIENFLSPSFKAFVPQMAEEFGFDFEFVTYKWPHWLHHETEKQRTIWGYKILFLDVLFPLNLDRVIFVDADQIVRADLQELADMDLHGAPYGYTPFCDDRPEIDGFRFWKQGWWRDHLRGKPYHISALFVVDLKRFRQMAAGDRMRGQYQALSRDGGSLANLDQDLPNNMQHIVPIYSLPQEWLWCETWCSDGGLKKAKTIDLCNNPMTKEPKLERARRLLPEWEVFDKQVADFSRTLAQHGKHEGAQIADAEAVNIDQPLPVAKAKHHSSNEAPADKNIHEEL

SEQ ID NO: 3739 - protein, 1260 aa, Paramicrosporidium saccamoebae
MRFSFVAVSVLLSVVETAKVTAPWLSYCSAQSLETSEFLSILHPNSFWTFLERLANGESIDQATSSLLSPTEKELLERAAKYRLYSGRIVVHEKLRPHDAPECETFAVYQGESVCNPENLGKSISTLKENASDPKDTYGHMLGDRGSMVILYSKIGSPTFLPFHRILKKAALDGEVRYVYRHLVHRDCPDPADAELGGFGLELEMKGYGPTPITVDTAHGQYRLEDPANSKNVEQFGLQALQTILDSSKPLESLSFISENAPMLVKHLSTVRPTKEVIEKATMLAQHFNLPETIISINGAEVQSLHFELQTLLEFLGEYQSLVKRFLLKLEDFEMVGRQLMASSLQVAPFRFDVRTSTAIVLNDLSRDHRYKQWPRTFRALMRPPSGQFYPLARNVVALTIVMDLDSFASSLLEDIVRVVGQMIPVQMILVLTAAEDSLTAAVYAVYRQYGRIAIVLKARELGTKVDTSVLLEEVMGELEINTGLDMDDLIQMTQATQLAEEAKKFAIKFGAPNEIVAYSWQRKVMQVYQEEIYNLQVAVMAQQIDDSSDYLSLLLDDEKTFKSRHSEIFSMQQNYAQKMVPWTEWIYSDRATDNCAFAVVVVAEMHRQGDVQMVQSWLEAVGKTDRKMRLKIVPIGSPTTNTQLLWKLHRKEITPEAALDGLEDDPQDLDNAELQRWVEENSQIVSDLCEMADKGPVVSINGHIYGPFTTPVAVSDIPTWLQAEWQRRTETLQALRINFELEREPSALTQMTLFTGHLVALMQKHSHLFTGKTVMDIPLEKVCHFEVENETALVQIKELATMVDAIIIPNVQPKYTDLPAKGVYRFRHFDGTLTHIIPDSHYALMLNTPSAWDIDGASDTADMDNLTSPADAVRVILRGLVLEAVVRSSGRGLQGIPLELRLDNRLVDRSVSMAFPGYTQLHGDPGLYTLQVSPNEYLRLSAPTIVPLASLAFNMAVANVEVAMGDESILNDTVHVFTIVSGAVYERLVLIMMRSVSKNTTKPVKFWIIANFITPALRESISKLSGVLGFTYEFHRFHWPGWLNPQSRKHRRVWAHKILFLDSFPHTVQRLVYVDADQVMRGDVAELARTDMKDCVYGFVPFCESRRESIPLQFWKSGYWEDYLRGLPYHISALFLVDMARFRAEAVGERLRAQYQPLSFDPASLANLDQDLPNNLQHEVPIHALPSEWLWCETWCDDQSKAKAKSIDLCSNPLRKDETKLDQARRIIPEWSTYDEEVAKILRETEVTDDSTDDSHEEL

SEQ ID NO: 3740 - protein, 1668 aa, Sporisorium scitamineum
MRALPLLSVGWAWLALASTLAIPTSVVHAESPPVKVQLRASWSKISLPSGGSPFLLELLEAARSQQPSSFFPLIELLTSKYSATELREASDEWLASTVQDLITTHQLFGAWRKHADEALDTWRMSLALSNSSPRVQALVQLYQTMQLDETWQKGSKDASCVSWVHFHDQVLCSGDDLRQAVRNGAPMTSIYDRSREVSLGHSRSSSAGSTAATQSFVLYADPFSDNFHELFSILEEHTNQPDANFTYTLRWRPSATDSALMPDVERTTFLSGYGAILDLKKVDYLVIDDRKLKDDSDIGDIGISASYQSEEGTAAKQAADQARWLRDQIGADSDASGATLSSLSEDQIADLGIKAARLIMDSSDPLRALQELSQNFPLHAADLAKTTKWDDADRSAALVDAVLNLASMRIEPGHSDLWLNGASTSTRDFMPLTLLETLRRERSWNHALQHPLAGGGLNVTEAGDLISSSLVGRAFLAQADGQASTAIFDASDRIEIKNAPEGTDVGAITWLNDLEKDAATSEWSSDLMDLLRPMWPGKFPRLSLNLFNVVLVLDLSQKETCRFLSATVIQSLGRVGLHWGLVPGGLEDETSSDAVRMARLFWFLLDQAGAQTTSDVLRKAAASKAGSSGALDISLAVKEAKFALKSIDTDGSLATKLDDALAGNNPAYTLKENLGRAYIKRLRATRKENRGGHVFINGQHQPFHPQIVHILHQTIQEQIQALAPQIYYGQISSSTPSLDTFFYDSVGALSFRSALVGGAGGEEGKGVKHGALDLFSALVDDAVPTETVEKVFRFFYPAAASGALLNSTVWVIADLDSDDGVALLARSFEALAKEDAKFRLGLLHTPSTGSEAEAHGRYVSTLMYRLLAEGRTEAVSPTQVLEALEQAHSHPDVSVQQLEGALGLTASDANSNQKARHFWQSISPSITSKLAIPPGPAILVDSHLVTNLSPSTIDARDITALVEYEAGQTLPSLIQALHLLRPNLSDLPPHQRQNLIFASLSVLNGIHHQAGSSMFTSKAASRSGLPEQLGTGDHVFEVGNRAEADVRITVLLDPLSEAAQRWSSVLLMLRELEGVYARVILNPQIKLRELPLKRFYRFSAPRALKFSEGRVVAPELRFFDMPEDAVLTLGLDAPAPWLTMPMEAVYDLDNIRLADVPSGSRGKGVKAVYELKHLLIEGHAREERAGSAVTVPRGLQLLLETPDEGTRLDTIVMANLAYFQFKAQPGLWKLRIRGGRSDELYEMQSVGSQGWNSPTVEVTGQHVVLDTLSGLTIYPRVAKRAGKEGQGLLEELDAQGRPIKIQRSPPYEAGLASSAGQLFLSAKDKLSTLAQTITGTPTTATTTTTEVTRRTHADINIFTVASGHLYERMTYIMILSVVKHTSSTVKFWFIENFLSPSFKEFIPHLAVEYGFEYELVTYAWPHWLRSQTEKQRTIWGYKILFLDTLFPLDLGKVIFVDADQVVRTDLQELVDLDLEGHVYGYPPMGDDSEDMDGFRFWKQGYWKDYLRGRPYHISALYVVDLHRFRLFAAGDRLRGQYQALSADPNSLSNLDQDLPNNMQSSLPIFTLPKEWLWCETWCSNDWLDRAKTIDLCSNPKTKEPKLERAKRQIPEWTVYDGEVGRLAQRLVEEKVGKSVVAPDSQVETKSGNTQQQAADANANADAHVHDEL

SEQ ID NO: 3741 - protein, 1544 aa, Schizophyllum commune
MGVLRSILIPLYACKLAYAASPPVKVSLRLSWAAPHPLVETLETVAQENRDAFFPLLDALTDGDKLVSPQSLTPEAAYQAALEIAASGGLLSKPGSLAAVEMNLALHSATPTIEAFHQYYENLNQWVECGSWVDWYGQVVCDVEELARLAGIETLDANTTEKKYLLAFDHVYPDPQYELARPPRTAILYASLFSPNFRDLHSYLYEQASRPATHVEYVVRYVPEQDARSPNSLSGYGVSLDLKKTDYLVIDDRAARIRSSDGIEEATDDDEARDDILTLIEAYPVNDTVSDSSEPLSEDEIRELDMKATQIIIDSSDPLRTLLDLAQNFPRYAAPLARHSIPLNDTVAAELAHNAAKVQQGGSMMWLNGKGVAERDITAFGLLRLLRKEREVVLSLTGLGLSAGQAVELITHPAIAAAQKGKDYADGVFDASDREEGGDVIVWWNSMLEDSRYARWQPSINALLRPLYPGQFPSLKLNLFNIVIVADLTDPVAFNFVSNSVSNIIDRNFPFRFGVVPIGESLDSERLAKLFYGMIQEFGRKKTIIFMRKVAGRHTTEPKIDWGIVEFEYDDMVDQLEAKDPSKQYPELDDLLNRDVLPQSKIRSYTERLDLDTSSNKHGYVFVNGKYFELDDTFLRAMQSEVALQTNFLQEQLYAGQLSEDDSARMETYFYDLPGAQKRRSAYIHQPADELVIESLPELLAKARLSLAPSSYVYPPEAGFLPLTTYVVADLDSEEGLGLVKEALLSLDETSRTRLSFIHNPKDVEGSLVDKQPYSAQGSQTPLSREGGLADLVDGITTDSDAYEAYIKSSVLLARELHLQPGQSAVVANGRVVGPIERKEFKAVTFKDLEEYEMKKRVGPITEALSKITPEALERDRASVAELLSTASSVVASLQIPDPSEVGLYQAPASPRLRNYNLLEGRHTSFEFGDNSTALYQLAVIVDPLSEAAQKWTPLLAWLANVPDIYIQVYLNPAPLKELPLKRFYRYNVRPALEFDEQGNEVTAETIFRGLPVDPIYTLGMDVPQSWLVRPKKALYDLDNVQLNHLDPRDDALEAVFDLDYIVVEGHAREGSGAPPRGLQLELLAGETPIDDTLVVANLGYLQFKGKPGVYRLAIRPGVGPKVYELESVGSQGWDSPPVNVSGPEVAVTSFEGITLYPRFARRPGMERADVLSLRGLPEEPKGFLESLKSSLTSWFSNPPPMPAEVGKAQADINIFTVASGLLYERFASIMILSVLRNTNSTVKFWFIENFLSPTFLEFIPHFAEEYNFQYELVTYKWPSWLRQQKEKQRIIWAYKILFLDVLFPMDLKKVIFVDADQIVRADLKELVDLDLHGAPYGYTPMGDDNTEMEGFRFWKSGYWHDFLRGRPYHISALYVIDLDRFRRMAAGDILRQHYQALSADPGSLANLDQDLPNNLQREVPIFSLPEDWLWCETWCSKDRLHRAKTIDLCQNPLTKEPKLSRARQIPEWEVYDAEIAGFTRRLAEEGAIQSRLAAADANALANSGGSTEDAKTMASSASEVETQVAKPGEYPIDTHFGHVAEEL

SEQ ID NO: 3742 - protein, 321 aa, Poeciliopsis prolifica
MFIFCSFLAVQVQKKPDKFNEELLSDGTEENDSGFWKSLARGFTGGGKAEEPKQEKDDVINIFSVASGHLYERFLRIMMLSVLKNTKTPVKFWFLKNYLSPTFKEFIPHMAKQYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKRTAKTIDLVTMFASNRSHKRALMVEESAIYFFL

SEQ ID NO: 3743 - protein, 1473 aa, Stachybotrys chartarum
MAFTALNRLQWGLILSLLAGSTANAAPSVNVGLEAAFPAGPYLLELLETAAQENSSAYFPLLDRISSGRFASVTTEADLYASFLDVLREDGHITRPESLSTFKLALSLRSAAPRVEAHYQYYSTAVDTTAGNDTSAACLDWVSLEGARYCTPSLDKAVSKQPKSSDVKQLPFDRVLGVGKEAVLYADPTSPEFGPFHQSLSEAARRGELSYRLRYRRVAHHPSAPLPVSGYGIELAMKRTDYIVIDDREASGDSSQKPLTSDVILDGEEEVADLKPLSSSELAPLGMKAASFILQSENPLQTLVKLTQDFPKFSVSLASHEVSEDFVKEYEETRFQGIPGGISYLWINGAQLTDRQIEPFALIELVRRERKLIDGVRNLGFNGKEAVSILGHQSLVKAQGSDDGVRYDWTDRSEDGGALVWLNDLEKDARYAKYPKDIFTLLQHGYPGQIPPIALNIFHLVAPIDFSSPEDLAFVGQYASLSQRGVPVRFGLVPLTSTPDAVDQAKVIYHLVQSYGPESLLRYLQAYFEGSHPAANKELFDAVVNTLELLPEAEARTFSEVLESDVYAKQVKHGQRWAKRLSADTPVRPLFINGQLVPRDKSWMQTLGMKIGEDLQRVQKALMMGEMDQKSSVPDMFLKNAAATRNTWIIPADGEEIQILDVNKIYSEHSELIEGIPVLEHFAESTKENWALFTVIADLATEHGQNLLLSALKFKRDDPGVRLDIIHNPANSQESSAINRELKINEAKLSEVETVDELKTLLDSPADALQEDGYAAALGGFLEYSKLLPGAQALLLNGRVVGPLPSDVVFSSENMQQLLEFERSTRILPVYAAMKDLGLDDKLSGPLAAAKVTSITALSTMSDLPEGIFDAAPSARTTLYTQWNSTHSAIEVGDAATASVHIAGLLDPASEQGQRWAPILKVLSELDGVYLKLFLNPKQKLEELPVKRFFRYVLDSKPTFDETGSIKPLQANFKGLPSEVLFTTAMDTPPAWLVAAKNSVHDLDNIKLSSVKGDVDAIYELEHILVEGHSREGEKGAPPRGTQLVLATEKDPILTDTIIMANLGYFQFKANPGFYNIQLKEGRSADIYTIESIGAKGYLPVPGDEGSDIAVMDFQGTTLYPRLRRKPNMEDVDVIDESGESEDDSLLAKGKKFAEGLWGSKSKSVSNEVHAEINIFSVASGHLYERMLNIMMVSVMRNTKHTVKFWFIEQFLSPSFKQSIPHLAAAYGFRYEMVTYKWPHWLRGQKEKQREIWGYKILFLDVLFPLSLDKVIFVDADQIVRTDMMDLVELDLEGAPYGFTPMCDSRTEMEGFRFWKQGYWANYLRGRPYHISALYVVDLRRFRHLAAGDRLRQQYHALSADPNSLANLDQDLPNHMQFQIPIRSLPQEWLWCETWCSDESLAAARTIDLCNNPQTKEPKLDRARRQVPEWTVYDEEIAAVLKRAGPTDEKAEPNTKSRRFEETKTADGSKDEL

SEQ ID NO: 3744 - protein, 1365 aa, Saccharomyces kudriavzevii
MRVVALVSILLCAPFCALAHSLRYGIPESVQIWSILVYLLRDLDGQLLSELYPLVTGLDDEIDIQENLLASTANALREQYDKEDVADLLELYASLYPMGMIQDDISFNTERASMSNNHFVLNGRKYEKPDDVFYLKSKDLISQQKITDINAMQPYDVVIGANPKAPILILYGCPTDDDPNFEEFNRNLFMEAMSEEGKIRFIWRPTCSLDGENLEYPLGFPLGITLQQGSNKSSIPQLKKILSTVPNEISVEMDHDEQLHDLKPEELRELDLKVTSLISKFYQDNEDILATLHFAKSLVNNFPLVSKELAEISSVNKDIIASNEQLNKKGFDYNMLGLYINGQNWKITSLDSYNLLNALKTEYQNLLKIATLLQKIEPSKGMLDAKSLLNKFSQFSLGNLQNSQPIKMDLHTIPGFSESVIYFNDIENDPQYNELVNNVQAFFDKSKFGELPEIKQNWSEIIFVIDFAHLEDSDVKEALNGLVRAVNVVSQGYPQRVGLLPFSSCGDKSVVNKIYELKSSINGLAELKTFLETSLLADGLIANTDTSNFKSVPDVHHLLDELQIDETSIIVNGEIYPFKKNTWNYLIAKVIKKDTEFIRKELSNSSPKKKQVSVRDLLHYKSANLRHNKYTPNYFADSLYSAVNNTALESIGPNRIMTYIKDEEYNLLHTVTLVDDFNSIYALTRLQNLLNTSFVGVRVRIIHVGGISSVWAQLNDSLSGTDPVNALDFLIDNLKSKSAKDNKYSKDKLNQLSLHKWLPDIPLFELEKGSFIVLNGRFIHLDQKEVPETKHFEAIVKREAIRTIDSVFALDLLFRDFSQERIDPDFIEMTSSILTKLFYQSTHIYGNGIEYTTESSLPRMDLNQFFEPNNLTMFEDARSAPIDLLLILDPLEERSQLLLSLVEQVKSLKFINFQVILMPTLELNIVPIRRVYVDDAEIVKVLIAEGDKMNSEVDIEMDGPNSFVIDNNYHLKKMLIELHVFSNETVLSAGNIDGVGGVCLELVDHAGNVIEETITMKTFGYGQFRTDRFLKDCLIRSCDSRYTVQSFSTDGHPGFIPSDSLNILSYNPYKIAVKIVENPSYEEEYKQGDGNETTINIFTILETGSKEEEKYVEMVLSILSKCPKSQRVKFFILDQPSISDAFRKSCEYINSLDEMRGDIVFLDYEWPQWLRPQRFSSRRRDVSKFLFLDVIFPKNISKILYMTPTKTPYDPFYLFQFQGLKRAPLGLFRMGGNGYWREGYWEKMLRENNLEFYSTEPGFLVNLERFRELNAGDKYRIHYQRISTDARSLVNIGQDLVNNVQIEVPIRSLKGSYKREMVIDYEFVAEWNKTINTFVSSLNDGKVPREGKSSENQDYDDCIPFHDEL

SEQ ID NO: 3745 - protein, 1490 aa, Brettanomyces bruxellensis
  MOD_RES (187)..(187): Any amino acid
  MOD_RES (396)..(396): Any amino acid
  MOD_RES (1059)..(1059): Any amino acid
MHFIHIIRWILTILLVACKAATTNNTIDISVAANWKAVPFKLIVLESIAQFNETLYEPLVEKLLGIKYEQSPDEDDEDMDVGDVSLVDSYLLSDQEFYRYGLSLINSDIFREIVNNTIANRYYSPSVEMHYQYFRNVVAKHKYCAKKDNTSYIVQNDHVYCDPTDVFALRTVSCNDENVGSHPLSVXHKMGNTGCPYFLYGDYRSEKFRETFFYLYQSMKAGKLSFVWRYIPDDAIISSELLAGYGIDLTLKRTDYIVVDDRDLAEGQKGKLNFDEKTITAPANISEDDEFWKESVSEIPKLSQDDIKQLGLKFTKFILDQNSKSDEQKLDLLTKLTFDFPLYASKIAGLNYSDHELHLFGLNVLRDEYAEIPNGFYINDEIVPSIKDDAYKLLAXLKNSVLQLDKLQSIGMDSRSANDILSKFSSFESALSKRPYLRYNYSDYENSIVYFNDIAHDHQYSKMVPSREAYSVEPQMGELPPARENIYDTIFFLDLSDPVRLYYTLSVINNILSKLVPERVGIVPLFTSKDGAILARKLFSIEDKFGSNDALRFLHKVNKYLAEDKLTDDVIAKLPGNSTFTSKKIEYAKNFMSAFKIDRLPQILVNGVFLPFNNDWQSSVQQLTLDVYYIFTQYQNGKIPLGLTFRDYLYKDAYKIRIPKLVPDNILSAGFDVIPAPNIDDYLKQHAAQDNNTLEIKSTKCTVKPCYKSQSLKTVTLIGDLANKEFRAQIIEMLQYIQRTKHIKLILADIGGHNYLSELKNESIDILIDKFSSDGIRATSKIIIPSILQSYSELGNAQLNSIFMVIDGRFLRISHSLLSQQDLDMVIQVDEKLRFKALSMIMKNKKNILELAKHKFNDKYNFYEYLIWTTSEIYFKNEDEFVYDALPRYDTNLLDDKLSIHIPAKEVPRVFVTMSIDPISEKAQKYLAMLDIFKAMPFADIVIHLHPKIEMENIGINRLYRGMFRPPVKFDDNGTFDENELQIIFDEVPEKPLFSLSVDEPQSWIVGIKEANADLDNIKLDISGPVVGVYEVENIIIEGYSRDVVSPSAKPIGLVLELXSSFNDKMQETSVMANFGYFQLKANPGEWSLRVKPETKGADIYDLVGVSLNSTSLDIGDGKISSFDFGVSNLGGLTLFPVFSKKSGKENDFIIGDHNIERKNNGSSNSYFSSFLSKLKNQVLSTKKAEEHKNADINIFSIASGHLYERLLEIMTASVMKHTEHSVKFWFIENYMSPKLKAELPLLANHYGFQYEFITYKWPVWLRHQREKQRIVWAYKMLFLDVLFPQSLDKVIFVDADQICRTDMKDLVDLDLEGAPYGFTPMCDSRKEMEGFRFWKKGYWKRLLGDKYKYHISALYVVDLDKFRSLAAGDILRQHYQELSKDPKSLSNLDQDLPNNLQDVLEIHSLPQNWLWCETWCSDESLKDARTIDLCNNPLTKESKLERARRQIPEWNDYDQEVANLVYHKNESHKEGETSNHKAEITNTNGHDEF

SEQ ID NO: 3746 - protein, 1492 aa, Aspergillus clavatus
MAIRSNIVASWRQCFVVVAALSCLARASPSVNVALQASFDSAPYLLELLETTAEENSTAYFPLLDRIAEGTFDDTTTEKELYDRFLQVVHDDGHLSTPELLSSFKLSLAIRSAAPRISAHYQFYNASVQHSLMAAQDAACPVWVHSEGKQYCSSSMERAQQDMSDEADSRELPFDRVLGDTSLPPAILYADIASPMFKDFHHTLTGLVKEGQVSYRVRYRPPQHWSSRPLFVSGYGVELALKRTDYIVIDDRDAEQRSQNTIASTEPSDGEDSPDDLRPLSSSEVSRLGINTASYVMDSDTPLDTLVKISQDFPKYSGKIAAYNTSTTLLQHIRASRLDLLPSGANVMWINGIQIDPRQIDAFSLLDHLRRERRSIDKFRSTGLSAQEAVDLLCHESLAETLAQDAPSRYNYQDEIEGGGVIIWMNDLEKDAKYQSWPSEVSAYLQPIYPGQLPAVRRDAHNIVVPVDLTNPEDMELIVKTIQVFVKKKIPVRFGLVPLASSPESIAQLKVAHYLQETYGLASLIQYLEEASDIQLSAAKNKIGSPDKACLQHATKDHDVRPNKQVLTLEEILKSDDFETLASRAAKYQSRLGIRGGGSHLLVNGVFIVRDEKWPQEMSMRVGRDLQTIQQGVMDGTIDDEMWLPQLFLSQAFDRRNPLIVPEDAKDIRIVDIAKLSESGKGLSEALVIASKAGNAIDSKHLIVVGDFDSAKGLQLLVTALEYQEKNGEVEVVLIHNPIPELETESGSALLYRSLKVNGRTDAAQVLADLKAADAPMSSENEAQEMAQFWEAQQLLAGELGFSPGANGIVINGRAVGPLLDDSTLSVEDLGQLLAYEQRTRVGPVADAAKDLGFESRLSSPLALAKLTSLTALSTVSDVPEGIFETTSNVRTDLFKKWNDSRSVITVSNSDDPAITIVVSIDPTSETAQRWLPILKVLSELASVRVRLSLNPRDEIQELPIKRFYRYVLDSEPSFSDDGSLARPTATFSGVPMEALLTLGMDVPSPWLVAPKESIYDLDNIKLSTLKPGSNVDAIYALEHILIEGHSRDLTTKTAPQGVQLVLGTDDNPHFADTIIMANLGYFQFKAQPGLWKINLKPGRSQTIFNLDSVGGQGYSPQPGDENNEVSLLSFQGKTLFPSLSRKKGQEMEDVLETGAKPGSAMDYVSKGFNFAQGVLSSVGVGSKHGSEKQADINIFSVASGHLYERMLNIMMVSVMRNTKHSVKFWFIEQFLSPSFKSFLPHLAEQYGFSYEMVTYKWPHWLRAQREKQREIWGYKILFLDVLFPLSLDKVIFVDADQIVRTDLYDLVSLDLEGAPYGFTPMCDSREEMEGFRFWKQGYWKNFLRGLPYHISALYVVDLNRFRALAAGDRLRGQYQMLSADPNSLSNLDQDLPNHMQHHIPIKSLPQEWLWCETWCSDESLGVARTIDLCNNPQTKEPKLDRARRQVPEWTEYDDEIATLAKKLAEEQQQREEEKRSDDREEQESDWIKDEL

SEQ ID NO: 3747 - protein, 1350 aa, Zygosaccharomyces rouxii
MKSITAGLAFLAVLECVICLSVTLQGAGVSERFKIWTIAQHLFQSDKKGTLTKVYPLITQLDEELEDTPIESLCEAVSYRLSELGEPDMASMMPLYCQWYPMGLPFTSNYDHSNSGTYFVLNGKRYDHSDDVFYLKSSELKKQAQVPDQAVIAVNDVVIGHNSEAPIVYFYGCPDDEESTFEEFNRNLYSEATETGKLRYIWRSTCHVERDTKLGPFPVELSLRDDKSDINVLPIECLGIPHQFDKSKYGLINPTAKKLSDLDLKVANLIAQKYNLSKDFNSTLDYARGIINNFPLLVPELITMKNNTEAIMKSNTNLTESGVDHKLLGLYINGENYRFSSLDQYTLLNALESEYRRLKQLLSGLMKMYSKSTLITAKDLITRFSQISIPNLQQSQPIKVDLHRIRGFSESVIYFNDIEIDNQYQELTQDINKFFEKSKFGEIPEYRHNWNELIFVIDFNKLEDQNTQLALEGLKRAIGVVTQGYPQRIGLLPLNTGDSDNIIRKIYELKDGDLLELEDFLGNELVSGSKITSDYADTPDVAKLLRNLQINETSIIINGEIYPFRKNTWHYLIAKTIKKDVGYLKRELKRYIKRDGDKVQPVIDVRGVLHLKSSETRHMKYTPDYFADSTYTTLDNSALQVWDERILEYVKGKEYNILHTITLVDDFNTLQALKRLHNLIGMKFVGVKFRLLHSGAFGSNWKILKKITSKPSFLQELKSLIKQSNRSSPINQLNPNVLQNWLPDLKPEFLSAKSFMLINGRFIHFEENEIPQIKLFETTIKREAQRTIDALEALETILPGITSNKIDPEFIETTSAVLTKMFYQGTELYGNGPVFTTESTLSRFDMTEILLVNNFTIFESISNEDKPIDLVLVIDPLEERSQRLLSLIKDVQYLPFLNVKIVIYPTTDLKFMPIDRIYVPNFPDEVSSKLDDIESKFDVTVEVPHNFVLNDHQNVRGYLVEVHAFDRKQPVSEGIIDGLGDVCLELVDGSGKSIDKTITMTTFGYGQFIVPELGSNFSICSCDPRYKVISFSSDARADYMPVKSINVTSLNPVVTYVKLEKVDEVAKIAVEDSIINIFTIPRNEHSFEQEYQKMVLHILNSPQGDYMGVRFWLLDQPFISHSLRKFIDAINLDTKLDGSIELVKYEWPPWLRPQRFLERRMDAYKVLFLDVLFPQSVSRIIYMDPSISQLPDPFKLNEKVRTKLPFAMYKMVGHGYWETRYWAQRLGDRNLKFHSVHPAFVINLQNLRAYYGGNKLRIHYQRLSADVLSLGKIDQDLINDAQEEVPIRTLSSSTIVFLNVKNQDSVDAWLKNFEEIAVNSETATTTSTSANPENAQENAKETQDFMHDEL

SEQ ID NO: 3748 - protein, 1459 aa, Lichtheimia corymbifera
MQAVVLCLFASLYAFTACAHSVELTLTAPWSSPPLTVEFIETVAGNNDTLYFSLVNDYVHQPVTDLNTPEAVYKDAVARAQQHTGSKRAVSIAKASFAIHAAAPRVEAYHQHYREQYGDSDIPCDTWVLQDLKTPVVCHPSDLIEKVVGLSYRPDLLLPFDHIMMTHQDVHHVAILYTTDITSSTFADFHRILSKAVHERPHFAYIIRYKPVSNVSHHQAIAGYGVELALKKTDYLVIDDRENKETSVKGKLASIGKKISQTLFEDTPSKIEPLSKDEIKELGLKATQFVQNAKDPMSTLVQLSQDFPRYAKSVSGLTLQKPLVEEVIHNQGLLRESGLNAFWLNGRPIEPEDLDPFSLVRTLKTEQELIEIFERIGFTAEQAISVMTDPALAKMESSTSAREPTDYFDVRSELVIWLNNLEKDKRYKSWSKNMMDMLKPVYPGQLRAIGRNIYNLVMVEDLASQDALTRMTQQVVDMIKRNTPIRFGVLPVVAKADSPTTAAAIAFSHIQQNKSRLDSLAFLNNVLAQLNEAKAQHASMDMIKKAFDEVEQDLSLQSLLEERQAFIEDTQRLLARLCVTSQDSVMFLNGKLIEYNNEQVIARDVYFGDLDQDEDVYNHIMSKPYVSASRNPYIVVSEHRPLVMLPLQTGEQDIHYIYDPTAVNTNLWVIADFDTVPGLKLASEALGFLETDNSVRLALIHNPSGKATLNDISTVLYREMLQGNKDFRELIDTAIATKDESLSETPEQVKVFAPGSPAVESFANEAVHRQSRVLEGLGLSDGFQGIVINGRVIGPFEESVTFTKEDFGSLLRFENDKRIQPVHAAVQNMTFDRPIADILTIVATLIELDKGSVKQDAFESPRPTIRERPYQELQGNHVKITLGDRAGAFVQLGVILDPVSETAQKWSSIIETLAGMDGIYAEVYLNPKASLDEIPLKRFYRYVFDREVMFDPATGAPTTPAAYFADPPADALYTLGMDIVKSWHVTVREANVDLDNIQLDDATSVYTMYELEYILVEGHCVDSVTRGPPRGLQFVLGTQTKPAMTDTIVMANLGYFQLKARPGVWQLALREGRSTEVYHIESVGTQGKWQTSKDGSDAHKELALTSFEGLTVYPQVRKNAGMENEDVLTEPSNSKDEGGFWSSITDKLFTKKQGAAVQSKQQADINIFSVASGHLYERFMSIMIASVMEHTNSTVKFWFIENFLSPTFKDFIPHMAQEYGFDYEMVTYKWPSWLRAQKEKQRTIWGYKILFLDVLFPLDLDKVIFVDADQVVRTDMKELVDLDLHGAPYGYTPFCKDRTEMDGFRFWNQGYWRDHLRGKPYHISALYVIDLVRFRQLAAGDRLRAQYQQLSADPNSLANLDQDLPNNMQHIVPIHSLPQEWLWCETWCSDESLSKAKTIDLCNNPLTKEPKLDRARRQLPEWEVYDQQVEALRDRIHAGKQVKDEGHVESNSKPEHAEL

SEQ ID NO: 3749 - protein, 1553 aa, Stylophora pistillata
MAAKKSLSSAGAICALMATLLTVLSLFHQSLCKSSSSKSIIASLDARWGSTPLLLEASEYLAADSNEKFWKFVDSCQDKSFDHDLDEYEHVLTTAEQLLAPIGLNFLQFSLSLRYYSPRVELFNKVAHDLPAPDCEAFVQLGSSTICDVSEAVSLIKQAENIPLVQSFEFDHHYPKSENNSIAVVLYGKIGSGSIWRFHQQLVNLAENGQVHYVLRHYIESSSKRKMRLSGFGVELAVKKTEYKAMDDSKVKDDAEGKVQKQEEEDDDEVEGFLFGKLRRLYPDLKENLEQFRAHLKESAHEMAPLKVWQLQDLSFQAAHRVMSSEPQRALKVLRDISQNLPMQTRSLVKTRVKEEMRKEIQLNQKHFAQFGLDPGDSALLINGLLVQADDLDPFQLLDLLRGEALAIDRLSSLGIKGEALGKLVSLATQPEHESFVLDARHDSIVFINDLEKDRQYWGWPSEIQEILRPTFPGMMRYIAKNIFNLVLFVNPLDVQSIELIKVVNELLQNSFPVRIGLSLVADVPLDAEVDAKTNAAVGIARAFSFITSEKDSRQAFDWLLQLYHNLAEGEVPTADKLFTSFTSLFGNDDAEELFGVESEYDEDRKSSQRFFDKTGFHQLPQVVLNGVPINTEEFDNLDEAVVREVMLQTGPIQHAVFSGSVYRYSSVYEYLMSQPNVVPRVNSMVQSMERPYVDLTGGQLSTDVDINNPEAFAMLDSSQMTSVIAKELKYLTKQGEDLSLKPVTNWVIADLASKEGRVLVRAALQQLKSSSSARVGLIHNPAVKQTDDLPESLQIARTVEAVLSSKSHVTPAMLKFMESLLDESNDFDKLSSDSKAMADLMAKNPGLKVEAIQAKLSDGKAFKGKLLSHQHFCTGVVNLRPGQPAVITNGRVLGPLAGNTLFTEDDFKLLENFDMDLYARKVRDQVDEMAFDGLPADDDTSEFRSDIIMKVSSALICREKRSRQEITAKASEHSVMKIKPKREGASFDVVAVLDPLSQAAQKISPILMVLQNVTNVNFKLAMNSREKLSELPINRFYRYVLEPEVSFNDDGTIAEGPAAVFSEMPQSVLLTMHMDTPLGWMVEAVYSPYDLDNIKLQEVENQVQAKFDLEYIFIEGHCSDFHTRQPPRGLQFTLGTSRDPAMFDTIVMANLGYFQLKAYPGAWSLRVREGRSAEIYEIESVSGSTKEDDGHFTVVIDSFIGKLLKVKVRRKPGMEGKDLLSDSDSASSGGIWDSLSSMVGSESTGDSPKDETINVFSVASGHLYERFLRIMMLTVMKNTKNPVKFWFLKNFLSPTMTAFLPHMAKEYGFQYELVQYHWPHWLHAQTEKQRVIWGYKILFLDVLFPLHVKKIIFVDADLIVRADLKELNEMNLRGAPYAYTPFCSSRKEMDGFRFWNVGYWRSHLGGKPYHISALYVVDLDRLRRLAAGDRLRGQYQGLSQDPNSLSNLDQDLPNNMIHQVPIKSLPQEWLWCETWCDDESLSTAKAIDLCNNPLTKEPKLQGAVRIVKEWPDLDNEVRRLQERVAAQTPSSKDTQESTRPTDLPPVKVKIEL

SEQ ID NO: 3750 - protein, 1634 aa, Dictyostelium purpureum
MIKKISFLILLLILFINISSIRGDENEATTSFDSKLIQLSLVSNWGDTPNYIEASEFFSKQDKLLFWKFIEEFNKKSIENKSNITDKINYDLTINTAKEILLPSTKYLIEFLNVELSMRTYSPIVETFRQLSLSQKNFNEKGWVQVKGKSISDASEINDQFLLSLSQNSKSQDGADLNEEKDEELKIFDFDHIYPISSGISAIDNTPIVIMYADIKSEFFQLVHPKLKQFSKMGKIIYCYRYIIKESSQKFNLQGYGYELSIKNLEYKVMDDSAIKKDIITDSGKSKTVISIPNEDVSGFNFHKLQKRKPDLTSKLSTFRSYLLAKSQEAKELKVWELKDLGIQSAQKIISSNDPFRTLKTISQKLPTISSYISKTAVNETLKKQIEANQKSIPVTETILLLNGRSVNVDDLNPFDLTNIIQQEYESASTIQSVGPISLETVNQIIAQSSDVTPIRIKFYPNNEEEAQAVGKHIIFPLNSLEMDYTYNSWENSLNSLSKESTEPTDIFFRKNLLTTVIVLDWNELNTLSILPELQSMIQSNIPTRFAIVFNTNKNSVRARYLRENGYVSGEEIAKVFLGFKNSNIGNRGAIFFINALNYFKKAYTPSEDGVTRSVLQSAFNAVINQMHSNFRSLNQGLQSDEYNNLLKASNLFIERMSLNSFPQVFLNGIPIEFTSPEQFSSQLLVSLYDEFERLKPLYKQGIIVDTPNSYASSFQLYKTITLDTDYWSENNIPTLEKYSPILFSSNYSYFITNSKNQLKEVEAQNVLKKQLFFIQDKEIDTEEDPEKEKTVTIEVVGDFDQYNTREVSLYLLKEISSSESYKNARAAFISNPSNQETLTSSSQNTLGKLVSILKHYKKEVTNDIMIKLFEDIQSDVAKYDSIKTLKELIESYKLPIPLSDIWVSQADNLFKQAAKTSREYLNLQSTNKLPVSILVNGKIITPPQYENVESFFKDFNLALFMESKKANDILNLLKEDSLLTGKSINYSDLINKISSLIGYHYKGSSIIRKRIPSSISTSFTYSPSNNNAAASSPLKFFLVINPFNKVSQKLIPMIQEFSNKLNIAVDVVLNPPVSVSEMPLKTFYTYVIKLDNEFSEETGQLINQPLGVTSNIPEDRVLTLALDAPSSWLVQPIIAKYDLDNIRLKDLGEEQVLYAVFELENIVIEGSCNDVSTDAAPAGLEILLNPVATQNKVTQDTIVMNNYGYYQLKSNPGIWKLTLAKGRSSDIMNIVEANGEMVPYHTVVIDSLFQPQSSLYVQRKQGQERTPILQPIQEYEKQKAEEVKNKENDSNGFFSNLFNKNDDSKKQVANKKNLDTIHIFSVASGHLYERFLKIMMLSVTKNTESPVKFWFLKNYLSPGFKEFIPQMAKEYGFEYELVTYKWPWWLRKQTEKQRIIWSYKILFLDVLFPLNVPKIIFVDADQVVRTDMKELWDMDLRGASLGYTPFCDSNKDTEGFRFWKQGYWRSHLGDRPYHISALYVVDLVRFRRLAAGDQLRATYDQLSKDPNSLANLDQDLPNYLQHYVRIHSLPQEWLWCETWCSQESKAKAKTIDLCNNPLTKTPKLENAVRIIDEWTSLDNEAKEFESKIEKLKEKEVANHHNEDDHSNLINNYAQNENVENILSKLDDAQKDFF

SEQ ID NO: 3751 - protein, 1233 aa, Monodon monoceros
AGDVVRLLLGSTALWLSLLGARTASASKAVTANLAAKWPETPLLLEARPRPYLYKGDHKFPANKENLPVIILYAEMGTRAFRKFHTVLSEKAQNGEILYVLRHYVQHLQDRFEIQPGDAGLYINGLHVDMDSYDPFNLLDMLKLEGKVMNGLRNLGIKEEHMSKFLKLSSPDWDDTYALDIRHSSIMVLFIDPAQEYTVDFIKLAELFFYHKIPLRIGFVFIVNTDDEVDGKNDAGVALWRAFNYIAEEHDVSQAFISIVHMYQKVENHNILTVDNVKGVLQNEFPHANIWDILGIYSKYDGERKAGASYYRMTGLGPLPQALYNGESFHHEELNIRELETAVLHRMMDETAYLQKEVFMGTLNDRTNAIDFLMDRNNVVPRINPLILYNKWQYLNLISTSVTADVEDSSTFFFLDSQDKSAVIAENMYYVTQEDDVISSVTFWIIADFDKPSGRKLLFNALNHLEISVHGRLGVIYNPTSKIDEDNTAISRGILAAFLTLENSFLRNFLRKLAEEETATAIYSGDKIKRFLTEGMNKNAFEKKYNTIGVNIFRTHQLFCQDVLKLRPGEIGVVSNGKKIYNNITAFKFLGPLDEDFCAEDFYLLEKITLTNLVEKIEDIVENTEVNSKNLSDLVMKIDALLSSLPKHASRYDVTFLEENHSIIKINSQENDMSFDVIAIVDPLTREAQKMAQLLIVLGKIINMKIKLFMNCRGKLSEAPLKSFYRFVLEPELTLPPNDVTGPVAKFLDIPESPLLTLNMITPESWLVETVHSNCDLDNIHLKDIEKTVTAEYELEYLLLEGHCFDIITEEPPWGLQFTLGTKNKPVVVDTIVMANLGYFQLKANPGAWILKLRQGKSEDIYQIVGHEETDSQPDLGEVVVVLNSFKSKILEVQVQKKPDKIQEDILSDKDEKKGVWDSIKSFTRSLHKKEDNKETDVLNIFSVASGHLYERFLRIMMLSVLRNTKTPVKFWFLKNYLSPTFKEVIPHMAEEYGFQYELVQYRWPRWLHQQTEKQRIIWGYKILFLDVLFPLAVDKIIFVDADQVVRHDLKELRDFDLDGAPYGYTPFCDSRTEMDGYRFWKTGYWASHLLRRKYHISALYVVDLKKFRRIAAGDRLRGQYQTLSQDPNSLSNLDQDLPNNMIYQVAIKSLPQDWLWCETWCDDESKQRAKTIDLCNNPKTKEPKLKAAARIVPEWVEYDTEIRQLLDHLENKKKNATCVKQEPSVTSVADYV

SEQ ID NO: 3752 - protein, 1344 aa, Ogataea parapolymorpha
MKALGIVFILNLWLLTLAEYVNLQMVGSWNQTSFKLNVLETFSAHNESLYLPLTLKLIGITHNEDEVELEDITLSDEDYFKYACSLVNTDDLGFVETDLALRTYSPRIVAHFQESDSLQCDGAWLKQENNVYCMPDDVFALKTASEGHVEPLEAFDRVIGNRENVFILYGDYESEKFRHFFANLYESAISGKLGFAWRYTPREEIEKEVLAGYGVDLTLKRTDYIAIDDRGFTEEQQAKLKFEPGQETVVPVDDFIDRHMDDIPKLSQDHMKGLVGKLVSYIAEKGSDLRLFRKIMLDFPKYASYISLRREPEEIAVESPNVPAGMYINGVPATEKFLSVFEILKRLKQEKLIVDNLSSVGVDKNEVKTLLYRFANESIVAAAHLPRYQTTDHPGIIYFNDLENDPQYADLQNPRLAYKSEWSGRKIPPARENIHDLVFAINPTDPLQLQYSLMMINAILKNLISQRVGLVPLVRTEEDQVVTEQLVKIHRTSGPIEALRYLILVHEVINSPGVSFDTLKQVDVPDKDELLRNLDSFKNQFALQSQPHVIINGIFIEFNQNWQYAMSEQITADILYLNSEQRQRRIPREVTLKDYLRQGALARRDPLLIPETLDRLRSSYVPAPTYETYKLLKNFGGDDKIVLNAVGKLSSRKFRSQVAEALKSGITLRIIDVSNSPEVETLTKSLDDVESALVYLDGEFASKPTDNSALSVISECFGVDDFADDDEVYLILNGRLIDLHDREPVKAVDLQILLNREKSVRLNLLDEDTQDFEYKSWVVTSSFYNDDGDFIISGLLPRYDFSRSSSFIEQGTGYVDVDSVIDPLSEQTQSILALSEVFEKFDFVRSRIWIKPSEKDELKIKRLYRGVFPTSVKFYENGTEKRDYSAFFDDIPEKTLFTADVDVIPSWIVSIKEANTDLDNIKLDISGSVDGVYELRSILIQGHAREGIDTIAPLGLGLQLLDSNGASVSDTNVMANLGYFQLKANPGLWTLSTKKIIPDVEFEIDAVDTKYKTRISHSRPEKIPILDLTGAMVYPIVSRKKPSNSLFSGLSKSFSSLFKPKQAEINIFTVASGHLYERFLGIMTASVMAHTKHTVKFWLIENYMSPKLKKHLPLLAKHYGFDYELVTYKWPTWLRGQREKQRTIWGYKILFLDVLFPQDLEKVIFVDSDQIVRTDMKELVDMDLKGAVYGFTPMCDSRKEMEGFRFWKQGYWKTLLGDNLKYHISALYVVDLKKFRQIAAGDRLRQHYQSLSADPNSLSNLDQDLPNNLQHTIPIYSLPQEWLWCETWCDDESLKKAKTIDLCNNPLTKEPKLDRARRQIPEWTKYDQEIETIIRGSPVTHDEL

SEQ ID NO: 3753 - protein, 1241 aa, Protomyces lactucaedebilis
MRLIEGCLLLGLGITVDAYQLRASLKGPSGFSPPSLPAEYVETLYHVNRQAYCDLLKDLSTSPVINDKPEAQLANLLKRSHLTDQERGLVKLSLALHEYAPAATFNGTLHNCTANPQRVVYTDFTTPFVYDAETQVGHLPPGAAQEPLTMTGYGAHLALKRTDYLVIDDSNKMSDASDDHKVVPLTKEQIKRIGLRAAARVVRSDNPLDELEDVSQNFPMRAQGLLKSSISKELEQEMKGLRELVRGDVFLINGREVETSPEKLMPALRAEAALASAMHKLGLNLTQIVHLLTLDVVGVDHVDRFEVRNPVVVYLNDLEKDDMYEGWRTDVNIFMEPLMAGQLHQIRRNFHTGVAYIDLTDEMHVDLLTNWMMLITRGIPIRWGFVPAGETELQRNLGNAFREIFKHGGLEQAYEFIAGYTRGGDLEGTYAMFQKKLKGKSLADLADLGSSEYDEFAKDWIERFGKDRIYINGQAVVRDEALMQRLSAAVRDDTMFVQERMIEGGVEDSGDLQDIFLDGAQLRFSEALFGERKYITLHEYQAQPNAGKCSRDTEIVFSGEGWPDLSKMEELAEKPCLSHVDGPRRMIVNGRIFEKLSFLEMPTMMAQEQREVIKYKDAAASVGASWSVALLTLIRTSKRLLRTSLPPFVSTDLSHFEVGREQSSTLEIKVFLDPLSENAQRWSTIIKSLSNLPNVFIKVHMIPKSGLTELPLKRFYRYLMPAEPSFAPVHVDFSGMPSDLMVFTLEPWNSWVIAPVSAIEDLDNLHLGDRSIDAVFEVTHILVQGHAREANTTNPPRGAQLVLSSGDGVSQAETIIMANLGYFQLKAMPGSWQLALKEGKSDEIFELQSSVRTVHVDSWAPSTLYVRLARKPGMEKADVLDDKQTAGKGSLWSKVSNMGKKDTALVKKHADINIFTVASGHLYERFVYIMVSSVMAHTDKSVKFWFISNFLSPQFRKFIPHLAERLGFEYEMITFTWPHWLRKQTEKQRIIWGYKILFLDVMFPLDLEKVIFVDADQIVRTDMIELVNEDLKGKVWGYTPMCDSRKEIEGFRFWKQGYWKSFLRGKPYHISALYVIDLVAFRAQATGDRLRQQYHALSADPESLSNLDQDLPNHLQAQIPIHSLKQDWLWCETWCSDESLATAKTIDLCQNPMTKEPKLDRARRQLPEWNEYDRKVKGFAKLVAEREAAGGQEGDDSMGSITVDVDAVGQNLEMKKDQLGDEAMTGSDGGEKATRKGHDEL

SEQ ID NO: 3754 - protein, 1657 aa, Phytophthora parasitica
MRPTTWLSAGLAALLAAAQPSLTSARGVHVNLTASWPSSPFFPLMETSEFLAEENPLYFWQFLEELETRTAYVEFMGNDVDALGTLAVTVAESIAAGSKNVLELMLATRTYSVQVEMFRQLGLDSGVRPCGEDADTWAVFYNEPHCVESVACSVDELEAILRGKKKQQNKDQTCVAAGVNDIELQVDHKYPFIASDSEKTPMSAILYGLVGTEKFHAFHKKLVKQAQNNNIQYMVRHYPRDSPLDTLLQGYGVALDIKNMEYKTIDDSKKTGGDDTANDEEGAEEEDEEEEEIDDEEVDGFLFKPLMARHGAIADDLKQFYDILVKKADGEQEQELKAWHLKDLGASAVRAIVDAKNPLKRLETLSQDFPVQAKKLAFSRKSISTELREEIALTRMQAANRRLKNKFIMNGIAVDPTERSFNVFDFMKTLKEEWSVAKQLGGLPLNQSELEDMLKHVRETNQEQPVVRIHVHGSMGGSTPLYLNNIETDPNSADWSPDLNILRRPAWNLIFVRKNMYECVLVMDPLTGAGRAALSHIGFMRMRGAPVQWALLVSSKELMTSKTSDERQAVVEKYKAFKTTDKASPWHFAKLLMLAQSKDNAEAAVKDDETNNSQSGDEETTEVEKEENRITPTRVASGFLQRVGEDGSSDVLVERLVEAYAEAAGGVGTVEDNEEEALECLNSDQFDDEILAMTEFIHLKHLPLDSFVFNGVVQKDLDIQRSMMANFGRDQPLYVNMAHRGMLNGEMDLIEELLAEQDAYPAYLSIFESSEGRPGDMEVKTPSHLVADDVDGRLEAAARPAVSYLHAPGSRALPKKQTVIFPVDLNDPRDAGHAYRVVKAVLEDSEQSLRVGVVAQLNDSDRNTVGELAAAIIAAIGHSDNEVHLKFVLEALNCIVKQKSVNTMKDKLRGIWNKTSKSENDKDPIYEKVLKLLSSKTGKWLTTKQRGVLTQFNTLLRSRFPPSYAHESEEDSSKIALPHLFINGRQVVLPPQSLSDEDVATIVNFDLKYRTQPVAKALIKRSATLKARDADKLSFAIMKTTGIVDKYVKTDRTPQMNVEENSLNTVRLPGDPSLQVAAYVDPLSESAQVMSSLLRMLHSQLNATIELVLVPADEYTEFPLQRFYRYLFDKKSSLAATSVEFRKLPVQPILTMKIDTPEAWNVQAFHAGDDLDNLRVDPDSPAAAKSTTSAVFQLESLLVYGQCRDTTFNMYSPPNGLQLVLEREVGAQLLHRDTLVMKNLGYFQLQATPGVWSLHLARGRAAELYDIIDLDTELPLETHPITVYDFGSHISQLYVRKKEGMEHEELLQSVEDAASEKSKSESSASEDDGALRSYWSSMLNMMGKQDDKKIQDAVTEAEQADNDSAVVQHKERTGETIHVFSVASGYLYERFVKIMMSSVLKRTNNPVTFWLLENFLSPDFKKSIPVLREELGMDIRLVTYKWPNWLRQQTEKQRIIWGYKILFLDVLFPLGVQKIIYVDADQVVRADLKELWELDLQGKPYGYTPFCDSRNVGFQFWRQGYWKDHLRGKPYHISALYVVDLALFRQMAAGDMLRAVYSQLSADPNSLANLDQDLPNYAQHQIPIFSLPQEWLWCESWCSDDTKVAAKTIDLCNNPKHKEPKLDMAKRVIAGELFNESWIELDQEIKDAEAKYAAQAA

SEQ ID NO: 3755 - protein, 1520 aa, Loa loa
MESLWLIILLALPYVTNSTISKKSVITSLHAKWPQTPFIAEASEFMAHESDSLFWAYIDEIVEKLNVDEWHTYSDAKQYDLTVRLAGYLLQEARVNLLKFALSLRAHSPAVLLFQRLGAEKKKSCAAFADIHGILTCDVNDLEKVIENDMKGPAPTVYSIDHVFPATKEHNVTLIIYGELGSASWRKFHLAAKALSRGGKARYVLRHFVKDVRDDKLLLSGYGVELAIKSTEYKAVDDSNTVTDKMVVEESSEEYIDNEEDNCGFNFNILRRLHHDLKESIEQFRLHLLERDELTPLKVWQVQELSYQTAQRIVQAGPQKAINIMTDSSQNFPLSARSLSRQIVRKEFISEVSANQEQLMEYGISEGESIFLINGIMVDIDALDVFQVLDLLKQEEKLANGFFRMGIKNEYLSMLMDLELSNERLSYALDFRSASPEYLNNLDTDKQYRQWANSVGLLLQPYFPGMLRPIARNLFTLIFVVDPSQKETRDLLHYALRFYAHEIPVRLGVVFVTNDEKETSGFDDASVAMLNLYNFIKMNNGIQKALDVLTEVLNVKEESVSPKDVLSYFQIKYPNHDPNDVFGSDSDYNNGRSTGYKFLRDSGLGLTPKVLLNGIVLDDSGITADHFEETVMMEIMRVTSRLQKAVMEKKLKDQDNVMNWILSQPEVMPRINKLILDSPLSPNALYLDLTSAKKCTNVSPAQYYKLPSEEQNQCMLKGMRYITRTEEMKTHFSTVWVVTDLETVEGRLLAYNAVRHLKRSYTMRVAIINNPKDIKAATTSGSITMLVNIASRLLVPRQMKSFVTKLVKEEIVSKLLNKQITLDDLAVNDMNMTFFYKESKQINSDEIVADARYSKDILGLKPGQLALVVNGLLIGPLSDGEVLDVADMELIDKLILLRGGKVIGDYMEKWKIQTRHGESSDMVARSMALIGSGVAKKRRSIALSREKESVVTIYGNNEEGIILVLCIVDPLSTQAQRLGHLLTVIQKVVNVEVKLVMNPRAKLSELPLKRFYRLVLQPTVMFDDSGRIDIAAYEARFTALPNKQLLTLAVVPPDAWMVQSVYAIYDLDNIRLENVAGNVLAKFELEHILLEGHCFDDITGSPPRGLQFTLGTLTNPSRYDTIVMANLGYFQLKADPGAWILNLRDGKSKDIYNIVSHVNTELEDETGVNVLIDSFSGRTIRIRVAKKKGREKENLLSEKSEGESEDYLSVWSSISTTSKSGGEKYDAINIFSLASGHLYERFLRIMILSVMKHTKHPVNFWLLKNYLSPNFKETLPQMAKHYGFKYEFIEYRWPRWLHQQTEKQRVMWGYKILFLDVLFPLSVRKIIFVDADQIVRTDLMELMELDLGGAPYGFTPFCDSRTSMDGFRFWKKGYWANHLAGRKYHISALYVIDLVKFRQVAAGDRLRGQYQGLSADPNSLSNLDQDLPNNMIHQVRIKSLPQEWLWCETWCDDASKEKAKTIDLCNNPQTKEPKLDSAMRIIPEWKDYDAEIKVLLDERSKKYAEERKSGHKAIDEHTEL

SEQ ID NO: 3756 - protein, 861 aa, Diploscapter pachys
MEKTALGKAPKVLLNGYVLDDSGIKSDKIEETIMYEVMKISPTIQRAVMEGRLKDRSNVANWLMEQKDVMPRLNARVLDAPTTKNYLDLTASTPCKASTLTQFGTLTAPQKSQCILEWAKYLQKSEEDITAASTLWVAGDAETAEGRDLFYSALKNLKHSKSTRVTFVMNPADEAQACKPNSITNLIHAAFRLLPRNQAKQFVTKLVKEENVKSFEESKLNIEDLAVGGMNVERFNKEKKQLNCDRIKMEAKFAQDILKLKPSERAIVANGLIVGPLSAEERFIETDFALLDKMLEARGAAQVATHVDKWEIEKNEEKASDMVLRSMALVGKHAVSKKRTWIDLQGDGHSVVKIFADDASKAIIDVATVVDPLSTAAQKVAPILELIGQTVNCDLRIVMNPKGKLSELPLKRFYRYVASPQLQFDQTGSVVASSARFSNLPSKQLLTLSVHAPDAWMIEAVYAEYDLDNIKMQQANPGSWLLRLREGKSKEIYKISNHFNSERTEGEAIRVLIDSFSGRTIRVRVVKNEGMEERSLLSDENEEGIWNSISQTLTREKPEKINVFSLASGHLYERFMRIMILSVMKKTKSPVKFWLLKNYLSPQFKKTLPLMAKEYGFEYALVEYKWPRWLHQQKEKHRVMWGYKILFLDVLFPLDVQKIIFVDADQVVRADLMELMELDLGGAPYGQAAIYFVNFKNSYVPFCESRKEMDGFRFWKQGYWANHLAGRRYHISALYVIDLHKFRQIAAGDRLRGQYQGLSSDPNSLSNLDQDLPNNMIHQVKIKSLPQEWLWCETWCDDTSKSSAKTIDLCNNPMTKEPKLDSAIRIIPEWREYDEEIKKVIASQLSSSEKKQSQEQGHPEL

SEQ ID NO: 3757 - protein, 1495 aa, Chaetothyriales sp.
MPASAFPSRLARLGLLACTLLFGSAQTASSVNVALRASFNSGPLLVELLETAAAENASSYFPLLDRIADGAFAESSTDKELYDQFVHVLREEGHVQSPEDLSSFKLAFSLHASAPRVQAHFQYYNRTISPHLPAAQDAACPVWVQLDRQQYCTPTLERSQQSLSLDEAEEVLPFDRVLGPNHGVPSSILYADISNPLFPEFHKVISASAKAGESSYRLRYRRSPGEHKPLYLSGYGAELSLKRTDYIVIDDRDAPKSEDLNQAALKEPSDAEELEIKPLTTSELANLGLNAASYIASSQDPLQALVQVTANFPKYSFFLAGQNASTHFLNEHQANRKLLLPAGYNILWINGLQIEPRQVNAYSLLDHLRRERKLIEEMKTIGLTATEAVSLLSSDVIAQAQADEVIQRYDWRDESEGGNVIIWLNDLEKDKRYAKWPTYLAGLFQRSRPGQLPPVARDIHNLIVPFDVENIKDIELVVKHLQSLIKGQVPIRIGLIPSGPTQTAETYARLSHYLVDTYGLSSLIAFYDDLVKSKKVSSNAEKHLATATKDAELREGKQALTYNEILQSEALGEYVSRAKEYLDRLELRTDDPHFIVNGVVLPRGETWFELLSSRVFLDLQQIQQAVYQDALQEDTWVPHFFLFQAIARRNSWIVPSDSKDVKIVDVPALTSAHPDAFAQLPKSDGEDATLLSDRAHLLLVADLDSPDGRELLASALGFKAARSEVELLILHNGGDSTIPGLSEHFKDFWVAYKEQAKDLTAEDLHRLIQQHANISTGHDAIKSAAAKLWEHGKGLVRDLGLEAGQNALWLNGRLIGALPRLFTLPDLLSLLDFERSSRIAPVTTAITALGLEERFTNALDLAKITSTVARSHKSELPEGLRDAAPLIRIDRFKAWNETYTVIKKEPAADPLVQVVAVVDPVSEVGQSWVPILNTLSELDGVNTKIFLNPKSSLSELPVKRFYRQVLSSAPTFHQDGSLQAPGAAFTNVPLETLFNLGMVVPPSWLVSPEEANADPDNIKFNVAGNDADVDVLYKLDHILIEGHARDVTAGPPPRGVQLLLGTTEQAHVTDTIIMANLGYFQFKANPGFWKISLKPGRSSKIFNIDSIGPNGYSAQPGDATSSVAVLSFDGLTLFPRLSRKPGMEYEDVLEESGSKGQVADIIHKGASFLSSLGLTTKEPWTKSTNAEINIFSVASGHLYERMLSIMLVSVMRHTTHTVKFWFIEQFLSPSFKSTLPILAEHYNFEYEMVTYKWPHWLRGQREKQREIWGYKILFLDVLFPLDLDKVIFVDADQIVRTDMIDLTRVDLHGAPYGFTPMCDSRTEMEGFRFWKQGYWSTYLRGKPYHISALYVVDLKTFRALAAGDRLRGQYQALSADPASLSNLDQDLPNHLQHSLPIFSLDQNWLWCETWCSDEALTTAKTIDLCNNPLTKEPKLDRARRQVPEWTVYDEEIAAVVRNASKKEDDDGEQESQAAAADSESGHDDTQKSAWQKKEL

SEQ ID NO: 3758 - protein, 1484 aa, Leucosporidium creatinivorum
MNDSDAPQTQLYAFDHLSPIKRDDSLPLITFYAYPSPSARRASPPAEFTARVQSFDKLYAFVRTLSSPSSLPTVNPKAAVSGGKTSSKASLAGPPRLQVALRWGAARNRFRRHIDDEEPQNLVLSGYGAGLDIKKSDYLAIDDRLASSDKAASHLEVEGEDASPKMDPVKKSDIAGLGLRATAHILSSDSPLEAFTNVTAAFPLLASHLSTLVPVVPEDLEEEVGTFQMTSPLSQRPSFHLNGMPLPESSIDPFALLRIMRRERKFVTDLQGLSSHMSTKQARDVLMHEGIGAVASGGTTSRGRDVALSPAVLGDLFDAGDKQEGGGLILWWNDLEKDKRYKSWSTDLKDMLRPVYPGQMNLIRRNLNTVIFVLDFSQPSALMLLSENIRQFVSRGIPLRFGVVPQVDSLAHENDISAKVAQVLWYVVDGVGRAPAMALLGDVSSPPSLALSGDRVSESILRRLYEQLAMQSVHISGGPLATFDEVIKGVEVEATAFNSRVSKARAYTKRLAVEREAKSLGSFFLDGAHFKLDDDWTQNLQRGLGSHVQYLQQMIYRDLLTNEVNVNRYFFDLPTTHARRNPYIFPSPETNPLKIVNLVDATKGVHASMAKATFIEGVSPEQLIDPEAEAPPALATLFIIADIDSPEGRDLAKSALQLDKTPQTRISLLHNPAHADLPHSWELSNLVYLLHTVGALDQVLPSELLSWLELDVDYGGPGKAAGTTWTEENPIRQFLRKGANRRDTLKAVEWWAEAGKLARNFRFEKGQNGIIINGRVIGPFEDGAFGAADLKGLVNFELQKRINPVVEAIDASGFNISLLERSQRCNLYNVASSIVSEAYLPDPAAGMFGGNSVERRSYYRALQNEHSSFIGPRENGAIFEIAVVVDPVTELAQKWAPIIQTLASLETVHLRLYFNPSLHIKELPIKRFYQYSFAPEPSFDVSTGAELQPEVRFEGIPEDILLTFAADLQQSWLAFPKTSVHDLDNIRLADLPSWSRREGVKATFELESIIVEGHAREMPSSQPPRGLQVELLAGSGPASTSEKRGDTIVMSNLGYFQLKAGPGPFRLAIRSGKSSDVYSFASIGAEGWKSGDISKTGDSLLVSTLEGLTLYPRLRRNPGFETVQLLDENEVAPSKGAGLFDRVKSMFPFLAPSNALAVKKQAEINIFTVASGLLYERMAFLMMVSVMRHTKSTVKFWFIQNFLSPSFRAFIPHMAQEYGFDYELVTYKWPHWLRAQKEKQRTIWGYKILFLDVLFPLELERVIFVDSDQIVRTDLKELIDMDPKGAPYAYAPMGDDRPEMEGFRFWKTGYWKDHLKNNPYHISALYLVDLDRFRKVAAGDRLRQQYQGLSADPNSLANLDQDLPNNMQSAIPIHTLDKSWLWCETWCSDESLAQAKTIDLCNNPLTHEPKLQRAKRLIPEWTVYDDEIAALARRVAAEESSIGAFGKRADDLEQAVQQEVERSEFVHEKEGEKEVRQERKKDEL

SEQ ID NO: 3759 - protein, 496 aa, Coccidioides immitis
MLVSQLQMFITRKIPIRFGMVPTLPDEASMQQIRVASYLHQTYGLKTLLTYFENALEGAKSQIVWPSKDSFNAAVQDREHHADRPKLTFEEILSSDHFEPTIITKTKAYLKRLSSDGPNPPMFVNGAIIPRDEHWMQPLVTRLAQDLEEIQQAIYGGLYDDDSWLPIHFLDGAVLTRNPLIIPEDPGAIQIRDLHAAFKSRRSAFDALPRIRASSDSNLENWSSLILIADFDSEDGIKQLGSVLEFREKNPGIEVLLLHDSHLDFSGRVSAELFNLMKESRDVDVSALKSILEVGSERLLTQEPDVERRRNYFSSFSPLARELGSNQGGVDIVFNGRLIGPIPSSSLFGYWKKFLKGLPYHISALYVVDLNRFRELAAGDRLRGQYQSLSADPNSLANLDQDLPNHMQHAIPIKSLSQDWLWCETWCSDEALKTARTIDLCNNPMTKEPKLERARRQVPEWTEYDDEIAELGRRVAREQGQAGDEKNEKMRERDEL

SEQ ID NO: 3760 - protein, 1453 aa, Papilio polytes
MKSTGLLIPLLVILIHVLVFVSTDTDPPKRDEKRAKGVTTFVTAKWESTPIVLELAEYLSGESSDLFWSFVNGVNSLKSPLQGLATDKEVYDACIGIASTLLAPAQLRMAKLALSMHLTSPAVRMFDEIATQNGAKDVQCEEYVHIASRKICDTDTLRDVLKAYKTYNPEDHILETYLLDHSYPSSDNKTLTAILYGELGTVEFANKHKILATYADMGAVNYVVRWNVKSRGGPKLRLSGYGVELQLKSTEYKSQDDTTPKETDTGDAAEPSVEEDENDPQNQIDGFNFGRLKNLFPALRTPLERFRRHLSESSEELAPLKVWQMQALSMQAAAAVVDANDAGGDEALKVLTSIAQNFPMQTKSLIHVNVPRSFRDEVLYNQDVWASSLGLRAAEPLLLVSGAQYDAEEVDVMALLAALREDVGPMNALHALGLPKNLINSLMSLELGEAYTWEEYGLDIRDSAITWLNDLESDDRYRRWPSSFMELLRPTYPGMLRNLRRNIYNYVCIFLKWLIFVTMVQSRNLSRFYLKMGETLLKHATPVRVGLVLAPGSDAALSAAVRSAFNYVAQDKNSNKEAFYFLTQLISSCENNDMTLEHVKNQLQKYASSGTNVDDIIYEDSEFNFGHQLAEEFLFKITSDKYPLVLINGVPLWDDGSPTAATSSVELLEEALVSLQRAVFRSELADTDDAVDHLMKQPHIMPRLNRRVLASEPTQYLDLSGVPSSPELFTEDRLHRLMHLTGRDALATALPILKYFQKSGKPEKITQTIWVVGDLNEKESRDLLRNAIKFMRESGGVRVAFIPNVEGVSGVSGEQSLNKAVLAALAALEPAAATKYVTSLLEQEGCHERQDCDILPELVPVLNKLEWVLKAARVLCARGMRLRAGARALVHNARIIGPFEDKLPFTMDDFVLLDRFSNQVYGDKIADLLLKKKTTVENDVYDESITVDIPELSADEYLKVISVLSSRSPKSRTPLPQGLLLLVLRRVVNCRLKLFLNPQDKNSDMPLKSFYRYVLEPELQFTEAGALGGGALARFWRLPQAPLLSLELRTPPNWLVECVRSVYDLDNIRLADVDSLVHSEFELEYLLLEGHAWDTTLGTPPRGLQLILGSREQPELMDTIVMANLGYFQLKANPGAWTLRLRPGRSEDIYEIVGHENTETTAGNSDIQVLLGSFRSHNAGGIWNSIASSFGGGGGGGEEAEGAEETINVFSVASGHLYERFLRIMMLSVLKHTKSPVKFWFLKNYLSPSLKDILPYMAQEYGFEYELVQYQWPRWLQRQRDRQRTIWGYKILFLDVLFPLHVKKIIFVDADQIVRADLKELVELDLAGAPYGYTPFCDSRKEMEGFSVLDQDLPNNMIHQVAIKSLPQEWLWCETWCDDKSKKQAKTIDLCNNPMTKEAKLSAAMRIVPEWREYDGEVRALQARVRRGLYQHTDTDQERHLHDAGKEHEHTEL

SEQ ID NO: 3761 - protein, 1517 aa, Exophiala dermatitidis
MRESTLPWRVTMLALWQFILVVASAASSSPSINVALETSFAAGPYLVELLETAALENSSSYFPLLDRIAEGVFAELQTEQELYNKFIDVLQHDGHISSPESLSSFKFALALHAAAPRVEAHFQYYNSSVQPHFMAAQDAVCPVWVYLDGQQYCSPELDRAQQSISLPEAEEMLPFDRVLGSGLDGPASILYADITHPLFGQFHNVVSQTAREGTSTYRVRYRPAIGTARKPLFVSGYGVELVLKRTDYIVIDDRDASATEEAPDADQKALEQPKDDELKDLKPLTTSEVVNLGLNAASFIASSSDPLRSLKDITSDFPRYSSLLAATNASKAFISEHRSNRERFLPSGYNVFWINGVQIEPRQINAYSLLDHLRRERRIIADLKGIGLTSTEAISLLSSEVIAEAQANEMPQRFDWRDDIEGDTVLMWLNNLEQDKRYASWPSALRNLFQRVYPGQLPQLRRDIHNLIVPIDMGNVKDIELAATSLQGLVRRQVPIRVAIVPTGSGYLADVYAKLSYHILDKYGLAPLMGFLSEVSGSRKLPANAEKSFQNAVKGLSPREGKQELSYNEVLNSEDLLKRLQARNAYLTRLALNSTDPPFIIDGVVLPRTDNWFETMSSRLFADLQLLQQAVYQGAVPDDSWIPEFFLLEAFPRRNEIVFPHDPKDVRIVDVSQLVSDFADEFDNLPRIPGSEAGLLSDRAHLFVVTDVNSEEGRTFLREVLGFRHQHPEADVLILHNPPSESSPSGLECAIHALVGETGRDITPEQLQQILDGHSNQADGEQKAHECGSYWSSKAKLTQSLGVTPGETGLWLNGRVLGPTHHALTAEDMEALLGFERRERIAPVTTAITALGLEDRFSNPLNLAKVTSLVARSLKSDLPEGLRESAPLIRMDRFKIWNDTHTSIKVANSEDPSIQAVAVVDPASEVVQQWVPILETLSKLHGVSVQIFLNPKDRLSELPVKRFYRQVISSEPDFDENGSLTTPTASFSGVPRDTLFNLGMIVPPSWLVAPKKCVHDLDNIRLSNLADGENIDALYELEYILIEGHARDVTVGPPPRGVQLLLGTEQEPHFTDTIVMANLGYFQFKANPGYWQISLKPGRSSKIFHIDSIGPNGYAAQPGDETNSVALLSFQGVTLFPRLSRKPGMEEEDVLEPPTSGIGGAMEYISKGASFASSALSSLGLKKGGASSSTNAEINIFSVASGHLYERMLNIMMVSVMKHTKHTVKFWFIEQFLSPSFKSTVPILAQHYGFDYEMVTYKWPHWLRGQKEKQREIWGYKILFLDVLFPLDLDKVIFVDADQIVRTDLIELVNLDLKGAPYGFTPMCDSRTEMEGFRFWKQGYWQTYLKGKPYHISALYVVDLKRFRQLAAGDRLRQQYQALSADPNSLSNLDQDLPNHMQHSLPIYSLSQEWLWCETWCSDESLAQAKTIDLCNNPLTKEPKLDRARRQVPEWTEYDEEIAAVIKAAKAKDKAREDQSKETLSSSSSSRLLEQGDDDDDGEQDQKNIIDGEGERPRDEL

SEQ ID NO: 3762 - protein, 1579 aa, Rhizophagus clarus
MVLKKLRYNTLLLVSYLFCIIFIVSKAETPPVQTWLKTSWDAPHLLLEIIESVSIDNSTAYYPLINEFINQGLFSSELTYHEVYNAALDVIESKQYLSTPTSISILEFSLSLHTTAPAIQAYYHYYNTTVVPSKQEFDVNFNPECEVWVDWHGHQACNVENFKKLTGISKTGSFDKLPNSSDQHPKLLSFDHVLSSNAGTTKPLIILYADISSPSFVPFHQFITDLVNNEKAEYVLRYKPPKGSQNSLYLAGYGVELALKKTDYIVIDDRKVESDDHNEKENENSESYNDSHSDKLNEHLFDEDISEIKPLTTSAIKDLGLKATQFIISSPNPLSTLAQLSQNLPKYSYHIAQLNLNSSLKQEIKINQNYVGLDSNSFWLNGLTVDPSSVDPFSLLKLLRRERQNVLSLMSLNMTSRQAVELLASPIILELKSSQDLVKGIFDVRDKSEKKNIITWFNDIEKDKRYKNWPPRMFDILQPIYPGQMRYIRKNLFNVLFVIDLSSMKGLEIINDTKMFIERNIPIRFGLIPLVIKEKNESIIMAKIFYYLIDQYTIPSIMQFFSEVLNELKNSPSANIVKIAEKQFNKVTNDQTPKDETSVKSFDYFTKSDTESSLEEQISGATEFINKFRINADGKGKGALFVNGKYFDIDDNYQRDMVQTITEHTVFIQQKVYVGEISDHTDIFEYFMTLPRVPSRRNPHVFVSDSQPLNVINLVDKKHESDEKLNNIRYIYSTKQDDNEVPISLLLITNFDSEYGARQGLEALKYLDESSNVRIAFIHNPSTQPSAREDISLSSFIYFILHSSEANTVDMPDLPKILKEAIEEYLNIEDNIKMPFIEQTESQEIPIPDSESINPARSFGWQFADKVKSQTYWKEWNSLTRKTLKLNENDTAIIVNGRVVGPFIKEDLFIVDDFRLLIDIEFSERIEPVINAAKAANLTVQLNRSNYSDFISKATSIIATSMISDVPLGLFGGQDLKRDLSFKKLKSEHSKIVIGDTEAALYKISVLIDPLSETAQKWSTILEILSQIDGVAIELYFNPKMNLVEIPIKRFYRYVLEPKLKFNTTTGNLIAPSAHFSNLPEDPLLTLGMDVIQAWLVTPKVSIHDLDNIRLANLDSRLRIKGVESVFELKNILIEGHARDMTLQAPPSGLQIVLGTKNNPVMVDTIVMANLGYLQLKANPGIWTFSLREGKSSEIFNIQSVGSEGWYSRNVEEIGNEIVLNNFEGLIIYPRFTRKPGKENEDVLKFEEKDGIWNYFVNKFSKNVSKNKAEINIFSVASGHLYERFLSIMILSVLKHTKSRVKFWFIENFLSPSFKDFIPHMAKEYNFEYELVTYKWPHWLRAQKEKQRTIWGYKILFLDVLFPLDLDKVIFVDADQIVRADLKELVDMDLQGAPYGYTPFCDNRPEMDGFRFWKHGYWKDHLKGKSYHISALYVVDLQRFRHMAAGDQIRGQYQSLSIDPNSLANLDQDLPNNMQHIVPIFSLPLEWLWCETWCSDESFERARTIDLCNNPLTKEPKLDRARRQVPEWESYDKEVATFAARISQLQKVLITESNIQSKSTIEVSSKSEIPVKTTTHEDL

SEQ ID NO: 3763 - protein, 1447 aa, Unknown
  Description of Unknown: ABL29440.1 Sequence 9 from patent US 7129341 sequence
MRWGFWFAIATLITICYAAKPLDVKIAATFNAPSFSALIAESLYQEKKEGFIWYLNHLSDLLDAENTTEKELYINVVNSLKREYVLSDEELSSLQFSLGLFSGAPKLQAFSSIVQSRTCDCDTWLQLDEESQVCFSDLPKDSPLFSKLYSKNPLDYEVVKTSATGIPYAVVVTSFERDLIPFHELYYKLALEGKCNYVIRYSPPSSSKLNSKLYVKGFGTHVSLKRTDYLVVDDREFPREKGDNPASFTSSRNKRSNERLFGMTSDSLQTVTPDKIAILDLLATQSIASSADMLSAFRELTQDFPIYAHYLSIQPDVSNHLIEELNQFQSQYVPEGINTIWLNGLSLDLEETDAFSILSLIKKEKDMFDRFEALGIKSSKVLDIVTNEAFANEDSDFKFVKFHCQDDIEDWKAIHWVNEIESNPKYDNWPKSIQILLKPIYPGQLHMLGKQLHTVIYPIFPSSPSSLPLLSELIQFSRRPSPVQTGMVCAANDDDEFAQTVCKSFFYISKESGTDSALKFLYKCLNSDSSADLYSLLEEHLPLSEHDDDTLANLKKDLSSSFFDHYMSKSNSWVNRLGIDSSASEVIVNGRIISHDENYDRSMYGIFLEDIPEVQIAVAEGKISEDDNLLDFILRDASLTRNPLVYPSAKSSIKSIDIKRVLENVGSLNHEDILLIGSSNAKYSFWLVADFNEKEGLEILSLLADLLSENKDANLMLIQEGKNHVVPPLFAKLLSSPKRSSKHLQEILNSSLDPSSGVVNDMDKALKFLKKSKAVVKELGLTGECKSALLLNGRMICSFSVDSLNTADLKMLMQMEYDNYLSKLSNIAGSSRRLKNSRAISFLSSYLKTLESTPMSTSSPTKEEKLFPRDFIYNKLGVGNATFETDDFSKAYYQFVAVLDPLSKDSQKWSAILEAVSKLNGVGVRIHLNPKQTLSELPLTRFYRYSISAEPEFDALGHLEESYVEFDNLPADTLLTMDIEARDAWTVMQKDVDIDLFNIKLEHTSEAEALDSHTAIYELKNILVQGYSQEEFRKSPPRGMQLKLGNLTNSHVTDTIVLSNLGYFQLKANPGVWTLEPMDGRSSQFYEILSLNKKNSYKDPQVIVDSFEGVTLNPVMRRKPGFESADIMDEDLSSHKFFDKIKKSLSFFNFKRKEASINIFSVASGHLYERFLYIMTKSVIEHTDKKVKFWFIENFLSPCFKSSIPAIAKKYNFEYEYITYNWPHWLRKQEEKQREIWGYKILFLDVLFPLELHKVIYVDAQIVRADLQELMDMDLHGAPYGYTPMCDSREEMEGFRFWKKGYWKKFLRGLKYHISALYVVDLDRFRKMGAGDLLRRQYQLLSADPNSLSNLDQDLPNHLQHLIPIYSLPQDWLWCETWCSDESLKTAKTIDLCQNPLTKEKKLDRARRQVSEWTSYDNEIASVLQTASSQSDKEFEEKDNNSSPDEL

SEQ ID NO: 3764 - protein, 1545 aa, Unknown
  Description of Unknown: Ramularia collo-cygni sequence
  MOD_RES (164)..(164): Any amino acid
  MOD_RES (401)..(401): Any amino acid
  MOD_RES (529)..(529): Any amino acid
  MOD_RES (648)..(648): Any amino acid
  MOD_RES (1419)..(1419): Any amino acid
MAFASGWKKVLVASGLLAAWANAAPSVNVALRTSFGAPPYLIELLETAADTNASSYFPLLDRIADGFFDSSTTDQDLYTSFRSLLQDDGHLSKEDLSLFDYALSIHSAAPRIEAHYQYYNTSIVPAIPQDAAEECDNWVHVPFSGERYCSAEMEEASAHSFGPXSPKVHSLPFDRILGDSLSERPSVLYAEIGSASFRKFHKTLSKTARDGKSSYRVRYKAATGAESKPFAVSGYGVELALKRTDYIVIDDRQDEEAQKDATVGTGEASLSEEEVSDLRPLSSSELRRLGLKAASFVMGSDSPFETLLRLSQDFPKHSSSIAAANVSDEFVAEHAKNRAEILPSGYNIMWINGVQIMARDVEAYALLEHLRRERKLINSVQEIGLNGEEAVELLSHEAITXSQVSQETQRYDWRDDTEGGNVIIWMNNIEKDKRYAAFPGSAQALLQRTYPGQLPSVRKEVHNLVMSIDFGDYNDAALVVDSIRGFVERKLPIRFGLVPRINSPVSEEHAKAILYLLDRYGLATALAYXERVVEASSRKLGTPDQKHFSAAIEGRELRRNKDALPLTGLLQDEQLDARIKRAQAYTSRLGDTGVTPLVFANGVPISRTEEWLSTMSQRVGTDLRIVQQAVYDGSVTDADYLPDLFLEXASLRRNPLVVPEDDKAVRHLNLGDYPELENLPNLPASTDTIERELVHITVAADLDSAKGFEQLMEALLFRQEHDNVEVAALHIPGNSSMTQRLGSIFATADGEKALTALAAGYDKLRGEGSDGSQDDAASKRNIYEKIRSTSASPSTSELDEAVIQAWAPFQDIVTSLGIQPGQKAMIINGRVIGPIPEWTTLEAVDLETLYNHERKKRLLPAALAIEDLKLQEKASTPLAFARISNLIALSLISDVPEGIFEAAPTVRTDVFKKWSSTHTAIQMGDPKTASIQIYTAIDPASETAQRWIPILKVLSELDGVYVSLFLNPRDRLEEIPIKRFYRHVISSKPVFESDGSLSHNGAHFSGLPADALLNMGMDLPPSWLVAPKETVHDLDNIKLSAVRSGSDIDATYELKHILIEGHSKDASTGPPPRGVQLVLGTDLDPHFADTIIMANLGYFQFKANPGVYNLGLQKGRSEEIFNIDSAGLLGATAQPGEHSTEIALMGFRGTTLFPQLSRKPGMEAEDVLEASKSTLESLAEGADKLLAQAGLRSQHASKYLSKAAQLGSGLFSGVGKSEVTAARHADINIFSVASGHLYERMLNIMMVSVMKHTEHTVKFWFIEQFLSPSFKDFLPVMAEEYGFQYEMVTYKWPHWLRGQKEKQREIWGYKILFLDVLFPLDLDKVIFVDADQIVRTDMYELVQHDLQGAPYGFTPMCDSRTEMEGFRFWKQGYWKNFLKGLPYHISALYVVDLKLFRQMAAGDRLRQNYHQLSADPNSXSNLDQDLPNHMQSMLPIHSLPQEWLWCETWCSDESLKEAKTIDLCNNPQTKEPKLDRARRQVPEWTAYDDEIAKVAKRYKDRQSGANEEVVEPGVPGTQAGEESIQERLQREDAERERKQHIKDEL

SEQ ID NO: 3765 - protein, 1406 aa, Nothoprocta perdicaria
MFQQIAADEPAPEGCSAFVVIHEKHTCKTNEIKKLLKKAIKRPRPYLFKGDHIFPTLKENGPVVLLYAEMGTKDFAKFHKILSEKAQKEEIVYVLRHYVQKPKSRKMYLSGYGVELAIKSTEYKAVDDTQVKGANDTSEVENEEEEEESDVQGFLFGRLRQMHPNLKNNLKEFRKHLIETTNNMEPLKVWELQDLSFQAAARIMSTPVYDALKVMKDIAQNFPIRARSLTRVPVSKELRNEIEKNQKHFYEILGIQPGEGRLFLNGLHIDMDFHDPFSILETLRLEGKAMHGLHELGIKEEILSKFMRLQVHSAGDSYALDIRHSSIVWINNIERDHSYSTWPASYQELLKPAFPGVIQQIRRNLYNLVLFIDPIQEDTNDYIKLTELFSHHNVPLRIGVVFILSTKEETDGNEDAGVALWRAFNYIAEETDTSQAFTSIINMYYEVEDGKVLSVNHVKNVLGREFPHADVQSILGVHSEYDEGRKAGATFYKKTGLGPLPQALFNGVPFTREEMDGAELETVILQRIIDATGFFQRAVFMGLLNDHVNAIDFLMEQHNVVSRVNPTILGAERKYIHFRSTSVPFDVQDFSTFSFLDSQDKSAVIADDMKYLTKKDEDVLYAVTIWIIADFDKPAGRKLLSNALKHLKTSRHTRLGILNNPSSKIQEDNTAIARGILTAFLTQNSSNLRGFLSKLTKEETAKSLAAGTKIIKFLMPGMDGDAFEKKYNTLGLDVIKTHQMFCQEVLKLLPGQMAVVSNGRILGPLDENEFYAEDFQLLEKITYTTSAEKIKTLVKEMGINAKSGSDLIMKIDALLSSLPKTEMRQDVKLLKEQHSAVKIDPEQNQPFYDVIAIVDPLTREAQKMAHLLIVLKDVINMRLRLFLNCRSKLSEVPLKSFYRFVLEPELTYGINNHLPSEPVAKFLELPESPLLTLNMITPESWLVEAVNSSCDLDNIHLQDIKGNVIAEYELENLLLEGHCFDVTTGQPPRGLQFTLGTKNNPVMVDTIVMANLGYFQLKANPGAWTLRLRKGRSEEVYQVFSHEGTDSVADLADVIVVLNSFRSKIIKVQVQKKSDKVNEELLTDDVTAEKGHFDSVTSFSGEIPTEEMEKRSDILNIFSVASGHLYERFLRIMMLSVLRHTKTPVKFWFLKNYLSPTFKEVIPHMAKKYGFKYELVQYKWPRWLYQQTEKQRIIWGYKILFLDVLFPLAVDKIIFVDADQIVRSDLKELRDLNLNGAPYGYTPFCDSRTEMDGYRFWKSGYWASHLGKRKYHISALYVVDLKKFRKIAAGDRLRGQYQALSQDPNSLSNLDQDLPNNMIHQVAIKSLPQEWLWCETWCDDESKKKAKTIDLCNNPQTKEPKLQAAARIVPEWVEYDAEIRKLIEKIALENKNQTSLFQKGFKHDEL

SEQ ID NO: 3766 - protein, 1562 aa, Danio rerio
MNHSMGHLYRPNMATHEADSEAGVGFCGKMWLFCAALLALGSVDSVNGDSKAVTTTLTTKWPSTPLLLEASEFLAEESQDKFWAFVEANQNIENDHDDTDQAYYDLILKRAGELLSPVQLNLLKFSLSLRAYSSTIHSFQQIASNEPPPSGCKAFFNVHGQKSCDSERLQGMLDNALERPKPNLFKGDHRYHSANPDAPVVILYAEMGTKEFSRLHQLMLSKANKGMITYVLRHFLASPSKSKVHLSGYGVELAIKNQEYKAKDDTQVQAGADANATVIGENDLVDEVQGFLFGKLKTIYPELKEQLKELRKHLIESTNEMAPLKVWQMQDLSFQTAARILAAPSVDALNVMKDLSQNFPTKARSITKTVVNSEIRKEIEENQKYFKGTLGLQPGDSALFINGLHIDLDVQDIFSVFDVLRNEARVMEGLRSLLIETPYIHDILKLNVQPSDSDYAVDIRNPAVHWINNLETDGRYASWPSNVQELLRPTFPGVIRQIRKNFHNLVMILDPTHENTAELLGVAEMFYSNNIPLRIGVVFVVNDSDDVDGMQDPGVALLRAFNYIADDVDGQMAFDAVISIMNRIPSGDKLKVEHVVGVLEKRYPYVEISSILGPDSAYENNRKEGKAYYEQTGVGPLPVVLYNGMPLQREQLDPDELETVVMHKILETTSFFQRTVYLGELNSDHDVVDYIMNQPNVVPRINSRILSTSRNYLDLSATNNHFIDEYARFLFLDAKDKNAAVANSMNYMTKKGMSTRDASDDGIIRPVTFWVVGDFDQPSGRQLLYDAIRHMKTSNNVRLGLINNPSENPSNENSLIARAIWAAMQTQTSNNAKNFITKMAKEETAQALYGGSDIAEFAVGGMDVPLFKSAYESPNVNFLLAHSAYCRDVLKLQKGQRAVISNGRIIGPLEEREVFNQDDFLLLESIILKTSGERIKGKIQQMGMVEDRASDLVMKVDALLSSQPKGEARIEHTFAEDRYSAVKIRPKEEEVYFDVVAVLDPVTRDAQKLAPLLLVLKQLVNVNLRVFMNCQSKLSDLPLKSFYRYVLEPEIVFLTDSSFAPGPMAKFLDMPQSPLFTLNLNTPESWMVESVHTRYDLDNIYLEEVDSVVAAEYELEYLLLEGHCFDVTTGQPPRGLQFTLGTASDPVIVDTIVMANLGYFQLKANPGAWMLRLRKGRSDDIYKIYSHDGTDSPAEADDLIVVLNNFKSKIIKVKVQKKPDMINEELLSDGTHENESGFWTSIARGFTGGSNPEEPKQEKDDVINIFSVASGHLYERFLRIMMLSVLKHTKTPVKFWFLKNYLSPTFKEFIPYMAEKYGFQYELVQYKWPRWLHQQTEKQRIIWGYKILFLDVLFPLAVDKFLFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKKAKTIDLCNNPQTKEPKLQAAVRIVGEWSDYDQEIKRIYNNFLDEKERGTLEGYQSTDRKHPGGVTHSEL

SEQ ID NO: 3767 - protein, 1588 aa, Toxocara canis
MILRLFSTVLLLAAILGSVNGQKKKKAVITSLHAQWPQTSLLAETSEFMTKEGSGMFWKYLDAIIEGVNADEWNSFSDAKQHDIAVRLASRLLGQSRTALLKFALSLRVHSPIVQLFQQLGAENAVNCDAYAVVHGEIVCDAEDLERAVGNASESGPPSTLYSVDHVYPKSRLHEITVVVYGELGSKSWLNLHLAAERIARNNKAKYVFRHWCREARDDKVLLSGYGVELAIKNTEYKAMDDSNIPGKTQSEEDSDADIRDYDDINGFNFNILRKLHGDSKESLDQFRLHLLERDELTPLKVWQVQDLSYQASQRIVSAPPEKALSLLTEMSQNFPLLARSISRQSIKKELRAEVQTNLEITLSELGIGEGESALLINGISVDVDQLDVFATLELLKQEQKLTEGFYRLGFKKEFITILLNIEPTDDRSSYALDFREAFPEYLNNLDTDKQYRQWGNSIKMMLQPYFPGMIRPIARNLFTLIFIVDPSQKETKNLLKFAHTFYKHDIPIRLGVVFVVNDDRSLSGFEDASIAMLNYYNFVKIDQDIPHAINTLIKVLEQAEGRDFLTPKDVINHFMEKYPDQDSNIVFSVDSDYDQGRSAGRNFLTTSGLGHTPKVLLNGVVLDDAGITPAHFEETVVNEVMKATPKLQRAIMSGKLKEKDNVMNWILSQPDVMPRINKRVLDAPSYFDAVYLDLTSRKPCTAKSPSQFNQLPDAEYNQCIMQRIRYVTRTEEERIRAVTLWIAADFESVEGRLLAYNAIRHLKHSHMIRVGFINNPRDVKKASHTSSISMLINAATRLLPPAQMRSFITKLVKEEIASQLIDQSLTLEDIAVNGMNVETFRKELKQLNADEIAADAKFAEKALGLQPGERAVVANGLVVGPLFDEETFEESDIQLLEKLMMSRNAKVIASFTDKWHIGKDYGQSSDMVARVAALVGAYPAKKKRFWVGLQSEEHSVVKLPAKQEDEAALNIVCIVDPLSTHAQRLGPLVNVIQQIANADMKIVMNPKAKLSELPLKRFYRLVLEPSVAFDDSGRISSVAYQARFTSLPEKQLLTLSLIPSDSWMVQAVKAVYDLDNIKMQNVEGNVIAEFELENILLEGHCFDENTGTPPRGLQFTLGTHTDLTMYDTIVMANLVEGNVIAEFELENILLEGHCFDENTGTPPRGLQFTLGTHTDLTMYDTIVMANLGYFQLKANPGAWILRLRTGKSTDIYDITSHTNTESEGVDEVHVLIDSFSGRTIRVRVSKKEGKQDENLLSEGRANEEEGLQQSLWSSISSTLSGSEKYDAINIFSLASGHLYERFIKIMMLSVMKHTKHPVKFWLLKNYLSPHFKETLPVMANYYGFQYELVEYKWPRWLHQQTEKQRVMWGYKILFLDVLFPLDVRKMIYVDADQVVRADLMELMELDLGGAPYGFTPFCDSRASMEGFRFWKKGYWANHLAGRKYHISALYVIDLVKFRQIAAGDRLRGQYQGLSADPNSLSNLDQDLPNNMIHQVRIKSLPQEWLWCETWCDDASKANAKTIDLCNNPLTKEPKLDSATRIIPEWNDYDSEIKKLLAGELQPLAERSESATSTAGDRIKEDDVHAEL

SEQ ID NO: 3768 - protein, 1831 aa, Vitrella brassicaformis
MISVMGGSRVLYLVAALLAALPLLVSSKENFNVEVELISPWPSVSPVAELFELMTDFDPHEALSFLYDLTEAAQAAPATSRIDIAFDTLQRFIKSPLTLTFLDMCASNHLHSPKVEMFRTLERDALAHFPGLMHRCNSSWAIVHPPACDGGVPSGMPISACDPVSLKEAVSRVDRTVSAHMDRADSPWCTIDYPYGFTVVKHHEHFMRRPAVNQTGRPVGMVVVYGDLEDPSVDGMVSAVRAMVDEWDRAEGSMGMGMEWGAVFRHGEMTSSARRPGRYDYLSGFGMELAVKSSEYKAVDEKDVDQKGGMKAEDDKGDRDDTDDDEAVEDALQREKESLTDNNGEGLEGLLFATLGSRYPSLTPHLAAYQESLDTELDSDELLKAWQLEKLGLQAVSKAMSSTNPLYTLIQIGQNFPAQALRLSKVSVLPTVEKALNRLHRRVYERSTFLSLNGRWARPSDLTTLQLLKDLGPVFLGLELLQRLGLPSTAAVKLLSSSARGMEASRVDWRPRKDEGGSVGGMAAIFDVTSDEATQDWYDLSALLYMWPRNLAPVRAPLYQVVMVMDPLDGPVLSLAGKMLMRRLPMKLWFAFVPSTEEQPDATWDEELLGAPPAWVVAARDAIPSVAPSSRSPAFISRVIAECYGQLLKKGKYKTQKNARKFVSSLVSLVTSQEKKQKKAAAKDTKDTPPLHSQQAPTTPPTLTESEIKKVFVSSGGDQPLWDTIWSGKVHQYSDGMAAYVAEKGLQSGTAMVNGRLVGRDRLLATDSDPFIRYMQYDQEEFQRALMTGWLDEDTDPAEAILTDGGFPSAYPGIVPLPEDAEENAPPEVAASTIGPATISYANVDAGLLRQLPWVEAEPESTKDPLLPVLHTLILPLPSSWWTLLDTFADHLLDLQKRTDTKDPHAVKSRLAIVVADSPDDLPAAATAAAATSVLRACLQVAMRTDDAATAMDEENEASVSAREKLKFLRYLGMTGRTAGAIKRRAGMGELSAGEVGDLCRMGMAKKINPAASKRLVGEFDKVVKGTKGGGGVVDGVEAEILRSVDFDDVTRRHPGEDVALVLTNGRKTVLHRPRDAVPPAVSSNTSSSLPAPSPPFLPCHVSLLEYLAHTREGPQSSRESITAILSNTTTDPYLIASASGIRAAYTAHNTDFWSVPEQVYEQTKGAIQLHLAPVDAEVPPPVRIVGVIDPLSSVAQGLLPIFEMLHICLNAEVQVVLNPATRYAEYPLKRYYRQVMAWPKRGFFNPTGVKERATDVPRAVFSGLTTQHTLTAAMHVLPSWLVRAYEAEKDLDNLRLVDLGAPNPSQGCRGTVRAVYMLNHLFLEGQIYEFNERGQPLGSPAGVYLALQKPPMARFPLPTTTTTDTDAHNASMSSQNRTATDEQQQQQEPPPLHDTQVMRNLGYFQLKANPGVFVVEIAYPDPATDDNPPPAPVEISSFFTQPHVIKLQKPSDADAAKGGDKKKSGTSGQEDKPGFWKSLTGLFKGENKTTDVSSSCPTVHIFSLASGHLYERLLRIMIKSVRQNTRCPLHFWFIDNFLSPKFRELISYMAARYSFDYQFVTYKWPSWLNPQTEKQRLIWAYKILFLDVLFPTWLNRVIYIDADQIVRADVRELWDMDLKGKVYGYTPFCSEGPGSNAATEGFRFWKQGYWKNHLGDLSYHISALYVVDLKEFRRQGAGDRLRSVYNQLSRDKNSLANLDQDLPNYAQHDIPIFSLPQEWLWCETWCANETMPMAKTIDLCNNPLTKEPKLHQAKRIVKEWTDYDEEIRAFELEVENMFSLDQSSVANDTISVTVNPAAESPTGSSSRQSRPSPPPSPPSSGQHEPPHDEL

SEQ ID NO: 3769 - protein, 1104 aa, Trichinella pseudospiralis
MEASEFMSKESNEKFWQFIEAVIDKHQTSQGNETDREIYSGILQIGEQILKSKARLEFLKLALTVRVHSATVEMHRQIAATSLDVQSDKSIYAVVHGKQISDLQQLDTILKHAEALARPVTYDFDHEYPGSKHGSVCVLLYADIENPHFKRWHLHLKKLVQRDGISYILRHYPKMNDDTVALSGYAVELAIKSTEYKAVDDSDKQTDSESGVSSSEEEVTDLNGFNLHLLEADELTPLKVWQLQHLSFQAGQRVMLAPKEEALRVLRDISQNFPIMARKDFTLLYAVKGNDPSAEYAVDYTQWSPQIFVLRLGDRASQNLLSTAYQMYEHVLPIRIGFIFVVNNDKSVSGYDDAGVAMLNAFNFIKEDRSVSKAVMFLIKIYNTSMRETISVEDVHKLFKSSYRDKNLKSIFNSEEYNEGRSISSEHIEEAILSKVMRFTADIQKDVYEGNLKENMDVQQHLLKKPTVLPKLNYNILQMENIFLDMTDTAMDMRIALIHNPKNEVQATKGIASLVQACIQFLPLYQSKAVIGKIFANKIATLEDLINLSLSGISWSEFTKAYNSMSDIWIQLHVHYAKFVLNLDPGVGGIVANGKLLLYSCVQIEASDPAAAQFDIVAIVDPLSAAAQKMSHLLVILSSVLNAHMKVCMNCKSKLSEIPLKNFFRMVLPRELEFAEDGSLKTQPSARFSALPQKQLFTLNILAPQSWMVESVEAVYDLDNIKMEEVKGDVMAKFQLEYILLEGRCFDERSGSPPRGLQFTLGTFQEPFMFDTIVMANLVAKKNDQLENELLAESEDAESESLWQSISKTFQSGEKYDMINIFSLASGHLYERFLRIMMLSVLKHTKTAVKFWLLKNYLSPGFKEFLPYMAGHYNFSYELVQYKWPRWLHQQTEKQRIMWGYKILFLDVLFPLDVKKIIFVDADQVVRTDMLNLMELDLEGAPYAYTPFCDSRKEMDGYRFWKQGYWENHLSGRKYHISALYVVDLKKFRQVAAGDRLRGQYHFLSRDPNSLSNLDQDLPNNMIHQVKIKSLPQEWLWCETWCDDKSKKFAKTIDLEPKLQSAMRIIEEWKDYDSEIKDLLDQRMKDKWSIAEQKIQVTEQKMLR

SEQ ID NO: 3770 - protein, 1466 aa, Aureobasidium pullulans
MSDRETAADENATAYFPLLDRIAEGHFDQASTDQELYNLFKKTLQDEGHLAKPEDISSFEYALSIHAAAPRIEAHYQFYNTTVEPTLKSQTDKGCETWLHFNGQQYCDSDLASSSGDPVNQERALDLPFDRIMGDKQSKTPSVLYADVMSPSFRQFHKTVSLTARSGKTSYRVRYRPSVGRPGSPLAVSGYGIELALKRTDYIVIDDRQAEDSDSTNNDASTAKLTDEDVADLKPLSSKELIRLDMKASSFVMDSADPFETLLRLTQDFPKHSAAMSAHDISEEFRKEHLANREVFLPSGYNVMWVNGLQVLARDFDAYAMLEHLRRERKLINSARELGLSGKEAIQLLSHPSISEASSGQEPQRYDWRDELEGGKVIIWMNDIEHDKRYAEFPTQVRALPPVRKEIHNLVLPVDFANYKDVETIVENLQSFVKRKVPIRFGLVPKTSSTASAEQAKAVYYLLDTYGLGVALEYLQKGRKLAGPVQSIFEGATKGRKLRKDRISSPLQEVLKSDDFSARVASAQKYLVRLGASGATPPFFVNGIPLPMSDEWLQQMSQRVTTDLRSVQKAVYEDELNDDSYIPELFLARASARRNPWVIPEDENSIRQVNLASVSDLAEGAIGSIPSLPASKDTVSNDLVHLVVIADFDTQAAQRMLSGLIKLRKEEYDQVEILLVHSAAKPLSTSSFAVELFKNMIAGPIVSLDALQALLSQDKVSASEADVIAAQAFWSSADRFLNDVGFNKGDQGILLAGRVVGPLPSFEEFDSDDFETLFSYERMKRLMPAAAAIKGINVADKANTALSFSKLSNLIALSSKSDVPEGMFDSSPPARSDVFSGWTGSHTLIERSDAEYATIQIVASVDPASETAQRWVPILKVLSELSGVHLRLYLNPKERLDELPVKRFYRHVLESKPRFDEKGSLQGTLARFEGLPADALLTMAMDMPPAWLVAPKDSVYDLDNIKLSSTQGRDIEATYELESILIEGHSRDVTIGTAPRGAQLVLGTNKDQHFADTIIMANLGYFQFKANPGFYNLTLQKGRSEEIFHIDSAGNLGYSPQAGDKLTEIALTSFRGATIFPRLSRKPGKEDEDVLESAKTTADHIADKADSILAKVGLGSVKSSDVLSKAQKFGAGFLTGSAGSSTDLSTLPHADINIFSVASGHLYERMLNIMMLSVTKHTSHTVKFWFIEQFLSPSFKAFLPIMAEEYGFRYEMVTYKWPHWLRGQTEKQREIWGYKILFLDVLFPLDLDKVIFVDADQIVRTDMYDLVQYDLQGAPYGFTPMCDSRTEMEGFRFWKQGYWKNFLRGLPYHISALYVVDLVRFRQMAAGDRLRQQYHQLSADPNSLSNLDQDLPNHMQHVLPIHSLPQEWLWCETWCSDETLGVARTIDLCNNPQTKEPKLERARRQVPEWTIYDDEIAALAQRKVGEGKSPIAGHAGGAGIQAEMQEADARAQREENEKKKKSHDEL

SEQ ID NO: 3771 - protein, 1414 aa, Yamadazyma tenuis
MQRIILLLVWVHIALCVSNHGDNSLKVMLQTPEWSPMPFHLHLLESIAAIDESLYGSAAYSLVNDDYDEEFLLSAANDELVYQLVHDSAGLDPINKSLADLKTASKYYAPRIQTHFSSYLNDIQPKYRGKCDYDMFGTKLERKPTKQYSWLLSGDRIYCTPDDLFALEFSKRSDMSSQLLPFDRVIGQNSKAPLLILYGDLNHEGFNSMFNNLYQSAEAGKLRFVWRYVPSMGAPDLLPNYASTLDLKNSSTPSSIGDFGLKLASKVLSNNVSPREKYRMLNSILEDFPSHLVDIDSEVVDSDVADSAAANEKMGTSKESVGIYLNGAPVNGLELDAFKLFNRIEEEVNIIQEIIALGFNLDQARTLLVKFALHAAVKLSEFNSGSDENRYKVHENSFVAGAQTKRGGVVFINDIETDENYQEYTTVREKAYIDMIPQLAPGQFPPLKENIHDLIFVINLSNQEQLKVFFTFSKLILDRGIPQQIGVLPFGDSELDIKIAKYFYFLYDTTTSKEALAFLYKIFMRETDNEITELLEHISIQGYEFSPSVYLSTLEKFSITEPSIVFNGIITDLKSDWRRQMGSQIRKDVSALHNGLRANKIGFSMKKFLHQSAKSERNLNIIPKDSSGFKYKKVSVSLIEKSSRFRLRPSLVVKDDIEVWLVGDLSQSAAFNQLIQLFKLMSISSFDIQLRVIDLSKSQLLSKIKQGDLNEKDLDNLLVTLEKESTTLKRADPDSDMKQFVSEQGLPPHHSYILVNSRYFRIDNTFSLKQVESIISFEKSFRLSIFDSFLGKYPEIFESSKVDDFYDEKLGIMFHDWKDLLVTRIMKSFFVDDDKYVDDVARYDFSSMNMYNSFVIDNELEPLVDVLVVVDPLVPYSQQIVGIVKGCINLPFIRTRILLQPQSQYLHLPIKRYFKGVYPSYPIKFDSSGFVDENLSAQFSGLSDDVFSVDLLSPKRWVAMSKFAPKNLDLDYFKFSSLSSKDQEVVFELSKLLIEGFATDVTNASPPGGLTLKVSQGDKEADTIIMSNLGYFQLPIGEGTWNLTTGASPYFNYGLLSASSDPFDSSTVIHKQVPLNVFNLDGLVLRPRLVKQASSLSKAKPIQQDGINIFTVSSGHLYERLSSIMMASVRSNTQHPVTFWLLENYLSPNFKALLPKLAEEYKFEYHLITYKWPMWLRSQFSRQRTIWGYKILFLDVLFPIELDHVIFVDADQINRSDMIDLVKLDMGDAPYGFVPMCESKEEMDGFRFWKTGYWKDVLKDDLKYHISALYKVNLKRFREIGAGDRLRSHYQKLSSDPNSLSNLDQDLPNNMQRTIPIYSLPQEYLWCETWCSDSTLQEAKNIDLCNNPLTKENKLDVAKRLIPEWSAYDKDISALIDTIEVQESRKEYEINTPVFIEDKDEDGEEDDEYEHDEL

SEQ ID NO: 3772 - protein, 1636 aa, Schizopora paradoxa
MRLWAIHLLSAAAAVCHASPPVKVSLRASWPSVPLLLEAIETINVEEPESFFPLLDALSNSESLPLEKLTPEAVHQLTIQTALSLGYLQEPGALASVELQLSLHAAAPKIQAFYQFYEDQHLDNTEEGCESWVDWYGERICDIEKLAAVSGRETIGEVSLNNTQILASKPKHTPFDHVSPSPSKVLESPPHTAIFYASPTSKNFQDIHSYLYKASTASPPRLEYIFRHIPPQTGPTDRSKSYLSGYGVTLDLKKTDYLAVDDRQTNGQGIRGAHDPYCYVLIRCPGKLSEKVETDESEAEEDFIFSLLTSQPENTTTELNSPLSTDELLLIDYQATQLITNSSNPLLAFTQLSQNFPRYSTSVARRVQLNDSVLEEIQRNNLKVQAGASQVWLNGLALQDADINPYGLLRLLRKERTTVLSLTSLGLTPSQALELLTHRAIGMSQSDSGVLDGLCDASDRPEGGSVIVWWNDITKDSRYVRWNPSLSGLLRPIYPGQFHNVKQNLFNVVIVADLSQTTALHFITNTMNMIIQRGFPFRFGVVPISETEAGRKMARAFYHSIDTYGRARTMSLLSRVSQLVMPSEYYVDISVVESELQALQNRDSPEEGESQVDAQILLDLNEELAVDERVSKAKEYATRMDSTLASSLTGHVFVNGKHFNLDDDFLKHMQTEIGHQLQHLQEKVFANEISDDSGEDVSTYFYDLPGTEKRRSQYVYPAPGTGSLRIFNLPEVFSKAGLTIESSAYLYPESGQLPLSTYVIADFDSDEGIELMKEALKSLPDSSSRLAFIHNPSSRVNASGTHHRHFSPFLVPLATEGLLWKLSGSEIMEFLEGHVVPEDSSNQVVMEADSPITRLIRSAGLNPNTVAESEIYKQSCHASALLVRDLGVLPGQRMVIVNGRMVGPIVGNTFLADDFKALQNFELRRRVAPVLDALANITVSAETFDRITYSNIVSSASSVISAVRLPDPSEQGLLNTAQRPRNRNYRLLESNYTFFDFGDKDSALYNLGFLIDPLSDGAPKTAAIMKWLATLPSVYVEVYLNPIARQEVPLKRFYRYNLSPTLSFDDSGSEIPAQIVFDDLPEEPIYTLGMDVYPSWLVRPREALYDLDNIQLSTLSDEDRSTGLEAIFELDYIVIEGHARETLTNAPPRGLQLQLNTIDNKVVDDTLVAANLGYFQFKAKPGVFNLEIREGRGRDVFEMESVGNEGWDSPDIEVVGQDITLTSFEGVTLYPRFKRQPGMQRSDVLDEFVLGETEKKGFFSDLTSRFSSFFRPNKSESTELVKKQADINIFTVASGLLYERFASIMILSVLRNTESTVKFWFIENFLSPSFLEFLPHFAEAYDFEYELITYKWPSWLRAQTEKQRIIWAYKILFLDVLFPMDLKKVIFVDADQIVRADLQELVDLDLQGAPYGYTPMGDDNVEMEGFRFWKTGYWKDFLRDRPYHISALYVVDLVRFRQMAAGDILRAQYQTLSQDPNSLANLDQDLPNNIQREVPIFSLHEDWLWCETWCSKDRLHRAKTIDLCQNPLTKEPKLSRARQIPEWETYDAEIARFARKLADEGKLRSHVATADANVLANANNANPSVDADADSSAADEGASRSADGEEKESGETHGEEDIAEARVSEVASNRHEHVEL

SEQ ID NO: 3773 - protein, 1348 aa, Camelus ferus
MIEYLLCLQNPRKEPVYLSGYGVELAIKSTEYKAKDDTQVKGTEVNTTVIGENDPIDEVQGFLFGKLRDLHPDLKGQLKELRKHLVESTNEMAPLKVWQLQDLSFQTAARILAAPVELALVIMKDLSQNFPTKARYVNNSPSFLGEEEELNGGDINQQKLQYGPKVMFLMGQAGLRAVRAAQSTCAPPPSQGAGVGGPHRGLQPGESALFINGLHIDLETQDIFRAIVFLSTMGTEKSRVFGFWDNVTLFDTLRNEARVMEGLHRLGIEGLSLHNVLKLNIQPSEADYAVDIRSPAISWINNLEVDSRYNSWPSSLQELLRPTFPGVIRQIRKNLHNMLLKRQEQVFLVDPAHESTAELMNTAEMFLSNHIPLRLGLIFVVNDSEDVDGMQDAGVAVLRAYNYVAQEVDDYHAFQTLTHIYNKVRTGEKVKVEHVVSVLEKKYPYVEVNSILGVDSAYDQNRKEARAYYEQTGVGPLPVVLFNGMPFEKEQLDPDELETITMHKILETTTFFQRAVYLGELAHDRDVVEYIMNQPNVVPRINSRILTAEREYLDLTAANDSFIRPTSNYAKNFITKMAKEETAEALAAGVDIREFSVGGMDFSLFKEVFESSKMDFILSHAMYCRDVLKLKKGQRAVISNGRVIGPLADSELFNQDDFHLLENIILKTSGQKIKSHVQQLRVEEDVVFVMPGRLHLAVAPGTAMHNPDLQPAGRFSSRKLSCGLFGHGVHPSPRNQMPIDVFCDSVDTSQETHGLFYMYFRVRSEKCQERASDLVMKVDALLSAQPKGDARIEYQFFEDRHSTIKLKPKEGETYFDVVAIVDPVTREAQRLAPLLLVLTQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSAQPVIVDTIVMANLGYFQLKANPGAWILRLRKGRSEDIYRIYSHDGTDSPPDADEVVVVLNNFKSKIIKVKVQKKADMVNEDLLSDGTNENESGFWDSFKWGFTGGQKAEEVKQDKDDIINIFSVASGHLYERFLRLVMLTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQCNNPMTKEPKLEAAVRIVPEWQDYDQEIKQLQTRFQEEKESGTLFRDKTTKEPSREAKSTPGLHAAFLTSVHGRSSGALPKGCTARVCATRGIRFPIKLKPHNNRVSSGSARGKLIWG

SEQ ID NO: 3774 - protein, 1620 aa, Suillus luteus
MHLGALVVLGCALLALSTSPPVSVSLRSSFSAADPLLEALETLALASPEHLFSLLNHFPLPLKPATPEESHRSVLDLAKKYLPLPEIAAMNVGLALHAASPKLAAQHIRESGREGCEDWVDWYGRIACNAEELRLFVETSVAGSDFESQPKLKRLPTDHTPHLQPSLDAPRLTAIHYADPMAPEFNLLHSTLLSLSPDVEYVLRWARPVIATDGPYLSGFGVALDLKKMDYLAVDDRKRAASTSGDHLAGNESQEDNEHDVLSCIFEAMSYIDTEMEKNATTNNPLSTEEIQDLGLKATSLFSLLSNPASSPPVISSCLLKNSLTPLHILNTLSTNFPRYAAPLARKVRVPDAVRDEVQENWVKAMMGINMVWVNGRVLEGEAGIFGLLRNFARERALIRSLVELGLSRSQAIEFAVHPVHSGPFDPSPSKLKVKKGTMFGSAKRFAEEVLRTDTEHNVEAEALIEGQKKYDISPKWNDLLDGLVDSSDRLEGGSVILWRNDIEEDTKYADWGTDLTQLLRMHPSQLFNPYLRLRINVINVVLALDFSQPRFFSLIANQVDNIVARGFPVRWGFVPVAVDHGDGLKMARIIYYVAQKFSRLEVASFFRSLSAAHTQQQLPTLSWSIVHATFNTLGTADNFGDIASGKVPSVEEALDSARRWTRRLGVSGRDGEGFVNGRWYEVGDNFLRDLQTEAVGQMQLLQELVYLEELTSASVSLVSTFFYDLPTTLSSRNPYIFSKAPASVHAPSSSIGNLKMFDLGDLSNRTGWSPFTCAWVTSDAERTPVSMVVIANLDSAEGQALVREAVTFVSVKSQSRITFLHNPTAGSPRGNVSSFFAHIGSTSNLGEISSNMFKRALDNFETQDAAQVFIAEGITLQSDPQAHTAFLTTSRLLVREAGLRPGEQAIIVNGRLIGPFSPTSEFVSEDFATLETYEMKKRVGRVAQAIEDVLADGTELDALAYANLVSVASSIIYADQQPDPSEAGLFDSAPRARNSNYRLLSGSYTKFEFGDRENALTHLVLLLDPLSEGAQKWIAILEKHEELFPEVYFELYLNPAQHSEIPLKRFYRYSVEPRVRYDNKGNEIPAQVIFNGLPVDPIYTLGMEVPPSWLVRPREALYDLDNIQPSTLPPDGLHALFSLDYLVVEGHARETKSNSPPRGVQLQLTTSSSAANNTPSVVDDTQVVANLGYLQFKARPGTFNLTIREGGGREVYHIASVGSEGWNSPSVEDSGEELTVMSFEGLTLYPRLSRKPGMEKADVLAGLQQRSGHSQTVIHDILSKVSSLFTSKSESTTAVAETGARQADINIFTVASGLLYERFASIMILSVLRNTNSTVKFWFIENFLSPSFLEFIPHMAEEYGFQYELVTYKWPSWLRAQKEKQRVIWAYKILFLDVLFPMDLNKVIFVDADQIVRVDLQELVDLDLHGAPYGYTPMGDDNYEMEGFRFWKTGYWKDFLGDLPYHISALYVVDLVRFRQMAAGDILRGQYQMLSADPNSLANLDQDLPNNIQRDVPIFSLPEDWLWCETWCGADRLHRAKTIDLCQNPLTKEPKLSRARRIPEWEEYDNEIAQFAGRLAAEGKIQSSIATARSDVLANVGLVQPAHNNDVGGKDLQHPHDEL

SEQ ID NO: 3775 - protein, 1410 aa, Pichia kudriavzevii
MILGDFATFSLALLSIIGACVAETEIPPENAVDISLAASWNRTPYKLNVLEAAASVNESLYEPLVLKLLNIEPDYDNGEFNADEDYIEVSDSDFLNHAMSLLHGDYEKYMFNLQLSNHLSTARINAHFQYYNTSVKDTHECDVDAVLFEPLGPSPQHYCDPDAAFMLQNANYAFIFDTFKLPFDRRLGSTFTPSSYIIYGDYRDETFRKMFLNMYQFAGTGKLNLVWRYVNTHPDNRPELLAGYGAALNLKKTDYIAIDDSGFTQEQESKLLELGSNNKDETVNITDIYRHNFEKVQKVDLEDLSTIGLKFTKLISESKSQFKDLMTILAEFPKYARTISKIGYSEDELKAVAGVADEDYGKFVENGIYINDALVPVEKTDLFEIFRAIKREVSFIKLLQAIDIHYDDARTLMSRFAQMISPYFASTKRRFNFSRYDDLVVYLNNIEEDYKYSLFDSTIDAYIKKPDVNELPRAKENIHQMIFIIDLTDLEKLENLISFLRTMFIEAFPIQFGVVPLSTSNELNEKITSQLYSAYAEDGREGAFKYLITLRSSLAGENHHPPDNFSQLEEPLLKERLEKLGLFYKNFGIDHEMPTIFSNGVVFGFHKVVDALNNVFDDMLYLYDMKSQIGEGETYSEFLRKDSVHSKDTNIVPERISQIKGNFIKPPSIIASKHWFSTDRLIIEKPIIPGQAPITINLLGSFFNTEYIRQVEEVLRYSQTNEGIKIVISDVTPTKDFKKLLQLQTVEEKISFLSTLVESDTEDNYKIRDYVRFCKEMFGLNFEKEYLNAYIVVAGRKVQIKNFMDVHSIESLVHYECASRLNVLKELENEFDYNVPFKNEYDRFQHFAWVVSYTYFFPAPEPYSASNIPRFHRYKFSEENTIIKQAKDELIEVDILIDPVSEYAQELVSFIPLFEKESFITLKVHLRPKRSVDILPINRFYKELVNTDVNQVSEKIRFEKVPEKTLFNVELHETQRWLVSINNASTDLDNLMLDLTDSKSAFGEFLLENILVEGYTSNDATGLPLEISGPSKYETTVLANTYFQLKANPGTWTIKIKDYTKGSLVYMMPEEVKTISVIELDGTIIDLDVQKRWLMESISLRKMYAYFFETMDFIYSFIKPTQADINIFSIASGHLYERFLGVMVSSVMKNTNSSVKFWFIENYMSPDFKKKLPLLSEKYGFDYELIMYKWPVWLDSQRERQRTIWGYKILFLDLLFPQDLKKVIYVDADQIVRADLKELVDIDLEGAPYGYVPMCDSKKEMESFRFWKTGYWKEFLGLKYKYHISALYVVDLEKLREVAGGDILRQQYQYLSKDPESLSNLDQDLPNLLQPHLKIYSLSQEWLWCETWCSNDTLKDAKTIDLCNNPQTKEPKLNRAKRQIQEWVELDQENMILFSGSTEVLKEDLGHDEL

SEQ ID NO: 3776 - protein, 1631 aa, Ananas comosus
MERLRLRSSSSKAVVVSLLLLFLLFGFAGNLAGAETPRPKNVQASLRAKWAGTPLLLEANELLSKEWKNLFWEFIDLWIEPDKGSECLTAKCCLQKIVEDAQSLLSESLGSVFEFSLTLRSASPRLELYRKLAQDSLYSSDYGKSEQVNNDANEEHFQKNTNPISGGTCCWVDTGNVLLTNVSGLLQWLEDSSKLAVDSSEQPELFEFDHVYPHSSITGPVAILYGAVGTECFKEFHVILVEASKKGKVKYVLRPVLPSGCQAKSSYCSAVGSVDAVTLAGYGVELALKNMEYKAMDDTAVNKGVTSEDSRTEDLSQEVRGFIISKILERKPELTTEVMAFRDYLLSSTISDTLEVWELKDLGHQTAQRIVHASDPLLSMQEINQNFPSVVSSLSRMKLDASIKDEILANQRMVPPGKSLMALNGALISIEDIDLYLLMDLVHEELSLADQFSKVQIPQSTIQKLLSAAPPVDSNAFRVDFRSSHVHYLNNLEEDNMYKRWRSNINEILMPVFPGQLHYIRKNLFHAVYVLDPATPCGVETIDMLLSLYQSSVPMRFGVILYSSKLVNIIEENGGNLPSLSDGTKNREDISSLIIRLFLYIKETYTTHLAFEFLSNIQKQWSDVDNFNEEMLEAHHVEGAFVDTLLSKAKSPPQDVLLKIEKETKYKEAAEESSLVVFKQGLFKLRCCLLMNGLVYEPTEDSTMHAMNEELPRIQEQVYYGHINSHTDVLDKFLSESGYGRYNPSIIGDDKGKKKFVSLFASFLQSDSVLHDIAYLHSHGSVDDLKPVTHLLAVNVASRSGLKVLHEGIRYLMGGSERARIGLLLYVAGDASRSAFLLDKIFGKTASSFSNKEKVFDFLHELCTFYENLYMSGSLVDSDGVSIISEKVYELAGENGLPVEEYEAIFTSFSFDKDQEKRDKVSNFLFGQLGLEFGSNAVITNGRIFTLNDGNSFLSDDLGLLDSVEYNLRIKYIVDIIEEVEWVDVDPDYLTSKFYSDLVMVVSSSLSIRERSSERARFEILNGEHSAVILNGVNSSIHIDAVIDPLSPAGQKLSPLLLVLWRRIHPSMRIVLNPISSLADLPLKNYYRFVLPSMDDYSTTDYSVHGPKAFFPNMPLSKTLTMNIDVPEPWLVEPVVAIHDLDNILLENLHDVRTLQAVFELEALLLTGHCSEKDRDPPRGLQLILGTKQRPHLVDTLVMANLGYWQMKVSPGVWYLQLAPGRSSELYMLKETGNGNKSYPSSKLITINDFRGKLIHLEVQKRRGKEHEDLLNASGDDQLQEKKKESNNRWNTNILKWASGLIGGNGSSRKQNETILDLKGGRHGETINIFSVASGHLYERFLKIMILSVLKNTLRPVKFWFIKNYLSPPFKDVIPYMAQEYGFEYELITYKWPTWLHKQKEKQRIIWAYKILFLDVIFPLSLKKVIFVDADQVVRADMGELYDMDLKGRPLAYTPFCDNNKEMDGYRFWRQGFWKDHLRGKPYHISALYVVDLVKFRQMAAGDTLRVYYETLSKDPNSLSNLDQDLPNYAQHTVPIFSLPQEWLWCESWCGNATKSRAKTIDLCNNPMTKEPKLQGARRIISEWVDLDAEGRRVTEKILGEQLEPPESVPPPPPDSSKGDNNEDTESKSEL

SEQ ID NO: 3777 - protein, 1662 aa, Papaver somniferum
MGLRSRSVRYITVWVLIVTIVISLSGSPVASENRRPKNVEVALRAKWSGTPLLLEAGELLSKEWKDLFWEFIEVWLRSENDSETSSAKHCAKKIAKLGRSLLSEPLSSIFEFSLTLRSSSPRLVLYRQLAEESISSFPQADESNSRHVAADTLEEGVESFGSKGADNMLIGMNPEGPNGKCCWVDTGAVLYSDVSELQLWLDSHTGSSGDSFEPPEIYDFDHVHFDSITESPVAILYGALGTNCFKAFHVVLAEASRKGRVKYVVRPVLPSGCEATTGSCGAVGTGDALNLGGYGVELALKNMEYKAMDDSAIKKGVTLEDPQTEDLTQDVRGFIFSKILERKPEMTAEIMAFRDYLLSSTVSETLDVWELKDLGHQTAQRIVHASDPLQSMQEINQNFPTVVSSLSRMKINESIKEEILANQRMIPPGKSLMAVNGALINIEDIDLYLLLDMVHQEISLADQFSKLKIPRQTIKKLLSTLPPSEASSFRVDFRSTHVRYLNNLEEDDLYKRWRSNLNDVGPYFCYMWIQSSFISILAIMLLSVGLRQASFSDYFQFVIIVFLLRLLRFVVFFFHFGIFQSVDTILSMYENNFPIRFGVILYSAKLIKKIEEHAGELPLSSAGKDDSMEDISSLITRLFLYIEENHGPRLAFQFLSNVNKLRSEEDLTEETLEVHHVEGAFIETILPKVKSPPQDVLLKLQKELTFKERAEESSLLVFNLGLFKLKCCLLMNGLVSESTEDAVVNAMNDELPRIQEQVYYGHINSHTDVLDHFLAENGYRRYNPQIIGEGKNKKKFKSLAASILGSDSVLNDISYLHSPGTVDDVKPVTHLLVVNLTSKKGINLLREGIHYLMGGSKRARLGALFTTADVAGSPTPLFVNVFRFTVAKFSYKKNVLEFLDQLCVLFERDNLFTVEKVIELAKANNLPVEEFEASLSDVSKELVRSHLDKVSQFLYREMGLDFGATGVITNGRIMLPARGSTFSRYDLDLLESVEFGQRIKHIMEAVEETKLDDMDPDILTSKFLSDLIMFVSSSMAMRERSSESARFEVLNAKYSAVVFNNDDASIHIDAVIDPLSPLGQKLAPLLRLLSKFVQPSMRIVLNPMSSLVDIPLKNYYRFVLPTMDDFSSSDFAINGPKAFFANMPLSKTLTMNLDVPEPWLVQPVIAVYDLDNIVLENLGDTRTLQAVYELESLVLTGHCSEKDHEAPRGLQLILGTKSRAHLVDTLVMANLGYFQMKASPGVWYLQLAPGRSSDLYVLEEHEDGDEVLPFRKQITIDDLRGKLVHLEVVKKKGREHDQLLSSSDDANTLDERKGNSKSWNTNLLKWASGLIGGSEHEKRKGGSVERKDGRHGKTINIFSVASGHLYERFLKIMILSVLKNTHRPVKFWFIKNYLSPQFKNIIPHMAREYGFEYELITYKWPTWLHKQKEKQRIIWAYKILFLDVIFPLSLEKVIFVDADQIVRADMGELYDMDMKGKPYGYTPFCDNNKDMDGFRFWRQGFWKEHLRGRPYHISALYVVDLLKFRQTAAGDNLRVFYETLSKDPNSLSNLDQDLPNYAQHTVPIFSLPQEWLWCESWCGNSTKARAKTIDLCNNPMTKEPKLQGAKRIVTEWPDLDLEARRFTARITGEEIDDAKETITTSTQAKSEASSIVEEDKESKSEL

SEQ ID NO: 3778 - protein, 1493 aa, Unknown
  Description of Unknown: AAM60110.1 Sequence 16 from patent US 6399321 sequence
MNLTGLLIFFCHIAVLAALEKKGVHTSLKANWDSTSLLAEASEFIAEENEKLFVKFIDIVNKDVGTLNWEKLTDEQKYEYTIKTAGKVLSTSSVDLLKFALALRQYSPRVQSFQQIAVEYGEKCDVFVVVGEQVSCEYTKLEKMIKDAKTNSQVLESDHIFGEKDLKQAAILYGELGTTSFAKAWEKLSKLQKTKLIFRHFSKKTDSHPVSLSGYGVELAIKNTEYKAVDESSEKKNVEEDEADLFGFNIKLLKELHPDSVDAIESFRVNLKESDELTPLKRWELQDLSYQAAQKIVNAGPADAIGTLEEYSQNFPTHARALAKTSVSDLLRKEVLQNRKMLEKASIEVGETSLYINGINQDINSLDLFKLADLLKQENKLADGFHSMGINREYLSILVGMDTSDDEKTTYAVDHREGYPFFINNLDTDKKYKQWGNSVKLMLQPYYPGMIRPIARNLFSLVFVVDPSTSEGRKFLRIGQTFNSHDIAMRIGYIFAVNQDTKASGETDLGVALLNLFNFVSIDSSNADALKVLNNFLDDYRSKDPTIEDIKEFFEAKFSDASFSDVFGVNSDYDKGRKHGFEFVQKTGLNSAPKVLLNGFILDDEGVRGDNIEETIMMEVMKISPKIQRAIMEGKLTDRMNVGNWVLEQKDVMPRINKRILSAPSKKTYVEILGSMDCKSLKDVENLSDSDKAGCLLQTTKYLQKASADSILPVTLWVVADAEAASGRRFIYNSLQILKNSANSRVGIIFNPESVEKACESNSISSYIRAALDFLPMDQAKRLILKLSNEEYAADFISGKITFDDLSVGGMDTAKFLADKKKLDCERTRLESQIVKKVLDISSGGRVVVGNALQVGPLESSEHFEAADFKLLESMLLSRGAEVISSHLKKWEFDVSNGVGSNTVFSIAGHVGKHASSQKRTWVSIQGDEHSVVTLPADEMDRPAVDVLAVVDPLTMEAQKLGSILHLIKKVTNCEIKIVMNPKDKHSELPLKRFYRYAAASELSFDHNGNLNTNVVRFDNLPSKQLLTLSLQAPDSWIVEAVSAKYDLDNIKMEQANGDVTAEFALQHLLLDGQCFDEVSGQPPRGLQFTLGTDKNPKQFDTIVMANLGYFQLKANPGAWKLEIRDGKSSEIYKIGSHVGAEKIGEDVLQVVIDSFTGKSVRVRVEKREGMEERNLLSDDEEGVWSSLSNLVSSKEKTQEVINVFSLASGHLYERFMRIMIVSVMKNTKHPVKFWLLKNYLSPQFKETLPTLAKHYGFEYELIEYKWPRWLHQQKEKQRIMWGFKILFLDVLFPLDVQKVIFVDADQVVRADLMELMKFDLGNAPYGYVPFCESRKEMDGFRFWKQGYWANHLAGRRYHISALYVIDLQKFRQIAAGDRLRGQYQGLSGDPNSLANLDQDLPNNMIHQVKIKSLPQEWLWCETWCDDGSKKNAKTIDLCNNPLTKEPKLDSAARIIGEWKTYDDEIREVISGHSSDNPSDNVISENDDSHTEL

SEQ ID NO: 3779 - protein, 713 aa, Danaus plexippus
PELVPALNKYEWVLKASRVLCARSLKLRGSERAVIHNARVIGPFNKGESFSLEDFALLERYSNQVYGDKLSELLHQNKKLSNNVLDDDDDITDISTDNYLKVISVLASRSPRVRTPLPSGLRTDHSVIELPPLYEDEAAVEIVAVVDPASAAAQRLAPLLLVLRRVVNCRLQLFLNPQDKNSDMPLKSFYRYVLEPELQFNSAGAQTGGAIARFSRLPHAPLLSLELRTPPNWLVECVKSVYDLDNIRLADVESLVHSEFELEYLLVEGHAWDTSLGTPPRGLQLVLGTRHRPDTVDTIVMANLGYFQLKANPGAWTLRLRPGRSDDIYEIVGHENTDTPAGSKDIQVLMSSFRSQVIKLRVTKKADKQHLDLLAENDEKNAGGIWNSIASSFGGGEEQEAQDETINVFSVASGHLYERFLRIMMLSVLKNTKSPVKFWFLKNYLSPSLKDILPYMAQEYGFQYELVQYQWPRWLQRQRDRQRTIWGYKILFLDVLFPLDVKKIIFVDADQIVRADLKELVDLDLGGAPYGYTPFCDSRKEMEGFRFWKQGYWRNHLQGRSYHISALYVVDLKRFRRIAAGDRLRGQYQALSQDPNSLSNLDQDLPNNMIHQVAIKSLPQEWLWCETWCDNESKKYAKTIDLCNNPMTKEAKLSAAMRIVPEWSDYDNELRALHARVRQGHYQDDTEQEIETHEHEQVSKEDKTDKAQEHTEL

SEQ ID NO: 3780 - protein, 1408 aa, Chlorella variabilis
MAPSLGWRHRAPAATAAVALLLLAALAGVPAARAARRETKGVKITVQAKWQATPLLHEAAEFLADEVPALFWRFVEEWQRGSEALGGAPSPQQCWAGIRQAAAAHLSPNMARLFSAALAARQYSPRLEMFRQLAWESVAAAPACCWALLGGAAYTEAAPLEAALAAALQAKAAALREGAGRGVEGGAGAVYPFDHIYAAAASSAPPLNITAPATVPVELFAPIGSRCGAQLHAVLAAAAERADAAAAAAAAPAAAPRLAYAWRPLLDAAACSAAGEGVVHPCTALGTEGRLVVPGYGVELALKNMEYNAQDDSKKVNNLEQDRQYQRWPRELQTLLMPMYPGRLPTVARNVLNAVYAFDPASPAALDIGALLHQLQQQAWPLRTGLLPVVAARVARARGGAGPRPDDAPSLSERMGRLLGAVHAAFGGRAAVHFLYAVRQAMPAQADGQADFDDRLWLEAVRAAEEQWAGWGELAEVEEGPVATAAEAVVMAERAGEAGSKEVAARLQAAAELAHSTGLAGPARSGVLVFNGVVSTNDGGSGWHGVTMGAVQSQLQQVQEDVYMQRLTDAAVDIYEEEYQARQLALAGPLLGLNATSPPAAGGGGGGLWIRYFGPQPSLAAEEEEASGPAPLAAVTHWVAADAGSRQGLRLVAAGLQHRSSNGRLGVVVNSGAGTAAPGADAAAQLLPVEKVVVAVGSGLLETDLNDFVDGLDAVVQQPQAPAALTLAQLDELLQARRRGGFEGRLEPALSGLGASLGQAAASQAGFVRRALGLGAGANAVVSNGRVVELPAEPPSGGDDAAGSGAEFEPHDFELLELYAQRNQYSERMAELVRSASQFGALRGVDLSAAAAVVSSALAAAKPEEVDARSGRVSELISGRSVQKNFVRVAAAGPADSAPLLVQAVVNPLSKPAQRLAPLLAFLRGVLDVDREYHDMPLKTFYRYALPTLGSPDGGPPAPAAATFTRLPPNKVLTLGMDEPEPWLVEPVQAEADLDNLRLEELGPGVAAAEAVFELEALMLTGMCLDLASLAARMREQIHPRGVQLQLQALSAPEAAPPLVDTLVMSNLGYFQLKAGPGLWKLKLAPGRSQELYSVASSTGASSSGQRAEAAVAGADAHQVPVAMSSFGGKHMHLFLRKHADRLSEDVLEAEEGEPGKGSLWSKVTSWAGSGGGGVPAPEGEGERETIHVFTVASGHMYERLQKIMILSVIKRTPARVKFWFIKNYMSPQMKAFVPFMAEKYDFDYEFVTYKWPSWLHKQTEKQRIIWAYKILFLDVLFPLGLKKVIFCDSDQVVRADLRELWHMDLQGAPYGYTPFCDNNKEMEGFRFWKQGFWREHLQGRPYHISALYVIDLERFRQMAAGDRLRVIYDGLSKDPNSLANLDQDLPNYAQHGVPIFSLPSEWLWCET

SEQ ID NO: 3781 - protein, 1539 aa, Pogona vitticeps
MVISDKMEVLIVLIGLWVNFSVVKADSKAVTTSLTTKWFSTPLLLEASEFLAEDSQEKFWNFVETCQDFGSSNHDGTDYSTYNAMLQAASKNLSPLQQNLLKFALSLRSYSATVQAFQQIAADEPPPERCNAFFVVHGEKTCTSDRLGMLLQTALERPKPFVFKGDHKYPGSNPEGPIVILYAEIGSEDFSKFHKLLVSKVNAGKITYLLRHYVANPSKEKVYLSGYGVELAIKSTEYKAKDDTQVKGTDMNATVIGENDPIDEVQGFLFGKLSQLHPTLKEELKELRKHLVESTNEMAPLKVWQLQDLSFQTAARILAAPTMDTLMVMKDLSQNFPTKARAITKTVVPSELRSEIEENQKYFKGTLGLQLGDSALFINGLHIDLDTQDIFSLFDVLRNEARVMEGLHSLGIVGLSMHNVLKLNIQPSDSDYAVDIRSTAISWINNLEVDSRYNSWPSSVQELLRPTFPGVIRQIRKNFHNLVLIIDPSHENSAELLTVAEMFLSNYIPLRIGLVFVVDDSEDVDGLQDAGVALLRAYNYVAQEVDNNYAFQTVISIYNQVNAGETLKVEHVVSILEKQYPYVEVNSILGADSAYDQNRKEGHNYYQQTGVGPLPILLFNGMPLQKEQLDPDELETVTMHKILETTSFFQRAVYLGELSNDQDVVEYIMNQPNVVPRINSRILMSDREYLDLTGTNNFYIDDYARFTVLDSKDKTAAVANSMTYLTKKGMSSKEIYDDSFIRPVTFWIVGDFDKPSGRQLLYDAIRHQKSSNYVRIGMINNPSKDPASENTFIARAIWAALQTQTSNNAKNFITKLTKEENAKMLEAGADITEFAVGGMDIAAFKAAFESSKADFILSHAVYSRDVLKLKKGQRAVISNGRIIGPLENDELFNQDDFHLLENIILKTSGQKIKSHIQQLGVEEDLASDLVMKVDALLSAQPKGEARIEYHFFEDRHSAIKLRPKEGETYYDVVAIVDPTTRDAQRLAPLLMVLTKLINMNLRVFMNCQSKLSEMPLKSFYRYVLEPEITFTSDKALVPGPVAKFLDMPQSPLFTLNLNTPESWMVEAVRTSYDLDNIYLEEVESVVAAEYELEHLLLEGHCYDITTGQPPRGLQFTLGTSTNPVVVDTIVMANLGYFQLKANPGAWILRLRKGRSDDIYRIYSHDGTDSPPDASDVVVVISNFKSKIIKVKVQKKLDMINEDLLSDGTSENESGFWESFKWGFTGGQKKEEVKQDKDDVINIFSVASGHLYERFLRIMMLSVLKHTQTPVKFWFLKNYLSPSFKEFIPYMAEKYNFQYELVQYKWPRWLHQQTEKQRIIWGYKILFLDVLFPLAVDKFLFVDADQIVRTDLKELRDFNLDGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKKAKTIDLCNNPMTKEPKLQAAMRIVPEWKDYDQEIKQLYSRFHQEKESGTPSTKNETKQQSRAENAHVEL

SEQ ID NO: 3782 - protein, 1714 aa, Pseudozyma hubeiensis
MSLSHRVEVAARLHQLIDPRPAQALVAVAVVQAIMRALPLLGVSWAWLALTLALTIPTSPVNADSPPVKVQLRASWSKISLPSGGSPFLLEVLEAARAQQSSSFFPLIELLTSRYHPNELLHASDEGVAATVEKLIRAHQLFGSSPDQAEEALDTWRMSLALSNSSPRIQALVQLYETLGLDKVWRKGSGEESCVTWVHHNDQVLCSAEDVQKATQEGRSGTSMQGQGEEVVLGHSRKKNGSKAAAASSFVLYADPYSGNFRELFTALEQHSSHPDVDFTYTIRWRPSMRTKENSTKHVDSHAEAVQPLSGYGAILDLKKVDYLVIDDRKLKDDSNIGDVGISSTSQTDQSTAAQRASDDTQWLQDQIGADSEAAIVKLSSLTDDQIADLGIKAARLIMDSSDPLRALQELSQNFPSHAPALAESTRWDHAEASAGLVDSVLNLASMRIEPGHSDLWLNGQSTNARDFMPLTLLETLRKERGWNHALQHHLAGGGLNVTQAGDLISSSLVGRAYLAQADGDAAAAIFDASDRIETKNAPQGTSVGAITWLNDLENDEATSEWSNDLMDLLRPMWPGKFPRLSLNLFNVVLVMDLSQKETCRFLSETVMQSLGRVGLHWGLVPGGVEDETNANSIRMARLFWFLLDQAGAQVTSDVLRKAAASKAGSAGAIDVALAVKEAKFALKSIDAEDPLTDQLDKALAGDVDEYAQRETLGRAYVQRLRAHRHESPAGHVFVNGQHQPFHPQIVHILHQAIQKQIQVLAPQVYYGQINSSTPGLDTFFYDSVGALSFRSALVAGATSSSDGGQEGGVTHSAVDLLSALVNDAELAPMVDKVFDFFYPSAAQDSLNSTVWVLADLDSPDGLALLTRSLKALARDDAKFRLGVLHRPATTNDRATAVSTLLFRLLVEGRYEQLSAQTILTVLQQAKDDPAVTSQQLMAALGMPAVDSMVELDASHFWRSLGSTTASKLDIPDGPAILVDGHLVSNLDMSSIEARDITALVEYEAGQKLPYITQALKLIRHDVDDMPPKQRQNLIFAALSVMNGVYDQAGQGAFAAKASSRSGLPEQLGTADHVFEIGDRETADVRITVLLNPVSEAAQRWSSILLMLRELKGTHLRVILNPEVRLRELPLKRFYRFSAPHRLEFDGEGQVVPPELRFFDMPEEAVLTLGLDAPAPWLTMPVEAVYDLDNIRLADVPSTSRAKGVKAVYELKHLLIEGHAREEVAGSAVSVPRGLQLLLETPDASKSLDTIVMANLAYFQFKAQPGLWRLRIRSGRSDELYEMQSVGSQGWSSPPVERTGDYVTLDTLSGLTIYPRVAKRPGKEREELLEELDASGRPMKKQRAESMDGGLAASASVAGQLFLSAKDKVASLARQVTGSTSQGNTAVAPIRKHADINIFTVASGHLYERMTYIMILSVLKHTSSSVKFWFIENFLSSSFKEFIPHLAAEYGFEYELVTYAWPHWLRSQKEKQRTIWGYKILFLDTLFPLDLGKVIFVDADQVVRTDMKELVDLDLEGKVYGYPPMGDDSEDMDGFRFWKQGYWKDYLRGRPYHISALYVVDLQRFRLFAAGDRLRGQYQALSADPNSLSNLDQDLPNNMQASLPIHTLDKEWLWCETWCSRDWLKDAKTIDLCSNPKTKEPKLDRAKRQIPEWTVYDEEVARLAQRLVEEKRVGSSVVAPDSQVATRAGQQEEVVEPKDAQTKDEADPPLHDEL

SEQ ID NO: 3783 - protein, 1405 aa, Ornithorhynchus anatinus
MFQQIAADEPPPEGCSAFVVIHEQHTCKTKEIKKLLRKAAERPRPYLFKGDHKYPKINENVPVAILYAEMGTKDFVKFHKILAEKAQNQEIMYVFRHYVQKPKSKKMYLSGYGVELAIKSTEYKVMDDSQVKATNETDLEEDNEENEVQGFLFGKLNKIHPDLKDNLKELRKHLIESTKEMVPLKVWELQDISFQAASQIMSTRVYDALKLMKDISQNFPIKARSLTRIAVNQDMRKEIEENQKNFPEVLGIQPGDARLFINGLHIDLDLHDPFSILEILKSDGKVMHGLHDLGLNEEDLSRLLRLNTHPTDVSYALDIRHPSIIWINDIEKDDMYKLWPTSCRELLKPIFPGSIHQIRRNFYNLVLFVDPVQEMAADFVKVAELFYHHKIPLRIGFVFILNTDEKVDGKDDAGVALWRTFNYFAEEDDITRAFISIVNMYHKVKKGETLTVDNVKSVLQNEFPHADLQEILGVDSEYDEKRKAGATFHKMTGLGSLPQALFNGVPFKSEEVDAEEMETVILQKIMDATEFFQRAVFMGLLNDQMDAIDFLMDQSNVVSRISPLVLGTERRYLNLISTSVSVDIQDFSTFSYLDSQDKSAVIARNMRYLTKKDEDVISPVTIWIIADFDKSSGRQLLSNALKHMKTTSHTRLGVICNPTSKLNEENTAISRGILAAFLTQKNKHLRNFLNRLTKEETVKEIANGVKIKKFLLPGMDVNAFEKKYNTLGVDIIQTHKLFCQEVLELFPGKMAVVSNGRVLGPLAENYFYTEDFRLLEKITFRTSAEKIKTIIKDMKVNSESGSDLVMKVDALLSSSPKRMSRQQVKFLKEQHSIIKINPQENDAFYDVVAIVDPLSREAQKMAHVLIVLGQIVNMKLTIFMNCRSKLSEVPLKSFYRFVLESELKMEPSGILTSGPMAKFLEMPESPLLTLNMITPDNWLVEAVYSSCDLDNIHLEGIEGTVTAEYELENLLLEGHCFDISSAQPPRGLQFTLGMKNKPAMLDTIVMANLGYFQLKANPGAWTLRLRKGKSEDIYHIIGHEGADSPSDSDDVIVVLSNFKSKILKVQVQKKPDKINEDLLSDKNKENQRIWDSISSSVEGIQIEEKDQSNQDFLNIFSVASGHLYERFLRIMMLSVLRHTTTPVKFWFLKNYLSPTFKDIIPHMAEEYGFHYELVQYRWPRWLHQQTEKQRIIWGYKILFLDVLFPLAVDKIIFVDADQIVRADLKELRDLDLGGAPYGYTPFCDSRTEMDGYRFWKTGYWASHLGKRKYHISALYVVDLKKFRKIAAGDRLRGQYQALSQDPNSLSNLDQDLPNNMIHQVAIKSLPQEWLWCETWCDDKSKKQAKTIDLCNNPQTKEPKLEAAARIVPEWSEYDTELRQLIQRTEEGKKSSSKPTSKKGFQRDEL

SEQ ID NO: 3784 - protein, 1614 aa, Cynara cardunculus
METRIRSGLRILLLIAVCIIVCGYSVSAETQRPKNVQVALRAKWPGTSLLLEAGELLSREWKDLFWEFIDVWLNNESGNTDPYTAKDCLQKICNYGKSLVTGPLASVFELSLTLRSSSPRLVLYQQLAEESLSSFPLSDDLSVNPSSPGGKCCWVDTGGALFFDLPELQLWLRSPHKDGDIFQQPELFEFDHVYFASSIGSPIAILYGALGTDCFKEFHLSLVEAAKEGKVKYVVRPVLPSGCESKSGHCGAIGTKDPLNLGGYGVELALKNMEYKAMDDSEIKKGVTLEDPHIEDLSQEVRGFIFSRILERKPELTSEIMAFRDSLLSSTVSETLNVWELKDLGHQTVQKIVHASDPLQSMQEINQNFPSVVSYLSRMKLNDSIKDEILSNQRMIPPGKSLMALNGALIDIDEIDLFVLLDMVHQELSLADQYTKLKIPSSSVRKLLSTLPPPESNMFRVDFRSEHAHYINNLEVDAKYRQWRSNLNELLMPVFPGQLRYIRKNLFHATYVLDPASICGLETVDMIISLFESALPIRFGVILYSTKLIETLEANGGEFPLSSLENDSQINEDLSSLTIRLFLYVKESHGMQNAFQFLSNVNKLRMESGEEDVPLLHHVEGAFVETILPLAKSPPQDILLKLEKDQSFREPSQASSLFIFKLGLAKLECSLLMNGLVHDYNEDSLMTAMNDELPRIQEQVYYGQINSRTDVLDKFLSESGIQRYNPQIVGDKAKAKFVSLTASFLGDESLLNNIEYLHSAGTIDDLKPVTHLLAVDVKSRKGVKLLHEGIRYLMAGSANARVGFVFNSDVDPDSNSLTFMKVFEIATSSYSHKKKVLNFLDQLCSFYGNEFRLGSSQDAQSTQALLNKISDLADANGIQSKGFMSALSEFTVAKLTSHLKKVGQFLYGQVGLENGINAVITNGRVVRVPDDVTFLSQDLHLLESVEFKQRIKHIADIIEEVTWDDVDPDTLMSKFLSDVIMSVASSLSTRDRSSEGARFEMLSAEYSAVVIGGQNATIHIDAVIDPLSSSGQKISSLLRILWKCSQPSMRLVFNPMSSLVDIPLKNYYRFVTPTMDDFSNTDITVHGPKAFFANMPLSKTLTMNLDVPESWLVEPVIAIHDLDNILLENLGDTRTLQAVFELEALVLTGHCSEKDHEPPRGLQMILGTKKNPHLVDTLVMANLGYWQMKVSPGVWYLQLAPGRSSDLYIMQDGLDMRSTKRITIDRLRGKPVHLGVVKKKGKEHEKLLIPSDDDDSSRKQGDQDSWNSNILRWASSLIGGNVQSKKSGSTKVDNNVSNGRKGKTINIFSIASGHLYERFLKIMILSVLKNTQRPVKFWFIKNYLSPQFKDVIPHMAQEYGFEYELVTYKWPSWLHKQKEKQRIIWAYKILFLDVIFPLSLEKVIFVDADQIVRADMGELYDMNLKGRPLAYTPFCDNNRDMDGYRFWRQGFWKEHLRGRPYHISALYVVDLVKFRETAAGDNLRVFYETLSKDPNSLSNLDQDLPNYAQHTVPIFSLPQEWLWCESWCGNSTKARAKTIDLCNNPMTKEPKLQGAKRIVAEWPDLDLEARHFTSKILGEGVSPVEKVVSPIEKIVSPPAQPQEPEEDLESRAEL

SEQ ID NO: 3785 - protein, 1208 aa, Phlebia centrifuga
MPPTSFGELHAYLLDVSSPPERQIEYVFRHIPPKGYESSIETEAKTYLSGYGVSLDLKKMDYLALDDRRQGSNSREEFASETSDLPYDTDRILSLVHQYPENVTADYVAPLSEEELLQIGMQSTQLIYDAGEENALATLKQLSQNFPKYVKDVARRVTAEDKLEAEIMDNQVKAQGGISMAWLNGVVIQETDWNPFSLLRLLRKERSTMQSLMSLRLTSEQAIELLTHRAVGVAQADSGVLDGIFDASDRLEGEGAIVWWNDFENDSRYARWGPSLSLLLRPMYPGQLPNLKLNIFNVVVVADLSQSSALNFIAGAVSNIIQRNFPFRWGIVPIIETEEGERMARLFYWLVENLGQTKTMEFIARISQVQTPVHLITPTVDWSLVHSEFHHAISERLDNDEVSDHFPRHIDLELILSGSVGDSAEVLQKARTYAKRLSADLASAPQGHTFLNGKHFNLDDDFLRNMQVEAGQQLLHLQEQLYHGLLTPEDGARISTYFYDRPEASKRRSKHIYPSGKPEGLKILSLTDLILHSHGSFVYPPESEGHNLPLTTFVVTDLDSTAGAELVKEVLSAMEDSTTRVAFIHNPSTKGANTNPSPGLSGLLRNLGNKGLLHGITPSRLLDVLRSGSVGPSKAIDQVVLSAEGLSDDALREALLPDMTEETEDYQQFVEASRFVLRDLKIGPGEQVVIMNGRVVGPLGRGEFVAEDFQELVAYEYRKRVGPVVDALADILPALDELDRIDYADFVSSVSSVISSIHLPDPSESGLFNAPIKPRRRNYQLLAGEYTKFEYGDNSTAFFHVGILLDPLSEAAQKWSSLLEWLLDDPAVFVELHINPARYKEMPLKRFYRYSVSPKINFDENGEEIPSKLTFHGLPEEPIYTLAMDVAPSWLVRPREALYDLDNILLSALSNHERAKGIQAIFDLDYLVIEGHARQVFTNSPPRGLQMQLVANSTPIADTLVVANLGYLQFRTKPGVFRLEIRPGRGREIFHMESVGNEGWDSPSVAEVGNEVTLMSFEGLTLYPRVTRFPGMEGVDVLATESVPGEDEGLFGKIKESISSLFSSKSTEVAVAEPNDDQAEINIFTVASGLLYERFASIMILSVLRNTKSTVKFWFIENFLSPSFLVRILHGFVKSTILYWKQEFIPHFAKEYGFQYELVTYKWPSWLRAQKEKQRIIWAYKILFLDVLFPMDLKKSFSWMRIKLSGQT

SEQ ID NO: 3786 - protein, 1581 aa, Columba livia
MTESGLSRLLDNPKLEREINTPENNASIQSNFKWEENCFDGNLVKINHSQWFTVRVVRHRTGWRQDPPQGGGANAAPALARGRVPLRPQRRVSTRELREPRYLFGVSEFIAEDGNEKFWQFLETVRELTVYKQGDSEHSYYNLILKKAGQFLSNLQINLLKFALSIRAYSPTVQTFQQIAADEPPPEGCSAFVVIHEKHTCKTNEIKKLLKKATKRPRPYLFKGDHKFPTLKEDGPVVILYAEMGTKDFVKFHKILSEKAQKEEIVYVLRHYVQKPSSRKMYLSGYGVELAIKSTEYKAVDDTQVKGANETKEEADEEEEEEEGDVQGFLFGKLKQMHPDLKNNLKEFKKHLIETTNNMEPLKVWELQDLSFQAASRILSAPVYDALKVMKDIAQNFPIRARSLTRVPVDKKMRSEIEENQKHFHEILGIQPGEARLFINGLHIDLDFHDPFSILETLKVEGKAMHGLHELGIKEEILSKFMRLHIHPKDDSYALDIRHSSIKWVNNIEQDHSYSTWPASYQELLKPTFPGVIQQIRRNLYNLVLFVDPIQEDTGDYMKLAELFYHHNVPLRIGFVFILSTKEEIDGNEDAGIALWRTFNYIAEESDTFQAFTSIINMYHEVREGNVLTVNHVKDVLRSEYPHADIQSILGVHSEYDEGRKAGATFYKKTGLGPLPQALFNGVPFNREEMDAAELETVILQRIIDATGFFQRAAFMGLLNDHINAMDFLMEQHNVVSRINPTVLGAERRYIHFRSTSVPFDVEDFSTFSFLDSQDKSAVISDNMKYLTKKDEDALYAVTIWIIADFDKPAGRRLLSNALKHLKTSSHTRVGVLNNPSSKIKEDNTAVARGILAAFLTQNNSNIKSFLSKLTKEETAKSLAAGTKITKFLTPGMDDDTFEKKYNTLGLDIIKTHQMFCQEVLKLLPGQMAVVSNGRVLGPLDENEFYAEDFNLLEKITYSTSAEKIKAIVKEMGNSSKSGSDLIMKIDALLSSLPKTEMRQDAEILKEQHSVVKVNPQQNEPFYDVIAIVDPLTREAQKMAHLLIVLKDIINVKLRLFLNCRSKLSEVPLKSFYRFVLEPELTYGINKHLPSEPMAKFLELPESPLLTLNMITPESWLVEAVNSSCDLDNIHLQDIQGTVLAEYELEYILLEGHCFDVTTGQPPRGLQFTLGTKNNPVMVDTIVMANLGYFQLKANPGAWTLRLRKGRSEEIYQVFSHEGTDSVADLTDVIVVLNNFRSKIIKVQVQKKPDKVNEDLLTDGTTGKKGNRESVTRFSEEISTEDNENKSDILNIFSVASGHLYERFLRIMMLSVLRHTKTPVKFWFLKNYLSPTFKDVIPHMAKKYGFKYELVQYKWPRWLYQQTEKQRIIWGYKILFLDVLFPLAVDKIIFVDADQIVRSDLKELRDLDLKGAPYGYTPFCDSRKEMDGYRFWKSGYWASHLGKRKYHISALYVVDLKKFRKIAAGDRLRGQYQALSQDPNSLSNLDQDLPNNMIHQVAIKSLPQEWLWCETWCDDESKKKAKTIDLCNNPQTKEPKLKAAARIVPEWVDYDTEIRKLIQQIEKEKKNLTSSFQKGLKHDEL

SEQ ID NO: 3787 - protein, 1496 aa, Talaromyces islandicus
MKPTAASSLAAGLLLLLHLPHVAIAGPSVNVALQASFDAGPYLVELLETAAEENSTAYFPLLDRIAEGAFESATTEQDLYRQFLRVLHDDGHLADAESLDSFKLALSIRSAAPRIQAHYQYYNSSVQSTLAAAQDAACPVWVHMDGKQYCSPTLERAQQPVEGDSDPRELPFDRTFGDPLATPAVLYADVSSPIFGEYHRTLKALAKDGEVAYRVRYRSIQNHDTPARPLFMNGYGVELTLKRTDYIVIDDRQDEERGTAQTKAKAPSTENLEDESSAELTPLSSSEVLTLGTSAAGFVVDSQDPFTTLVKLSQDFPKHSAAVAAYNTSDKFLEEYMKNRQAGLPGARNIMWINGQQIDTRQVDSYSLLEHLRRERRLIGEFKKLGLAGSEAVDLLSHSALAEVKLGSGVQRYDWRDEAEEGGVLIWMNDIEKDSRYASFSANLQMLLQPMYPGQLPPVRRDIHNVVVPVDLANEEDVGFIVQYLYVFVKRMLPVRFGLVPIVHTEESKAQAKIAHHLQQTYGLASLLKYLEETASSGKNPKANKKFFAAAIADRALRPDRQSLSFDEVLQSQDLEATVTKTAKYLRRLDLRGPSPPTLVNGVAMSRTETYLQSLPMQLGNDVQVIQQALIQGEFEKDSWIAGFFLLDAAQSRNEWIVPENDNEIRMLNMLEIASAHNDFNEVLRLPSDKTHTTNNVQLVVVGDFNTDYGLALLVSALKFRQSHLQAEVIPLHTSDAKEDAAGVSSKLYELLRQAKQPEVADVLLHVQSANAAATHSQEEQEYWTRAQKLVESFGFALGASGVVVNGRVVGPLPSSVEFGEAELEHLYSYELSRRLGPVTEALGDLGIESKVTGPLAFAKLTSLLALSNTPDVPEGIFESKPKYRLDVWGRWNSTYSGITAESQEDASINIVATIDPTSELSQRWVPILKTLSELAGVKVKIFLTPVTQLQELPIKRFYRHVLSPEPLFDENGALIRPEASFRGLPQEALFTLSMDVAPSWLVAPKESVHDLDNIKLGALKDGTDVDAIYQLEHILIEGHSTDTTLQTPPRGVQLLLESEGGSFFADTIVMDNLGYFQFKAQPGFWKIELKEGRSQSIFKLDSVGAKGRTVRAEDDGSNEVALLSFQGKTLFPRLSRKPGKEDEDVLETGPRPGSAMDYVSKGLNFAQGMLGVKSSSSSKSVTAEKHAEINIFSVASGHLYERMLNIMMVSVMKNTQHTVKFWFIEQFLSPSFKSFLPHLAAEYGFSYEMVTYKWPHWLRGQREKQREIWGYKILFLDVLFPLSLDKVIFVDADQIVRTDMYDLVSLDLEGAPYGFTPMCDSRTEMEGFRFWKQGYWKTYLKELPYHISALYVVDLQRFREVAAGDRLRGQYHTLSADPQSLSNLDQDLPNHLQTMIPIKSLPQDWLWCETWCSDESLASARTIDLCNNPMTKEPKLDRARRQVPEWTVYDDEIAALAKRVAQGDVDGVDDVDVDVDAEDDVDHVRVEEQLRKDEL

SEQ ID NO: 3788 - protein, 1554 aa, Phanerochaete carnosa
MRLRCLLALLPLTAVLASSPPVQVELRTSWAPPPFLVELLETIAIEDPESYFPLLDRFTHPEWSPLAQDQAHENVYRNALETALAAGYLAEPGELAAMEATFALHSSTPRLEAAYQFYSDNQAGRGADCGSWVDWYGDVVCSVEDLQRLAGIKAIEAGEVAARNGSASDVKVLPFDHIRPSPDLTLDRPPQTAVLYATLTSSNFRNLHSFLYAASAGPRPHIQYILRHIPPTGHASDRERAYLSGYGVALDLKKMDYLAMDDRRQSSADDSDASDDALSAPGEADVVAALLQQYPEDADTDYTIPLTSDELSNIGLQATQLIADASDPLATLKQLSQNFPKYASSIARRVVVSDTLEDEITLKNTRAPAGASMAWLNGSPLTEGDMNPLSLLRLLRKERAVMRQLAALGLNTTQSLDVLTHRAVGAAQADTGALDALFDASDRPEGGAAIVWCNDLEQDARYARWPDRLSTLRGVMLYPGQLPSLRLHLYNIALVLDLSQPAGLGFITNAVVSLISRGIPFRFGIVPSVETEESLKMARLTYWLFENIGQDKALNFIARLARLQLGNPFAEPTFDWSLVTSEFTDLLARTEGLSASLASIFDGEDEEMEHKVAAARAYAARLAADLTSAPRGHVFMNGKHFDLDDDIMRNMQFMGTQMFQHLQEQLLAGALTDDDAEHIATYFYDLPTTAARRNRYIYPSGKNSELVLNVPELLAKASFSSGQDAFVYPPGEAQVSLTTLIIADLDSEEGLALAKEALMAMEEDSPARVSFVHNPSNSTARASTSAFLGHLGEQVVLSAGGGIDEILDGASLAALDDDPFVRASRFLLRELKLAPGAQAVVVNGRVVGPFVPGGIVAEDLHALYMYEQHKRVGPVVEALEEVADLERLSRKGAAELIARAASLISSIHQPDPSEVGLFNAPVRPRKRSYQLLGGEHTKYEFGDNATAIFHVGILLDPISDTAQKWSALLEWLLNDPAVFVELHINPWRYTELPLKRFYRYNVQPALRFSDAGDETKSLVSFNGLPEDPIYTLAMDIPPSWFVRPREATYDLDNILLSGLGKHERAQGVYALFELDYLVIEGHAREDGTLTPPRGLQLQLINGEGNAIADTLVVANLGYLQFRAKPGVFGLEIRPGRGREIFELESAGSEGWNSPTADQAGNEITLMSFEGLTLYPRMRRSPGMELVDVLAPPRLDEQDGTIVDKLKHGITSLFKSKPEERTEAAEPATQQAEINIFTVASGLLYERFASIMILSVLRNTNSSVKFWFIENFLSPSFLEFIPHFAEAYNFQYELVTYKWPSWLRQQKEKQRIIWAYKILFLDVLFPMDLKKVIFVDADQIVRADLKELVDLNLHGAPYGYTPMGNDNEEMEGFRFWKTGYWKEHLEDLPYHISALYVVDLVRFRQLAAGDILRAHYQQLSADPNSLANLDQDLPNNLQREVPIFSLPEDWLWCETWCTKDRLHRAKTIDLCQNPLTKEPKLARAKHIPEWEEYDGEISRFARQLAENGLIHSGMADADATILADVGAGKVATENKQGTGSAGDDAETLHRQKDEL

SEQ ID NO: 3789 - protein, 1396 aa, Rattus norvegicus
  MOD_RES (550)..(550): Any amino acid
MARAGAAKGLRLLLRSVALWLALLGASTATASKAVTAHLAAKWPETPLLLEASEFMAEESNEKFWQFVETVTELAVYKQTESDYSYYNLILKKAGQFLDNIHINLLKFAFSIRAYSPTIQMSQQVAAEEPPPDGCAAFVVVHTKRTCKTSELKKLLSKAASRPRPYLFERDHKFPTSSENLPVVILYAEIGTRAFAEFHRVLSKKSKNGKILYVLRHYIKKPSSRKMYLSGYGVELAIKDTEYKALDDIQIKATTDATVENETGADEVQGFLFGKLNILDLLRSEGKLLSGLKSLGLSEEERSRFLKLNSPVWDDDFVLDIRHSSIVWINDLENDALYTDWPTSCWEFLKPVLHGTVPSVRRNFHNLVLFIDPAQEYTLDFINLAEFFYFNEIPLRIGFVFILTMDNDVDGTTDAGVALWRAFSYIEENYGVSEAFLSMTHMYQKVKGRHILTVDDVRTVLQNKFPHADILDILGTHSKYDSRRKEGANFYKMTGLGPLPQALYNGEHFGLKEIDTEELKGAILEKMMDAFIYLQRDVFMGKITDEINAXDFLMDKSNVVPRLNSLILHTEPQYLNLLSSSVTADIEDFSTFSFLDSQDKSAVVAKHMHYLTRDDAVISAVTLWIVADFDVPSGRKLLSHALEHMETTFHSRLGIVYNPTSKINEENTAISRGILAAFLTHENDLLRSFLRKLAKEETAEAIYSGDKIKTFLATEMDKNAFEKKYNTIGVNIFRTHQLFCQEVLKLRPGEPGIVSNGRFLGPLNEELHKEDFHLLEKITFSDSVVKIAGIVENMEMNSKHMSDLVMKIDVLTSSLPVRASRSDVTLLKENLSVIKINPPENDTFFDVIAVVDPLTREAQKMTQLLDVLGKIVNVRMKLFMNCRGKLSEAPLDSFYRFVLEPEPFSGASNSPSQGPVAKFLDIPESHLLTLNMITPEGWLVEPVHSNCDLDNINLKDIERSVTAEYELEHLLLEGHCFDMTTEQPPQGLQFTLGTRSNPDVVDTIVMANLGYFQLKANPGAWILKLREGKSEDIYEIIGHEGADSETDVGNVIVVLNTFKSKILKVQVKKKSGKIKEDVLADKHEDRGMWDSIKSFTESLQKDGRKDNNILNIFSVASGHLYERFLRIMMLSVLRNTKTPVKFWFLKNYLSPTFKEVIPHMAKEYGFQYELVQYKWPRWLHQQSEKQRIIWGYKILFLDVLFPLAVDKVIFVDADQIVRHDLTELRDFDLDGAPYGYTPFCDSRTEMDGYRFWKTGYWASHLVKRKYHISKTHSPVSTCKVGISGFFGDSGIMMFCRGRQVKEQFAEADTGDLPNNMIYQVAIKSLPQDWLWCETWCDDESKQRAKTIDLCNNPKTKEPKLEAAARIVPEWVEYDTEIRKLLDHLENKKKSTIHDEL

SEQ ID NO: 3790 - protein, 1525 aa, Ophiostoma piceae
MAGFPNRPRGLAMALLAALSLQPSLTAASPSVDVGMIAAFPAPPYLTELLETAAQENATSYYPILDRIAEGYFADASTDRDLYEKFLALLKDGGHVASDAALSTFKLALSLRSAAPRVEAHYQFYNTAAEGSVSGDQTGCSQWILWEGSQYCSPSLDEAHSKVSGHQRQEKTVPFDNTLSHGPAAILYADITSPGFGPFHKFLAEKARNGEISYRLRHVRPTAVDGVAEPLPVNGYGVELALKRTDYIVIDDRESATGNEAAQKKLAAPAEVILDGEEEVTDLKALSKSELSNLGMSTADYIIQSENPFDTLLKVTQDFPKYSSSIAAHNASEAFLTEHQKNRALMVPPGVNVMWMNGVQLIERQIQPLALLDIVRRERIMIDGVCELGLTGKEAVDILGHQAVAQSKAESAPLRFDWRDEIEDGRVIIWLNDLVNDNMYEEYPKTLRALLQGGMPGQIPPIGLDVFNQLYPVDLTKKADIHLIVNQLVDFVRRRLPVRFGLVPLTPTPEAAKQAKVVYYLLETHGLIAVVGYLTQTLKDGKAASPNASIFKSIVKDHDLREEAKVLAFDDIMTDEGYAKQIELAQHWADRLGANSEIPPIFIDGSVVPRDERWVQTMSNQVALNLRAIQEAIYYKRIDDTIWAPDFFLIESLTRRNALIFPEGPQSLHVLNVHKLLTEHADLFNHIPSIEADEETTKETWAALTVVLDIGTEDGLKLLINALQFRVNNPGVTLDVVYNPKDTDSALDLINSLQDVDLDVLTEVQSWEELKALIATEKPATADYLAALTRFRTAAAINPGDNMLILNGRVLGPVDKADSFKEDDFFTFLEYEQAERILPVYKAVEDLNMTSKVSSPIGAAKLTSITALSTITDVPEGIFESAPTLRISSFNLWTAEHTAFEAGDAATATIHFNIALDPASEVGQRWTPILKVLSQLDGVYMRVFLNPRDRLQDFPVKRFYRSVLEAAPLFDDAGKVKALAARFNGLPSEALLNLGMEVPPAWLVAPKVSVQDLDNIKLSSVKSDITATYELEHILIEGHSEEEGSKAPRGAQLILGTEKDEHFADTIIMANLGYFQFKANPGFYNIKLMDGRSSDIYTIKSVGSRGKAPVPGDEGTDVVLMDFQGTTLYPRLARKPGMEKEEIIPSDASAAPAAAARDSSAGSGGAMDYVSKGLKFAEDMIGKAKSATHKTAAVAAKEKQADINIFSVASGHLYERMLNIMMVSVMENTNHTVKFWFIEQFLSPSFKDFIPSLAEAYGFEYEMVTYKWPHWLRQQKEKQREIWGYKILFLDVLFPLSLDKVIFVDADQIVRTDMYDLVQVDLQGAPYGFTPMCDSRTEMEGFRFWKQGYWSNYLRGQPYHISALYVVDLRRFREMAAGDRLRQTYHTLSADPNSLSNLDQDLPNHMQFQIPIFSLPQDWLWCETWCSDEALTTAKTIDLCNNPQTKEPKLDRARRQVPEWNVYDTAIAAIDKQRKQGSDAASKPSSPIRVGGGAGGQQKPVVGSEPKEVAEEAVVVAGTHERDEL

SEQ ID NO: 3791 - protein, 879 aa, Zea mays
MYRRWRSNIQELLMPVFPGQMRYIRKNLFHSVYVLDPASACGAETIDMMVSLYQDSVPIRFGIIMYSSRFINVVEGSDGTLTNNDGEDTSILITRLFLYIKETYSTQLAFQFLGNIHKSRNGEDDYNEELVEAHHVEGAFVDSLLSTAKSHPQDVLLKLQKENMYKQEAEESSHFVHKLGLYRLQCCLLMNGLVHEASEEATMNAMNDELPRIQEQVYYGHIQSHTDILEKFLSENSYKRYNPSITGKNAEKKFVSLFASYHQDSFIFNDMKYLQSPGTTDDAKPVTHLLAIDLSSKVGTKLLYEAILYLMDGSDRARVGLLLYVHTGGSSPILLLKDIFDRTISSFSYKEKVLVFLHGLLKFYDAQPLPASSVADDWTRTMMEKVYTLAAETALPVDDYKAWFKSFSADTVLKGMDKLSDFLFGQLGLVFGSNAVITNGRVFIMNEGKSFLANDLGLLESMEYDLRTKYIFEIIEEVEFASVDPDDLTNQFYSDIAMLISSSMSVRERTSERAHFEILHAEHSAIKLNNANSSIHIDAVIDPLSPTGQKLAPLLRILWKQIQPSMRIVLNPISSLADLPLKNFYRFVLPSMDDFSSTDHSVHGPKAFFANMPLSKTLTMNIDVPEPWLVESVIAIHDLDNILLENLGDVRTLQAVFELEALLLTGHCMEKDRDPPRGLQFILGTKQRPHLVDTLVMANLGYWQMKVSPGVWYLQLAPGRSADLYELPPKLIAIDSLRGKLMHIEVQKKKGKEHEDLLNAADDYHFQEKTDNKGWNKNLLKWASSLITGDASSKSKADKTTDRKDARQGETINIFSVASGHLYERFLKIMILSVLKKTQRPVKFWFIKNYLSPQFKDVIPHMAREYEFEYELVTYKWPT

SEQ ID NO: 3792 - protein, 1505 aa, Auxenochlorella protothecoides
MGVGQCALACVLLTTLVLLHPSLADVGRGADIQLRAKWNSSTFAHEAAEFLAAQDTAAFWSFAGAFTLPQDSTDCLEHVLRQARSLPPDEPSRRLLGVEVAARLHSPRAELFHAAAARELGDASPSMPCCWASVGGAPFLSLSALRAALAAPATGRASEGPRAFDHVHPGPPEGAPEVPFVALYAPLGNACGAAFHAELRALASAGKITYAWRPLATVACAGDDSSPCLHAGSSLVLPGYGVELAIKNMEYNAADDKAASEAAADAGGDPAGAEDTAPSGTAAVGAARVPAGEGDLEALHAQLEAWRDSAAAETVLTKRQLRRLGLQAAARVAEAPASPLAVLVELAQNLPSYAPLLSAVHVPKNLTRAVDLLQRLLPPASGMLAVNGRLLRARDLSLHDLLGKSDARYARWPARLESLLVPSFSGRLPGLRRNLLTAVLLFDPASDSAADLGEAARVVLLQGWPLRLGLVPLVRNGAGDEAGARVARLFLGVHATLGPDPALAFLVSLAGVDFQSGDEAAAWKQVQLTFKRHWPTWVDKASEDAEPHPALQWTAAQALEAYVDQPDAATLRTLRAGVALARSTGLAGLAASPEASGGVLVICGLVVPLRAGEPVARLVGQALQMELRQVQEDVYLHRLTDDMPDLEDELLELRGAAPRINPRIFPSRQGTGAGGGLEGVPDPSAPRQLALTGPGLGAAARHAAGLAYWKVGDGVETDAPAIIHWAVADVLTREGLSLVLAALQHESSHSRTALLLNSAGGLGEGSLAPLERGLLAMLTRADKPVPALDVAAALESILALPLDTDLGSLSESDIHITHGLSWAELPNADQVAAAHSRFAREGLRLPRGSSAVVTNGRVVTLQPSGELFVPEDFELLELYARWYQFAGDGDSEEQQAGLEDAGYELSGRGLWERFPTDELNTVRVLAYLHEALGAEVMLTLNPDRGLADLPVKGFLRYVLPRGDGAPPAARFDGLPADQTLTLGMEVPEPWLVEPVATDHDLDNIRLAELAPGQRLAATFELEALLVTGSAIDLGAARSGDPSQEVHPRGVKLELGPAGKVPLVDTLVMSNLGYFQLKAAPGEWTLGLAPGRSRELFSVARDDELEADHGMEGAAAPRNQGGLTFELPVTVDSLMGHHLRLFLKKDPAWLDEDVLAPSPGTGPTVGVWSSLPVWGVKKDEAPAPAKEGEDARIHIFTVSSGTMYERLQKIMILSAVKRTSARLKFWFIKNYMSPQMKAFIPVMARRYDFDYEFVTYKWPTWLHKQSEKQRIIWAYKILFLDVLFPLGLKKVIFCDSDQVVRADLAQLWATDLQGAPYAYTPFCDTNKEMEGFRFWKHGFWKDHLQGLPYHISALYLVDLDRFRTLAAGDKLRILYERLSKDPNSLSNLDQDLPNYAQSIVPIHSLDQEWLWCETWCGAASRPAARTIDLCNNPLTKEPKLQSARRIIAEWPALDREVEELTAAVTAAAGRARELEAVVASDSLFRARLAPMVEGVVGGQGRDASEL

SEQ ID NO: 3793 - protein, 1472 aa, Mus musculus
MRLLLRSVALWLALLGASTATASKAVTAHLTAKWPETPLLLEASEFMAEESNEKFWQFVETVRELAVYKQTESDYSYYNLILKKAGQFLDNIHINLLKFAFSIRAYSPTIQMFQQMAADEPPPEGCTAFVVIHTKCTCKVNEIKKLLNKAVSRPRPYLFERDHKFPTSSDNLPVIVLYAEIGTRAFAEFHRVLSKKSKNGKILYVLRHYIQKPSSRKMYLSGYGVELAIKDTEYKALDDTQIKTTTDTDIENETEVDEVQGFLFGKLKEIYSDLKDNLTIFQKYLIESSKEMTPLKVWELQDLSFQAATQIVSTPVYDAIKLMKDISQNFPVKARTLTRIAVNELMRKEIQENQKDLRDRFEIKPGDARLFINGLRVDVDVYDPFSILDMLKSEGKLLSGLKSLGLSEEERNRFLKLNSPVWDHDFVLDIRHSSIVWINDLENDGLYIDWPSSCWEFLKPVLHGTVPSVRRNFHNLVLFIDPAQEYTLDFINLAEFFYFNEIPLRIGFVFILNVDNEVDGTTDAGVALWRAFNYIEEKYDVSEAFISMTHMYQEVKGHRILTVDEVKSILQNKCPHADILDILGIHSKYDGRRMEGATFYKMTGLGPLPQALYNGEPFDLKEMNTEELKGAVLEKMVGTFVDLQRDVFMGTIRDETSAIDFLMDKSNVVSRLNSLILQTEPQYLNLLSSSVTADIEDFSTFSFLDSQDKSAVIAKHMHYVTQEDAVISPVTLWIIADFDVPSGRKLLFNALKHMETSFHSRLGIVYNPTSKINEESTVISRGILAAFLTHKNKHLRSFLRRLAEEETAEAIYSGDKVQTFLAVEMDKNAFEKKYNTVGVNIFRTHQLFCQDVLKLRPGEPGIISNGKFLGPLSDELYQEDFHLLEKITFSNSLQNIAGIVESMDMNSKHVIKINPPENDTFFDVFAIVDPLTREAQKMAQFLVVLGKIVNTRIKLFMNCRGKLSEAPLDSFYRFVLEPELTSGPNNRPSHGPVAKFLDIPESHLLTLNMITPEGWLVETVHSNCDLDNINLKDTERSVTAEYELEYLLLEGHCFDMTTEQPPQGLQFTLGTRSNPVVVDTIVMANLGYFQLKANPGAWILKLREGKSEDIYEITGHEGAEPETNVGNVIVVLNTFKSKILKIQVKKKSGKIQEDVLADKHENRGMWDSIKSFTKSLHKDEKKENDILNIFSVASGHLYERFLRIMMLSVLRNTETPVKFWFLKNYLSPTFKEVIPHMAKEYGFQYELVQYKWPHWLHQQTDKQRIIWGYKILFLDVLFPLAVDKVIFVDADQIVRHDLKELRDFDLGGAPYGYTPFCDSRTEMDGYRFWKTGYWASHLVKRKYHISALYVVDLKKFRRISAGDRLRGQYQALSQDPNSLSNLDQDLPNNMIYQVAIKSLPQDWLWCETWCDDESKQRAKTIDLCNNPKTKEPKLEAAARIVPEWVTYDTEIRTLLDHLENKKKSANSVHDEL

SEQ ID NO: 3794 - protein, 1984 aa, Atta colombica
LQMRGLIFFYIFLLCSSQLGADKKINKYVTTLINAKWKETPLVLEAAEYLSDENPNYFWKFIESYSKIIKHSTSHTQQNNYNIILELAQKYLSPSEIAVFKLGMSLRIYSARVEMFFQMAVNKNVSSYGFCDNFVNIGETFTCSLEDIDRLLEQLIITLFIFQDTWETVDTYDVDHKYLSTPESNKIIILYGQVGTPMFIDFHEKLKNIAETKGINYILRHFIKDYNEEREDTKLRLSGYGVELQMKSTEYKATDDSDIKDNTGKSSEMANDGMEEIEGINFMILKKLYPDHQAELDKIQTYLLETSHEIGAFKVWQFQELSHQAAERIMKSPSAEALNILTDISQNFPMQAKSLIRTKVNIDMKKEMKLNQEIFMASLNIQPTDTALFINGLYFDLEAIDILTLLESLRNELRVMEALHKIGFSNKKMSKLLALDLSGGTDNQNFAMDIRDSAINWINDIENDPRYSNWSPSLTELLRPTFPGMLRNIRRNLYNLVLIIDPLSDDSMPLIALAQSLYAHSAPLRVGFVFVTNYNTSVTGLIDASVAVNNAYHYFADTRSPKEALHFLSELGNYIGHSGVDVDDVKKVIRSRDSSASIPYILGEESEYDVGRHLASDFIKRCGFKKFPQALLNGVPLTPNQINSESYEEAVLSTIMLQTPMLQKAVYRGEVTEGDDIVDFLMNQPNVMPRLNERILKVDKNAWLNLIGTIPEDDDYTKWASQNLSTYLMKEMHYLFVPRRNMRHLYSFWIVADLKSLSGRQLLREALEYIESNADARISIIINAEDDANLKSDINKIVLAVINALSPEKAILYMRKILKEDIVALIANDNFEIEDESVAAILENQNSILSLHQHYVKAVLNMELGTRAVLCNGRVIGPLDDNEEFTNDDFSLLERFSQSTYGEKLFMKLIKDQIFDEDEYEENNITDDTIMKITSLLVPRPQTRSRYDVPFHGDDHSVVKISAINPDEVAFNFIAIVDPVSRGAQKLGPILKTLQQALNCNIKVFLNCVDKNSDMPLKSFYRFVLEPELQFTTEGDINGPIAKFTKLPTSSLLTQYIHAPENWLVEVVRSVYDLDNIKLDNVAMGVHSEFELEYLLLEGHCFEAVMGNPPRGLQFTLGTEKQSVMVDTIVMANLGYFQLKANPGEWVLRLRQGRSAEIYDFTTIDGQNVIQNGNDVKVLISSLRSHVLKVKVSKKPDKAGIDLLSDNEKDSGLWNSISRTFTATDENEDKDEKLNIFSLASGHLYERFLKIMMLSVIKHTKTPVKFWFLKNYLSPTLKDFLPHMAKEYGFEYELVQYKWPRWLHQQTEKQRTIWGYKILFLDVLFPLNVKKIIFVDADQVVRADLKELATLDLGGAPYAYTPFCDSRIEMDGFRFWKQGYWRNHLQGRAYHISALYVVDLKRFRRIAAGDRLRGQYQALSQDPNSLSNLDQDLPNNMIHQVAIKTLPQEWLWCETWCDDASKKYAKTIDLCNNPMTKEAKLQAAMRILPEWVGYDEEIKILQQKIENANRQTWRDSDLPCLALPWLRDRLGGRLLSIVRCSRTRIVRTPPRRSAWKIHDMDNSGDKSADVEILAVVAEQNNITNKFKDKAIYGYGTSIPPNNNEDEENEMSPRKVIFCVHGKLSGCCTVVKGSGDENTAANYQQNSLSPEDHCHRERNEEIDKKARKKLLIASALCVIFMIAEIVGGVLSNSLAIATDAAHLLTDFASFMISLFSIWVASRPATRKMPFGWYRAEVIGALTSVLLIWVVTGILFYLAIERIVHKDFELDATVMLITSAVGVAVNLVMGLSLHQHGHSHGGHSHGGHNHDDMENGHDDDLKGEQSKKNINVRAAFIHVLGDFIQSVGVFVAALVIYFKPSWSLVDPICTFLFSILVILTTVAIIKDVINVLMEGIPKGFDYSHVENTFMQIDGVVKVHNLRIWALSLDKTALSAHLAIKPGSSPQNILCTATRNIHDKYKFFEMTLQIEEFNERMENCKQCKALS

SEQ ID NO: 3795 - protein, 1547 aa, Austrofundulus limnaeus
  MOD_RES (164)..(164): Any amino acid
  MOD_RES (588)..(588): Any amino acid
  MOD_RES (1182)..(1182): Any amino acid
MEAVSITSRTGAELMVCSSAKMKNVLLMTLLLLNVRPGTSTPKGVTASLKAKWSTTPFLLETSEFIGEDGNEKFWQFVETVKELTVYKQGESVRSYYNLIIKKAGQFLTDLQVNLLRFALSMRSYSPAVHSFQQIASDEPPPEACPAFVSVHGERSCSAKDIKXLLKAAAGRPKPYLYKNDHTYPGVNKTDTPVVILYAEIGTKRFSSFHKVLSEKAEEGALIYVLRHFVADPKPQKILLSGYGVELAIKSTEYKAVDDTKVKDSKTVLNTEEDDNDEVQGFNFAKLKKSHPELREQLGELRKHLLESTNDMAPLKVWEMQDLSFQAAARIMSVPKFDALKVMRDLSQNFPSKARSLTRVAVKKEMRKEIEENQKRLGETVGVHPGYGELFINGLHIDLDIHNPFSILDILRTEARILEGLHNLGIKGEHQGKLLRLPVNSVDDSYALDIRHPAIMWMNDIENDPIYRSWPASVQELLRATFPGVIRQIRRNFFNLVLFLDPLQEETVELVKLGELFYKHKIPLRIGFVFVVNTKDEIDGLSDAGVGFYRLLNYIADEYDLSQAVMSIVSLYGQVDVGERLSAETISXYLKKKYPKANVERILGVDSVYDYKRKDGSLFYKTSGLGALPLALFNGVPLNPDEMDPEDLETIILQRIMDTTTAFQRAAFMGQLTDSSDVVDYLMEQANVVPRMNPVVLSTDRKYLDFTGTPVVNDWEDTSMFSFLDARDKTAVISKRLKYFTNSDADGMTPVTMWIVGDFQKVSGRKLLLNALKHVKSRPGVRVGVINNPSGKPNEDNTVVYRAVWASLLTQKNKAAAEFVQKLLKEESSQLLQQGTKMKDLLMQGMDVDAFEKKFNTLEVDFIHSQQLFCGDVLKLRPGLQAVISNGRILGPFEEQEEFTVEDFHLLERITLSGSAEKVKAEVKQMGMKPKHASDLVMKVDALLAAAPKGEVRRDVQFKDTHSVLHLSPRENEVFYDVVAIVDPLTREAQKISSLLIVLSQVVNVRLQVFMNCRAKLSEMPLKSFYRFVLEPDVAFLANESASPGPVARFAELPESPLLTLNMITPESWMVQAVSSPHDLDNIHLQEVNGVVAAEFELEHLLLEGHCFDLSTGQPPRGLQFTLGMSQDPLMYDTIVMANLGYFQLKANPGAWTLRLRKGRSEEIYQILSHDGTDSPAEAADXIVVLNSFHSKIIKVRVQKKTEKINEDLLSETSESKGIWDSLVSVWSTFEKSITGGGSKKNDGEKKKEDVLNIFSVASGHLYERFLRIMMLSVLRHTNTPVKFWFLKNYLSPSFKETISHMAESYGFQYELVQYKWPRWLHQQTEKQRIIWGYKILFLDVLFPLAVDKIIFVDADQIVRADLKELKDLDLEGAPYGYTPFCDSRREMEGYRFWKTGYWASHLGHRKYHISALYVVDLKKFRKIAAGDRLRGQYQALSQDPNSLSNLDQDLPNNMIHQVAIKSLPQEWLWCETWCDDASKVTAKTIDLCNNPKTKEPKLTAAARIVPEWVEYDEEIKKLLRHIQDGAAQKQTPPPSRHKKDKGRDEL

SEQ ID NO: 3796 - protein, 1324 aa, Eremothecium sinecaudum
MVCINRYITNLQLDQLIAMLLLLTSLLAILIQRVFAGSYDSTRLWQSVGLVGISEINEWYGVITGANDENTIEDLFESLPNDHAKLLQLTYDLHPGYTEFAGEDDTGSLNWFELNNKKYVKPDDSFYLKSDELKAQSQISDNLVLQDGELVVGTNPTAPLVVFYGSAETGDFEDFNRNLYTEAIGGKIRLLWRPTGPAKPLSDLEVPNEYAYEYSINAESWGKEVQGDFDLPAEYSSEEYIVGDIKEGTESELAVVVASLISDYYEKTNDFHKTFEYARKIINNYPILMDKLTASPESLNKTSSYVEKISNLGITYDAIGVYLNYQHWKLSDLNPWNFIAAVTYELKMFKSLFSTLKGAFPDLEKEDVKSILQKYSEVGVMNLQHLQPARYDFHRIPGFSESVIYFCDIENDEIYANLSSDTNAFFQKSKFGELPEYKENWNEFIFVIDFDNLATKDTSEIFAGFKRALEVLELGYPQRIGLLPLFRGEPSEVVKHIYALKDEGLDSLKEFLQKFDPTQKIPEIEGNQLPPVSEILHNFGIKQNSVIVNGQIHPFTKNTWHYKVANIVKNDVNFVTSALKRVKDTKAREILHFHSLTARHPEYVTDYFEDNLYTIINGSVLDQIESRVLYLNKPSDALLHTITVVDDFNTGSAIEKIINLLSIKFTGVRVRLVHRGEELENWENLNKMIVAMTSNSMLIESLRTTMNKPPVPKTFDSETYRVLRQWLPSLSKEFIEADSYALLNGRYINLSNCGPLSVDIWEAIIQRESRRTLDFVAILQDVIPDLSERGVLPALVEESVSCLSKMFYGGSGIFDNGIEYTGEAKLPRLDILKLLDKGSLNNAISSGNEDALVDVTVIIDPVEERSQKFLHLVNFVKDLSFVNVNLLTIPTLNLSIIPNHRIYSDVKLDINDDNYYTFSRDLPSNVVGEASKNDYKPTAVVVEGHVFKEDTIISKSNVEGEIGVCLEIVNSRGNVISKGISMGAFGYVQFQLPSLEKNLSIRSCDSKYDVVSFSSNARSDYLPMDTFHVQDLSPKSIVIKVKPAPNNKALVRGPVKDNAIHVYVTIHDSFEASIFTQQLMAIVTALSPTTEVHFWISSYAEPPLALRNLMRYTTSRTNNRVVFSMVSYHWPKWLRPQRFLERRLDVMRILFLDVMFPEVEIEKLILFTIRTKEIPDIEALHKINSSACFIMKKHRGEGYWKHGYWKKFLKGNNLRFYDASSTFVVNMEAYRNKMAGEALRIHYQRLSADVKSLEDIDQDLLNSLQQQIKIKSLLSKETVPLLSTKEMGSWYSELLKFITPASEEIDNNENVDPDKEEDYLHDEL

SEQ ID NO: 3797 - protein, 265 aa, Lithobates catesbeianus
YGCFLFSFTGAVNTEVKGKKTDVLNIFSVASGHLYERFLRIMMLSVLRHTKTPTKFWFLKNYLSPRFTEIIPHMAEEYGFQYEFVQYKWPRWLHQQTEKQRIIWGYKILFLDVLFPLATDKIIFVDADQIVRTDLKELRDLDLGGAPYGYTPFCDSRKEMDGYRFWKSGYWASHLGHRKYHISALYVVDLKKFRKIAAGDRLRGQYQALSQDPNSLSNLDQDLPNNMIHQVSIKSLPQEWLWCETWCDDKSKERAKTIDLLLLLM

SEQ ID NO: 3798 - protein, 1655 aa, Musa acuminata
MRGSSFSRRKFERNLLRFEMELRCRSWVLGALFISLLFCGFGGSGCLGFAFNRRPKNVQVSLRAKWAGTSLLLESGELLAKERKDLFWEFINLWLEPDKGSDCLTARCCIQKIVDDGRTLLSEPLASVFEFSLTLRSASPRLVLYKQLAEESLASFPINDEINLVPITGEKQIPDEIEAYYLSTSTTTRTHGRHCCWVDTGSVLLFNTAELLAWIETSSNISVGYLEQPELFEFDHVYLASSIISPVAILYGAIGTECFKDFHIILAEASKQGKIKYVVRPVLPPGCQAVSSYCSAVGSSDAVNLGGYGVELALKNMEYKAMDDTTIKEGVTLEDPRTEDLSQEVRGFIFSKILERKPELTTEVMAFRDYLLSSTVSDTLEVWELKDLGHQTVQRIVHASDPLQSMQEINQNFPSIVSSLSRMKLNDSIKDEILANQRMVPPGKSLVALNGALINIEDIDLYLLMDLVQQELSFADHFSKLKLPLSAIQKLLSAAPPSESNAFRIDFRSGHVHYLNNLEEDAMYKRWRSNINEILMPVFPGQLRYIRKNLFHAVYVIDPATSCGAETIDMILSLHQSSIPMRFGIILYSSKLVKMIEENGGHLPSSAVQDDKKRTEDVSSLIIRLFLYVKENYDTQLAFQFLGNVNKLWNSGDDFGEENLEAHHVEGAFVDSLLSKAKSPPHDTLLKLEKELTYKEEADGSSLFVFKLGLSRLECCLLMNGLVYEANQEASINAMNEELPRIQEQVYYGHINSKTDVLEKFLSENGYRRYNPQILSEAKGHKKFSSLISSYVGTESILQDVHYLHSYASADDLKPVTHLLAIDITSRAGMKLLHEGINYLIGGSKRARVAMLLYSTAGASSTASHFVKAFDTAVSVFSDKERVLDFLEELCSFYEDQFMTASLLDYDNFSIFTDRVCELAAKFGLPSDYYNSTFSSFSVDVINKQMEKVSGFLHGQLGLEYGSNAVITNGRIFILKDGSPFLSDDLSLLESVEYELRIKYIYEIIDQVEWVDVDPDDLTSKFYSDLIMLVSSLLSTRERSSDRAHFEILNAKHSAVNLNTGNSSIHIDAVIDPLSPSGQKLSPLLRILWKCIRPSMRIVLNPVSSLADLPLKNYYRFVVPSLDDFSNVDYSVNGPKAFFSNMPLSKTLTMNLDVPEPWLVEPVVAIHDLDNILLENLGDLRTLQAVFELEALLLTGHCAEKDHDPPRGLQLILGTQRGPHLVDTLVMANLGYWQMKVSPGVWYLQLAPGRSADLYALKESGDGSPGNRSAKLITINDLRGKLVHLEVAKKRGKEHEELLNASDDQLLEKRKEGQNSWNTNILKWASEMIGSGGLSRKGETRLDHKKAGRQGETINIFSIASGHLYERFLKIMILSVLKNTQRPVKFWFIKNYLSPQFKDVIPHMAQEYGFQYELITYKWPTWLHKQKEKQRIIWAYKILFLDVIFPLSLRKVIFVDADQIVRADMGDLYDMDLKGRALAYTPFCDNNKEMDGYRFWRQGFWKDHLQGKPYHISALYVVDLMKFRQTAAGDTLRVYYETLSKDPNSLSNLDQDLPNYAQHTVPIFSLPQEWLWCESWCGNATKAKAKTIDLCNNPMTKEPKLQGARRIVPEWVDLDAEARQLTARILGEEVDSNEPVTSTSLPPDGPQNNHEKDEL

SEQ ID NO: 3799 - protein, 1515 aa, Microcebus murinus
MAPAKAANVVRLLLRSTALWLLLLGARTVSSSKALTAHLAAKWPETPLLLEASEFMAEESNEKFWQFLGTVQELAIYKQTESDYSYYNLILKKAGQFLDNLHINLLKFALSLRAYSPAIHMFQQIAADEPPPDGCNAFVVIHKKHTCKINEIKKLLKKATSRPRPYLFKVDHKFPTNKENLPVIILYAEMGTRAFSAFHKVLSEKAQNGEILYVLRHYIQKPSSRKMYLSGYGVELAIKSTEYKALDDTQVKTVVNTTVEGEAEANEVQGFLFGKLKEIYPALTDNLIAFQKYLIESNKEMMPLKVWELQDLSFQAASQIMSTPVYDAIKLMKDISQNFPIKARSLTRIAVNQHMREEIQENQKDLQDGFEIQPGDARLFINGLRIDIDVYDPFSILDMLKLEGKMMNGLRNLGINEEDTSKFLKLNPPVWEHTYVLDIRHSSIMWINDLENDGMYVTWPTSCQELLKPVFPGSIPTIRRNFHNLVLFIDPAQEYTLDFFKLAELFYFHKVPLRIGFVFILNTDDEVDGADDAGVALWRAFNYITEESDESEAFISVVHMYQKLKAQSILTVDNVKNVLQNKFPHASIWDILGIHSKFDKERKAGASFYKMTGLGPLPQALYNGEPFSHEEMNIKELEMAVLQRMMAASIYLQKDVFMGTLNDRTNAIDFLMDRKNVVPRINSLIFHTKRQYLNLISTSVTADIEDFSTFFFLDSQDKSAVIAKNMHYLTEKDDNVISAVTVWIIADFDKPSGRKLLFNALKHMRTSVHSRLGVIYNPTSKINEENTAISRGILAAFLTQKNSFLGSLLRKLAKEETATAIYSGDKIKTFFTEGMDKNTFEKKYNTIGVNIFRTHQLFCQDVLKLRPGEMGIVSNGRFLGPLDKDFYAEDFYLLEKITFSNSLEKIKGIVENMDINSKNMSDLVMKVDALVSSLPKRASRYDVTFLKENHSIIKINPQENDMFFDVIAIVDPLTRAAQKMAQLLVVLGKIINMKIKLFMNCRGKLSEAPLNSFYRFVLEPELMSGANGNPSLGPVAKFLDIPESPLLTLNMITPEGWLVETVQSNCDLDNIHLKDTERTITAEYELEYLLLEGYCFDTMTGQTPRGLQFTLGTKNKPVVVDTIVMAKLGYFQLKANPGAWILKLRKGKSEDIYQIVGHEGPDSQPDLEDVIVVLNSFKSKTLQVQVQKKPDKIKEDILTDKDETQKGVWDSIKSFTIGLHKKYKKEKDVLNIFSVASGHLYERFLRIMMLSVLRNTKTPVKFWFLKNYLSPAFKEIIPYMAKEYGFQYELVQYKWPHWLHQQTEKQRIIWGYKILFLDVLFPLSVDKIIFVDADQIVRHDLKELRDFDLDGAPYGYTPFCDSRREMDGYRFWKTGYWASHLIRRKYHISALYVVDLKKFRRIAAGDRLRGRYQALSQDPNSLSNLDQDLPNNMIYQVPIKSLPQDWLWCETWCDDASKQRAKTIDLCNNPKTKEPKLKAAARIVPEWVEYDAEIRQLLDHLENKKKKAILTHDEL

SEQ ID NO: 3800 - protein, 1510 aa, Coniella lustricola
MIRLSQLPWGLTASMLAATFLGSRTVSAGPSVDINMNAAFSSAPYLIELLETAAQENASSYFPLLDRIADGYFATTTTDKELYEAFLELLTSGGHIPSGESLSTFKLALSTRSAAPKIEAHYQYYRTGVEPSLSGDQAGCDAWVLWQGQKYCSPSLDQPQGQTATGQERNLPFDIALGHGPSCVLYADITSPNFGDFHKVLVQKARNRECAYKLRHRRSSSATLEPLPINGYGVELALKRTDYIVIDDRKAEADASQSAIASEIVLGEEEDMADLKPLSTSELRSLGLRASSFIMHSDSPFDTLLKLTQDFPKYSTSLATQNISDGFYVEHKANRASLAPAGVNLLWMNGVQLVERQIDAYTLVDLVRRERKMIQGVMDLGLTGEEAISLLAHEAVAEAKSDDTGVQRFVWHDAQEEGRVIVWLNNIEKDKRYEEFPHNIMTLLQGGMPGQLPSIRRDLFNLVVPVDLTQKNDTVTVVKQLQDFVKRKIPIRFGFVPLSSTEASERQAKVVYYLAETYGLAAMMHYLEASLEAGKTDDADKDLFDRAIADREAREDTTALSLTDVFSSERYAEQISFSKRWVERLRADGPNPVLFVDGVPVPREGNWMPAMGQQVGMDLQMLRQAVYYGEVEEGQWLPDFFLKDAFSRRNTVIFPDDPKDVKILDVNKMLIEHSILFEKIPVIEAYQDSTKENWAVLTLVVDFTTIEGLKLAVNALQFRTNNPGVRLDVVHNPVDAAGAHKINTALKMSQPDLLAADDEETLQMILDTSSSVPDDADYDTVLPRFLISAGIRPGQNVLILNGRLVGPIQSAADFAAQDFELLLEIEQDSRILPVYEAIEELGLTNKVSGPLAAAKVTSITALSSMSDVPEGIFERGAPLRNSAFNVWNSTHTAFEIGDKSTATIQFVASLNPASEQGQRWVPILKVLSELEGVYVKIFLNPKERMEELPVKRFYRYVLESAPSFDANGKVKTLHAEFKGVPSEALLNVGMDVPPAWLVASKVSVHDLDNLKLSSFKSNVEATYELENILIEGHSRESTGGLPRGAQLVLATEKDSHFADTIVMFNLGYFQFKANPGFYNIQLKQGRSSEIYHIESVGAKGYNAALGDEGTDVVLMDFKGTTLYPRINRKPGMEEEDVLDESGSESALDVVSKGFKSIFGVKTKSASDEEHAEINIFSVASGHLYERMLNIMMVSVMKNTKHTVKFWFIEQFLSPSFKEFIPYLAEEYGFKYEMVTYKWPHWLRQQKEKQREIWGYKILFLDVLFPLSLDKVIFVDADQIVRTDMYDLVQHDLEGKPYGFTPMCDSRTEMEGFRFWKQGYWANYLKGQPYHISALYVVDLRRFREIAAGDRLRQTYHSLSADPASLSNLDQDLPNHMQFQLPIHSLPQEWLWCETWCSDEAFSKARTIDLCNNPQTKEPKLDRARRQVPEWTLYDDEIAEVDRKRRLKSVESKDDADASQKIVRGDGKVLDETVDASAKNTKSRTFEEEPKSVAPTEKTNRKASEDVKDEL

SEQ ID NO: 3801 - protein, 1504 aa, Exserohilum turcica
MRASPAALGAKALLVLSALRHTGVLASPSINVALQAAFSPAPYLVELLETAAEENATAYYPILDRISEGYFDDKTTEQELYTAFVDLLQSDGHITQPEALSSFEFALSVRSAAPRIEAHYQFYNTSVEPSLAAEQTDACEIWASFHGKQYCSVHLDEPFGKIASERTYQLPFDRILGNTSALPAILYADITAPQFKKWHKTLSSTAKQGKTSYRVRHKPSSKAPASPLVVNGYGVALQLKRTDYIVIDDRQAAESDKNTAQKPMDTDLNSEEDVADLKPLSKDDVADLGLKAASFVTQSEQPMDTLLKLVQDFPKYSSIIASHNASDAFVEEHIKNREQLLPTGYNVIWINGVQVPTRDVNPYSLLAHLRRERKLVNGIRSQGLSGPEVISLLSHSAIAETQSESEPQRYDFRDATEGGDVIIWLNDIENDDRYENWPTDLRALLQRTFPGQMPSCRRDIHNAIVSVDFTSANDVTNLLETILNLVKRGIPIRWGLVPQTLTSEALAQAKIVYHLQEAYSITAMEVYLQSSLDNKKLAQPDKAIFDATVKTSTLREEQTSLTFEDVWNSEDIARRITGAKQYLQRLAAEGPGAPVFVNGVPVPATEEWLQTVSERISMDLREIQKGVFEGAFNEESWVPLYFVFQAASRRNPLIIPEKEQNITLINMAEFEEAHGDIYNKMPRVYASESASKSDWVHIALVADFDSENGLALLKSLADFREANPNVEAVLIHNPQAGAEQSKVSENILGASKTDGKLTIETLLELLARESKPVSFPAESRLFWKAAEPIYDAFGLKPGQHSLVVNGRHVGPIPEEYTFSKDDMETLISYETKKRTDPLSKALTELQILDKIQSPFDIAKIQSLVALSTVSDVPEGIFETASTLRLSTFNEWTAEHTAIIKGDKDKAVFQIVASVDPATELAQKWVPILKALSDMEGVHLRIFLNPKQMLQELPVKRFYRYVLEARPHFNSDGSVGSLGAHFSGIPKEALLNLGMDVPPSWLVAPIESIYDLDNIKLSTIPAGSNVDAVYGLESILIEGHSRDTTNAGQAPRGVEVVLETEKDPHFADTIIMANLGYLQFKANPGFYNIKLKSGRSQEVFNLDSAGPIGYAPQPGDETTEIALMSFQGATIFPRLSRKPGQETADVLAPEESLASELAGKSAQKVNKFLGKIGVNFDSEKVFKKGADLLLGGKAVTKGTQADINIFSVASGHLYERMLNIMMLSVMKHTKHTVKFWFIEQFLSPSFKSFVPHMAAEYGFEYEMVTYKWPHWLRGQTEKQREIWGYKILFLDVLFPLDLDKVIFVDADQIVRTDMYELVQHDLKGAPYGFTPMGDSRTEMEGFRFWKTGYWANFLRGRPYHISALYVVDLNRFRQLAAGDRLRQQYHALSADPNSLSNLDQDLPNNMQFNLPIHSLPQEWLWCETWCSDEDLAKAKTIDLCNNPQTKEPKLDRARRQIPEWNVYDEEIAALAKRVKGEQKLVDVQEQEQLREKKEKDAEKIQHNEL

SEQ ID NO: 3802 - protein, 1567 aa, Pterula gracilis
MTASMKPPLLLALSLLTYTYASPPVRVSLQPSWQAQPLLTELIETIALENSLSFFGLLDAVLDPSASPPVSSLSPEALYNYVLELASSTGALRLPAAKTRVELNLALRAAAPKTEAFYHHYQTTTPPNCGSWVDWYGQQVCTVKELAGLLESHETIEAELGADHSRSFARPKTLSFDHIRPPLSASTRPLRTAVLYSNLTSPNAHELHSYLLSHSQGAAPAVEYIFRPAPLHASDVDDQRKPALTGYGVSLDLKKMDYLAVDDRQLHQGSASSNEKNSAQAVVGEESVDHITELLDQYPSLYDTVNASHPLSGQELRVLGLQAIQLIQSSSSPLFTLKTLVQDFPRYAASVSRRVNLEERLIEEEVVANSQRITQGMNLMWINGAVVPPKDINPLGLLRVLDKERLISLSLQSLGLNVSQVSDLITHSAISAAQTTASSGVTSGLFDSSDRQEGEGTIIWWNDIEKDVRYAKWSSSIHQILRPIYPGQYHNLKINLFNVVFALDLSNTNALDFVSGSIYTIIARSFPFRFGVVPVVESEAGAKMARLFYHVVKTQDSQMALKFCKAISTNHLARESEPTFSDVDWTLVRSAYEDVLSEVPHDDFDTVVAGTEDGDVANAKAYAKRLSITLSESPKGQAFVNGRPITMDEKVLRALPQEVAKQLQHLQEKLYVGELTEDPAALATYFYDLPSTNARRNSYIYPDPSNPSSLRIFNLVEEYSKAGFSLSAGAFAAPHESESLPLTILVVADFDTAPGLELAIEALKSITPNSKARISLVHNPTEQTTSGKRDASKLIFNLMSSKLISRLSPQSVIEKLQNLDATSGVEAETYAAYVDTCKQLVWQLGMGKGSLGVVANGRVVGPIKEGDFGSGDFSALEGYELKARTEPVEEAVRSVMPASEQLDRSSFADLVSMASSIVASLQLPDPSESGLFDAPARPRARSYDVMDGEQTRFVVGNKQTAMYQVVLIMDPLSSSAQKWSSYLEWLLAIPDVYLEVYLHPSFYQEMPLKRFYRYNLQQALAFDDAGNEVYAEAVFEDLPTDPIYTMAMDVPSSWLVRPREAVYDLDNIQLGKLYPEDRDIGVTAVFGLDYLVVEGHAREAHNMSPPRGLQIQLLESDGSSIDDTQVVANLGYFQFKAKPGVFKLEIREGRGRQVYRMESVGSQGWESPDVESAGDEISVTNFEGLTLYPRLAKKAGMEMSDVLSYVEEEGVEEEGLFQTLTNKVFSIFGGSKGGSTDMVVKGSSQAEINIFTVASGLLYERFVGIMILSVLRNTNSTVKFWFIENFLSPSFLEFIPHMAREYNFDYELVTYKWPSWLRAQTEKQRIIWAYKILFLDVLFPMDLKKVIFVDADQIVRADLKELVDLDLHGAPYGYTPMGDDNYDMEGFRFWKTGYWAEFLRGKPYHISALYVVDLVRFRQTAAGDMLRGQYQQLSADPNSLANLDQDLPNNLQHQVPIFSLPEDWLWCETWCNKDRLDRAKTIDLCQNPLTKEPKLARARQIPEWEVYDSEIAQFARRLTDKGLVRSRISSADSNVLAAEGVVAPEESGATDVDAESAEESGVVRDEL

SEQ ID NO: 3803 - protein, 1486 aa, Colletotrichum salicis
MVRLSQLPVGFSLSLLAVVNVAAVPSVTVDMKAAFPSGPYLLELLETAAGENATAYFPLLDHIASGHFSEAKTDKEVYDKFLDTLNEDGHITTPDALSTFKLALSLRTAAPRIEAHYQYYRTAVEPKLGAETQDGCEIWAEQGGKQYCTPSLDSAKDSTLDGAKVLPFDRVLGSGKEAILYADPTSSSFGSFHKALAQKARNGEIEYRLRYTKPAGKYEEPLPVSGYGVELALKRTDYIVIDDREAHQDDSQKTVKTEEVLDAAEEVADLKPLSKSEVQELGLKAASFVMQSQNPFETLVKLSQDFPKFSTSIAAHNVSAEFLAEHQLNRQQLVPSGMNVLWMNGVQLIERQIEAFTIIDLLRRERKLIDGVRDLGFTGGQAVSLLGHPKVADSKSDEEPPRFDWTDDLEEEQVIMFLNDLEKDERYQDFPDQLTSLLQRVYPGQLPPIKRDIFNLIIPVDFSKMEDLSVVAQMNSFVQRKLPIRFGLVPLTPTEDAFQISKVLYYLLDNYGLDVFIEYLDAAMQASKTEKPDQGSFDKAIQDREPLPDADSKILSFAEVVESDELDGIVKLAKNWAKRLNANTPVPPVFINGIPVPRENNWLQAMSMKASSDLQAIQRAVYLGMVDEKSWIPDFFLEKAVKRRNTYIYPEDEKSLQVLDVNKIYTEYDGLFSKVPVIEAYSDSTKENWAVMTVVGDFNSDEGANLLLSALAFRRNNPGVRLDIVHNPSASASASGVNAALKNGGDKFAEAETLADIKDLLKAATSDSDAVFTAALSEFLSFAAVKTGSNVLILNGRVVGPFTENDPFQGDDFQFLLEFEQKARILPVYAAVDELGLTDKISGPLAAAKITSVTALSTISDLPAGIFESAPSLRVSAHDAWNSTYTAIEIGNLETSSIHLVGVLNPASEQAQRWAPILKVVSELEGVYLKLFLNPKDKIDELPVKRFFRYVLESEPTFDEAGKVRALEASFKSLPSEALLNAGMDVPPSWLVAPKVSPFDPDNIKLSSIKSNVHASYELESILIEGHSREGGQSQPPRGAQVVLGTEKEPHFADTLIMANLGYFQFKANPGFYNIELKEGRSTDIYTIDSIGAKGWAPVPGDEGTEVVLMDFQGTTLYPRLSRKPGQEESDVLAEPEDNSIVGRGLKFAEGILGKKKSASDEEHAEINIFSVASGHLYERMLNIMMVSVMNNTKHTVKFWFIEQFLSPSFKDFIPHMAKEYGFKYEMVTFKWPHWLRQQKEKQREIWGYKILFLDVLFPLSLDKVIFVDADQIVRTDMMSLVNHDLEGKPYGFTPMCDSRTEMEGFRFWKQGYWANYLRGQPYHISALYVVDLRRFRELAAGDRLRQTYHSLSADPNSLANLDQDLPNHMQFQIPIHSLPQEWLWCETWCSDESQRVAKTIDLCNNPQTKEPKLDRARRQVPEWTVYDDEIAALDRKRKGLPAEAPKVVVDESEQKPVVVKEVEKNTKSRNWEEPPSEQTHVRDEL

SEQ ID NO: 3804 - protein, 1485 aa, Chlorociboria aeruginascens
MGLFSLPWSLTGAVLASTYLHSISVAASPSINVGLKASFSSAPYLIELLETAADENATSYFPLLDRIADGYFEKASTDQELYEEFIQILRKDGHMTDPESLSSYQLALSMRSAAPRIEAHYQYYHTAVEPSLKTKQDSSCPSWVLFNGKQYCSPSLDESRGEIAGDLQILELQFDRILGNPTGPVSVLYADITSPTFGQFHKTLVKTAREGRTSYRIRHRKGLSSESKPLIIPGYGVELALKRTDYIVIDDRDEDNSIAAKTTSETVKFEDEEFADLKPLSSSELLSLGLKASSFIMQSSNPFDTLVKLSQDFPKYSSAVASHNASQEFLAEHEYNRGQLVPAGYSVWWMNGVRLIERQIEAESLLDTLRRERKLINGVRDLGLTGAEAIQLLSHKDIATVKAEDESQRYDWRDEIEGGKVIIWLNDIEKDKRYQDFPDTLSSMLQRTYPGQLPPVRKDIFNLVLPVDFNVPEDLQLVVGTLTSFVKRKLTLRIGLVPLIRTTHAEEQAMIIYHLLETYGLSGAVAYLEASFENKVTHPSKTSFNTAVEGRKLRGEKVALSFEDALQSEESRHRVDASKKWISRLSADSTIPPFFIDGAALPRDEGWLQAMSTQVTADLQAVQQAIFTETFTQETYIPSLFLLGSATRRNALIAPEDEKLLRFFDVNTIVGDNEGLLNTLPRIQADASSPKADWAHMIVIADISSEPGRNLILSAVTFRESNPSIELIIIHNPASTEPEAGFGNHLFAHVRDGSYKPFSDIAHLQTVLVSEGLGQADKDKKAAYQYWQAAESLVKSVSLLAGQNGILLNGRLVGPIPAETTLSQEDFEQLLSYERRKRITPAYSAMEALGLSDKIKDPLEGAKISSIVAISTVSDMPDGIFEQASTLRMSQFDVWNSSYTAIEVGDASTATIQMIVLVDPASEQGQRWIPLLKVFSELDGVYIKLFLNPKERLQELPVKRFYRYVLDSKPTFDEFGALIAPGASFSGVPQEALLTVGMNVPPSWLVAPKISVHDLDNIKLSSIKTDVDALYGLEHILIEGHSRELPGGAAPRGAQLVLGTEREPHFADTIIMSNLGYFQFKANPGFYKIGLQEGRSSEIFNIDSVGSKGWSPVPGDESTEVFLMSFQGTTLYPRISRKPNMELEDVLEAKPDSKLDFVSNGLKLAHGILSGKGKEVVVKDEQAEINIFSVASGHLYERMLNIMMVSVMKHTKHTVKFWFIEQFLSPSFKDFIPYVAAEYGFKYEMVTYKWPHWLRSQSEKQREIWGYKILFLDVLFPLSLDKVIFVDADQIVRTDMMDLVNHDLQGAPYGFTPMCDSRTEMEGFRFWKQGYWKNFLRGLPYHISALYVVDLKKFRQIAAGDRLRQQYHQLSADPGSLSNLDQDLPNHMQSMLPIHSLPQEWLWCETWCSDEALKEAKTIDLCNNPQTKEPKLDRARRQVPEWTVYDDEIAAVDRRRKGLGNVNGEEKNEKSRNHEETTKNKKDEL

SEQ ID NO: 3805 - protein, 1506 aa, Tetraodon nigroviridis
APKGVTASLKAKWNMTPFLLETSEFIAEGGNEKFWEFVDTVKELTVYKRGESVRSYYNLILKKAGQFLTDLQVSLLKFALSLRSYSPAIHASQQIAGDEPPPETCPAFVSIHGQRSCSTKEIKKLLKAAAGRPKPYLFKNDHIYPGANKTDVPVVILYAEIGTMKFTSFHNSLSKKAEEGTLVYVLRHFVVHPKPQKMLLSGYGVELAIKSTEYKAVDDTKVNDTKTAANAEDDDSEDVQGFLFRTLKKSHPELTEQLGELRRHLLESSNDMAPLKVWEMQDLSFQAAARIMSVPKFDSLKLMRELSQNFPSMARSLTRVTVKQEMRKEIEENQKHLSETIGVHPGDGELFINGLHIDLDIHNPFSLLDILRREGRILEGLYSLRITGEHQISLYPALYPAVPLCCSYLKLSFLLMLSHFLTSACNFQWMNDIENDPAYRSWPSGVQELLRATFPGVIRQIRRNFFNLVLFLDPVKEESVKLIKLAELFYKHKIPLRIGFVFVVNTEDEMDGLSDAGVGFYRLLNYIADEYDVPQALMSMLSVDVGETLTVETIAEYMKRKFPKANAKRILGVDSEYDDQRRDGALFYKKSGLGALPVALFNGVALSSDEMDPDELEAIILQRIMDTTTTFQRAVFTGQLTEGVNVVDYLMEQPNVVPRINPHILSTDGHYLDFTASPVVDEWEDATMFSYLDTRDKTAVLTKRMKYFTNNDEDGMSAVTVWIVGDFEKDSGRKLLLSALRHMKTDRGVRVGVIDNPSAKASEDNTLLYRAIWATLLTQKKKAAAEFVQKLLKEESSQLLQQGTKVKDLLIQGMDEDAFEKKFNTLEVDFIRSQQMFCQKVLKLSPGQQAVISNGRILGPFEDQEEFTVEDFHLLKKITLSGYAEKVQIKVKQMGLKQKQASDLVMKVDALLSAAPKGEVRRDVHFIKDSHSVLQLSPRENEVFYDVVAIVDPLTREAQKMSALLIALGQVVNMRLQVFMNCRAKLSELPLKSFYRFVLESDVSFLANDTVSPGPVARFVEIPESPLLTLNMITPESWIVQAVRSPHDLDNIHLQEVSQPLDHLVIFCLYSLLRWCFVLPCQVSGIVTAEYELEHLLLEGHCFDLSTGQPPRGLQFTLGMSQDPLTYDTIVMANLGYFQLKANPGAWILRLRKGRSEDIYQILTHDGTDSPADAGDVIVMLNSFHSKIIKVRVQKKADKINEDLLSENSESKGIWDSIASITAGGSHKDDAAKKEDLLNIFSVASGHLYERFLRIMMLSVLRHTKTPVKFWFLKNYLSPSFKDTISHMAQAYDFQYELVQYKWPRWLHQQTEKQRIIWGYKILFLDVLFPLAVDKIIFVDADQIVRADLKELRDLNLEGAPYGYTPFCDSRREMEGYRFWKTGYWASHLGQRRYHISALYVVDLKRFRKVAAGDRLRGQYQALSQDPNSLSNLDQDLPNNMIHQVAIKSLPQEWLWCETWCDDASKAGAKTIDLCNNPKTKEPKLTAAARIVPEWLEYDNEIKQLL

SEQ ID NO: 3806 - protein, 732 aa, Zea mays
MMEKVYTLAAETALPVDDYKAWFKSFSADTVLKGMDKLSDFLFGQLGLVFGSNAVITNGRVFIMNEGKSFLANDLGLLESMEYDLRTKYIFEIIEEVEFASVDPDDLTNQFYSDIAMLISSSMSVRERTSERAHFEILHAEHSAIKLNNANSSIHIDAVIDPLSPTGQKLAPLLRILWKQIQPSMRIVLNPISSLADLPLKNFYRFVLPSMDDFSSTDHSVHGPKAFFANMPLSKTLTMNIDVPEPWLVESVIAIHDLDNILLENLGDVRTLQAVFELEALLLTGHCMEKDRDPPRGLQFILGTKQRPHLVDTLVMANLGYWQMKVSPGVWYLQLAPGRSADLYELPPKLIAIDSLRGKLMHIEVQKKKGKEHEDLLNAADDYHFQEKTDNKGWNKNLLKWASSLITGDASSKSKADKTTDRKDARQGETINIFSVASGHLYERFLKIMILSVLKKTQRPVKFWFIKNYLSPQFKDVIPHMAREYEFEYELVTYKWPTWLHKQKEKQRIIWAYKILFLDVIFPLSLRKVIFVDADQIVRADMGELYDMNLKGRPLAYTPFCDNNKDMDGFRFWKQGFWKDHLRGRPYHISALYVVDLAKFRQTASGDTLRVFYEQLSKDPNSLSNLDQDLPNYAQHTVPIFSLPQEWLWCESWCGNATKARAKTIDLCNNPMTKEPKLQGARRIVPEWTGLDSEARQFTARILGDDVEPADATPPPSEAPKPEDDQDVKDEL

SEQ ID NO: 3807 - protein, 1485 aa, Trichuris suis
MDLLLLRMWRNVVQGGILPLLLVYFYAARPSSCRATQKNVIAYVQSKWADTPLVVEASEFMAHEGDGYFWKFIEVLGKNETDLGSATDEGIYERLIGIAKSVLDSKSRVKLFQFALAIRCHSPSVEMYRQLSLSLSGRPAGHVFVDVHGQLSSNINSLDELLSQAKQRSPAIFSFDHIYATRSNKAKKWTILYANLESNEFIAWHDLLKSRAIKGELNYVFRHLPRVGKGKVPLSGYSVELAIKSTEYKAQDDTKIRSKPTAGANLTDDGDEEEADLDGFNIRLLKLLHPELRDRLDEFKLHLLEADELAPLKVWQLQDLSFQAGQRVLLAAKEDVLHTLQELSQNFPLMARSISLTAVKPEFRSEVETNQEAFSEIGIEPGNSAMFINGLRIDLDEIDIFSLLDKLKKEERLLAGFFDMGFRKETQSLLYRISSETSWSKFALDYTQWLPDFVNDLENDPQYRQWGNSVQLLLQPYFPGMIRPIARNFFTLASFQLFREEKRDDFVICRVGLILATNPDKKISGYSDGGVALLNAYNFIKGDTSIERALKFVLHVYNRVPSGNVTPSDVIDVFKQKYPDEDLSNVFDVDSDYNSGRQRWAQFAQNSGLSKLPSVLLNGFPMADNDVTSDQFEEAVVLEVSQVTSELQKDVLEGKLTDGVDVQKFILNKPFVLPKLNPKVLATDNEALILTDVMEYKVRTVDELKELGRKQQNQYIVQSRRYLTKNDESVLRPVTLWVVANVATKDGRDLYLAAIRSLKQLPNERVGLIHNVAPNDRVGYAIASLIQACLKLPLHQAKVIITKMLEKQLKTIDELEKLDIHGVDWSFLRNELTKKGEDIVAIDSYYSTHILNIPSGKVGLIINGIILSDVTSKDFSSTEDFALIEKYLLSSGCKVIASQIRKWNVPHDDGRSSDLVMRVFSLLKAYGPDTKRQWVTPLMQNNSCVDILSKDMTSATFEVVAIVDPLSASAQQISHLLSTIGHVVNADIRLCMNCKPKLSDIPLKRFLRVAIPTQLEFNQDGSLKRQPVARFSILPQKQLFTLNVIAPHSWLVEATEAAYDLDNIKMSDAFTDVVGIFELEHLLLEGHCFDEVTGSPPRGLQFTLGTAEQPVMFDTIVMANLGYFQLKANPGAWLLRLREGRSKEIYKVNSLDGSQVANDEDMVVILDSFGGRTVKIKVAKKPDKYEEELLPTSGEEDEESSLWQSISKKFTSPKDDYDVLNIFSLASGHLYERFLRIMMLSVLKHAKSPVKFWLLKNYLSPHFKAFLPFMAKRYNFSYELVQYKWPRWLHQQTVKQRVMWGYKILFLDVLFPLDVKKIIFVDADQVVRTNLMDLMRLDLEGAPYGYTPFCDSRKEMEGYRFWKSGYWKQHLGDRKYHISALYVVDLKRFRQIAAGDRLRGQYHGLSKDPNSLSNLDQCNNPMTKEPKLQSAMRIIEEWRDYDAEIKKLLDEYDRQRGIDRSASNEEEEEEEPQQPSGPIPHGEEL

SEQ ID NO: 3808 - protein, 1453 aa, Malassezia sympodialis
MWWVPWAVLFAVFCSISRGRAENEVHVKLRHHWHNYSESALHAAPLLEMVEAVGQVWPHDFFHIVSRIWSKETADHFIHYTQKETFEWVKSAIIDYLAEQEVSQYREVLDEWHVNVAQHWSAASVEAHYQVYNTSKEIKALSPSCATFVHFNGRAICSPEEARLTLNQTVHGSPIAHPQDHAYPTLHPARYIAILYADPYSESFLNFHNMLMSLAEEQPFTYVLRWRPSVARVELRKSMPYISSFGTSLHLKKVDYLVLDDRQVDLQHSANKDSEHLEDPISEMRADLLRQLYQRSKTKSHPSIQEAVQIQSNLSAPDFIYLGQATSKFILESKDPLSTLLALTSDFPIYAAALSHYSAHVSKSDPIYALLNDHSTRFVQPGHSQFWINGISLSEEELDPQKLIERIQEERRLQATFNVPELGISPEGTEAILTSEPVTLAFGAQRPSIFLYDVSDEREAKSSPVGTRVIAWVNDLEDGTFSQWPQTVEQMVEYRWPSGFPLVARNFFQLVVQIDLGDPDALLFMNSMLDHSLTEMPLRWGVVPLLVNSESETLAQVLWYAVDHLRPHEISLLFKRLAQSTLNQVGRVDAARARAILGQMLSLNDMDEKDLLESFVKESHTSSSFRLRLSRLRDYLDRIFVVPRPDTFGTAYLNGQPVSLNENLFSDISQAMSYQLRLASHEIFTGQLDEDNMYESFFYHLEDTKSSRSMLRTMLEETKASLRPSRFVNFPHIFRQIGNLGDPLRHFVYSRNDSLISIRLVGDLDSESTLSEITVILDAMYPVVEPFRLSFVHTGSDEGFVSQWFLSAMYSGALSDISPQLLSEALKSPDRVAALTQLSSDYGMSLKAYSWKPIASAFLLASNIDHEQGITLLINGHILSGVTGLRTKDVKEALSWEQSTHVDALLEAVNVPLAPPDVRSQVMEFVLSAVGSAFTEILNKGRSFSPSSNRMPVSLALQAGADLCITQGDPSSSVHITGVLNPLDSKASYFASTLRMLSSMSGVRFTVRMNPSLRVTSLPLQKFSRFNMRVTPAFNSDGYEIAPATVFTGIPPRSVLTMQLHTPRSIVAMAEEALYDLDNLRLSDVTGVVEAIFSVNSILIEGHARADQEPTPSGLQLSLSTDDDSSSLDTIVMETLGYFQFRGQPGRWKLSIRPGVSSDLYEMKSVGAWGWQSPSVDVTGSYIVLNQLSGVLTFPIVRKRLGKEMDSLVAQVNELKNVSFKDHVKAKVNDMVSFVLGRRSLHADINIFTIASGHLYERMTYIMILSVLRHTKSTVKFWFIENFLSPSFKAYIPHLANAYHFKYELITFAWPSWLREQTEKQRMIWAYKILFLDVLFPLDLDRVIFVDADQIVRTDLKELIDMDLHGAPYGYPPMGDDSEDMDGYRFWKKGYWKSFLRGMTYHISALYVVDLKRFRYVGAGDILRRHYQRLTADKNSLANLDQDLPNHRKFIWN

SEQ ID NO: 3809 - protein, 1752 aa, Histoplasma capsulatum
MYSDYFMTAVRTGGPGADGISFLLIPRTEGIRTRKIEIGADGLSATTYIIFEDVRVPVEYLIGSEGQGFRYVMSNFNHERLWIAFQALRNARTCLQDAMAWAMKREAFGMKLIDQPVVRYKFGSMAKEVEALQAWTEQIVYELDHMSYQDGNRHLGGVTALLKVKGGQMNKFVADNCVQIMGGLGLTKTGQGSRIEAISRGTHSLIVPGGSEDVLIDLGVREALKLSAAKVKKGAKISIYVKDKTYYDVICYMAHGVKRSHLYGRLHYHNMIFRYYTFPWRLGGLVLFVAASLFTSHATGGPSVNVALQTSFNAAPYLVELLETAADENSTSYFPLLDRISEGTFTEITTEKGLYERFIQLLQEDGHLTHPESISSFKFALSLRSTAPRIEAHYQYYNTSVEPSLMIAQDAVCTVWAHYDGDQYCSPSLEYAQQSVSWDGCSPLFGGFHHQLMQQARDGQFSYRVRYRPASSATSRPLFVNGYGVELALKRTDYIVIDDRDAEQRVLKDTDTTKPELAPAEDLENEQPADLKPLSASEVSTLGVNAASFIMSSDDPFATLLRLSQDFPRHSSAIAGASRTSEFTQEFEQNKANHLQTGRNVIWVNGLQIEAQTVDTFSLLDHLRRERKLINGLRKFGLSARQAVDLLTNPTISKSLGTDDSIRYDYRDELEGGGVIVWLNDLEKDHRYEGWPRDLHSLFIMTAHGQLPPVRRDIHNVVFPVDLASSEDVSVVSQSLLRAIKARIPVRFGIVPLVHNENAQGQAKIVHHLLDTYGLGAVMNYLQASLSADKVGSPDQASFTAALENHELRKDRTPLTFEDVLSSDNYDPIISNTKSYLKRLAVEGDILPFFVNGATLMREGNFLQNMIAALSKDLEHLQRRVYEGDFEEDIWIPSHFLQEALQSRSPLLIPENPSEIQITDLNEICANHQNVFDTILRIPASVESDDPMLDWNSIILIADLDSGAGAELLSSLLELHKKHPGVEILLLHNGESSSTPEALSTRLYSIRNGRDLDLAVVTATLASRNDDSASDSAAASAYWNTVQFLAKEIGFGTSEIGMVVNSRILGPLPSSTILDTEDLESLLMYEHSKRIGVLARVASEMDLDSNILDPLSLSRMQAVLSLSVTSGISESIYNYGPSARTRVFEKWSGIHTAISVSNSDDPSINIVATIDPTTEEAQHWVPILKVLSELVGVSLKLFLNPREEIKELPIKRFYRHVLDVAPSFNEDGSLAKPQAVFHGIPGEALLNLGMDVPPAWLVAPKESIHDLDNLKLSTLRAGTNVDAIYELEHILIEGHSRDITQGGPPRGVQLLLGTEKSPHFADTIIMANLGYFQFKAQPGCWKITLKPGQSERIFHIDSVGGLGSKPTPGDESNDVALLSFQGKTLFPRISRKPGYENEDVLDEVNKPAAAAKVFLAKGLNFASGILHRLAGPAQGRHADINIFSVASGHLYERMLNIMMVSVMKHTKHSVKFWFIEQFLSPSFKSFLPHLAAEYGFSYEMVTYKWPHWLRAQTEKQRIIWGYKILFLDVLFPLSLDKVIFVDADQIVRTDMYELVTLDLEGAPYGFTPMCDSRTSMEGFRFWKQGYWKNFLRGLPYHISALYVVDLKRFRAIAAGDRLRGQYHTLSADPQSLSNLDQDLPNNMQRMLPIKSLPQDWLWCETWCSDESLATAKTIDLCNNPLTKEPKLDRARRQVHEWTVYDEEIAAVQRRVLEKEEKERMGAVIEGGDEEVPQNEGGDHGDGKNEKRKKDEL

SEQ ID NO: 3810 - protein, 1607 aa, Gymnopus luxurians
MFWLLHLLLLFGKSASASPPVKVSLRTSWPAPPFLVEVIEAVALENPKSFFPFLDRVTDPEIVSVTPNEAPEAIYSSALEVAKSIGLFSEPGALASVEINLALHAATPKIEAFYQYYGETVEPSGQHKECGSWVDWYGSVVCDVESLAQLAGLDTIDSTEGHSANYTRPKTLPFDHIYPPPASKLETPPRTAILYASIHSPNFRELHTYLWKLAKHAEPRIEYILRFVPPENVDASKRSYLTGYSVALDLKKMDYLALDDRHLGAAHINDQTRPEELETEDIAAADAILKLLDAYPENPAAPDANTPPTEEELHLLGFQASQLIMGSPNPLLTLKHLSQNFPRYVTTLARRVTINDNLALEIHENQLRVQSGLNVMWINGLHLTERDINAFGFLRLMKKEREIMLELTSLDLERGEAIELLTHPLVAAAQDSKDVLDGLVDASDRPEGGGVIIWWNDLEKDKRYNQWSSALTTLLRPMYPGQFPTLKLNLFNNVLVLDLSRPANMLFVAGTMHSIIERGFPFRFGVVPIAETEDGIKMARLVYFLLENFGRKLTMTFMKRAATPFTRPGAPDSFQWSEIRRDFDDLMAAEAQAGESEEKTNVEFEAIVSGTTPSVKSLDNVQAYAQRLSATLSAFPAGHGFINGKHYPFDENFLRNMQIETGRQLMHFQEELYAGHLTDDDSEKASTYFFDLPTTARRRNKYVVPSKETLDILSLPELLVGSGYGSGPASFIYPAETEVIPITMHIIADFNSKDGLDFIKEALLSMEKNSTARVAFVHNPSMPLDEEASQSLSMSSIFAHLVDSNQLSKVTPSQLLQALEGGKIATEVEEVTQQVPLSTVKAIKNALELDDLNSQKSAKNSNFLDSCRWFVSSVGLDPAQNAVLINGRVVGPITPKEFVAADFHALQEYELLKRIRPVLSALESIRPNLKSLDRASIAHIVSMASSIISAIQVPDPSEIGLFDAPKRPRSRNYQLLESSHTLFKLGDNSTALYQISAIVDPLSETAQKWSSLLQWLSHFPDTYIEVRLNPTQYSEVPLKRFFRYNLRNSLTFDESGQEVYSQTIFENLPIDPIYTLAMDVPSSWLVRPREALYDLDNIQLGKLAPEDSSVDTIFDLDHIVVEGHARDTTTQAPPRGLQLELDSSSVPIDDTLVVANLGYFQFKAKPGVFKLEIREGRGRDIFVTESVGNDGWDSPSVEAVGNEITVTSFEGLTLYPRFSRLPGMEREDVLAEEEEEEDSAGVFESVFSSVKSLFGAAEEKKEIVELANEQADINIFTVASGLLYERFVGIMILSVLRNTNSTVKFWFIENFLSPSFLEFIPHLAEAYNFKYELVTYKWPSWLRAQKEKQRIIWAYKILFLDVLFPMDLKKVIFVDADQIVRADLQELVDLDLHGAPYGYTPMGDDNEAMEGFRFWKTGYWKDFLEGRPYHISALYVVDLVRFRQIAAGDMLRGTYQQLSLDPNSLANLDQDLPNNLQREVPIYSLHEDWLWCETWCSKDRLHRAKTIDLCQNPLTKEPKLDRARQYPEWEEYDAEIARFARKLAEDGKIRSRIAAADANALAQTASGVAPDPAGAGDAEGADKGESGIEEERQAQGTEKTAEIRDEL

SEQ ID NO: 3811 - protein, 1951 aa, Temnothorax curvispinosus
MKGLIFCYILALCSSQLGADKKINKYVTTLINAKWNETPLVLEAAEYLSDENPIYFWKFIDSYSRRISNLVLATQKENYDVILELAKKYLSESEIAVFKLGLSLRIYSSRVEMFSQMAVNKNVSLYGCNNVVNVGGTFTCSLEDIDNLLEQDTWESIDTYDVDHRYLSTPESDKVMILYGQIGTPTFSDFHEKLKNIAETKGINYILRHYVKEREDKRLRLSGYGVELQMKSTEYKATDDSDIKDNTGKDSEVANDGMEEIEGINFMTLKKLHPDQQAELDKIQTYLLETSHEIGAFKVWQFQELSHQAAERIMKSPSAEALNILTDISQNFPMQAKSLIRTKVNSDMKKEMKLNQEIFMASLNIQPTDTALFINGLFFDLEAIDVLTLLESLRSELRVMEALHKIGFSNKKMSKLLALDLSGGTDNQNFAMDIRDSAINWINDIENDPRYSNWSPSLTELLRPTFPGMLRNIRRNLYNLVLIIDPLSEDSMPLITLAQSLYAHSAPLRVGFVFVTNYNTSVTGLMDASVAANNAYHYFADTRSPKEALHFLSELGNYIGNYADVDDVKKVIRSKDSSASIPYILGEESEYDVGRHLASDFIKRCGFKKFPQALLNGVPLTPNQINSESYEEAVLSTIMTQTPMLQKAVYRGEVTEGDDIIDFLMNQPNVMPRLNERILKVDKNAWLNLIGTIPEDDDYTKWSSQNLSTYLMKKMHYFFVPRRNMRHLYSFWVVADLKLLSGRQLLREALEYVESNTDARVSVIINAKDDANLKSDINKIVLAAISALPPEKAILYLRKILKEDNAALIANGNFEIEDESVAAILETQNSILSLHQHYVKTVLSMETGTRAVLCNARIIGPLDSSEEFTSEDFSLLERFSQSTYGEKLFMKLIKDQIFNEDEYEENNITDDTIMKITSLLVPRTQTRSRYDVPFHGDDHSVIKIPAANPDEVAFNFIAIVDPVSRGAQKLGPILKTLQQALNCNIKVFLNCVDKNSDMPLKSFYRFVLEPELQFTPEGDISGSIARFTKLPTSSLLTQYIHAPENWLVEVVRSVYDLDNIKLDNVAMGVHSEFELEYLLLEGHCFEAVMGNPPRGLQFTLGTEKQPVMVDTIVMANLGYFQLKANPGEWVLRLRQGRSAEIYDFTTVDGQDVIQNGNDVKVLISSLRSHVLKVKVSKKPDKARMDLLSDNENDSGLWNSISRTFTATDENEDKDEKLNIFSLASGHLYERFLKIMMLSVIKHTKTPVKFWFLKNYLSPTLKDFLPHMAKEYGFEYELVQYKWPRWLHQQTEKQRTIWGYKILFLDVLFPLNVKKIIFVDADQVVRADLKELATMDLGGAPYAYTPFCESRVEMDGFRFWKQGYWRNHLQGRAYHISALYVVDLKRFRRIAAGDRLRGQYQALSQDPNSLANLDQDLPNNMIHQVAIKTLPQEWLWCETWCDDASKKYAKTIDLCNNPMTKEAKLQAAMRILPEWVGYDEEIKTLQQKVENANRQTEKDSANPFSIARVPVSFALLLADGPSRTFHDMENSGAKSANIEFLTVVVEQNNRANEFKDKAIYGYGTSIPPNNNEDEESEMSPRKVIFCVHGKLSGCCTVVKGSGDENASADYQQNPTMSPEDHCHRERNEEIDKKARKKLLIASALCVIFMIAEIVGGVLSNSLAIATDAAHLLTDFASFMISLFSIWVAGRPATRKMPFGWYRAEVIGALTSVLLIWVVTGILFYLAIERIVHKDFELDATVMLITSAVGVAVNLVMGLSLHQHGHSHGGHSHDRGSDVESELDGDLKGEHQKRNINVRAAFIHVLGDFIQSIGVFIAALVIYFKPSWNIVDPICTFLFSVLVILTTVAIIKDVVNVLMEGIPKGFEYSQVENTFMQIDGVVKVHNLRIWALSLDKTALSAHLAIKPGASPQNILRTATRNIHDKYKFFEMTLQIEEFNERMENCKQCKALSQ

SEQ ID NO: 3812 - protein, 1370 aa, Oncorhynchus tshawytscha
  MOD_RES (198)..(198): Any amino acid
  MOD_RES (629)..(629): Any amino acid
  MOD_RES (637)..(637): Any amino acid
MADAGSYQAGFGPRMWQQCALLLFLSLLPVVSGEADSKAVTTSLTTKWASTPLLLEASEFLAEESQEMFWDFVEANQNIKGEHDDTDQAYYDLIVKRASALLSTVQLNMLKFALSLRAYSATVHSFQQIATNEPPPSGCSAFFNVHGEKSCDTEKLTALMETAAERPKPYLFKSDHRFPGSNPDTPVIILYAEIGSSXFTMFHQLMLSKVNKGLATYVLRHYLASPSSRRVYLSGYGVELAIKNQEYKAKDDTQVQGAEVNATLMGENDPVDEVQGFLFGKLKTLYPELKEQLKELRKHLVESTNEMAPLKVWQMQDLSFQTAARILAAPSSDALNVMRDLSQNFPTKARSITQTVVSSEIRKEMEENQKFFKGTLGLQPGDSALFINGLHIDLDTQDIFSVFEVLRSEARVMEGLRSLLIETPFIHDILKLNVQPSDSDYAVDIRNPAVNWINNLETDSRYGSWPYNVQELLRPTFPGVIRQIRKNFHNLVVILDPTHESSAELLNVAEMFYSNNIPLRQTWCGSAPGFNYITEELDAPAAFDTSSRREKSTAVANSMNYMTKKGMAPKDHHDDGYIRPVTFWVVGDFDQPSGRQLLYDAIRHMKTSNNVRLGLINNPSDSPSEENSXVARAIWAXMQTQTANNAKNYITKLAKEETAKALETGADVTQFTVGGMDVALFKSAFEGPKFDFLLSHAVYCRDVLKLGKGQRAVISNGRLIGPLEEGEVFNQDDFLLLESIILKTSGERIKSKVQQFGVEEDRASDLVMKIDSLLSSQPKGEARIEHAFADDRYSAIKIRPTEGEVYFDMVAVVDPVTRDAQKLAPLLLVLKKLVNVNLRVFMNCQSKLSDLPLKSFYRYVLEPEVLFQTDGSFSPGPLAKFLDMPQTPLFTLNLNTPESWMVESIRTRYDLDNIYLEEVDSIVAAEYELEHLLLEGHCFDVSTGQPPRGLQFTLGTPSDPVIVDTIVMANLGYFQLKANPGAWILKLRRGRSDEIYKIYSHDGTDSPADADDLIVVLNNFKSRIIKVKVQKRPEKFSEELLSDGTQENDSSFWESLTRGFTGGVKTEESKQEKDDVINIFSLASGHLYERFLRIMMLSVLKNTKTPVKFWFLKNYLSPAFKEFIPYMAEQYGFQYELVQYKWPRWLHQQTEKQRIIWGYKILFLDVLFPLSVDKFLFVDADQIVRTDLKELRDLDLEGAPYGYTPFCESRREMDGFRFWKSGYWASHLAGRKYHISALYVVDLKKFRKIAAGDRLRGQYQGLSQDPNSLSNLDQDLPNNMIHQVPIKSLPQEWLWCETWCDDNSKKKAKTIDLCNNPQTKEPKLQAAVRIVAEWSDYDQEIKRLQNRVQERGAENHTTQKDKPDDTHTEL

SEQ ID NO: 3813 - protein, 1614 aa, Fistulifera solaris
MKSPMAKHSIIFSNLLLCPLLLIVVWVVEGNDELHTMVSPLVNRELETSVVANHWPSTPHNVFCEAFVYHNREEKGVEFLDRLVEENLDRVMSDAIAAELVMKVTPLMGAAKQLLQLSLALRAQSPHCELYRGLARETLQQQQSHHLFLHPSDAFAVVDGEIVAVDTLSSFLVTKPQTAVKTIPKETIIPASGENAYVILYGNMGTPLFAATYRLLRNLKIPFVVRHMGAVDYEERNKSNATGLPLQGYGVWLDIRNVEYKVFDDQGNDLFHSDNEIMVDLTKDDLDVPPEFLSGVNLTALGLDKDKALVRKLWSAHHNQNLHSSLIPPVWRRRQLPLQATTAILNSATDPLVTLQQISQNLPSMASSLVHLEVPDNLRKAVEVLEESGALRPGLLYINGKPLPIDMASFNLFDILNVIQKEQRNLDEIAEMLKDLPQAALHDVQAAWMNGKRFLEGSAGDKKDAKSKTLRIDVARGWKNAVIYLNDVEKDSLYSRWPTSLHHMRMNMEYGGPPSVRRNLFTLLAVMDPIEDPENVALNLGLQLMQAAYPVRIGLLLVDTKHFQECSTFLSKQGTTTSEPCPIPSIFDTKSEPDISKATATTQTVHHLLLTAIRDLRAYPGGIFSYIEYIMSFLRDARSNNESVSIGQLLDFHGKLYQSLNLKPAEEAVSDATTSMKAGDKNDDVIAYGHSIKFAVQRGLKPGMGFVNGRPLPVNMADESINRLFGEEQNHMLSLISQGKITDTSPKSVYAYLLEGDNVYAKIHPLLIDQSSGPIPKFLNLNDSFGEEALCSPNKMTKDEADRVNATKFVIDGIFDFSTELGMAHAAAFLSVMKSLPDKNERVAYRILPSNIKAASTAICSIFAQASFVESDALETILDPKYKSLTTKQLLDKLVDLSPEARGKMLSNDGLCSSQKYLQRKTSANNLIVGNGRTFLLDDELVTLSDVEMLLSVQMASSRAVTRILSPYFPVESPQYFLSVARVVALVSEHAEASSRTRLRDIISDLDVRSKEDLRKLSLSWNNGPNENREALKVHLGAVLDPLSEAAQRLSSILLIARDHLQFAIDLVLLPKSVLDNESKIPLTSYYRFVADHRSFFNFESPVASFSNLPECHTLTVRMDVPEPWDVQQSWALQDTDNLLCDTKTRCGDGPLLNGKGSTKVVYELKSLLVFGQCFETKGTPPNGLHLTLNRDTEVGVQIKQPLVEVDMDGSIAESSSNQFIPTNRAEMNYSDTVVMKTVGYWQLRASPGIWELAIAEGSKGATMFDMVDGSARGGRLVVDPNNIPKEVRMPIIVQDFSNRGELLVLQRKSGFAESTSLFHSEENGVVEADDTIHVFSLATGHLYERFLKIMMLSVTKRTTSKVKFWLFENFLSPTFKQSAQAMARNIGCEVEFVTYKWPQWLRSQSEKQRIIWGYKILFLDVLFPQSVKKIIYVDADQVVRGDLKELWDMDLKGAPYGYTPFCSSRKETLGYQFWREGFWKNHLRGKPYHISALYVVDLEVFRRNLVGDTLRSIYQQLSADPNSLANLDQDLPNYAQHSVPIFSLPQEWLWCESWCSDESKANAKTIDLCNNPMHKEPKVSMAKRVIQGDLFHESWVELDAEVRQYEEEYALTE

SEQ ID NO: 3814 - protein, 1502 aa, Pestalotiopsis fici
MLRLFKLPGGLAAALLAAICLNAGNASAGPSVSVDMKAAFSAPPYLLELLETAAQENATAYFPLLDRIAGGHFADATTDKLLYEKFLETLQNDGHISSAEALSTFKLALSMRSAAPRIEAHYQYYDTGVAPTLEALDSNCKDWVLMEGKQYCSADLSEVKSSVESGSQGRILPFDRKLGRGPEAVLYADITKPEFGAFHTALSEMARKGKVSYQLRYRPERRELLEKLPVSGYGVELQLKRTDYIVIDDREAEAKEESTETANLKVNLDAEEEVTDLKPLSSSELSALGVKAASFIMQSDDPFNSLLKLTQDFPKYSASFAAHNESEDFLREHYFNRGQMVPQGMNVLWMNGVQLIERQIDPYTLVDLLRRERKLIKGVTDLGLTGKQAVSLLGNREVTIAKSNDEVGRFDWRDEIESGRVILWLNNIEKDKRYAEYPTSLMSLMQRTYPGQIPPIRKDLFNLIVPVDFTDPDDLSLVVEQLRAFITRLLPIRFGLVPLTSSPEAEQQAKVVYYLIENYGLASLMVYLEACNTGKQVTKVDQSKFEKAIKDRAPREEAQPLPYAEIFDSEYYAQQIEHAQHWVSRLNAGTPVPPIFLNGQAISREKNWLQEMSIKLGQDLQLIQQGIYMGQIDEDMWIPNIFLEGAPARRNVYIFPSKENQLTVLDVNKVYTEHDDLFSIVPVIEASPDSSKETWAALSVIADLTSEAGLKLLLSALDFRRNNPGVRLDIVHNPLNSEDGDRVNTAIKDNIEQLLGADTLETLRLLVAHDESRTTLESSFDIALSQFLGAANLPPSTQILLLNGRVIGPIANDVEWTEDDFQQLMDFEQTSRILPVYQAIEALNLTENVSGPLAAAKLTSITALSTISDLPEGIFESAPTLRTTIFDTWESAQTMISVGDESTASIHFVAVLNPASEQGQKWAPILKVLSELDGVYLRIFLNPRERIDELPVKRFYRYVLGSSPSFDAAGKVQSLGASFKGIPSEALLNLGMDVQPAWLVAAKDSIHDLDNLKLGSINTDVEATYELENVLIEGHSRDSTGSPPRGVQLQLGTESDPHFADTIIMANLGYFQFKANPGYYNIQLKEGRSSDIFTIISVGAHGYNAASGDEGTEVVLMDFQGTTLYPRLARQPGQELEDVLEESGSSGSDLLSRGLKFAEGILGGSKSKSKSVSDTEHAEINIFSVASGHLYERMLNIMMVSVMKNTKHTVKFWFIEQFLSPSFKEFIPHLAKEYGFKYEMVTYKWPHWLRQQKEKQREIWGYKILFLDVLFPLSLDKVIFVDADQIVRTDMIDLVNLDLEGAPYGFTPMCDSRTEMEGFRFWKQGYWANYLRGLPYHISALYVVDLRRFRELAAGDRLRQQYHTLSADPASLSNLDQDLPNHMQFHIPIHSLPQEWLWCETWCSDESQKEARTIDLCNNPQTKEPKLDRARRQVPEWTVYDDEIAAVAKRVKTHVLTGDEQQKVLGGDKVEVEKNIKSRRFEEEPEVKTRVLEDDGHVKDEL

SEQ ID NO: 3815 - protein, 1498 aa, Diaporthe helianthi
MIRLSQLPGGLLASLLAATLFKAQPICAGPSVEIAMKASFPSPPYMIELLETAAQENESSYFPLLDRIADGYFSELKTDAELYESFLSALQEDGFITSDEDLSILKLALSTRSAVPRIEAHYQYYQTGVEPTLQGEQAGCDAWVIWEGQQHCIPSLDAGQARGDVSERQDRDLPFDRSLGDGPSCILYADITSPRFAPFHKVLSEKALNRECNYKLRHRRLSHENLEQLPVSGYGVALQLKRTDYIVIDDRKAEEDASQKVIASEIVLDQEDEVTDLKPLSTSELSSLALKASSFIMQSEDPFGTLLKLTQDFPKHSSSLAAHNVSDEFYNEHKGNRAELVPAGTNVLWMNGVQLVERQMDAFTLVDLLRSERKLINGVTNLGLTGEEAIDLLTHQSVAAAKASDDAQRFVWHDGPEDGKVIVYLNNVEKDKRYEGFPKHLMSLLQGGGMPGQLPQIRRDIFNLVFPVDLTNEEDVTLVSKQLQEFVRRKLPVRFAIVPLAFTDASERQAKIIYNLVETYGLGAMMTYLQTAIEDKKTADADKAIFEMAITNRTVREDATALSFEDVLASEHHAEQTRLSKVWADRLRAHGPSPVFFVDGLPMPREGNWLPPMSQAIGMDLQMLRQALFYGEVNDDMWIPDFFLQNAAKRRNTVIFSNDPKDLKVLDVNKLHSEHADLFEMIPVLESYPDSTKENWAVLTLVLDLTSPEGVKLAASALQFRSNSPGIRLDIIHNPLESEEAYKINSALKASQSDLAAADSEELLKRVIDTSEGLTEANDLYDSALRRFLVTAAIRPGQNMLILNGRIVGPVASAEDFNADDFQLLLDIEQKARILPVYTAIEDLGLAEKVSSPLAAAKVTSITALSTMPDLPEGIFESGSPLRISAFNVWNSTHTAFEIGDKSKATIQLVAVIDPASEQGQRWVPILKVLSELSGVYLKVFINPKEKLEELPVKRFYRYVLDHAPVFDESGKVKSPAAEFKSLPSEALLNVAMDVPPAWLVAAKESVHDLDNLKLSSIKSDIEVVYELENILIEGHSRESTGTLPRGAQLALSTEKDAKVADTIVMFNLGYFQFKANPGFYNIQLKEGRSSDIYYIESVGAKGYSPVPGDEGTETALMNFMGTTLYPRINRKPGMEEADVLEETDQGGVFNAVSKGLKFGKDLFGVKTKSSSDEEHAEINIFSVASGHLYERMLNIMMLSVMKNTKHSVKFWFIEQFLSPAFKDFLPFMAEEYGFKYEMVTYKWPHWLRQQKEKQREIWGYKILFLDVLFPLSLDKVIFVDADQIVRTDMYNLVQHDLEGAVYGFTPMCDSRTEMEGFRFWKQGYWANYLRGQPYHISALYVVDLRRFRELAAGDRLRQTYHTLSADPNSLSNLDQDLPNHMQFQIPIHSLPQEWLWCETWCSDETFAEAKTIDLCNNPQTKEPKLDRARRQVPEWTPYDEEIAALDRRRKGVVDGDKEKVVRGDGEELKEPQEEKNSKSRAFEGEAPEATPHVKDEL

SEQ ID NO: 3816 - protein, 1556 aa, Drosophila virilis
MLRLVCVLLLTAGTLTILSPASVSVEAAESSQSYPITTLINAKWTQTPLYLEIAEYLADEQAGLFWDYVQAVTTLDTALNDYDTESKQYNAALQLVRSHLSVPQLPLLKLVVSMHSLTPRIQTHFQLADELRAAGACQGAIYAQVGTELACTYAELEQKLKLPHAASSLDAEVGSYSFDHVYPGSENNTRTVVLYGDLGSAAFRPYHKLLEKAANAGKVRYLLRHQLAERSGRPVRLSGYGVELHLKSTEYKSQDDAPKPEAGNGSTAEAEESTNETDVQGFDFKLLKSKHPTLKRALDQLRQRLLQGNDEIAQLKAWEFQDLGLQAAAAIAEIQGDEALQLLQYTAHNFPMLARTLLAHKVSDELRAEIKHNSESLGRSLNVAPPDGALFINGLFFDADTMDLYTVVETLRSEIRVLESLHGNNVHGRLASALLALDLNSANKREFAIDIRDTAVQWINDIEQDAQYRRWPPSVMDLLRPTFPGMLRNIRKNVFNLVLVVDPLQPEARSVIKLAESFVIHQAPIRLGLVFDARAEEDATAADYVAIACAFNYVSQQKDARAALSFLTDIYAAVGETETVTKQHIVKQLTKEFSSLSSTKAKELLGEESDYDYGRQLATEFVQRLGFGAVRQPQALLNGAPMPSNIISADSDFEEAIFTEIMSQTTALQKSVYRGELTDNDEMINYLMNQPHVMPRLNQRILSQEDVKYLDINGMPAKQLGNAAALNKLSNRDMTATLMANLKYFGGKQSTERIGRASLQFLTIWVFADLETPEGCELLTHALDYVRGSESVRLAFIPNTEGVSDKRSLNRLAWAAMHSLEPAKATDQVLKWLRQKKQRIEDIPKQMEDILGSTELHLKMLRVYAQRVLGLSKSQRLVIGNGRLYGPLGAAESFDSADFALLARYSDLQYGDKVREVLKESATEVDSDFNSDTLLKLYASLLPRQTKTRFKLPSDLKTDHSVVKLPAKQQTQPHFDIVAVLDPASRAAQKLTPILILLRQTLNCQLHLYLTPVAQHSDMPVKNFYRYVIESEVQFEANGARAEGPLAKFSGLPANPLLTQQLQVPENWLVEAVRAVYDLDNIKLHDIGGPVHSEFGLEYLLLEGHCFDAASGAPPRGLQLVLGTKSQPALVDTIVMANLGYFQLKANPGAWTLRLRDGKSTDIYAISHAEGPNTLHQQQTGAVQVLITSLRSHVTKLRVSKRPGMQHAELLSDDTAPSQSGIWNSIASSFGGNSGTPGTDEDTETINIFSVASGHLYERLLRIMMVSLLKHTKSPVKFWFLKNYLSPQFTDFLPHMAKEYNFQYELVQYKWPRWLHQQTEKQRTIWGYKILFLDVLFPLNVRKIIFVDADAIVRTDIKELYDLNLGGAPYAYTPFCDSRKEMEGFRFWKQGYWRSHLMGRRYHISALYVVDLKRFRKIAAGDRLRGQYQALSQDPNSLSNLDQDLPNNMIHQVAIKSLPDEWLWCQTWCSDSSFKSAKVIDLCNNPQTKEAKLTAAQRIVPEWKDYDAELKALLARIEDHENHNIGSNKDNTEDDEEEHVVVITEPPPPEYVHGEL

SEQ ID NO: 3817 - protein, 1303 aa, Trichomonas vaginalis
MISFVLFSLVSSTFRPDHEVVMSTVAPWDESPLFDHVLFFMTDFSKEFATSFLKEIILNHDQINNETYIWNTAYKILPSYHHAYLKSQIELGFYTLRGEMYREMARTKGGSNFPDLIVIGKKLDTKEISCHYLPSDEIDVQPFELQYGVPQSIVYANILNKEVANFVLNLIETNIPFSLRPTSKTGKFGVHLRGFGVEMRPFKYSMEYGVKDSIILESKNEVHLHKDETTENISGIPESFYDIQNEQYFSEKFTSWVEKHNDTDLVRLMRDFSNNYPLYINEILKTNVTNTSIKDLDRLYSLRYNGRMVSSINGRVVEPNNLDIFSLIDIINKERTSRQILRDEFKLNKTQLNKVFKSRKIDISVVFFDTRSKYVQWYDNVTEDPRFENYNDDFEIFYGPLYQMPRVRRALAQYVSFVDPTTFGGFYQLYWGSNLVEDGFPVNFGIVPSFNLGNKVSRRVAFAFYHLARNVNSSEAIQFLIDSFLIAGIDKKTNYANMATLATYSAAYKLHCNSKCLKWSKLHKLYAGSPELDMILETNKYISDTQVQIPSNFMNGKDIETKSGMQSIHYHAQMQITEIGRMIAQFGIKETDPFDSLDLISRNFFLAKTLDNKVLNYNPVSLKISSLTYDRQLEFLKFISNTKWDHIDEGKINNYYFLFCNESVNTSTFFSFAKKNRFNKSKFKVNPEIPHSLQSIFPQDRTTCTLVVNGRIYSDIDPNNEEFLQLVDDWNTYFVMDQIYPLSSNISCNFSEFNCYLSSLYIDWMSDDIVRRFQSDDMFNINNSLIYKTKESSTDIVWELLIDPTKRSFQRISSIINYVEKHDLARIHLCILPPLELNESFTTLTTYYRNTLDCDYAVFSFLNDTTTYSAMPDMPMSWVYESMRASTDLDNILLSELTTHSQEGVYVVTNLLVEGMCLTTQQDTASGTELQLTNEMNERESDTIVMQNGYYQLQGKPGIWNIELGGSRSASIFELSKSQVVIDSFVSPMKIIKVKYLPGKEGMEVNNVSSSDNYKTTDRVDVFSVASGHLYERLLKIMMLSVRKQSTHNVKFWIVKNFLSPTFKATLPIMSSKYNFSYQLVSYKWPTWLRPQYEKQRIIWGNKILFLDTIFPLDLERVIYIDSDQIVRTDLNELMRMDFHGAPYAFTPMCNSRNETEPFRFWKQGYWLEYLQGKPYHISALFAVDLVRYRDLSAGDQLRFHYQQLSADHGSLSNLDQDLPNYAQHTIPIFSLPQEWLWCETWCSDETMSTAKTIDLCNNPLTHAPKLRIAQTRIEEWPGFDSLARNISASPDDYQYQFFKNGI

SEQ ID NO: 3818 - protein, 1582 aa, Esox lucius
MCLLNITQTQVYTKDLSMTNITRTMRNVLLLSLLLLKVQYVQSTSKGVSASLKAKWSMTPFLLETSEFIAEDGNEKFWHFVDTVKELTIYKNGESVRSYYNLVIKKAGQFLTELQVNLLKFALSLRSYSPAVYASQKIASDEPPPEACLAFVSVHGQHGCSTKDLKKLLKAAAARPNPYLYKNDHKYPGLNGTDVPVVILYAEIGTKKFGSFHKVLAEKAAAGKLIYVLRHFVAEPKPQKMLLSGYGVELAIKSTEYKAVDDTQVKGTINTEEDDIDEVQGFLFGKLKKSHPNLQKQFGELRKYLLESTNDMAPLKVWELQDLSFQAAASIMSVPRFDALKLMRDLSQNFPSKARSLTRVAVNQEMRKEIEDNQKGLSETMGIHPGDGGLFINGLHIDLDVHNPFSILDTIRGEAKILEGLHNLGIKGDHLGKLLRLPMNPVEENYALDIRHPAITWINDIETDSMYRSWPSGVQELLRATFPGVIRQIRRNLFNLVLFLDPVQEESVELVKLAELFYKHKIPLRIGFVFVVNTDDKVDGNTDAGVAFFRLLNYIADEYDLSHALMSMVSLYHKVEIGETLSVNTVSAFIKKNFPKASASRILGEDSEYDDKRKAGALFYKKSGLGSLPLALFNGVPLSADEMDPDELETVILQRIMDTTNFFQRAVYMGQLTEGTDVVEHLMDQPNVVPRINPLVLSTDRTYLDLTASPVADEWEDTTMFSYLDYKDKTAVIAKRMKYFTKNDEDGINGVTVWIIGDFEKASGRRLLLNALKHMRASSGVRVGVIDNPSGRVASEDNTVIYRAVWSTLLTQKSRATLEFVQKILKEETVHLLQQGTKMKDLLAQGMDSDAFEKRFNTMEVDFIRSQQLFCREVLKLNAGQGVVVSNGRILGPFEDEEEFSVEDFHLLEKITLRSTAEKIKARIKQMGRKGKQASDLVMKVDALLAAAPKGEGRRDVRFVKDKHSVLNFAPREKEVFYDVVAIVDPLTRDAQKMSSLLIVLTQVVNVKLQVFMNCRAKLSEMPLKSFYRFVLESDVSFLANETVSAGPVARFLELPESPLLTLNMITPESWMVEAVRSPYDLDNIHLQEVKGVVMAEYELEHLLLEGHCFDLSTGQPPRGLQFTLGMSQDPLMQDTIVMANLGYFQLKANPGAWILNLRKGRSEDIYHIQSHDGTDSPADSGDVKVLLNSFHSKIIKVRVQKKADKMNEDLLTEATENKGLWDSIARRDGALGARLRYYSVRSNAKRMCFCRPRIWSTFEKSLTGGGSSSEDEDKKREDVLNIFSVASGHLYERFLRIMMLSVLQHTKTPVKFWFLKNYLSPSFKESIPYMAETYGFQYELVHYKWPRWLHQQTEKQRIIWGYKILFLDVLFPLAVDKIIFVDADQIVRADLKELRDLDLEGAPYGYTPFCDSRKEMEGYRFWKTGYWASHLGNRRYHISALYVVDLKKFRKIAAGDRLRGQYQALSQDPNSLSNLDQDLPNNMIHQVAIKSLPQEWLWCETWCDNASKTTAKTIDLCNNPKTKEPKLSAAVRIVPEWVDYDNEIKQLLTNVQKRKEEATQIQTQAHSLSSPEKTGSQRDEL

SEQ ID NO: 3819 - protein, 1585 aa, Ganoderma sinense
MLGALIPLLAWPILCASAGKPPVNVELRTSWQATPILLESLESVAIEEPSSFFHLLDGVTDPSVFPLSKDKSTPKHAHKHVFDIALAMDHLAAPGAYVAAEMHVALHSASPKLEAFYQYYNDHHAARKRAFGKRGEECESWVDWYGSIVCDAKTLARLVEMETLDPAEGDTKATCSTAPPAPKLLPFDHVLSDPARLLDLPPKTAVLYGTLDSPNFRELHSYLYAAARAPSPHLTYVFRPIPPPPSASSERTYLSGYGVALDLKKMDYLAVDDRLQSGSGGSHEEDSGTAVQDDEEVDPIVTLLQQYPIDESVDVALPLTEEELHEIDFQAAQLIYDAEDKHKLRTLKHLAQNFPRYAGALARRVAVFPALLAELAENQPRARGGVTMAWLNGVALDERDMTPSALLRLVRRERGVMAGLMGGRLGMSSKEGIEVLTHRAVARAQSEGGGPMDGLFDASDRAEGGGVVGYFNDFEKDERYDRWGRNLKIILRQMYPGQFPTLKLNLFNVVLAVDLSQLSSVDFIATTVQMLISRGLPFRWGVAPIVETEDGSRMARLFYFLMENFGGDETLAFFLNISQRDEPMESLKPTVDWALVRSAFKSLLERKAEDLAEDLGLETDLDKILEGTAGDLEKQRAYALRLGTSLASAPQGHAFFNGKHFDLDDDFLRYLQTESAEHLQHVQLKVYKGELTDEEHADGMATYFYDLPTTAKRRNAYVHPSAKAGAGDLRIFGLPDLIEANGLKSSPGAFVYPAESQQVPLTTYVVADFDSEEGAKFLKEALASVTPDSLSRLSFIHNLASSSTRGKSDALESPSRSIAQLIVSDTLSKVAPERLLEALQPKELEESTGEGKQAPFSLSLDELADAEGRVLTAVEHEQYLNACRLVLRQLELKPGEHAVIVNGRVVGPIKPGEFVAGDFETLAAYEHHRRVQPVVDALLEVHGASAEATREDFAELVSVASSIVSSIQQPDPSEAGLFNAPQRPRLRNYQRLSSTYTGFSIGDNSTAIYHFGLLLDPLSEVAQKYTALFEWLQEMPGVYIEFHINPTRFEELPLKRFYRYNIAPRLTFDDNGNEIHATTQFTQLPVEPIYTLAMDAPQSWLIRPKEALYDLDNIQLSKLSGKDRVSGLKAIFDLDYLVVEGHARESVSSAPPRGLQMQLVTSDSTPIADTLVMANLGYLQFKTKPGVYKLEIRPGRGREIFEMESVGNEGWNSPTVGEAGDEVTVTSFEGVTLYPRLATLPGKEGEDVLLATGAHAEEASVVENLMAKVTSLFGSKHKGETAVVPVGDGQAEINIFTVASGHLYERFASIMILSVLRHTKSSVKFWFIENFLSPDFLEFLPHFASEYGFQYELITYKWPSWLRAQTEKQRIIWAYKILFLDVLFPMDLKKVIFVDADQIVRTDLKELVELDLHGAPYGYTPMGDDNPDTEGFRFWKTGYWKDFLRGLPYHISALYVIDLVRFREIAAGDMLRGHYQQLSADPNSLANLDQDLPNNLQREVPIFSLPEDWLWCETWCSKDRLHRAKTIDLCQNPLTKEPKLDRARQIPEWEVYDGEIAAFARRLQSNQTSGSEDESAANPVKHVEL

SEQ ID NO: 3820 - protein, 1673 aa, Phytophthora kernoviae
MRPTTLLSAGLAALLVSVQPSTTSARGVHVNLTASWPSSPLFPLLETSEFLAEENPLYFWQFLERLQTRTTDVQKLGDDVDALGELAVNVAEDIAPESKNILELMLATRTYAVKVEMFRQLALDSGVRPCGDDAETWAVYYHEAHCVEAVACSLDELAVLLHGETQTSESCVAAGVNDVELQVDHKYPHVESGNNPASVILYGLLGTPTFHAFHEKLVVQAKSNKIQYMVRHYPRDSPLDTLLQGYGVALDIKNMEYKTIDDSKKTEEEDGIVDDEEDEDDEDDDAIDDEEVEGLLFKPLMARHDAIAGELKQFYDVLIKKADNEQEEELKAWHLKDLGVSAARAIVDAKDPLKKLQTLSQDFPLQARKLAFSRRTLTSEFRGEIENSRAQIAFKRLKNKFILNGIAVDPTELSFNVFDFMKTLKEEWSVAKQLNGLPLNQSELENMLEHVRETSSEQPTVRINVRGSMGGSTPLYLNNIETDPNFANWSPDVNTLRRPSWNLIFLRKNMYECVLALDPLTSTGRSALSHIGFMRMRGAPVQWGLLVSSKELMASKTPDDRRALLETYKSLTTKAKATAWHFAKLLMLAQSKDVAEAGITDEENEEALDDAEETSKEASEQKEPKDQIIPTKIASAFIQHVGDDGNTDVLIENLLDAYANAAKVIGTTEENGVEARECLQSDRYDDEILSMTEYIHLKHVPLNSFLFNGVLQKNLDIQKSMMGNFGRDQPLYVALAHQGMLDDDMDLVEELMTSQDAYPAYLSVFEKSEAKHPGDIEVTSPKHLFADDVDGRLEDAIKTAISYLHAPGSRSLPKKQTVIFPADLNDPRDAGHVFQAVKAVLQDSEQALRIGIVHELSTAGKKKQSDSSVGELVAAILDTVGDSDNEVYLKFVLEALSCVVKKKTADATQAKLVGVWNKLTEDNKKQDPTSKKILALLRGKPKTWLTSKHRDALTQCNALLRSRFPPVFAEDIEEKTADKTLPHLFINGQRVNLPSQALSDEDVATIVSFDFKYRTQPVSKALVKRSAHLTIEEADNLSFAIMKTTGIVDKYVVTPRTSRYNVAENSLNTVRLSGDPSLQVAAYIDPLSEAAQKISPMLRMLHTQLNATIELVLVPADEITEFPLQRFYRYLFDKKTSLVATSVEFRKLPVHPILTMKIDTPEAWNVQILQAGDDLDNLRVDPNSPAEVKSTTSAVFQLENLLVYGQCRDMTFNMYSPPNGLQLVLDREVGAKLIHRDTLVMKNLGYFQLQATPGVWSLHLARGRAADLFDIIDPDTDLPLETQPIVVYDFGSHISQLIVRKKDGMENEELLQLTEEDDLSSDKPKSTSKSSDSTSAKDAGALRSYWNSMLSMMGKEGDGTTNKQQAAVADGDDASPSTTSDESALASPKVRTGETIHVFSLASGHLYERFVKIMMSSVLKRTNNPVTFWLLENFLSPDFKKAVPVLREQFGMDIRLVTYKWPNWLRQQTEKQRIIWGYKILFLDVLFPLGVQKIIYVDADQVVRADLKELWELDMQGKPYGYTPFCDSRNVGFQFWRQGYWKDHLRGKPYHISALYVVDLALFRQTAAGDMLRAVYSQLSADPNSLSNLDQDLPNYAQHQIPIFSLPQEWLWCESWCSDETKATAKTIDLCNNPKHKEPKLDMAKRVIAGELFNESWIELDQEIKDAEAKHTA

SEQ ID NO: 3821 - protein, 1592 aa, Agaricus bisporus
MAWALAVLGACLALQHANAGSPPVRVSLTPSWPDPPVVAEVLESVALVNPDGFFQLLDQVTDPDASIFAQSSTPQSLYQSGISSAVTHGVIQGAGDLAEVHMNLYLHAATPKLEAFYQHYEDRHKDSTGTVCGSWVDWYGQVVCDLESLVQLVERQLYPRPKILTFDHIHPSHSTTIDRPHRTAILYATLDSENFRGLHSYLYSEANKPEPRIQYVLRHVPPQGPRSKLNYLSGYGVSLDLKKMDYLAIDDRYSSEKHSQVDDKDSSRNMDDVFSLIQAHPENETLIDAKATLTEEEFNTIGYKAVQLIAESTNSLQTVTTLSQNFPKYATSLSRRVQVNSSIEEELGKKARKIAPGANYFWFNGQTVAPRDVHVFGLMNLLKKEKSLMKQLIGLGLERSEALEVMTHAEVTSAQKDGLVTDGLLDASDRPEKGDVIVWFNDIENDPKYMRGNPSVRGVLQAYPGSMPNVRRNLFNIILVLDLRQSSNIQLIGTLVYNVVSKGLPYRFGLVPLIENEDSLKMAKVISYMLKNFGWKITTNLCQSIANPTTIYEDHPEKVPEYVSLETVKGTYIALMSNEMDKSQFLPFDDLVGDKKFARPAFTIPTDKITRYVERLGAGTKQSASGRGHVFFNGKPLPLNAVLADALQAEAGQQLQYLQEKVYLNIVTDETHPDISTYFYDLPTTQKRRNQYIVPSTSKVKVVSVPEVLTKSGLDGVLEGGSWMYPSKSFYVKPVIVSLFVVADFDSEEGKETLKQALEFLAQTSESRVTFLHNPSATPNDSTRTSISSTLAHLISTHTLSKVTSQKLSEALDLSMTVTTGESDKQAPLDIVDIEDKFDSDSYGRYVKASRLAARALGIKGGETGIVINGRVIAPLGKDQFSTADFVSVVNFENKRRAVAVADALRSVKNGVDELDGTSYANLVSMLTSTIGASQQPDPSEVGLFDTPPRPRSRNYQILDSEYTAIKIGNNETALYHVAVVMDPLSLLAQKWSSLLQWLSTVPDVFVEIHMNPGRYTEMPLKRFYRYNVIPHATLSFDKATGNEIPSEVVFDDLPIDPIYTLAMDVPPSWLVRPRVALYDLDNILLTQLSPEDKSVDATFSLDYLVVEGHARNTKTLEPPRGVQLELVKTSDKTPIDDTLVVANLGYLQFKAKPGVFQLQIREGRGRKIFEMESVGNEGWNSPSVKEAGDEIVLDSFEGSTLYPRLERLPGMEWEDVLDEEENSEASVMGSFTNKFMSMFGKEEKGMTAVEEQADINIFTVASGLLYERFASIMILSVLRNTKSSVKFWFIENFLSPSFLEFIPHMAEKYGFKYELVTYKWPSWLRAQSEKQRIIWAYKILFLDVLFPMDLKKVVFVDADQIVRADLQELVDLDLQGAPYAFTPMGDDNTAMEGFRFWKTGYWKDFLQGLPYHISALYVIDLWKFRQMTAGDILRGQYQALSMDPNSLSNLDQDLPNNLQRQVPIFSLHEDWLWCETWCNKDRLDRAKTIDLCQNPLTKEPKLSRARQIPEWEEYDSEIAHFARELAKEGKIRSRFATADADVLASASAALVTDEILPVMGEPDYMEEYEDTDAPEEPSAAEESKISGRDEL

SEQ ID NO: 3822 - protein, 1370 aa, Chondrus crispus
MSEKCNYELKPKIVIYADLDSKEFASWLREVEDVVGHCEYHFLLRFWLPSRMNPESDDLRPSLQGFTVQAALKNTEYKVIDDRVFSTKLFQDCRYGETACDSPAPEFENDEYEWSEANSNASEEYTGLQAFRFLTRSDKGDLDDALKRLQAFTEDTPSVLSSNRFTDQESYDKTEEKRVLAAVRRFREQFGENDCLFINDRSFDVGSLTQGTEELLRCLSVTSVAEMKLRMLSEENGEHRIPIQTSGPSSDSSNRLRVNLDVQNSLKSSLVWVNDLLKDSRYRKWKPLNVRSEDDVMGFKTEVKRTRSDKGSDEDHLQLVKVKAHHLSLTILLDPGDPQQFPYTGIPQSVVHADLPIHVGMALIPNGQVSSLITATFHYFLRMKGRKTGFRFLQMIQQILQYMGGGYQQVELSEQVVELAFKQIAPEIEGGYGSARETLDGDEEIGGILDEARTFAEENGLLANASRAKDRSKENDSKLFSMLGIFNGIVLKDISADVIRIAIVEQERISALLGSSSLESDLVDSKIGGWVEADSSLIVVESLSEEMKAGDERVSQIKTKGELTRISGTVLFSVRHELEELRYEQSVSSGNVKREPMITVWLVASDQSSTEFKSASSLMNQLAKSKFAERTRSRFALINPELLLHRKALEASSNGDGLADIVFVINGRILPFSKAPSLGELKTEVASEYKDMPPAQRSADTELIRSMLMKDVAQACTSQQSSAAGTGHVDFGDFANAVSSSNLSEYMFSSEGDQKRQADTALRISAVVNPIGQRPYILSSLLMAMREVYGRKDMFMTLAIVPLEKQMQMKHHVSSTYSKFVLGIPQTSDAVGGIANRLTALFRRLPIARVLTFAVIPPRPWFVSSYSTNYDMDNVLLPTSGAKRLHAEYEIKSLIVEGSCIDEDDKPPQGLKLILENGNGISVDTLVMANLGYFQLKVPTPGRWFLRLAPGPSAEIFSLRIMEMYTGMVKSIYTVDSEGRVPILVASLSGAGGILLRVERKPGMENMSVLDPNRIKGDTKSLTERLKTSISSMYKVTAPKSSPVRILERDGGYIHVFSVASGHLYERFLKIMMSSVTRHASRPVKFWLLENYLSPSFKKMLPLFAKQLGCEVGMVTYKWPGWLRAQTEKQRIIWAYKILFLDVLFPLDVSRVIFVDSDQVARGDLAELMDIDLEGAPYGYVPFCDSRKEVEGYRFWKQGFWKETLRGAKYRISALYVVDLARFRETAAGDTLRYIYQSLSADPNSLSNLDQDLPNYASAGSLGAGASVPIFDLPAEWLWCESWCDDESKKTAKTIDLCNNPMTKEPKLESAKRIISEWEEYDDAASRMTEEIYERLAGATVDLTIQTSRVGTCDAKGPCTPPEDTAKDEL

SEQ ID NO: 3823 - protein, 1722 aa, Bremia lactucae
MRRQVHNRGPHATGAHLPLGRHLTVRIRIAHDKTAEQEHGIDSLQMVLYLKQIHVEHQSSFRKTMRRSTWLGTVLAALLAAVPPLMVYARGVHVKLKASWPTSPFFPLMETSEFLADENPLYFWQFLEQLEERTSYVELMSSDVDALAELAVVVAEFVAPGLQNVLELMLATRTYSVKVEMFRQLGLDSGVRPCGVYADTWAVFYREPHCVEAVACSVVDLDDSLRNMKQKISKKTCIAAGFNDIELRVDHKYPCVASTNEEITPMTAILYGLVGTTSFHAFHSTLVNEAKQSKIQYIVRHYPRDSPLETLLQGYGVALDIKNMEYKTIDDSRMAGGDETAANGENEVDEDEDKDIDDEEVSGFLFKPLLARHVAIAFKLKQFHDMLVKKSEQDQELRAWHLKDLGASAVRAIVDAKNSLKRLETLSQDFPIQAKRLAFSQKLISTELREEIASTRMQASMRGLTNKFIMNGIAIDPTERSFNVFDFMKTLKTEWSVAKQLASLTLNQTELEDMLTHVRETNQEQPIVRIHVRGSMDGTTPLYLNNIETDANSADWPSDINVLKRPAWSLIFLRKNMYECVLVMDPLTGTGRAALSHVEFLQARNAPIQWALLISSKELIASNTFDERQALVEKYKTLKGTDKANPWHFTKLLMLAQAKEKCSKVTIDGEKKQAKGGDDDTSNEKEKVDQVRSMKIVSGFLQRVGNDDSSIILIDRLVEAYAEAAAEIGSPEENEDEAMACLSSDQFDEEVLSMTEFIILKHLPLNSFIFNGVIQKDLDIQGAIMANFGRDQPLYINMAYRDMLNNEMDLIEQLLMEQNAYFAYLSIFESSRDRLGDKEVDLPNHLVADDVDGRLKAAAQQAISYLHPRGSRNLPKKQTVIFPVYLNDPRDADHAYRVVKAVLEDSDKSLRVGIVPQISSDVKSEGVGELLAAILAITGDSDNEVYLKFVLEALTCIVKKKSVEASRGKLKEIWKGTADSRDENDSIYIKVLTLLSQKPGKWLSTKQRGVLTRFNALLRSRFPSTFTDESLSKSALPYIFVNGRQVDLPRHSLSDEDVATILSFDLKHRSQPVAKALIKRSATLNAKEADKLSFSIMKTTGIVDKYVKIDRTSRMEVNENSLNTVRLDGDPSLQVTAYVDPLSEAAQVMSSLLCMLHSQLNASIELVLIPANEYASFPLQRFYRYLFDKKLSLAETSVEFRKLPVQPILTMKIDTPEAWNVQTFLAGDDLDNLRVDPESLAAVRSTTRAVFQLESLLVYGQCSDITFNMYSPPNGLQLVLEREVGAQLLHRDTLVMQNLGYFQLQATPGVWSLHLAEGRAAKLFDIINSDTELRLEARPITVFDFGSHMHQFLVRKKAGMEHEVLLQSIEDAVSEDTTKTDSNTLSSSHGEGALRSYWNSLLNVMGKNDDNLDTISQAAVKEVNETSAVHQNSTSLPQKRRTGETIHVFSVASGYLYERFVKIMMSSVLKRTNNPVTFWLLENFLSPDFKKSIPILREQLGMDIRLVTYKWPNWLRQQTEKQRIIWGYKILFLDVLFPLGVQKIIYVDADQVVRADLKELWELDLEGKPYGYTPFCNSRNIGFQFWRQGFWKDHLRGKPYHISALYVVDLALFRQMAAGDMLRAVYSQLSADPNSLANLDQDLPNYVQNQIPIFSLPQEWLWCESWCSDETKATAKTIDLCNNPQHKEPKLDMAKRIINGELFDESWTELDQEIKDAEGKHA

SEQ ID NO: 3824 - protein, 1539 aa, Penaeus vannamei
FKDIIILKVRQINAMREILGPLLGLLCFLLTGTTVKCQGKVKPVTTHLSAKWSHTPLLLETAEYMREESIATFWEFVEAVSQKDFTLFTKGSDKAAYNEILGTAGQFLSPSQVSILKLSLSMRVYSPKIEMFRQIALDRNLPTGEDCIAVFDVNGELTCNIEAMKKLVEVGSGTKPVSYDMDHHYPGGENSKVGVTLYAELGTKEFRIHHLAVKELVGLGKIDYVLRPYIKGNSKKKVRLSGYGVELAIKSTEYKAQDDTKVQDDGGRQEEDDEQEVEVEGFLFSKLESLHPEKMEELEQLRNHLVESRHEMAPMKVWQLQHLSMQAAQRIMTTPREEQLSVFVHTAQNFPMLARSLVRTKVDDKMKREILKNQNQLSAQMDVNPSDAALFINGMYFDMDFTDIYTLLDHIRTEDRVMGGLYKLGVPGESLSTLLNIDLSESKQDYGIDIRDTAIVWMNDIENDRAYSKWSSSVGELLRPTYPGMLRSIRKNFHNLVIVAEPEKATTADLIRLVEGFLTHNAPVRIGIVMSVNPDQTLRGYDDAGVAMLCAFNYVAQNLEGREDANYKALQFLVDLYSNVQGDITVDDVTSHFKSKYRSVDLEDVFGEDSDYDVGRMLAQEFVEKAGITSLPQALMNGVPLPEKHLNADEFEEVVLMDVMRTTQTLQRAVYKGQLEDKHDVVDWLMSLPNIMPRLNERILSTKNSKFIDLTGTSGETLSSVPVESFATQKAPEMTATLANSCRYITTKNDHTLRPLTVWIVGDFDTYEGRAILLEGVKYLRESNSIRICAIHNTDLSSESPKLFSRAVEVAQTTLPPAVARQFLAKVLEKDNAKKIIAGTKKWKDFEIAGLDIDAFTSRMNSFKDSVFKAHSVFCKKVLALSPGQRTVVANGRHLGTFKATEKFVMEDFGLLEKYVHSTFGEKLTEVLIGEDPPVNSDISDLTMKVAGVLQTKPQSKGRTTVNLRSDQYSVVKIPARNPNMPVFDIVAVCDPVSNAAQKIGPILMVLQEIVNAEIRVVLNAREKHSEMPLRRFYRYVLEPEPQFTEAGDMTAGPYARFTGLPESSILTLNYHAPENWLVEVVKSVYDLDNIKLDLVETGVHSEFELEHLLLEGHCFEQSSGNPPRGLQFTLGNRQQPVLVDTIVMANLGYFQLKANPGAWLLRLRQGRSADIYTIASHEGTDTPVGSEDVEIIISSFRSHVVKVRVGKQPGKQHLELLADENEESGGLWNSITSTFSSSGAKEDETEKVNIFSVASGHLYERFLRIMMVSVRRHTKAPVKFWFLKNFLSPNFKDILPLLAKEYGFEYELVQYKWPRWLHQQTEKQRIIWGYKILFLDVLFPLDVKKIIFVDADQVVRADVKDLNNEELDGAPYGFVPFCESRKEIEGFRFWKQGYWRNHLAGRKYHISALFVVDLKKFRRIAAGDRLRGQYQGLSQDPNSLSNLDQDLPNNMIHQVRIKSLPQDWLWCESWCDDESKKSAKIIDLCNNPMTKEAKLVAAQRIIPEWTEYDNEIKAVLKGFKENKSYTEEQPSQSPHIEL

SEQ ID NO: 3825 - protein, 1532 aa, Brugia malayi
MKSLWLFIIMKSLWLFIILSAFPKMIHSSPSKKSVITSLHAKWSQTSFIAEASEFMAQESDTLFWAYIDEIVEKLNVDEWHTYSDAKQYDLAVRLASYLLEETRMNLLKFALSLRAHSPTVLLFQRLGTERKKSCAAFADVHGTLTCDVNDLEKVIESDDRGPVPTVYSIDHVFPVSKEHNVTLIIYGELATPSWRKFHLAAKALSRSGKVKYVLRHFVKDIRDDKPLLSGYGVELAIKSTEYKAVDDSNAVTDKVAVEESSEEYIDNEEDNYGFNFNTLRRLHSDLKESIGQFRLHLLERDELTPLKVWQVQELSYQAAQKIVQADPQKAINIMVDSSQNFPLAARSLSRQIVRKEFISEVSANQEQLMEYGISEGESTFFINGIMVDIDALDVFQVLNVLKQEEKLANGFFHMGIKNEYLSILMDLELNSERVSYALDFRPAFPEYLNNLDTDKQYRQWANSVGLLLQPYFPGMLRPIARNLYTLIFIVDPSQKETRDLLQYALRFYAHEIPVRLGVVFVANDEKEITGFDDASVAMLNLYNFIKSNNGIQKALDVLIEVLNVKEESVSPKDVLSYFQMKYPNHDPNSVFGSNSDYDNGRSTGHKFLRDSGLGLTPKVLLNGVVLDDSGITADHFEETVMMEIMRVTSRLQKAVMEKKLKDQDNVMNWILSQPEVMPRINKLILDSPLSPDALYLDLTSVKKCTSVSPTQYYKLPPKEQNQCMLKRMRYITRTEEMKTYFSTVWVVTDLETAEGRLLAYNAIRHLKRSHTMRVAIINNPKNIEKATTSGSITMLVNIASRILIPKQMKSFITKLVKEEIVSELLNKQITLDDLSVNDMNMTLFYKEAKQINSDEIIVYAKYSKSILGLKPGQLALVVNGLLIGPFGDSEVLDVADMELIDKLTLLRGGKVVKDYMEKWGIQTRYGESSDMVARSMALIGSVGVTKKRRFIPLLREKESVLTISGNNEEGLILALCIVDPLSTQAQRLGHLLTVIQKIVNVEVKLVMNPRAKLSELPLKRFYRLVLQPSVMFDNSGRISDAAYEARFTALPNKQLLTLAVVPPDAWMVQSVYAVYDLDNIRLENVPGNVLAKFELEHILLEGHCFDDMTGSPPRGLQFTLGTLVNPSRYDTIVMANLGYFQLKADPGAWILNLRDGKSKDIYNIVSHVNTESEDEAGVNVLIDSFSGRTIRVRVAKKKGKEKENLLSEGKSEGESEDHHSIWSSISTTSISGDEKHDAINIFSLASGHLYERFLRIMILSVMKHTKHPVNFWLLKNYLSPNFKETLPQMAKHYGFNYEFIEYRWPRWLHQQTEKQRVMWGYKILFLDVLFPLGVRKIIFVDADQIVRTDLMELMELDLGGAPYGFTPFCDSRTSMDGFRFWKKGYWANHLAGRKYHISALYVIDLVKFRQVAAGDRLRGQYQGLSADPNSLSNLDQDLPNNMIHQVRIKSLPQEWLWCETWCDDASKEKAKTIDLCNNPQTKEPKLDSAMRIIPEWKDYDAEIKALFDIRSKNHTGQTKSGHERTDKHTEL

SEQ ID NO: 3826 - protein, 1537 aa, Malassezia pachydermatis
MTAIFGWIGLLLWCVVQLAIAGDVPVHIRLRHGWHNYTNAATHASTFVEMMEAAHEVFPNELFDMVSHVWPACGKDTTKVMRTAGHKDLFDSIEDFLRTYATSVGIPRVEERLDEWRIHVAQHWQAPRVESMYQIFNTSRELQGHSPTCDTFVYFDDRVLCSPNDLRAAITKPPRTLPTVFPHDHVYPSGQSALPALILYADPYSTTFGAFHSELMTLAGEQRIRYVLRWRPTLATVSEPRSTNYFSGFGASMHLKKVDYLVLDDRQIDAAEASEAVPIQSDRIGSLYRDVQDQLYSLGGERTSSVQEAVLKQSNFSLVDGLYLGQAAAHAILTAEDPLSTMESIVHDFPAHAVALQAYAAHLAENDPIIEYLNERNYRLIGAGSSQIWINGRAVPKSDLELLTFFKSIQEERRLLDDFGAPELGVSPEGVESLLTQEAINLQFSPSPRDIVLYDTSDTIEQESGFGTTVIAWINNLESEEYKLWPNTLEMMMEYRWPSGFPLIARNFFQVVMLLDVGHPEALEFMSEALEAMMTDYPFRWGLVPLLRDDASEEIAQVLWHAINMLQPREIAPFLLHLAKGPTVNGRVDPEAARAHLGSIVRNIKKRGIDLVQEFVHYKQVSPLFKYRLELAHAYVERVYPNPRPGTYGVAFLNGQEISLSERFIEDLASAVSYQLHLAHDDITRGRIEKTENYETYFFDLKGTVKERSQLADMLEDAKALLRPYKFVSLPEVFRRLGSLADPLRHFLYDPKAHDSLVSLRVVGDIDSDVGRHSVVEVLKAMEAEGPSFRVSFIHTGADHGVLSHFLLSAMMSGALSDIPPSRLRSAIEAADISSALDALSHEFTSPKSDMVWSQIAPTFVSAAGLDVGLLPTLILNGQVLPHIRHLKAREVTAAVEWEQQKHVSTLLNTLTVPERPRDVRAQVVEFATAILGKVFVKQVTDTGSSEASSNPRVPIAPLIASSPVAFKVGDASAAIHVSVIMDPIAEEAPQLTSILRMLSSVRGVRLSILMNPRMRVTAMPLQRFTRYDVRIRPEFDAQGHERIPGIAFNHLPQQAVLTMQLHAPRSMVTMADEAIYDLDNIRLSDVHGSVDAIYAIKSLLLEGYAQALPNSIPRGLQLVLETDDQSTQLDTIVMENLGYFQFRAQPGHWHLSIREGRSSDVYEMLSVGSQGWRSPPVNETSSSVLIDSRLGLTVFPQFRKRLGKTVEELISERPKDDSGLASVSHGLQKQWGKALRLLRGTKSKHADINIFTLASGHLYERMTYIMILSVLRHTKSSVKFWFVENFLSPSFKAFIPHLAEAYGFKYELITFAWPEWLREQTEKQRMIWAYKILFLDVMFPLDLDRVIFVDADQIVRSDLKELVDMDLRNAPYGYPPMGDDSEDMDGYRFWKKGYWKAFLRGRTYHISALYVVDLQRFRYMAAGDILRRHYQRLTADPNSLANLDQDLPNHLQTYLPIYTLDKTWLWCETWCSYDWLSQAKTIDLCSNPKTKEPKLDRARRQIPEWTELDNEVAALAHSLQAKSFDSNAPVEMHDEL

SEQ ID NO: 3827 - protein, 397 aa, Aphanomyces astaci
MNIGQVRRSGEIFCVLPDQHVIYVNGRPLELVAPVTPSLFDGLVTYESATRSKAVSKAYVSQFKHNVLTAEDAADKTLQLNVVLSMVDSYLKTPRVAAVLPDDVQRPTYSYVTPSGSSSLDVVAYLDPLSDTAQRASGILRMLHSVLHAKITLVLVPPPSYDEFPLKRFYRFLWGGTSSSLVEFDRLPRHPVLTLNIETPELWNVQMVQSDVDIDNIQQNASATFTIKDVLVYGQCVDKTNAQYPTLPNGLQLVLERSVAKLHSHKDTVDERVDAVPVIVYDFLSKTLQLEVKKQPGQEGVRLLDDGPEATKAPAQPEETSVWTSLTDKQRIIWGYKILFLDVLFPLGVDKIIYVDADQVVRADLKELWTMDLQGKAYGYTPFCDSRNVGFQFWRKG

SEQ ID NO: 3828 - protein, 1609 aa, Aegilops tauschii
MATAGGSRSGVSRAAFALVAVVLVGCLGGGVSVAEIRRQKNVQVALRAKWAGTPLLLEASELLSKERRDYFWEFIGHWKELDKGSECLTAKCCAQKIVEDVRSFLSEPLASIFEFSLTLRSASPRLVLYKQLAEESLSSVPVKDDALEQISGSGAVEGTCCWVDTGNTLFFNSDDLHKWLEGSGKGATDSTGQPELFDFDHVYPRSNITAPVAIFYGAVGTKCFKELHVHLAEASKQGKVRYALRPVLPSGCQATSSFCGSIGAADAVTLSGYGVELALKNMEYKAMDDTAIKKGVALEDPKTEDLSQEVRGFIFSKILERKPELNAEIMSFRDYLLSSTVSDTLEVWELKDLGHQTAQRILHASDPLQSMQEINQNFPSVVSSLSRMKVDDSIKDEIIANQRMVPPGKSLMALNGALINIEDLDLYLLMDMVREELSLADQFIRLKLPQSAAHKILSAAPPAESNSFRVDFRSSHVHYLNNLEEDALYKRWRSNLNELLMPVYPGQMRYIRKNLFHAVYVFDPASACGAETIDTILSLHQDSVPVRFGIIMYSSRLINVIEENDGSKSDEDTSTLIMRLFLYIKETYSTQLAFQFLSDIHRLRNGGDDYSEEPVEVHHVEEAFVDSLLSGAKSHPQDVLLKLQKENLYKQEADENSRFVHKLGLYKLQCCLLMNGLVHEPNEDATMNAMNDELPRIQEQVYYGHIQSHTDVLEKFLSESSYKRYNPSITGKSTEKKRFVSLFASYHQEDSVLHDISYLHSHGTRDDAKPVTHLLAVDLSSVTGTKLLHEAIRYLMDGSNRARVGLLLYACSDSVSTILLMKDIIDRTISSFSGKEKVLDFLYGLCKYYEGQHMVASSAAGDTLSSIKDKVYSLAAETALPVDDYKAWLTSFSADTILKGIDKLSDFLFGQLGLEFGSNAVITNGRIFVVDDGDSFLNEDLGLLESMEYELRTKYIHEIIEEVEWAGVDPDYLTSKFYSDITMLVSSSMSIRERPSERAHFEILNAEYSAIKLNSMNSSVHIDAVIDPLSPAGQKLSPLLRILSQQIQPSMRIVLNPISSLADLPLKNYYRFVLPSMDDFSSTDFSVHGPKAFFSNMPLSKTLTMNIDVPEPWLVEPVVAIHDLDNILLENLGDVRTLQAVYELEALLLTGHCMEKDREPPRGLQFILGTKQRPHLVDTLVMSNLGYWQMKVSPGVWYLQLAPGRSADLYELPSKLIAIDSLRGKLLHIEVQKKKGKEHEDLLNADDDNHVQEKTDNKGWNTNLLKWASSFISGDASLKKKAEKNTVSISSDLKDARQGETINIFSVASGHLYERFLKIMILSVLKKTERPVKFWFIKNYLSPQFKDVIPHMALEYGFEYELITYKWPTWLHKQKEKQRIIWAYKILFLDVIFPLSLRKVIFVDADQIVRTDMGELYDMDLKGRPLAYTPFCDNNKEMDGYRFWKQGFWKDHLRGRPYHISALYVVDLAKFRQTAAGDNLRVVYETLSKDPNSLSNLDQDLPNYAQHTVPIFSLPQEWLWCESWCGNATKAQAKTIDLCNNPMTKEPKLQGAKRIVPEWVDFDAEARHFTARILGENVEEIAEAIPPSSESDAPKPDHDDSSQDAKDEL

SEQ ID NO: 3829 - protein, 1595 aa, Alligator mississippiensis
MACGGWGRGVLSGRLAVGRKRKLSARKSGSDGRSRKGAWRTLTGAGSAAAPSARAAGISYKMGIFIAVLGIWFSSSLVKADSKAVTTSLTTKWYSTPLLLEASEFLSEESQEKFWSFVEASQDIRSSSPGGNNYSSYHAMLKIASQNLSPLQKNLLKFSLSLRSYSATVQAFQQIAADEPPPEGCSSFFAVHGEKTCEFNTLENLLQTASKRPKPFLFKGDHKYPVSNYESPTVILYAEIGSEEFSRLHNWLVSKAKAGEITYVLRHYVANPSKEKVYLSGYGVELAIKSTEYKSKDDTQVKGTDMNATVIDENDPIDEVQGFLFGKLRQLYPELKEELKELRKHLVESTNEMAPLKVWQLQDLSFQTAARILAAPTVDALMVMKDLSQNFPTKARAITKTAVSSEIRTEIEENQKYFKGTLGLQPGDSALFINGLHIDLDTQDIFSLIDVLRNEARVMEGLHRLGIEGLSLHNVLKLNIQPSDSDYAVDIRNPAISWINNLEVDSRYNSWPSSMQELLRPTFPGVIRQIRKNFHNFVLIVDPTHESTAELLNVAEMFFSNHIPLRIGLVFVVNDSEDIDGLQDAGVALLRAYNYVAQESDNNYAFQTVISMYNKVKTGDQLKVEHVVSVLEKQYPYVEVNSILGIDSAYDQNRKEGRSYYEQTGVGPLPIVLFNGMPFQKEQLDPDDLETVTMHKILETTSFFQRAVYLVELSNDQDVVDYIMNQPNVVPRINSRILTSDREYLDLTATNNFFVDDFARFTVLDSKDKTAAIANSMTYLTKKGMSSKEIYDDSFVRPVTFWIVGDFDKASGRQLLYDAIKHQKSSNNVRISMINNPSEEPSNENTLITRAIWAALQTQTSNNAKNFITKMAKEEIAKALEAGADIAEFAVGGMDINSFKDAFESPKVDFVLSHAVYCRDVLKLKKGQRAVISNGRIIGPLEDGEMFNQDDFHLLENIILKTSGQKIKSHIQQLGVEEDLASDLVMKVDALLSAQPKGEARIEYHFFEERYSAVKLRPKEGETYFDVVAIVDPVTRDAQRLAPLLLVLNQLINMNLRVFMNCQSKLSDMPLKSFYRYVLEPEISFTADDNFAPGPIAKFLDMPQSPLFTLNLNTPESWMVESVRTPYDIDNIYLEEVDNIVAAEYELEYLLLEGHCYDITTGQPPRGLQFTLGTSTKPVVVDTIVMANLGYFQLKANPGAWVLKLRKGRSEDIYRIYSHDGTDSPPDANEVIVVLNNFKSKIIKVKVQKKLDMMNEDLLSDGTSENESGFWESLKWGFTGGQKNEDVRQEKDDVINIFSVASGHLYERFLRIMMLSVLKHTKTPVKFWFLKNYLSPTFKEFIPYMAENYSFQYELVQYKWPRWLHQQTEKQRIIWGYKILFLDVLFPLAVDKFLFVDADQIVRTDLKELRDFNLDGAPYGYTPFCDSRKEMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLQAAMRIVSEWQDYDLEIKQLYSRFQEEKEIGTIKTTGETKHQSKEDPAAHVEL

SEQ ID NO: 3830 - protein, 1511 aa, Ceratotherium simum
MAKAANVARLLLGSSTLWLLLLGFGTASASKAVTAHLAAKWPETPLLLEASEFMAEESNEKFWQFLETVKELAIYKQTESDYSYYNLILKKAGQFLDDLHINLLKFAFSIRAYSPAIQMFQQIAADEPPPDGCDAFVVIHKKHTCKINEIKKLLKKATSRPRPYLFKGDHKFPTNKENLPVIILYAEMGTRAFGKFHTVLSEKAQNGEILYVLRHYIQKPVSQKTYLSGYGVELAIKSTEYKALDDTQVKTVTNTTVDDETETKEVQGFLFGKLKERYSDLKDNLTAFQKYLIESNKEMMPLKVWELQDLSFQAASRIMSTPVYDAVKLMKDISQNFPIRARSLTRIAVNQHMREEIQENQKNLHYRFEIQPGDACLFINGLRVDMDTYDPFSLLDMLKLEGKMMNGLHNLGINGEDMSKFLKLNSHVWDSTYALDIRHSSIMWINDLENDNLYVTWPASCQELLKPIFPGGIPSIRRNFHNLVLFVDPAQEYALDFIKLAKLFYYHKTPLRIGFVFIVNTDDEVDGTKDAGVAFWRAFNYIAEEHDASQAFVSMLKMYQKVKNQNILTVDSVKSVLQNKFPQADTGDILGIHSKYDDKRKAGASFYEMTGLGPLPQALYNGESFNHEELNNKELEKAVLHRMMDTAVYLQREVFMGRLNDQTSAVDFLMDKNNVVPRINPLILHTKRQYLNLISTSVTADIEDFSTFSFLDSQDKTAVIAKSMYYLTQEDYDVVSSVTLWIIADFDKPSGRKLLFNALKHMKTSVHSRLGVIYNPTSKINEENTAISRGILAAFLTQKNSFLRNFLRKLAKEETATAIYSGDKIKTFLTEGMDKNAFEKKYNTIGVNIFRTHQLFCQDVLKLRPGEIGVVSNGKFLGPIDENLYAEDFHLLEKITFTNVVEKIKGIVESMEINSKNMSDLIMKVDALVSSLPKRASRYDVTFLKENHSIIKINPQENDMFFDVIAIVDPLTREAQKMSQLLIVLGKMINMKVKLFMNCRGKLSEAPLKSFYRFVLEPELMLMANDSIGPVAKFLDIPESPLLTLNMITPEGWLVDTVHSNCDLDNIHLKDIERTVTAEYELEYLLLEGHCFDIITEQPPRGLQFTLGTKNKPVVVDTIVMANLGYFQLKANPGAWILKLRQGKSEDIYQIVGHGGTDSQPDVGDVIVVLNSFKSKILEVQVQKKPDQIKEDVLSDEDEKKGMWDSIKSFTRRLHKEKDKKETDILNIFSVASGHLYERFLRIMMLSVLRNTKTPVKFWFLKNYLSPTFKEVIPHMAKKYGFQYELVQYRWPRWLHQQTEKQRIIWGYKILFLDVLFPLAVDKIIFVDADQIVRHDLKELRDFNLDGAPYGYTPFCDSRTEMDGYRFWKTGYWASHLLRRKYHISALYVVDLKKFRRIAAGDRLRGQYQALSQDPNSLSNLDQDLPNNMIYQVAIKSLPQDWLWCETWCDDESKERAKTIDLCNNPKTKEPKLKAAARIAPEWVEYDAEIRQLLDRLENEKKNAILTHDEL

SEQ ID NO: 3831 - protein, 1700 aa, Camelus bactrianus
MASIPKEQGETEESGKPLQIDFAISRQSIRPKSQFSSVPHILCVSRYGAAGASVKLRTRAPPAPTWLGGPPAGAPGRARRACARRKPGPGRSNGLELPPPEVGGHAAGGVGGSVAAAGCGRGVRAARTALSAPWQRPPTCPRGGRVRRGCGRPGTPAAPRTPPPSRPGRPFLASVVLVKCKRKQKLKKKLVRKKEAVFGNLGESQPIQIAKGAKIGKLSVENACSVKQAKCVAGYLLLYSEFMAEESNEKFWQFLETVQELAVYKQTESDYSYYNLILKKAGQFLDNLHINLLKFAFSIRAYSPTIQMFQQIAADEPPPDGCDAFVVIHKKRTCKVNNIKKLLKKATSRPRPYLFKGDHTFPTNKENLPVIILYAEMGTRAFRKFHTVLLEKAQNGEILYVLRHYIQKPSSQKMYLSGYGVELAIKSTEYKALDDTQVKTVTNAGVEDKTETNEVQGFLFGKLKERYSDLRDNLTTFQKYLIESNKEMMPLKVWELQDLSFQAASQIMSTPVYDALKLMKDISQNFPIKARSLTRIAVNERMREEIEENQKHLRDRYEIRPGDASLYINGLHIDINAYDPFSLLDMLRLEGKLMHGLHNLGVDKEDVSELLKLSSHNWDDIYALDIRHSSIMWINDLESDDLYVSWPANCREVLKPVFPGSIPSIRRNFHNLVLFIDPAQEYTLEFIKLAEHFYFYKVPLRIGFVFIVNTDDEVDGTADAGVALWRAFQYIAEEYDTTQAFISIVNMYKKVENRNILTVDNVKSVLQSTFPHANIWDILGTYSKYDGKREAGANFYKMTGLGPLPQSLYNGEPLQDEDFVKLEVAILQRMVDTTVELQKYVLTGILNDQTDTVDFLMVMNNAVPRINPLILHTEWQYLNLISTSVTADIEDFSTFFFLDSQDKSAVIAENMHYLTPEDDRLSPVTFWIIADFDKPSGRKLLFKALKHMKTSVHSRLGVIYNPTSKIDEENTAISRGILAAFLTQEKRFLRKFLRKLTKEETATAIYSGVKIKTFLAEGMDKNAFEKKYNTIGLNIFQTHQLFCQDVLKLLPGEIGVVNNGRFLGPLDENFYAEDFYLLEKITLTSLGEEIEDFAQSTKSIDLKVMSDFVMKFDALVSSLPQSASRYDITFLKENHSVIKINSLEDDMVFDVIAIVDPLTREAQKMAQLLIVLGKIINMKIKLFMNCRGKLSEAPLKSFYRFVLEPELMLTANGIVGPAAKFLGIPEAPLLTLNMITPEGWLVEIVRSNCDLDNIHLKDVEGAVTAEYELEYLLLEGHCFDVTTEQAPRGLQFTLGTKNRPVMVDTIVMANLGYFQLKANPGAWILKLRQGKSEDIYQIIGHKGTDSEPDLGDVIVVLNSFKSKILDVQVQKKPDKIKEDILSSKNEEKKKGMWDSIKSFTRRLHTKRDTQETDVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLAVDKIIFVDADQIVRHDLRELRDFDLGGAPYGYTPFCDSRKEMDGYRFWKRGYWASHLLRRKYHISALYVVDLKKFRRIAAGDRLRGQYQTLSKDPHSLSNLDQDLPNYMIYQVAIKSLPQDWLWCETWCDDESKQRAKTIDLCNNPKTKEPKLKAAARIVPEWVEYDAEIRQLLDHLDNKKTSAILTHDEL

SEQ ID NO: 3832 - protein, 1512 aa, Meriones unguiculatus
MARAGAADERRLLLRSVALWLALLGARTTAASKAVTAHLAAKWPETPLLLEASEFMAEESNEKFWQFVETVRELAVYKQTESDHSYYNLILKKAGQFLDDIHINLLKFAFSIRAYSPTIQMSQQIAADEPPPDGCNAFVVIHQKYTCKINEIKKLLNKAASRPRPYLFRRDHKFPTGRENLPVVILYAEIGTRAFAEFHRVLSKKSQNGKILYVLRHYIKKPSSRKMYLSGYGVELAIKDTEYKALDDIQIKTTADTSLENETEADEVQGFLFGKLKEIYSDLKDNLTLFQTYLIESSKEMMPLKVWELQDLSFQAASQIVSTPVYDAIKLMKDIAQNFPIKARSLTRIAVNELMRKEIQENQKDLRNRFEIKPGDARLFINGLRVDLDVYDPFSILDMLKSEGKLMNGLKNLGLSEEDMNKILTLNLPVWDYDYVLDIRHSAIVWINDLENDGMYVTWPTSCWEFLKPVLHETVPSIRRNFHNLVLFIDPAQEYTLDFISLAEFFYYNEIPLRIGFVFILNVDNEVDGAADAGVALWRAFNYIEEKYDVLEAFISMTHMYQKVKDNQILTVDNVKSILQNKFPNADILDILGTHSKYDRRRMAGASFYKMTGLGPLPQALYNGEPFDLKELNTEELKGVVLEKMTDTFVYLQRDVFMGILNDEINAIDFLMDKNNVVPRLNSLILHTEPQYLNLLSSSVTADIEDFSTFSFLDSQDKSAVIAKNMHYLTQDNMISAVTLWIIADFDTPPGRKLLFNALEHMEMSVHSRLGIVYNPTSKINEENTVISRGILAAFLTHTSSVLRRFLRKLAKEETAEAIYSGDKMKTLLTGDMDKNAFEKKYNTVGVNIFRTHQLFCQDVLKLQPGRMGIVSNGKFLGPLNEEFYIEDFYLVEKVTFSNSVEKIKDVVENMEVNPKHTSDLVMKLDVLLSSLSVRATRYNITLLKENLSVIKINPPENDVFFDVTAIVDPLTREAQKMAQFLIVLGKIANVRIRLFLNCRDKLSEAPLRSFYRFVLEPELLTGANNSPSNGPVAKFLDIPESHLLTLNMITPEGWLVEIVHSNCDLDNINLKDTERVVTAEYELEYLLLEGHCFDMTTEQPPQGLQFTLGTRSNPAMVDTIVMANLGYFQLKANPGAWILKLREGKSEDIYEIVGHEGTDSETDTGDVIVVLNSFKSKILKVQVKKRSGKITEDILADKHENRGMWDSIKSFTKSLHEDKKKENDILNIFSVASGHLYERFLRIMMLSVLRNTKTPVKFWFLKNYLSPTFKEVIPHMAKEYGFQYELVQYKWPRWLRQQTEKQRIIWGYKILFLDVLFPLAVGKVIFVDADQIVRHDLKELRDLDLGGAPYGFTPFCDSRREMDGYRFWKTGYWASHLVKRKYHISALYVVDLKKFRRISAGDRLRGQYQALSQDPNSLSNLDQDLPNNMIYQVAIKSLPQDWLWCETWCDDDSKKRAKTIDLCNNPKTKEPKLEAAARIVPEWVKYDTEIRKLLDHLENKKKTATSVHDEL

SEQ ID NO: 3833 - protein, 478 aa, Ancylostoma duodenale
MKHTTKPVKFWLLKNYLSPQFKKNLPFLSAEYGFEYELVEYKWPRWLHQQKEKHRIMWGYKILFLDVLFPLDVQKIIFVDADQVVRSDLMELMEYDLGGAPYGYVPFCDSRKEMDGFRFWKQGYWANHLAGRRYHISALYVIDLQKFRQIAAGDRLRGQYQGLSSDPNSLSNLDQDLPNNMIHQVKIKSLPQEWLWCETWCDDASKSKAKTIDLCNNPMTKEPKLDSAIRIIPEWRDYDNEVKEVLKRAQQQTGKMSATLPRLWQPGNKQKYTFLADFWMTVASNPTAGRMRLPRNCVKFEVDPRMSKRDIRDYLSKIYKLPVRDVRTEVQMGEISWSTPADAQYKKAMWKDDDKKYAYVFMSKDFEFTFPNIFPDEDENAELQKVKEQQKKMTLNSSFANRDRNKQKGNVGEKSGECRAWAKFPSLVPAIFLALVAWRLLGRFPGQGSSHNTGLSEQAGLRGYAYVYRGEPGRRLAG

SEQ ID NO: 3834 - protein, 1469 aa, Ophiocordyceps australis
MKAAFAAPPYLLELLETAASENETAYFPLVDCIASGHFAAAKSDAQLYTAFLDVLDTQGHISSPEALATFDLALSLHAAAPRIEAHYQYYSTAVEAAVTNISCPNDWVWLDGKQYCTSSSLDHGIRDRLLSAQAKELPFDRTLGAGPDAILYADMTSDSFAPLHATLSTAARQLGLRYRIRYRHSILDKAQPLTISGYGVDISLKRTDYIVIDDRAAEKDGVQKPLASAAFLDDSSQAADIRPLSTSELALLGMKTASFILESENRLETLIKLTKDFPRYSSSIVAHNVSADCAAEFEQHRADIGRGGINFVWINGLQLAERQMEPFALVQLLRRERKLMDSIRDIGLNGKQAVSLLGHKAIVASKSNKESLRYDWTDQSESSQAIIWLNNIEEDARYQEYPASLNATQFLQYTHPGQLPAVRRNVFHIVIPADLTKTEDLAFANDIISLMTRGIPIRFGLVPLTSSANAKTRAQVLYYLAESHDTAALTAYIKELSHDEEPESEEKLLNDAMEYGQLLPEAQKSRLEDIVKSESYLQQIEMARKWVGRLNADGKVRSLLVNGVSLPLEGDWMHAMSMIITQDLQTIQKGIFQGIIDEETDIPAIFLQDAVKRRNAYISLDDDKALDVLDVNKMYHEHAELMAMIPVLGPSSSSSKDNWAVLTVFADMTNVHGLKLVTAALDFKRSNPGLHLEIVHNPKDGMASSRVNSALKSAQSLLSTIDSVEALSSIIEITEGLEGLDSYWTMLSQLHASTNIRPGASVVILNGRLVGPLVANATLTPDDLQQLFDFEHSRRILPVFAAMDSLDLTDKLTSPHAAAKITSMVARSTISDIPEGIFESAPSIRSTLYDSWNTKHSAIEIGDAETATIHIVGLLDPASDKGQRWAPIFAVLSELKGVYVKLILNPQQTLTELPIKGFYRHVMESKPSFDQEGNVIQLRATFRNLPSEALLTTAIHVPPAWLVAPSKSVHDLDNIKLSTARSDIDATYKLEHILIQGHSREDQGGAPRGAQLVLATEKDPMITDTIIMANLGFFQFKANPGFYKIELKQGRSAEIYTFESTGANGWEAVAGDQGNELVLMDFQGATLYPRLKRRAGMEDEDVLEPATKPSGDSLLSRGLELASHLFNSASSPQALSAQAHADINIFTVASGHLYERMLNIMMVSVMRNTKHSVKFWFIEQFLSPSFKDFIPYLADEYGFKYEMVTYKWPHWLRQQKEKQREIWGYKILFLDVLFPLSLDKVIFVDADQVVRTDMMDLIKLDLEGAPYGFTPMCDSRTEMEGFRFWKQGYWASYLRGRPYHISALYVVDLRRFRELAAGDRLRQQYHALSADPNSLSNLDQDLPNHMQFQIPIHSLPQEWLWCETWCSDESLASARTIDLCNNPQTKEPKLDRARRQVPEWTVYDDEIAALDARRRQQQQPQQQNRAGLEQEIEQEEMQTSHGDGSNNVNTMSRNWDEVKLGQSNTKDEL

SEQ ID NO: 3835 - protein, 1448 aa, Fusarium verticillioides
MPRLSQCLAMALVAATASLASPSVNVGMNAAFPRAPYLLELLETAAGENSTAYFPLLDKIAGGHFQSTNSDAELYDRFLEVLQQDGHITKPEALSTYKLALSLRVAAPRIEAHYQYYTTAVDSVSKGDTNDDCSTWALIDNKKYCSETLGKAVEGDFSARQVNLLPFDRVLGFGKDAILYADPTSASFGPFHIALSKAAKQGDVSYRLRYRRSAGAHNTPLSVSGYGVKLDLKRTDYIVIDDREASQEEVADLKPLSTSELASLGLKTASFILNSENPLDALVKSTQDFPKFSASIATHEVAKEFAAEQEKNVAAGIPSGINFLWMNGVQLIERQIEPFTLIEMIRRERKLIDGVRDLGFNGQQANSLLGHSEVASSKAEDEPPRFDWTDRLEEGKALLWLNDLEKDARYQKLPSDLTALLQRTYPGQLPQVALNLFHIVAPVDFTNIEDGRAFGQLAQFMQRGVTLRFGILPLVTTPASAAQAKVVYHLMETYGFESLITYLQESEEGPEGAANKKAFTRAIDGRETLPGANKMTLAEILEADTYKQRVEASKAWANRLNADTTVRPVFVNGLAIPREKSWVQAMGQRLTEDQQAIQKAVYFGQIEEGTPVSDLFLRDAISKRNTYIFPDDEKALRVVDINKLHKDFAGLFGNIAVLPSDSKAPKESWAVLTAVADLATDDGQDLLLAALEFKRKNPGVRLDLVHNPPSSAEAHVINGAFKLNEGKLAEMKNKDDLKAILEASWTAEDDGLGTALADFLSASNILPGTKGLLLNGRVVGPLPSDVSFNEDDLQQLLEFERRNRILPVYAAIKDLGFEDKLSDPIAAAKLTSITALSTISDLPQGIFESAPSIRSSMYNTWNSTHSAIEVGNPETASVHIAGLLNPTSEQGQRWAPILKVLSELDGVYLKLFMNPKEVVAELPITRFFRYVLDSKPSFDQAGHVHSPKATFKGLPSEALLTAGMDVPPAWLVAAKESVQDLDNIKLSSVKADIDVIYELENILIEGHSRDGKRGAPRGAQLSLATEKEPLITDTIVMANLGYFQFKANPGFYNIQLKQGRTSKIFTIESVGAHGYAPVPGDEGTEIALMDFKGTTLYPRLNRKPGMEEIDVLESPDSEDSGIVAKGLKFAESLLGGAKTPKEISAEEHAEINIFSVASGHLYERMLNIMMVSVMRNTKHTVKFWFIEQFLSPSFKEFIPHMAAEYGFKYEMVTYKWPHWLRQQKEKQREIWGYKILFLDVLFPLSLDKVIFVDADQIVRTDMIDLVNHDLEGAPYGFTPMCDSRTEMEGFRFWKQGYWANYLRGLPYHISALYVVDLNRFRQLAAGDRLRQQYHALSADPNSLSNLDQDLPNNMQFTIPIHSLPQEWLWCETWCSDESLAQARTIDLCNNPQTKEPKLDRARRQVPEWTVYDEEIAALDRRRKVVGNSSEKNSKRRTMEEAVHTKDEL

SEQ ID NO: 3836 - protein, 1444 aa, Schizosaccharomyces japonicus
MRWKSLLLFLSSGISLCLGARPLEIGLEAVFSKPSYLALFAETLHAESPEAFYWFLNSVSDRPLESSSPKAAYDDLLIRLQNENVLDDETLSSFQFALALSSGAPKLAAFHSLVDEKNVECNSWILGRDGPSCKVPTSFSSIPKINVYEKNNLDYVYDDCSVETPTVIAVTDFGVEFAGFHKQLMPLAESCKIRYVIRYSPSPKTTEEPLRVAGFGAHASLKRTDYLVVDDREVKISSQEAGSVSTDNEQKLFADLDDNLEAVPEEQLEQLGSLTAQYISQQEDPLTVLRKLSQDFPLYAHKIAGEQLNKQFIENITAFQERIIPEGTNIVSFNGIPVDVNELDAFSLLSMLRSERAIVNDLKKLGLSPHEAQQVLCSDKFGRDSNEIVLPKFDYRDDTEGGNVIVWANDLENDPRYSEWPTEVQNFLRPLYPGQLHMVRKQLHTVIYPVDPSSSISAQFVRDLLMTTQRVIPIQTGMVCRASGDNVVGQVLCRAFHFLRNEADIDTALSFLLNCLQEDDKTDVWSLVEKHMPPLLRDDESLDSLHNILYSPFFDALMANSNSWMNRLSIDPHNRDIIVNGRIIDYGNDFHQNMLGIFIEDIPQVQTAVAMYKLTDDDDLLDFALSDALPKRNALVYPSSKNVQRNVNLQASLNSLGLTLNDVLLFGRKSAPITLWLITDFSAPEFGTFITTLEELQQDVSDISVVLLPNSNTTDSVSLQLVERVKARIAPRLSQLEDLYDLYQPEHKVKAETKELMEKYLKLVSIIGVSEHETGILMNGRLITPLSPDSLNVDDLAELAYIERNNFVEILEDLIKNPRVCLPFLSSYLKELKTRPFQAVGYGQTQMSFPRDSYVDKLKQHATFSYGDVETAMYSVVAIINPLSAEAQKLSVFLETLSKMNSVFIMVILNPQQKLEELPLKRYYRYSIASVPQFDEQGNMVPPSVIFDNLPADVLLTMDLETRDAWVVMQKDVQLDLYNVKLPHTESNENLTPLTATYELKNILVQGYSTERQSGRPPRGMQVLLSNKDGSYKTDTIVLANYGYFQLKGNPGIFTIAPKSGRSEEIFSIDGVNHGTTDNSLTISGFEGVILHPTVSRNPGYENEDVLKPDAPSHKFLNKLLRPFRGAQKDEHAEINIFSLASGHLYERFIYIMTRSVMEHTKHTVKFWFIENFLSPSFKRDIAILAEKYKFKYEFVTYNWPHWLRKQTEKQREIWGYKILFLDVLFPLDLEKVIFVDADQIVRADLKELMDLDLKGAPYAYTPMCDSRTEMEGFRFWKQGYWKKYLRGMKYHISALYVVDLDRFRHMGAGDLLRRQYQLLSADPESLSNLDQDLPNHLQRMIPIYSLPQEWLWCETWCSDESLKKAKTIDLCQNPLTKEKKLDRARRQVTEWTTYDDEIHDLLEHELHKEEARPESIRQPQQVLQLSQQSTQSNPSSNEGVDEL

SEQ ID NO: 3837 - protein, 1512 aa, Linderina pennispora
MRVTVQLFGSLATLAAMSGHAFGASSESAPIRTKLEASFHAPPLLLEIAEGIATHNASAFFPFIERLAENRQVFDKPDSAAYAQALEWISNDQLLTPVAMSLLKLELATRTYAPAVVAQYQLYNATVVPEIKQVRKTFDDSRHAPVEALDEMLNIEKFYGTTYIEEAKTEPQVLDLDHVYRTDAPASDKLVVLYADPRADDFLKLHQNAKELAESAQATYVLRYRPWASAERPLGLAGYGVELALKSTEYKVIDDRDLDFAGERSKGGAGVKLAVQDAGRNGEIELFDSDAEPATQMILGASDKLAVLKQLAQDLPRYAHLLSEVELNTTLTDSIEQFRQIAPHDSFFVNGVRLTPDELDPFKLLNHLRKENSIIAALEDIGFTQQQALDLMLSEDLAQPDQAEEDMPTFDMRDPSKSVVAWLNNLEKDSRYGMWPKDLRNLMRIFTPGQIQRIRHNTVQVVFALDLSSSASWTMILDEIMTNIEHGLPMQFGIVPLVDYANPNSDADSNKMAKLHYYLRQAFGKKKVLSFWQGAMIAFTKNSGKMSFTESTRGLYAAFAKSTKTKSGDGALSWDQVISLSDEKLSEWWTASVKYCARLDLSTTSSPDGLVFVNGGVISLSDNYQSALYQAVQMQMWQLAQALRRTDLDPEGNVQDYIYSQPGVMSTRSALIYPSDESPLRFLTLGKPAVQGWVDSSVPYLSFRKDTDTELQTPDDKRMRVGLVHSPSPAAASEYRADGEEDEDQPEGFSAEIPLAVHQLGSVTDVPADVVASFAARLLSSADLDQGILADEQFSAHSDAFAEIFEPSDDAVDSADIAFAANKAALHALGVPATVAGSGHVVVNGRLLPPITEDMPFTADTVSALVSYELSERINNVYNAIKDIVPDPSSIDLPALVMKATAILSHGQTLVKVNGIFQRPWSDTRRSIEKLVRSKRDTLIQINDPATARFRIQAVLDPLSEYAQKWAPVFQALASLPSVSVEVYLNPSVGMSELPVKRFYRYLWPSQLSFGSDGAVATPEVQFNGVPADPLLTLGMDVPAAWLVTAVESIHDLDNIRLSSVKDKSTGVSAIYRLVNILLGTSLKPSITDTIVMANLGYLQLKANPGVWNFSIRDGRSSDIYRIADISEGRWNYVAAKRAQTSNAESAKPILLTSFNGVTIFPVVTKRAGKENEKLLLEKGADDTAKAAGGSGSKGSLWGKLKGAISGGVSTGDSRPHFDVFAVASGHLYERLMSIMILSVLKNTQSHVKFWLIENFLSPSFKAFVPHMAEEYGFDYEFVTYKWPHWLNHETEKQRTIWGYKILYLDVLFPLNLDRVIFVDADQIVRADLQELADMDLKGAPYGYVPFCDDRKEIEGYRFWKQGWWKDHLKDKPYHISALYVVDLKQFRLLAAGDRLRGQYQTLSRDSNSLANLDQDLPNNMQHIVPIHSLPQEWLWCETWCSDSSLKKAKTIDLCNNPMTKEPKLERARRLLPEWEAYDKERGNLEGAQIAKAEAVVIDKPKEERKKEHDEL

SEQ ID NO: 3838 - protein, 1490 aa, Scytalidium lignicola
MGVFSLPWSFAAALLASTYFYSPCVSASPSINVSLKAAFDSAPYLLELLETAADANVTSYFPLLDRVADGDFAKAKTEEELYTEFIKVLKDDGHIPDAESLSLYQLALSVRSAAPRIEAHYQYYHTAVEPSLTAEQDDSCPVWVLFNGKQYCSPALDKAFGEVKNSIQAQELPFDRVIGNESAPASILYGDITSPTFWKFHRSLTKAAREGKTSYRVRYRKPLDQEAKPLIIPGYGVELALKRTDYIVIDDRVEGDKEITKQTVEADINLEDEELSDLKPLSTSELFNLGLKASSFIMQSDNPFDTLIKLSQDFPKYSSIVAAHTTSEEFIREHEYNRAQLVPAGYNAWWINGVQILERQIDALSLLEILRRERKLINSVRELGLNGSEAIQLLAHDEISNSKAEDEPQRYDWRDKNDGSNVIIWMNDIETDKRYADWPTHLTAMLQRTYPGQLPQVRKDIFNLVVPVDFTATNDIRLVVEILQSFVKRKLSLRIGLVPLTKTADAVEQARILYHLLDTYGLSSVIAYLEDVLLSQKPSHPSKASFQKVISGRKLRAEKTAADADVVFNSNIHQDQIDAARRWISRLAADSEIPPFFIDGVALPRDENWLQSMSNRVTSDLQQIQQGIFKEVFTEDTWIPTYFLFSAATKRNPLIIPENEDTLKVFDMNKFAAEHQTLSTLPRLEIDTSLPRADWAHMILIADFNTEAGQKLLSTAGEYCEANPTIELVLIHNPSSIHSTTNISDRLYTSLHDRSYKPYNSINDLRTVMTTESLEGTISSNQDAVQYWSAAQPLVNSIGLLPGQTGILLSGRLIGPIPEELEFIYTDFEQLLAYERSKRLLPVYTAMNALGLSDKIINPLVAAKFSSIVATSMIVDAPEGVFEQAPLLRYHQFHIWNSSYTAIEVGNADTATIQLTVLVDPTSEQSQRWIPILKVLSQLDGVYLKLFLNPKERLQELPVKRFYRYVLESKPSFNENGALRSLGATFSGVPQDALLTVGMDVPPAWLVSAKVSTYDLDNIKLSSIKTNVEAIYELEHILIEGHSREVPSGNPPRGAQLVLGTERDSHFADTIIMANLGYFQFKANPGFYRISLLEGRSSEIYNIESLGSKGWAPASGDESTDIALMSFQGATLYPRLSRKPDMETEDVLEAKPESTMDILHRGYKFAESLLAPKEKAAVPAKAQAEINIFSVASGHLYERMLNIMMVSVMRHTKHTVKFWFIEQFLSPSFKDFIPYMAAEYGFEYEMVTYKWPHWLRGQKEKQREIWGYKILFLDVLFPLSLDKVIFVDADQIVRTDMIELVNHDLEGAPYGFTPMCDSRTEMEGFRFWKQGYWKNYLRGLPYHISALYVVDLHRFRQMAAGDRLRQQYHQLSADPGSLSNLDQDLPNHMQAVLKIHSLPQEWLWCETWCSDESLANARTIDLCNNPMTKEPKLDRARRQVPEWTVYDDEIAALDRRRKGLDDSTKEEKEGGTNPRSRNHEEVVSTRKDEL

SEQ ID NO: 3839 - protein, 1626 aa, Unknown
  Description of Unknown: AAM60113.1 Sequence 19 from patent US 6399321 sequence
  MOD_RES (2)..(2): Any amino acid
  MOD_RES (4)..(4): Any amino acid
  MOD_RES (7)..(8): Any amino acid
  MOD_RES (10)..(13): Any amino acid
  MOD_RES (18)..(18): Any amino acid
  MOD_RES (20)..(21): Any amino acid
  MOD_RES (23)..(23): Any amino acid
  MOD_RES (26)..(26): Any amino acid
  MOD_RES (28)..(30): Any amino acid
  MOD_RES (33)..(48): Any amino acid
  MOD_RES (50)..(50): Any amino acid
  MOD_RES (53)..(56): Any amino acid
  MOD_RES (58)..(58): Any amino acid
  MOD_RES (60)..(65): Any amino acid
  MOD_RES (67)..(69): Any amino acid
  MOD_RES (72)..(76): Any amino acid
  MOD_RES (79)..(79): Any amino acid
  MOD_RES (81)..(81): Any amino acid
  MOD_RES (85)..(85): Any amino acid
  MOD_RES (87)..(88): Any amino acid
  MOD_RES (90)..(90): Any amino acid
  MOD_RES (93)..(93): Any amino acid
  MOD_RES (95)..(95): Any amino acid
  MOD_RES (99)..(105): Any amino acid
  MOD_RES (107)..(107): Any amino acid
  MOD_RES (109)..(109): Any amino acid
  MOD_RES (111)..(112): Any amino acid
  MOD_RES (114)..(115): Any amino acid
  MOD_RES (118)..(122): Any amino acid
  MOD_RES (124)..(127): Any amino acid
  MOD_RES (129)..(129): Any amino acid
  MOD_RES (131)..(135): Any amino acid
  MOD_RES (137)..(144): Any amino acid
  MOD_RES (147)..(150): Any amino acid
  MOD_RES (153)..(155): Any amino acid
  MOD_RES (158)..(161): Any amino acid
  MOD_RES (163)..(164): Any amino acid
  MOD_RES (169)..(172): Any amino acid
  MOD_RES (174)..(176): Any amino acid
  MOD_RES (178)..(181): Any amino acid
  MOD_RES (183)..(183): Any amino acid
  MOD_RES (185)..(186): Any amino acid
  MOD_RES (188)..(189): Any amino acid
  MOD_RES (191)..(191): Any amino acid
  MOD_RES (195)..(196): Any amino acid
  MOD_RES (199)..(199): Any amino acid
  MOD_RES (202)..(211): Any amino acid
  MOD_RES (214)..(214): Any amino acid
  MOD_RES (223)..(224): Any amino acid
  MOD_RES (231)..(232): Any amino acid
  MOD_RES (235)..(241): Any amino acid
  MOD_RES (243)..(257): Any amino acid
  MOD_RES (260)..(260): Any amino acid
  MOD_RES (262)..(263): Any amino acid
  MOD_RES (266)..(266): Any amino acid
  MOD_RES (268)..(268): Any amino acid
  MOD_RES (270)..(270): Any amino acid
  MOD_RES (272)..(274): Any amino acid
  MOD_RES (276)..(278): Any amino acid
  MOD_RES (280)..(281): Any amino acid
  MOD_RES (283)..(286): Any amino acid
  MOD_RES (289)..(289): Any amino acid
  MOD_RES (291)..(291): Any amino acid
  MOD_RES (294)..(294): Any amino acid
  MOD_RES (301)..(302): Any amino acid
  MOD_RES (306)..(307): Any amino acid
  MOD_RES (309)..(321): Any amino acid
  MOD_RES (323)..(329): Any amino acid
  MOD_RES (334)..(335): Any amino acid
  MOD_RES (338)..(338): Any amino acid
  MOD_RES (340)..(344): Any amino acid
  MOD_RES (347)..(348): Any amino acid
  MOD_RES (351)..(351): Any amino acid
  MOD_RES (354)..(355): Any amino acid
  MOD_RES (357)..(368): Any amino acid
  MOD_RES (370)..(372): Any amino acid
  MOD_RES (374)..(374): Any amino acid
  MOD_RES (379)..(380): Any amino acid
  MOD_RES (382)..(385): Any amino acid
  MOD_RES (387)..(387): Any amino acid
  MOD_RES (391)..(393): Any amino acid
  MOD_RES (396)..(396): Any amino acid
  MOD_RES (398)..(404): Any amino acid
  MOD_RES (406)..(406): Any amino acid
  MOD_RES (410)..(416): Any amino acid
  MOD_RES (419)..(429): Any amino acid
  MOD_RES (432)..(432): Any amino acid
  MOD_RES (434)..(434): Any amino acid
  MOD_RES (436)..(443): Any amino acid
  MOD_RES (447)..(453): Any amino acid
  MOD_RES (455)..(456): Any amino acid
  MOD_RES (460)..(460): Any amino acid
  MOD_RES (463)..(463): Any amino acid
  MOD_RES (465)..(466): Any amino acid
  MOD_RES (468)..(469): Any amino acid
  MOD_RES (472)..(472): Any amino acid
  MOD_RES (476)..(476): Any amino acid
  MOD_RES (479)..(479): Any amino acid
  MOD_RES (481)..(482): Any amino acid
  MOD_RES (485)..(485): Any amino acid
  MOD_RES (488)..(488): Any amino acid
  MOD_RES (490)..(490): Any amino acid
  MOD_RES (494)..(496): Any amino acid
  MOD_RES (503)..(516): Any amino acid
  MOD_RES (518)..(522): Any amino acid
  MOD_RES (524)..(524): Any amino acid
  MOD_RES (526)..(526): Any amino acid
  MOD_RES (528)..(528): Any amino acid
  MOD_RES (535)..(542): Any amino acid
  MOD_RES (544)..(545): Any amino acid
  MOD_RES (548)..(548): Any amino acid
  MOD_RES (550)..(551): Any amino acid
  MOD_RES (557)..(558): Any amino acid
  MOD_RES (561)..(563): Any amino acid
  MOD_RES (566)..(567): Any amino acid
  MOD_RES (569)..(570): Any amino acid
  MOD_RES (573)..(589): Any amino acid
  MOD_RES (592)..(596): Any amino acid
  MOD_RES (598)..(600): Any amino acid
  MOD_RES (602)..(606): Any amino acid
  MOD_RES (608)..(610): Any amino acid
  MOD_RES (612)..(612): Any amino acid
  MOD_RES (615)..(616): Any amino acid
  MOD_RES (618)..(626): Any amino acid
  MOD_RES (629)..(634): Any amino acid
  MOD_RES (636)..(636): Any amino acid
  MOD_RES (639)..(639): Any amino acid
  MOD_RES (642)..(651): Any amino acid
  MOD_RES (653)..(653): Any amino acid
  MOD_RES (655)..(655): Any amino acid
  MOD_RES (657)..(658): Any amino acid
  MOD_RES (660)..(662): Any amino acid
  MOD_RES (664)..(666): Any amino acid
  MOD_RES (668)..(670): Any amino acid
  MOD_RES (672)..(672): Any amino acid
  MOD_RES (675)..(676): Any amino acid
  MOD_RES (678)..(678): Any amino acid
  MOD_RES (680)..(681): Any amino acid
  MOD_RES (683)..(684): Any amino acid
  MOD_RES (686)..(690): Any amino acid
  MOD_RES (692)..(692): Any amino acid
  MOD_RES (694)..(695): Any amino acid
  MOD_RES (697)..(697): Any amino acid
  MOD_RES (700)..(700): Any amino acid
  MOD_RES (702)..(702): Any amino acid
  MOD_RES (706)..(706): Any amino acid
  MOD_RES (709)..(713): Any amino acid
  MOD_RES (715)..(715): Any amino acid
  MOD_RES (718)..(723): Any amino acid
  MOD_RES (725)..(726): Any amino acid
  MOD_RES (728)..(729): Any amino acid
  MOD_RES (731)..(735): Any amino acid
  MOD_RES (737)..(739): Any amino acid
  MOD_RES (741)..(749): Any amino acid
  MOD_RES (752)..(753): Any amino acid
  MOD_RES (755)..(758): Any amino acid
  MOD_RES (760)..(771): Any amino acid
  MOD_RES (773)..(774): Any amino acid
  MOD_RES (780)..(783): Any amino acid
  MOD_RES (786)..(787): Any amino acid
  MOD_RES (789)..(791): Any amino acid
  MOD_RES (793)..(800): Any amino acid
  MOD_RES (803)..(805): Any amino acid
  MOD_RES (807)..(807): Any amino acid
  MOD_RES (809)..(826): Any amino acid
  MOD_RES (830)..(832): Any amino acid
  MOD_RES (834)..(836): Any amino acid
  MOD_RES (839)..(842): Any amino acid
  MOD_RES (844)..(845): Any amino acid
  MOD_RES (847)..(851): Any amino acid
  MOD_RES (853)..(864): Any amino acid
  MOD_RES (870)..(871): Any amino acid
  MOD_RES (873)..(881): Any amino acid
  MOD_RES (883)..(889): Any amino acid
  MOD_RES (891)..(898): Any amino acid
  MOD_RES (901)..(901): Any amino acid
  MOD_RES (903)..(903): Any amino acid
  MOD_RES (905)..(905): Any amino acid
  MOD_RES (908)..(908): Any amino acid
  MOD_RES (911)..(911): Any amino acid
  MOD_RES (915)..(915): Any amino acid
  MOD_RES (920)..(920): Any amino acid
  MOD_RES (922)..(922): Any amino acid
  MOD_RES (924)..(924): Any amino acid
  MOD_RES (926)..(927): Any amino acid
  MOD_RES (931)..(931): Any amino acid
  MOD_RES (934)..(943): Any amino acid
  MOD_RES (946)..(955): Any amino acid
  MOD_RES (958)..(964): Any amino acid
  MOD_RES (966)..(967): Any amino acid
  MOD_RES (969)..(970): Any amino acid
  MOD_RES (972)..(985): Any amino acid
  MOD_RES (987)..(987): Any amino acid
  MOD_RES (989)..(991): Any amino acid
  MOD_RES (993)..(997): Any amino acid
  MOD_RES (999)..(999): Any amino acid
  MOD_RES (1003)..(1005): Any amino acid
  MOD_RES (1008)..(1017): Any amino acid
  MOD_RES (1020)..(1020): Any amino acid
  MOD_RES (1027)..(1029): Any amino acid
  MOD_RES (1034)..(1035): Any amino acid
  MOD_RES (1038)..(1042): Any amino acid
  MOD_RES (1044)..(1044): Any amino acid
  MOD_RES (1046)..(1051): Any amino acid
  MOD_RES (1055)..(1057): Any amino acid
  MOD_RES (1060)..(1061): Any amino acid
  MOD_RES (1070)..(1073): Any amino acid
  MOD_RES (1075)..(1076): Any amino acid
  MOD_RES (1080)..(1080): Any amino acid
  MOD_RES (1082)..(1090): Any amino acid
  MOD_RES (1092)..(1093): Any amino acid
  MOD_RES (1096)..(1097): Any amino acid
  MOD_RES (1102)..(1103): Any amino acid
  MOD_RES (1105)..(1106): Any amino acid
  MOD_RES (1108)..(1108): Any amino acid
  MOD_RES (1110)..(1110): Any amino acid
  MOD_RES (1114)..(1114): Any amino acid
  MOD_RES (1116)..(1118): Any amino acid
  MOD_RES (1128)..(1137): Any amino acid
  MOD_RES (1139)..(1139): Any amino acid
  MOD_RES (1143)..(1143): Any amino acid
  MOD_RES (1145)..(1146): Any amino acid
  MOD_RES (1150)..(1150): Any amino acid
  MOD_RES (1152)..(1152): Any amino acid
  MOD_RES (1154)..(1154): Any amino acid
  MOD_RES (1156)..(1158): Any amino acid
  MOD_RES (1160)..(1160): Any amino acid
  MOD_RES (1168)..(1168): Any amino acid
  MOD_RES (1172)..(1173): Any amino acid
  MOD_RES (1176)..(1178): Any amino acid
  MOD_RES (1180)..(1180): Any amino acid
  MOD_RES (1193)..(1195): Any amino acid
  MOD_RES (1202)..(1202): Any amino acid
  MOD_RES (1205)..(1206): Any amino acid
  MOD_RES (1212)..(1213): Any amino acid
  MOD_RES (1216)..(1216): Any amino acid
  MOD_RES (1218)..(1218): Any amino acid
  MOD_RES (1221)..(1222): Any amino acid
  MOD_RES (1225)..(1228): Any amino acid
  MOD_RES (1230)..(1236): Any amino acid
  MOD_RES (1239)..(1241): Any amino acid
  MOD_RES (1244)..(1249): Any amino acid
  MOD_RES (1251)..(1251): Any amino acid
  MOD_RES (1253)..(1253): Any amino acid
  MOD_RES (1259)..(1262): Any amino acid
  MOD_RES (1267)..(1269): Any amino acid
  MOD_RES (1271)..(1273): Any amino acid
  MOD_RES (1275)..(1275): Any amino acid
  MOD_RES (1277)..(1278): Any amino acid
  MOD_RES (1281)..(1284): Any amino acid
  MOD_RES (1286)..(1297): Any amino acid
  MOD_RES (1299)..(1301): Any amino acid
  MOD_RES (1308)..(1308): Any amino acid
  MOD_RES (1312)..(1312): Any amino acid
  MOD_RES (1323)..(1324): Any amino acid
  MOD_RES (1329)..(1331): Any amino acid
  MOD_RES (1334)..(1334): Any amino acid
  MOD_RES (1344)..(1344): Any amino acid
  MOD_RES (1349)..(1349): Any amino acid
  MOD_RES (1352)..(1354): Any amino acid
  MOD_RES (1356)..(1357): Any amino acid
  MOD_RES (1360)..(1360): Any amino acid
  MOD_RES (1364)..(1364): Any amino acid
  MOD_RES (1369)..(1371): Any amino acid
  MOD_RES (1382)..(1384): Any amino acid
  MOD_RES (1389)..(1389): Any amino acid
  MOD_RES (1405)..(1405): Any amino acid
  MOD_RES (1407)..(1407): Any amino acid
  MOD_RES (1420)..(1420): Any amino acid
  MOD_RES (1423)..(1423): Any amino acid
  MOD_RES (1426)..(1426): Any amino acid
  MOD_RES (1430)..(1430): Any amino acid
  MOD_RES (1432)..(1432): Any amino acid
  MOD_RES (1446)..(1446): Any amino acid
  MOD_RES (1456)..(1456): Any amino acid
  MOD_RES (1459)..(1460): Any amino acid
  MOD_RES (1464)..(1464): Any amino acid
  MOD_RES (1467)..(1470): Any amino acid
  MOD_RES (1482)..(1482): Any amino acid
  MOD_RES (1499)..(1499): Any amino acid
  MOD_RES (1502)..(1502): Any amino acid
  MOD_RES (1530)..(1533): Any amino acid
  MOD_RES (1542)..(1542): Any amino acid
  MOD_RES (1544)..(1544): Any amino acid
  MOD_RES (1548)..(1548): Any amino acid
  MOD_RES (1559)..(1559): Any amino acid
  MOD_RES (1563)..(1563): Any amino acid
  MOD_RES (1566)..(1567): Any amino acid
  MOD_RES (1569)..(1569): Any amino acid
  MOD_RES (1573)..(1573): Any amino acid
  MOD_RES (1575)..(1575): Any amino acid
  MOD_RES (1580)..(1580): Any amino acid
  MOD_RES (1583)..(1584): Any amino acid
  MOD_RES (1586)..(1622): Any amino acid
  MOD_RES (1624)..(1624): Any amino acid
KXIXTSXXAXXXXWSLLXEXXEXLAXEXXXLFXXXXXXXXXXXXXXXXEXDTXXXXYXAXXXXXXRXXXLSXXXXXLLXFXLSLXSXXPXIQXFXQIAXXXXXXXGXCXSXXFXXVGXXXXXCXXXXLXKXXXXXLXXXXXXXXVLXXXXDHXXXGSXXXXPXXILYGXXXXGXXXFXXXXHXLXXKXXNXEGKXXYIXRHXXXXXXXXXXPVXLSGYGVELXXKSTEYKXXDDXXXXXXXGXXXXXXXXXXXXXXXGFXFXXLKXLXPXLXXXLXXXRXXLXXXXDEXAXLKXWELQDLXXQAAXXIXXXXXXXXXXXXXLXXXXXXXQNFPXXARXLXXXXXVSXXLRXEVXXNXXXXXXXXXXXXGXXXLXINGLXXDXXXXDXFSLXXXLKXEXXXXXXXHXLGIXXXXXXXILXXXXXXXXXXXFAXDXRXXXXXXXXDIRXXXXXXXAXXWVNXIEXDXXYXXWPXSVQXLLXPXXPGXLRXIXKNLXXXVFVVDPXXXXXXXXXXXXXXFXXXXXPXRXGXVFAVNDXXXXXXXXDXXVAXLXXFNYVSXXSDXXXALXXLXXIYXXXXXXXXXXXXXXXXXLEXXXXXDXXXAXXXXXLXXXSXYDXXRXXXXXXXXXLGXXXXXXPXVLXNGXXXXXXXXXXDXNXEXXIXXXIXXXTXXXQXAVXXGXLXXDXXVXXXXXLXQXXVXPRXNXRILXSAXXXXXYXDIXXXXXXNXXLXXVXXXXXLXXXDXXXXXXXXXKYXXKXXXXSXXXXXXXXXXXXTXXWVADFXXXXGRXXLXXXLXXXXXXXXVRXXXIXNXXXXXXXXXXXXXXXXXXAALXXXPXXXAKXXXXKXXKXXXXXEXXXXXXXXXXXXVGGMDXXLXXXXXXXXXKXXXXXXXLXXXXXXXXVLXLXKXQRXVIXNGRXIGPLXSXEXFXXADFXLLXXXXXXXXXXKIXXXXXXXXXXVNXXXXXXXSXXLXXLXXXXXXXXXXXXXXKXEXXXPXXXXXDXHSVXXXTLXXXXXXXXXXDVXAVLDPLXXXAQKLXXILXXXXXLXNXXXXXXLNPXXXLSXXPLKRFYRYXXXXEXXFDAXGXXXXXXXXXFXXLPXXPLLTXXLXXPXSXWVEXVXXXYDLDNIKLEXXXXXXXXXXVXAEFXLXXLLLXGXCXDXXXGXPPRGLQLXLGTXXNPXXXDXTIVMANLGYFQLXXXKANPGAXWLXXRDGRSXXIYXIXSHXXGTXXXXDXXXXXXXQVXXXSFXXXXXXVXVXKKPGMXXXXLLSDXXXEXXXEXGXXWSXXXXFXXXXXXXXXXXXDXXXINIFSVXASGXHLYERFLRIMXXSVLKXXXTKXPVKFWFLKNXYLSPXFKXXXPXXAKXYNFXYELIXXXYKWPRWLHQQXXXEKQRXIWGYKILFLDVLFPLXVXKVIFVDADQIVRXDLXELXDFDXLXGAPYGYTPFCDSRXEMDGFRFWKXGYXXWHLXGRXXXXYHISALYVVDLXRFRKIAAGDRLRGQYQXLSXDPNSLSNLDQDLPNNMIHQVPIKSLPQXXXXWLWCETWCXDXSKKXAKTIDLCNNPXTKEXKLXXAXRIVXEXWDYDXEIXXLXXXXXXXXXXXXXXXXXXXXXXXXXXXXXXXXXXXXXHXEL

SEQ ID NO: 3840 - protein, 1487 aa, Elephantulus edwardii
LAVRLVLGAVWLLGVASASKEVTAHLAAKWPETPLLLEASEFMAEESNEKFWQFLETVKELTIYKHAESDYSYYNLILKKAGQFLDNLHINLLKFAFSLRAYSPTIQMFQQIAADEPPPEGCSAFVAIHEEHTCKISGIKKLLKKARKAKSRSRPYLFKADHIFPTNKENLPVVILYAEIGTKGFGKFHKVLSKKAQNEEIMYVLRHYIQAGLFVSLFLVSRLKGSRHHSMNASDVEDKTEAGEIQGFLFGKLKEIHSDLKDNLTTFRKYLIESSKELMPLKVWELQDLSFQAASQIMSTPVYDAIKLMKDISQNYPVKARSLSRIAVNKQMREEIQENQKHLQDRFDIRPGDTRLYINGIHIDIEGSDPFSMLDMLKLEGKLMNGLQNLGINGDDISKFLKLNSQLWEYTYALDIRHSSIKWINDLENDDVYITWPTSCQELLRATFSGNIPFIRRNFHNLVLFIDPAQEYASDFIRLGLLLHYNKIPLRIGYVFILNTDDEVDGMKDAGVALWRAFTFMTKEADVLQAFMNIAHMYLNLQDQNILTVDIVKNGLQDYFPHANLGDILGIHSKYDQERKAGASFYKMSGLGPLPQALYNGEPLRPEEMHVKEIETAVFRRMMDTNAYLQREVYMDRLNDHTNVIDFLMDKSTVVPRINSLILHTKPQYLNFIPTSVTADIEDFATFSFLDSQDKTVVIAKNMHYLTQGDAVISPVTLWIIADFDKPSGRKLLHNALKHMKRSVASRFGVIYNPTSKVTEDNTIISRGILTAFLTQKNKNLKSFLRKLTTEEIATALHSGEKIKTFLTEEMDQKTFEKKYNTVGVNIFRTHQLFCQNVLKLSPGEIGVVSNGKFLGPLDEALYVEDFYLLEKITYTSLVEKIKDIVKNMETNSQNMSDLIMKVDALISSLPERVSQYDVTFPKENHSVIKINPKENDTFFDVVAVADPLTRETQKMAQLLVVLDKIINMKVKLFMNCRGKLSEAPLKSFYRFVLEPELMRGTGGINSLGPAARFLDIPETPLLTLNMITPEGWLVETVHSNCDLDNIHLKDIERMVTAEYELEYLLLEGHCFDVATEQPPRGLQFTLGTKTRPVLVDTIVMANLGYFQLKANPGAWILKLRQGKSEDIYQIVGHEGTDSGRNVSNAVVLLNSFKSKILEIKVQKKPDKIKEDVLADKDEKKKGMWHSIKSFTMKLIKDDGEADVLNIFSVASGHLYERFLRIMMLSVLRHTKTPVKFWFLKNYLSPTFKEVIPYMAEKYGFQYELIQYRWPRWLHQQTEKQRIIWGYKILFLDVLFPLAVNKIIFVDADQIVRHDLKELRDLDLGGAPYGYTPFCDSRTDMDGYRFWKTGYWASHLSKRKYHISALYVVDLKKFRKIAAGDRLRGRYQTLSQDPNSLSNLDQDLPNNMIYQVAIKSLPQDWLWCETWCDDESKQRAKTIDLCNNPKTKEPKLKAATRIIPEWVEYDREIQQLLEDIKNEKKNASYED

SEQ ID NO: 3841 - protein, 1499 aa, Aedes albopictus
MRICYGLVLLGLVALLETATGESKSHPVTTQLSAKWGITPVELEIAEFIEEENVNLFWDYIDLLNKIPNGLHSIGTERDRYRKSIELAESLLGVGQTNLLKLALSLHSFSAKVQAHLQIANQVLKQGDCETSAFVTIGGKVACDEDELRSILKALDKDPTKVEVHILDHVYPASENNSLTAILYAQIGTELFEKLHGILKEKAEQGAVRYVLRHFVKTVPNRKMRLSGYGVELHLKSTEYKSQDDSPRPQDQETMFSDDSAEPEVEGFDFVKLKERFPHLSHSLDRFRNALQEKHEEIAPLKAWEFQELGLQAAQRIAQIQGEEALQILQFTAQNFPTQAKSLLAQTVSEDFKKEMRHNIEVLGRNLNLQPPDSALFLNGLFFDADTIDTITLLDTLRSEMHVLEGLNRINLRGKAAAPLLALDLSSTSKEFAIDIRDSAITWINDLENDAQYRRWPGSVMDLLRPTFPGMLRNIRKNLFNLVLVIDPVANSDNGRGIVKLAESFVVHSAPVRVGLVFDTRGSSDKEMDYRSIVCAFNYVHQKKSSSEALGFLTDLFATTSKRDITYDDVRKQLKKTFSKLKSDEVEEILGEDSDFDYGRQLSQEFVGRLGLKSTPQALMNGVLLAQNTLNTDDFEETILTEIMQQTPTIQKAVYKGDLNDGEPVIDYLMKQPHVMPRLNQRILSAEDPTFLDVSGNPHPDLEDVSALAQLSNSDLTATLMKNLKYMGGKSTYEKFMGYRLHFHSVWVVADLKHSDGRKLLQNALRFMKSTSGTRVAFVPNVDGSDAARSQLKKDLNALVWATINTLRPEEATELVVKLLKQAEEGKDYEVPDSVLGFLPATQLHLKMLRAYCQRVLKLKASTNGLVANGRVLGPFEHGEVFDSEDFGLLEKFISLQYTDKIRKALKEASVDGEDIEVSSDTIFRLVAILVPRQQSKSRFNIPTELQEHHTVVKLPPKSNDLPFFEIVAVLDPASRGAQKLSSLLILLRNVVNCNMRLVLCAVDRHSDMPVKTFYRFVVEPELQFMPDGKHAPGPYAKFVGLPANPLLTQSLNVPENWLVEVVRSVYDLDNIKLSEINGPVHSEYELEYLLLEGHCFDTTTGSPPRGLQITLGTEEHPIVVDTIVMANLGYFQLKANPGAEDTRVVVSSLKSHVLKLRVTKKPGKANADLLGDDKESGGGIWDSISSMVGTGDAQDKEVLNIFSVASGHLYERLLRIMMLSLLKHTKTPVKFWFLKNYLSPQFIDFLPYMAKEYNFQYELVQYKWPRWLHQQTEKQRIIWGYKILFLDVLFPLDVKKIIFVDADQIVRADMKELNDFDLGGAPYGYTPFCDSRQEMEGFRFWKQGYWRNHLQGRKYHISALYVVDLKRFRKIAAGDRIRGQYQALSQDPNSLSNLDQDLPNNMIHQVAIKSLPQEWLWCETWCSSDTLQYAKTIDLCNNPLTKEAKLTAAQRIVPEWKDYDAEIKRLQAKVDELEHEAGQISHSQGEASSNQEAQHTEL

SEQ ID NO: 3842 - protein, 1647 aa, Ascoidea rubescens
MSSSRWFSYALLLYFSYMLAIASSLASSQNSVNVKLYSSWLNPPFALQILETISNQNESLYLPTILKLLNINDIDALSIHDIDAINSIDLSDACELSPVFNDKFYYDNTFNTLLNNDSKLVYDIYLANHYYSPTVISHYNYYNSSVIPNFNIPQSSPRDSWILFDDKIISDPTDLFALQIDNSNNNNNKINELILPFDRVIGNYSTNNLPLLILYGNINDPSFKNFFISLYQNVLAKKLNFVWRYIPEYNTKIDYELLSGYGVDLTLKRTDYIVIDDRDVFNNSNSNSNSNSKQNSNIEKIDTDDSDILNTHFSDIQSVPKKRIKNLDLKLVNYVLNYSNNSYTNFKRLIQILNDFPKFSNLIAFSKSFKINKKRDQKIKNIIDITNSNSKIGLSKDSIGLYINGKPLSDSKFNFFNLINLFNNELNLIHFLKKNLKLSTFNSKSILTRFAFMLTYLRRNFKSNSNNLFKRFNLNKNSHILGDKFFYLNDIESDSFYSHLKIDRSIFLQQSKEIRPGQLPNLKENLFDMIFVLNLNDDSLLNIAMSISSLILDRGIPQRIGFLPILQNASDKNEDEKLINKLLFHKFYKTGYNDQVNSKKDLYSFLERLSNSPGKVKKELLDHYNNNEDDYNLDEYDNSFFLKNYAIKKPYIIIDGVFTEFDKYNQWQYAIANQLYKDVNLIAKIIQENLSSKNKEFENKKLIDYLYEKSLSSRNLKIMPEHDNIKGIDDGIIDEGFTYKFFSEEFFKTIRYNEKIQENTVEFQYEKKIRRINSEQKIPITTYLIGDFNSKPFLKEVVELLKMEYSLFEYDQDYKARIKLVNTAIDNSNFKKIKESLTNKNIGKSITLKDTMELVVDIIERNSNLIEFKDQHKQHFNKEVISLLKSIDIDIEAYNYAPVIIVNSRLIKFNSEEELFTEKEIDFLVLYEIENRLKPIDILRTDLDISFKNQILIYQKTEITLFKDYYDWFELLSTVLTKSFFDTNQVDYQIGEKITRYDLSSITYEDVSIEIGNENAKSVFRSKDLADLEIVAIIDPISEESQKILTMLDGFTNLARFSNLCHITILLQPDLEMSEISIKRFYRGLYLSNVTFDSDSGEIDRNNYNAKFENVPEKTLFTLDMDVSTSWIVMPKTSIWDLDNIKLDSTEFGYVEGIYELRNILIEGHSKDIEKKIPPVGAQVELIDVQDKTYSDTNIMANLGYLQLKSNPGLWKFQIKPNSKSREIYSINDIFIIDNEGKKISRNDSYLGISDMNGLTIFPRFVKNPGMEGSSLIIKNDQDADDFDASTFKKILNLDGIVNKLPRLLKNVFNKISGKDNELVGSNYNLDKADINIFTIASGHLYERFLSIMTASVRKHTKHSIKFWLIENFMSPSFKEFLPYLAKKYDFKYELITYKWPFWLRPQREKQRTFWGYKILFLDVIFPQDLDKVIFVDSDQICRTDLKELVDLNLKGAPYGYTPMCDSRKEMEGFRFWKQGYWANLLGDEYKYHISALYVIDLKKFRGIAAGDRLRQHYQSLSADPNSLSNLDQDLPNNLQKEIKIFSLPQDWLWCETWCSDESLRTAKTIDLCNNPLTREPKLDRARRQIKEWSDYDDEITALREEAKQIKAVELKEAEIHLVSASDSADSAASDSEEDFDADLADFHDEL

SEQ ID NO: 3843 - protein, 1664 aa, Quercus suber
MGTFRCRSGLWVMILVVVLLGLCEIGSVVAQNRRPKNVQVAVRAKWSGTSLLLEAGELLSKEWKDLFWDFIEVWLHTEDSLDSSTAKGCLKKILEHGHSLLSEPLASLFEFSLMMRSSSPRLVLYQQLAEESLSSFPPADEGISNNVGVEALETNAKMENKKSDLLLVGVNLKSPGGKCCWVDTGGSLFFDVSEMLLWLRNPTEPAGDSFQQPELFDFDHIHFGSSAGSPVAILYGALGTDCFKKFHVKLVEAAKEGKVKYVVRPVLPSGCETKTGHCGAVGTRDSLNLGGYGVELALKNMEYKAMDDSAVKKGVTLEDPRTEDLSQEVRGFIFSKILERKPELTSEIMAFRDYLLSSTVSDTLDVWELKDLGHQTAQRIVHASDPLQSMQEISQNFPSIVSSLSRMKLNDSVKDEIAANQRMIPPGKSLMALNGALINIEDIDLYLLLDMVHQDLLLADQYSKLKIPHPTIRKLLSSLPPQESSMFRVDFRSTHVHYLNNLEEDAMYKRWRNNLNEILMPVFPGQLRYIRKNLYHAVYVLDPATICGLESIDTITSLYEDNFPMRFGVILYSTKFVKHMELTGAGIYSSVKENDSQNEDDISSLIIRLFIYIKENHGVKTAFQFLGNVNKLRIEGDGSLDDVPEMHHVEGAFVETVLPNVKSPPQDILLKLEREQTFKELSQEGSMFVFKLGLAKLQCCLLMNGLVFDSNQDALINAMNDELPRIQEQVYYGHINSRTDVLEKFLSENGISRYNPQIIANSKPRFISLSTSILGGESVLNDINYLHSPETINDLKPVTHLLAVDVATKKGMKLLHEGLRYLIEGSKGARVGMLFSVNQDADLYSLLFVNVFEITASSFSHKKNALNFLDNFCSFYEQKYIFASSKAADNTQAFLDMVYELAEANGLPSNAFKSALTEVSIDQLRKHLNKVSHFLYRQLGQEFGVNAVITNGRVMFPVDESTFLSHDLHLLESVELKQRIKHIVEIIEEVNWQDTDPDAITSKFISDAIMVVSSSMAMRDRSSESARFEVLNAEYSAVVFDNENSTIHIDAVVDPLSPSGQKLSSILRVLQKYIQPSMRIVLNPLSSLVDLPLKNYYRYVVPTMDDFSGTDYTINGPKAFFANMPLSKTLTMNLDVPEPWLVEPVIAVHDLDNILLENLGDTRTLQAVFDLEALVLTGHCSEKDHDPPRGLQLILGTKSTPHLVDTIVMANLGYWQMKVSPGVWYLQLAPGRSSELYVLKDDGDGSQENQFSKRITISDLRGKVVHLEVMKKKGKEHDKLLVPDDDDNSEEEKGNGWNSNFLKWASGFIGGSEQSRKSESTSVEQGKGGRHGKTINIFSIASGHLYERFLKIMILSVLKNTRRPVKFWFIKNYLSPQFKDVIPHMAQEYGFDYELITYKWPTWLHKQKEKQRIIWAYKILFLDVIFPISLEKVIFVDADQIVRADMGELYDMDIKGRPLAYTPFCDNNKDMDGYRFWRQGFWKEHLRGRPYHISALYVVDLKKFRETAAGDNLRVFYESLSKDPNSLSNLDQDLPNYAQHTVPIFSLPQEWLWCESWCGNATKSKAKTIDLCNNPMTKEPKLQGARRIVSEWPDLDSEATGFTAKFLGDEVELQEPSPNQSQTSTSKTFSEVDLESKAESSSKVDLESKEESSSEVDLETKAEL

SEQ ID NO: 3844 - protein, 1512 aa, Terfezia boudieri
MRLVSLVASLVVIAQFPQNIVAAPAVTVGLKPSWGAAPFLLELLETAAEEEKDSYFPLLDKIATGEFEKQTTDEALYSRFLQVAQQEGFLTDTVTLSSFNLALSMNSVAPRIEAHYRYYEDTLEPVMGVSYKPRCRVWLQWSQKQHCAKSIESMISTWERFPNDRTELAFDRVLKTKPDVPAAILHADIEDPDFLHFHSILTDFAKRGVLSYRVRYRAPKNPVKRQVLLGGYGAELALKKTDYKVMDDREVQNQNASNEEPVKQEGLADDEEISDIKPLHPKDVTSLGIKAASFIMSSDYKLDSLLRLVQDLPKHSSALSTTEINSALADELIENRDIFLNPGANAIWVNGLQLEDSEINAFALLSTLRRERRFIKKFETLGLTKTQAIELLSHKVIREARQNELPLRFDYRDDIEGGSVIIWLNDLENDERYKGWSTDPKILLRRVYPGQLHQLKRNIHNLVLPLDLTSLEDVSLLTEHLMMFVERGIALRFGIVPVIKSEQSMEQAKLFYYLFDTYGLEPALKYLEKSLEQEKLSKPNKKIFDAVCKESSLKPGKTANSLEDALVSEHVKKMAEDAIKWSKRLGITDIPQVFINGLAVPRTEDWMQQMSGRLSTDVMYLQRKVHEGVAFQGPTSDVTLLDHMLLIGAKRSRNVHIFPEDEVTVNLVDIAELAKAHALVYEKLPALATEQPDKLIDTTVWVVGDFDEKDGYELLRAVAEAQKKAVGISIILINNPELVSERPAFSTLLYQLNVKGLIKTSEQLFQFIELLTEVDEYHDVKSKTWFFNEHIEAGKFWRSCQELLQKAGFKPGQRGLVVNGRVVGPIPAKDDFSAADVKQLFMYEWEKRIMPVLEAADDLGALDNLSSSTNAAILTNLVALTTIPEGSQELFVDPPSMRLNLYDQWRAEHSAIVTGDKHTAIFHIVASIDPTSELAQRYVPILKVLSEMDGVYLRLFLNPERVLNDLTVKRFYRYVLDSKPRFGAEGQLIYPKADFHKMPVDALLTLGLDVPPSWLVTPKVCVFDPDNIQLSSLRGRFRGENLEAIYELRSILIQGHSRDITIGGPPKGAQLVLGNGRDPHFADTIVMANVGYFQFKANPGMWKLSLKDGNSATIFNIDDAGTRGYNNKNHDGNPQLAVVTFQGATIFPRLSRKAGMEAADVLAEPAKLKDTLYYVKEGLRKTDEVLQVIGILKPPKNQVIEKKQADINIFSVASGHLYERFLNIMILSVMKHTDHTVKFWFIDNFLSPSFKDFIPHMAKEYSFEYELITYKWPHWLRGQKEKQREIWGYKILFLDVLFPLDLDKVIFVDADQIVRTDLKELVDLDLQGAPYAFTPMCDSRKEIEGFRFWKQGYWKNFLRGLPYHISALYVVDLKRFRQIAAGDRLRQQYHQLSADPGSLANLDQDLPNHMQQFLPIYSLPQDWLWCETWCSDESLATAKTIDLCNNPMTKEPKLDRARRQVPEWTLYDSEVATLAKRVRNDEESVHHLADSGAEKSKAETPAVEDNDVKDEL

SEQ ID NO: 3845 - protein, 1596 aa, Selaginella moellendorffii
MSKALLPLLAWVAILVLAAAAAHRLQKNVIVELHAKWSGTSLLLEMGELVAKERDDNFWKFIDSWIEREEKESQSSSNSTSNCLEQILSQGSALLDGHLASLLDLSLSLRSASPKLVVYAQLALESLSAFNLHSEGSDRPRPPRQKCCWVDVGSSLLLEESELLHWLKSLSGEPLLDKTLDLFEFDHVYPQSASFAYTAILYGALGTPCFKRFHSILSDSSKTQDLVRYVARPFLPDGCEESCSACSKAGVGEPLNLAGYGVELALKNMEYKAIDDSEVKAGGSSEDTSTEDPLAQEVRGFIFSRLLERKPHLEGELMTFRDQLLSSEISDSMNVWEVKDLGYQAAQRIVGASEPLRLMQELNQNFPNLVSSLSRMKINETIKQEIVSNQQMISPGRNLLAINGALVNPESLDLFTLIHMVHQELSFADKILKMKVPSSSVSKLLRLPEPVESVAVRVDFRSKDFVHYLNDLEEDNKYKRWRTNLNELLMPAFPGQLRYIRKNLYHAVYVLDPVSVRGLRTVEMILHYYHNNLPMRFGLILLSPADLHSLDEENGAGEKDDLSSLMIRLFLYVKNTGGVYNAFEFLKNVLDSYSEDSEENYTEASHIEEGFVKSLGTMTKTSAMEVFSKLKNGEDYRKEAFESSQFVYRLGLSEVYPCLLMNGLVYGESQPQFSVMAAMNEELPKIQEMVYFGQIHSRTDVLDKFLAEEGLKRYNPKIAGTGKDSKYVSVAPVVSESHPVVCSLQYLHTPGTEDDVKPVTHWLVVDLTKESGIRLLTQGVRYIMEGTDRGRLAILHNMKDADNTPESSKELLLPRLVSHVMQASSRRAKYLRLLHSFLTHYKSGTFEEVLHLYLSTAKEMGLDIAKEAILESSTLSTQLLQFHKEKKFVAELFGIRPGINAVATNGRISSQDSKPFIAEDLMLLESLMYRRRIKDVQEIIEDVKWEGLEPDDITRYVDLINVAFLSYFVVLSAYLSTVIMAVSSTMASRTRSSETAQFELLKADHSAIVRHVDGSPIQIDAVINPLSALAQRLTPLLLMLEEWLHPSIRIVLNPMSSLGDVPLKNFYRYVLPSKEEFLSGGIGPHARFSNMPPSKTLTLNLDVPEPWLVEPVVAIHDLDNIVLEKLDDERTLHAVFELEALMITGHCYEHNEPPRGLQLILGTKQHAHVVDTIVMANLGYFQLKAAPGVWTLGLARGRSSELYTLQGHKQGTDEGPISKQILVADMRGELVHLEVVKRRGMEDEKLLVVDDDNGKKTSLSDKTKGFFEWAANIMGTGEKKTSKQNTSASARHGETINIFSVASGHLYERFLKIMMLSVLKNTRRPVKFWFIKNYLSPQFKNLIPHVAVEYGFEYELVTYKWPTWLHKQTEKQRIIWAYKILFLDVIFPLSLKKVIFVDADQIVRADMGELYDMDIKGRPLAYTPFCDNNKDMDGYRFWSQGFWKEHLQGKPYHISALYVVDLDKFRQTAAGDNLRVFYENLSKDPNSLSNLDQDLPNYAQHTVPIYSLPQEWLWCESWCGNATKGRAKTIDLCNNPMTKEPKLQGARRIVQEWPALDEEAQLFTKRILGKGRDEENTMQVPKEPSSTNDADVKDEL

SEQ ID NO: 3846 - protein, 1736 aa, Pluteus cervinus
MGNKSRLKRGTVVATTLGLLQLASINLGVASASTSPPVNIALQSSWPAPPFLVEVLETISIENPDTFFTLLGAISNPNAPVPYHKLTPEAAQAALLKDAASYAFLTESEAKGFLNMYLSLHASTPKIEAFYQHYRSTFGEEGQDEGSKCGSWVDWYGQVVCDVDTLYRVAGVENGSGGSVHSHDRPKLLPFDHIHPPHENTLDRPPKTAILYGSVESSNLHDLHSALMSISSKPEAQVEYVFRHAPPQAKILEKNYLSGYGVALDLKKMDYLAVDDRHAYRSTSQKGDTVPDLSETEADSILALIQAQAQNAEPEERPTDSEGEPTDPNAPLTKEEIQELGYQASQLIYSSEDPLSTLLNLSQDFPKYTTSLSRLVKVDPDIRNELDNNAVKAQGGVNMFWLNGALLQESDVNPLTLIRLLKKERTIMHSITALGILKDEAMRLLTHQKIALKQKEGGVLDGLVDASDRQEGGGAVVYLNDIENDARYAKWSSSLYALVRPMFPGQFPNVRLNLFNIVLVLDLSKTSNLGFMFGTMGNIIERSYPFRVGVVPSLNTMEGLKMARLLYHLIETYGTQSAMEFYKGILPSQISHPTVQWDVLKYEYNEFLDLQDEKADEDVESKPKERVSFQTIINGQGPVQVPTDKILGYTKRLAVGDTGKSNEQGEITEGHAFVNGRYFEFNDNFLRAMQGEIATQLNHLQEAVYAGQLPDNADTYAIVQNYFYDLPSTTKRRNMYIVPKAPAGSPASLRIWNLPEVFMKTGWRTSPWTYVYPEGNSDIPVGMYVVADFDTELGFELAKEVLLYLTEDVGTRVTFVHSPTDPTNGSPEPLSVTWEEPDKVPLSRLFSHLLYENLASAASPRLILKSLAVPFYPHASLFAGGLTDQSDPTVPVSVDGVQWVASADHPLQVPVIKAPTEEEEEDEWDEAALGPKPKPMKTLLTRREAIDELVRGKEPSAFRVDDYADYVKRSRMMVREFGLKPGERAVIANGRLVGPFKGKGGEFLAQDFGTLEQYEVKKRTASFVEAVFDVLPYMHVVKGMDRPSFANLVSLGASVITSIQQPDPSEVGLFDAPLKPRHMTYQLLDSNYTSFESGDNITAIYQVSVLIDPLSETAQKWAPILQWLSTIPNTFTEIHMNPARYQEIPLKRFYRYNILHNLQFNEEGYEKPAQAVFSNLPIDPIYTLAMDVSSSWLVRPREALYDLDNIQLGNLAPEDSGVDAIFDLDYIIVDGHAREGGSMMPPRGLQLQLVNAQETAKVLKPNEDGGIETSTHEEAKPIADTQVMANLGYLQFKAKPGVFKLEVRPGRGRDIYEMESVGNEGWDSPDVAVAGSEITVTSFEGLTLYPRLRRRPGQETASVLADLSPKADTIEGILGGWASKIKSVFGAKEPESTAVAKTQQQAEINIFTVASGLLYERFVGIMILSVLRNTNSTVKFWFIENFLSPSFLEFIPHLAEAYNFQYELVTYKWPSWLRAQKEKQRIIWAYKILFLDVLFPMDLKKVIFVDADQIVRADLKELVDLDLHGAPYGYTPMGDDNTDMEGFRFWKTGYWKDFLRGKPYHISALYVVDLVRFRQLAAGDHLRGSYHQLSADPNSLANLDQDLPNNLQNEVPIYPLHEDWLWCETWCSKDRLHRAKTIDLCQNPLTKEPKLSRARQIPEWEEYDAEIARFARKLAKEGRIKSRIATADANVLASAGNANAAPPDTETKEKVEEPENAEVDKNEGERHKVDVPRDEL

SEQ ID NO: 3847 - protein, 1681 aa, Diplodia seriata
MSGTGSKIVLQDDTEHIHDMVCRCRWCLNATFLSRLVSTDELTDFTIVCGGHERKVHRLILSAASTYFAYLFRVRGVRETILGRIEFPETDPELVFAMVDWMYYGKIEVSAYGGVGGYSELLLECVYMYAMGEQYGVLGLPESAAYAVGAILHHQRYYLLEQVDDIVEMVDLVNATTMPRSPLRWQVWDSLLENGQAALLFAALAPPSASASQSHSPPINVALKARFNSPPYLVELLETAAFENATAYFPLLDRIADGYFDAKSSEQAQYDAFLQLLQDDGHITDPDALSSFQFALSIHTAAPRIEAHYQFYNTSVEPSLVPDQPDDCESWVLLNGKQYCSPDMDKEHGDVKNPRVKDLPFDRPMRQEYRSVPSVLYADITSPSFRNFHKTIIKTARAGETSYTLRHKPPKNTRNDPQDVHGYGVELALKRTDYIVIDDRQAEDDAKAPAADAAQAVLQDEEVADLKPLSESDLKGLGLKAGSFVMGSEDPLDTLLKLSQDFPKHSSAIAAHDVSKDFLKEHKANREAVLPPGYNILWINGVQVMPRDVDAFALLEHLRRERQIVNSVRKLGFTPPEAINVLANNNIAKAKDNDEPQRYDWRDSAEGGNVIVFLNNLEKDKRYAEWPESLRALLQPSYPGTLPSVKRDIQNVVIPVDLTNALDATLLVETLQSMVKRKLAVRWGIVPSTKNVRAERQAHVIYYLLEYHGLSAVMQYLEQSLKLKEIFEPSKTAFGTVTADAKIRGNRVAKSFDQLFEEPSVVQRVEAASTWLTRMAADGNSPPFFVNGVALRRNDEWLSSMSMRVSRDLNTIQKAVFENELDEDADDWLPGVFLANSLVRRNPMIVPEDEKDVKHVDMAQAYADYGHLIERLPTFKPAEDSEWFQWAQLIVLGDFDSNAGANLLADAYQFAAEHGDLETAFVHTGDVDRHSRLSYLLWKNKGQSFVDDLPEDFVPSSRELKECGEYWESMKPLMRIFDGDSGRESLVLNGRTVGLIRKRRPFTVDDLENLLTYERQKRIEPANKAIMDLGLEDKIKSPGASAQFTSLVALSTVSNVPEGIFDTPPTTRRDVFKFWNETHTCIKTGELETSPIQIVASVDPSSETAQRWLPILKVLSELSGVHMRLFLNPKERLSELPVKRFYRYVLASKPSFDENGSTEALQARFDGIPSEALLNLGLDVPPQWVVAAKESVHDLDNIKLSQLKGQSSIDAVYELEYILIEGHSRDLTNGMYPRGAQLDLRTTSNPRYADTIIMANLGYFQFKANPGFFDIELQPGRSQEIFTIDSAGTLGWEPRPGDRTKEIALMDFKGVTLYPRLSRRSGKEDEDVLEAPTTMVEDLAAKGAAFADGILSKVGINVKTGGSSRHADINIFSVASGHLYERMLNIMMVSVMKHTKHTVKFWFIEQFLSPSFKSFLPTLAASYGFEYEMVTYKWPHWLRGQKEKQREIWGYKILFLDVLFPLDLDKVIFVDADQIVRADMHELVTHDLEGAPYGFTPMCDSRTEMEGFRFWKQGYWKNFLKGRPYHISALYVVDLNRFRRLAAGDRLRQQYQQLSADPNSLSNLDQDLPNNMQVGLPIHSLPQDWLWCETWCSDDALRSAKTIDLCNNPQTKEPKLDRARRQVPEWTVYDEEIAALARKADAAAGIVAEDNGAEQDERLLEKVAEQAEEVEKEKAKKHDEL

SEQ ID NO: 3848 - protein, 1512 aa, Cavia porcellus
  MOD_RES (16)..(16): Any amino acid
  MOD_RES (702)..(702): Any amino acid
MALAKATKAVRLLLGXTALWLTLLAARKACASKAVTARLAAKWPDTPLLLEASEFMAEESNEKFWQFLETVGELSIYKQRESAYSYYSLILKKAGQFLDDLHVNLLKFAFSIRAYSPTIQMFQQIAADVPPPDGCNAFVVIHEKHTCKVNNIRKLLKKATLRPRPYLFEGDHKFPTDKENLPVVILYAEVGTRAFSEFHKVLSEKARSGKILYVLRHYVQKPSSRKMYLSGYGVELAIKSTEYKALDDTQAKTVTNTSMENEIEADEIQGFLFRKLKELHSELRDNLTVFQKYLIESNKEMMPLKVWELQDLSFQAASQIMTTPVYDAIKLMKDISQNFPIKARSLTRVAVNQQMRKEIQENQKDLKDRFHIQPGDAYLLINGLQVNTDTYDPFSILDMLKLEGKIMNGLRNLGIHQEDISKFLKLNSYDEKYILDIRHSSIVWINDLENDQMYAAWPASCKELLKQIFSETISVIKRNFHNLVLFIDPAKEYTFDFMKLAEIFYFHKFPLRIGFVFILNADDKVDGRNDAGVALWRAFNYILKERSVSEAFISILHMYQKVKDQSVLTVENVKSVLQNEFPHADIWDILGVHSKYDNGRKAGASFYKITGLGPLPQVIYNGEPFNHEELNSEELDIVVLHRMKGASVYLQRDILMGTLNDKMNAIDYLMDRNSVVPRINSVILHAQHQYLNLISSQVTTDXEDFSTFSFLESQDKSAMIAKNMHYLTQEDNVISAVTLWIIADFDTSSGRKLLYNALIHMKKSVHSRLGVIYNPTSKINEENTAISRGILAAFLTQKNNLLWSFLKKLSKEETATAIYSGSKIKTFLTEGMDKNAFEKKYNTVGVNIFRTHQLFCQDVLKLRPGEISIVSNGKFLGPLNEEIYVEDFYLLEKIAFNNLAEKIKGIVENMKISSENMSDLIMKVDALLSSWPKQTPWYNVTFLKEKHSIIKINPQGNDVVFDVVAIVDPLTREAQKMAQLLLVLGKIINMNVKLFMNCKSKLSEAPLESFYRFVLEPELMSGADGNSFLGPVAKFLDIPESPLLTLNVITPESWLVETVHSNCDLDNIHLKDIEKAVTAEYELEYLLLEGHCLDSVTKEPPRGLQFTLGTKTKPVVVDTIVMANLGYFQLKANPGAWILKLRQGKSEDIYQIIGHEGTDSPSNIQDVIVVLNSFKSKILEVEVKKKPDKINEDILTDNEEKKGMWDSIKSFTRRLHEDDDKKEKDVLNIFSVASGHLYERFLRIMMVSVLRNTKTPVKFWFLKNYLSPSFKEVIPHMAKEYGFQYELVQYKWPHWLHQQTEKQRIIWGYKILFLDVLFPLAVDKIIFVDADQIVRHDLKELRDLDLGGAPYGYTPFCDSRTEMEGYRFWKTGYWASRLLGRKYHISALYVVDFKKFRRIAAGDRLRGRYQSLSQDPNSLSNLDQDLPNDMIYQVAIKSLPQDWLWCETWCDDESKKRAKTIDLCNNPKTKEPKLEAAARIIPEWVEYDTEIRQLLDRLENKKKSKILAHDEL

SEQ ID NO: 3849 - protein, 1631 aa, Momordica charantia
MGTSSFRSACGALIIISLLGIYGGSGVFAETRRPKNVQVAVRAKWSGTSVLLEAGELLAKERKDLYWDFIEVWIREEGNDSDASTAKDCLKKILKHGCFLLSDPLASLFEFSLILRSASPRLVLYQQLADESLSSFPLPEESISNIVGEGNESIERKKSDTSVVGRKPKTPGDRCCWVDTGGSLFFDVPELQLWLQNPAERVGDSIQPPDLYDFDHVHFGSSSGSTVAILYGALGTDCFKQFHVTLVKAAQEGKVKYVVRPVIPSGCELKMNSCGAVGTRGSLNLGGYGVELALKNMEYKAMDDSAIKKGVTLEDPRTEDLSQEVRGFIFSKILERKPELTSEIMAFRDYLLSSTVSDTLNVWELKDLGHQTAQRIVQASDPLQSMQEISQNFPSIVSSLSRMKLNDSVKDEITANQRMIPSGKSLMALNGALINIEDVDLYLLIDVIHQDLLLADQFTKLKIPHHSIRKLLSSLPPADSDMLRVDFRSSHVHFLNNLEEDAMYKRWRSNINEILMPVFPGQLRYIRKNLFHAVYVLDPATACGLQTIDMILSLYENHFPIRFGVLLYSSKFIKETERGDDGLTKSEEDTSSLVIQLFIYFKENHGILTAFQFLSNVNKLRIEADGLADDAPEMHHVEGAFVDTLLPKSKSHPQDVLLKLEKEQTFKDLADEGSMFIFSLGLSKLECSLLMNGLVFDSSEESLINAMNEELPRIQEQVYYGHISSRTNVLEKFLSDSGISRYNPQIVAEGKPRFISMFASTHGGESLLNGFNYLHSPGTMDDLKPVTHLLVIDVASKKGIKLLEEGLHYLMRGSKSARVGFLFTASNHTSESSLLLVKVFEISASLHSHKKKVLDFLDQLCSIYSQKFIFESSVTVDSPQEFIEEACKLAEANELPPKAYRIAFSDSFVDEMRKYLGQVELLSGQLGLEANVNAVITNGRVTLLTDESSFLSHDLHLLEAVEFKRRIKHIVEIVEEVNWDDFDPDTLTSNFISDVIMFVSSSMARRERSSESARFEVLNAEYSAIVVGNDNSSIHIDAVIDPLSPSGQKLSSILRVLSKYVQPSMRIILNPLSSLVDLPLKNYYRYVLPSVDDFSTTDVTVNGPKAFFANMPLSKTLTMNLDVPEPWLVEPVIAVHDLDNILLENIGDIRTLQAVFELEALVLTGHCSEKNHEPPRGLQLILGTKSTLHLVDTLVMSNLGYWQMKVSPGVWHLQLAPGRSSELYLLKQDGGISQDKPLSKRIIIDDLRGKVVHMEVEKKKGKEHEKLLVPDGGDNLLENNKVGYNYWNSNFLKWATGLIGSNDQSKQTKSTAMEQGKGGRHGKTINIFSIASGHLYERFLKIMILSVLKNTRRPVKFWFIKNYLSPQFKDVIPHMAEEYGFDYELITYKWPTWLHKQKEKQRIIWAYKILFLDVIFPLSLEKVIFVDADQIVRTDMGELYDMDIKGKPLAYTPFCDNNKDMDGYRFWRQGFWKEHLRGKAYHISALYVVDLKKFRETAAGDNLRVFYESLSKDPNSLSNLDQDLPNYAQHTVPIFSLPQEWLWCESWCGNATKSKAKTIDLCNNPMTKEPKLQGAKRIVPEWPDLDLEARAFTAKILGDVNPKTPDILTDQVDNSAIKKSSDEDLESKAEL

SEQ ID NO: 3850 - protein, 242 aa, Oryza sativa
LVTYKWPTWLHKQKEKQRIIWAYKILFLDVIFPLSLRKVIFVDADQIVRADMGELYDMNLKGRPLAYTPFCDNNKEMDGYRFWKQGFWKDHLRGRPYHISALYVVDLAKFRQTASGDTLRVFYETLSKDPNSLSNLDQDLPNYAQHTVPIFSLPQEWLWCESWCGNATKARAKTIDLCNNPMTKEPKLQGAKRIVPEWVDLDSEARQFTARILGDNPESPGTTSPPSDTPKSDDKGAKHDEL

SEQ ID NO: 3851 - protein, 1635 aa, Pisolithus tinctorius
MTCIHPLLAFLALGLVAGAYGASPPVTVSLRSSFRAADPLIEALETVAMEDDSSLFSLLSAFPLQDKPSTPRDAHTSVVDLASSLMDVSALASVRARLALHAASPRLAASAEHYDLRLSNISDKNDRLSSVECASWVDWYGRVVCDADSLLQLANDGAGNGMPRPTRLPFDHVHSVHHLLDEPQYTVVHYADPTAPSFASLHAMLLSLEPKVEYVLRWGRGASEKKTSELSSYLSGYGVALDLKKMDYLVIDDRHWSGGASDSSGSDASPSSHANTKDKNFSEEALSCVFESLPYVDEHAEARAKAGEPLSTQEIADLGLKATQFLASFSVQSRMGLVPAHQCWDQSPSIEALFRTLSSSFPLYATSLARKIPVSDELRDEVLENWAKATPGANMVWVNGRVLNDDQGASGNIFGILRTLQRERRLVKSLVGLGLTHEQAIELLMHPVYSSSQSTGSHFESRQRQGGEENKEQKRTFTISPKFADFLDGLVDASDRQEGGDVVIWLNDLEKDPRYSRVSSSLVGLLRVHAMSLFSPALHVRYNLMNVVFVLDLSQLRSFSILSSLHDNFVMRGYPVRWGFVPETRGEGLKMARLSYYIERIYGRDTMTSFIQRLLAMHNQRRLTTLSWDVVHELFDTFGAVDNLVAVTGGVVSPLDGPAGGDLLFRAQRYAKRLGVGAQGEIGKGHVFVNGRHLSLNDNVMRQIASEATAQLQILQEMVYVGEITDVDGPSLSTFFYDLPSTVTRRNPYISVHFKPGHNPDSRGLEIFDLTEMFSSTGFAPGEGAFVLPANGYNDVVPMTMYIIADLDTPQGIKLVTEALAFIANTANTRVTFVHNSEVANSGGRASSLLTTLIQARALSHVSSVDLLATLAGDNQKSAYELLRNERLASIATTEAEVSGLTQVMRLVARHLGLRPGERAVLVNGRLVGPFDSDSEFLKEDFETLETFEKKRRVSQIVDALDDILRGGDNLERSKRSDLIAVTSSIIYSDQQPDPSEVGLFDTAPRPRTQNYRFLSGKYTKFTFGDQSASLTHLALLLDPLSDAAQKWSSVLEYHTSLFPEVYIELYLNPSQLSEIPLKRFYRYNVMPSLQYDENGQEIPARVMFTALPEEPIYTLVMDVPHSWLVRPRSALYDLDNIQLGLLQGEERTRGVQALYALDYLVVEGHVFELHTNNPPRGVQLQLIDVADQSVVDDTQVVANLGYTQFKARPGTFRFEIRQGRGRTPYSLDSVGADGWNSPPVAEVGDEFTVMDFDRLTLYPRLARRPGMEGMDVLDDLDHVEGESGLVDNLLSKLSSFFKPATDESMAVTKKPGETAEINIFTVASGLLYERFASIMILSVLRNTKSTVKFWFIENFLSPSFLEFIPHMAEEYGFQYELVTYKWPSWLRPQKEKQRIIWAYKILFLDVLFPMDLKKVIFVDADQIVRADLKELVELDLHGAPYAYVPMGDDNYEMEGFRFWKTGYWRDFLKGRPYHISALYVVDLSRFRQMAAGDILRGQYQLLSADPNSLANLDQDLPNNLQREVPIYSLHEDWLWCETWCSKDRLHRAKTIDLCQNPLTKEPKLSRARQIPEWEEYDAEIAQFVRKLAAEGKIHGGASTADSKILAGDSASAPVPLSSSQQADMAGPPRAHDEL

SEQ ID NO: 3852 - protein, 1397 aa, Gekko japonicus
MFQQIAADEPPPKGCRAFVVIHGRSTCKANEIKKFLTKAAARPRPYLFRGDHRFPALSETGPVVILYAEMGTKDFATFHKVLSEKAQKEEIVYVLRHFVQKPSSEKMYLSGYGVELAIKSTEYKAVDDSQAKGASNVTEEEDNKESDVQGFLFDTLKQNYPDLKDNLTELRKYLVESANDTEPLKVWELQDISLQAASQILTVPVHNALKVMKDIAQNFPIKARSLTRVLANLQMRKEIKENQKHFHETLGLQPGEARLFLNGLPIDLDFHDPFSILETLKSEGKAMHGLHTLGIQGDILSKFMRLSVHEADDAYALDFRHSSIIWINDIEKDQPYDKWPTSFQELLKPAFRGMMRQIRRNLYNLVLFIDPLQEEALAFMKLVEVIYNQRVPIRIGFVFILNTDEEVDGNKDAGVALWRAFNYVADEVDVAKAFTTTTNMYHEVKNGGVLSVEHVKLVLRREFPYADMQDILGVHTDYDDNRMAGAAFYQKTGLGPLPQALFNGVPFNRKEMNVAELETSLQKIMDATESFQRAVFMGQLNDHKDVVDFIIEQQNVVSHINEKILSSEKRYLNFISSPVPVDMEDYSTFSFLDSQDKAVVLSENMNYVTRKDEDVIYAVTVWIVADFDRPDGRQLLSNALKHLKTSSYIQIGIVNNPASKITEENTLVARAIVAAFLTQKNTSLRNFLDKIVKEETAKSLARGMKIKKLLVSGMDDDAFEKKYNTMGVDSIRAHRIFCQEVLKLLPGQMAVVSNGRVIGPLHENEFYPKDFDLLEKVTLSSAAMKIKTLVKEMGLASKRGSRLVMKVDALLSSLPKTDVRQDVEFLKEQLSVLKLEPQQNEPFLDVVGIVDPLTREAQKLAHLLIVLGQVVNMRVKLFMNCRTKLSEAPLNSFYRFVLEPELTSGTHNVFPRAPGANFLEMPESPLLTLNMITPESWIVEAVNSSYDLDNIHLKEVEGIVAAEYELEYLLLEGHCFDVTTRQPPRGLQFTLGTKNNPVKVDTIVMANLGYFQLKANPGVWILRLREGRSEEIYEIFKHEGAESSEEEVIVVLNSFRSKIIKVQVQKKADKVNEDLLSDGVTEEDGSFASSVGQAQLEGKEKKIDILNIFSVASGHLYERFLRIMMLSVLRHTKTPVKFWFLENYLSPTFKEVIPYMAEEYGFQYELVQYKWPRWLHQQTEKQRIIWGYKILFLDVLFPLAVDKIIFVDADQIVRSDLKELRDLNLKGAPYGYTPFCDSRKEMDGYRFWKSGYWASHLGRRKYHISALYVVDLKRFRKIAAGDRLRGQYQALSQDPNSLSNLDQDLPNNMIHQVAIKSLPQEWLWCETWCDDKSKRKAKTIDLCNNPKTKEPKLEAALRIVPEWAKYDSEIQQLISRNRGRKENMAQPSPKESKHDEL

SEQ ID NO: 3853 - protein, 1519 aa, Athalia rosae
MWAFVFLYSLVFCSSPIAADKQVNKYVTTLIDAKWKETPLTLEVAEYLSDESQDYFWGFVDEISNHPNPLPENASDRETYDFVIGVAEKFLSPAEIAVLKFGLSLRTYSARVEMFSQMAENKDLSSLGCSIVLDIGGNLTCSLDELEDLINQLVKKKISTYSVDHHYHGGEQSDKTVILYGQMGTPEFLQFHNKLKSLAEQKKIDYVLRHYIKHRSDRKLRLSGYGVELQMKSTEYKATDDSDIKDNSGNDAESASPGIEEIDGINFGVLKKLYPDHQAELERIHTHLLENSHEIGALKVWQFQELSHQAAERIMNSPVDEAVNALTDIAQNFPMQAKSLIRTKVNADMKKEMKLNQEIFSVKLNIQPTDTALFVNGLFFDLEAIDILTLLEALRAELRVMESLHKIGFNNKKMGKLLALDLSNSGDNQDFAMDIRDSAIIWVNDIENDSRYKRWSPSLTELLRPTFPGMLRNVRRNLYNLVIIIDPLSKEATPLISLAESLYAHSAPLRVGFVFITNYDTSVTGQTDASVAVNNVYHYFAETLGHKEAMHFLSDLGYLIEKDRIDLDEIKKAIKAVDSSADINYILGEESEYDVGRHLANDFVKRSGFKKFPQALLNGVPLPSNQLNSESFEEAVLATIMTQTPTFQKAVYRGELTEGDDVIDWIMNQPNVMPRLSERVLKVEKSHWLNMIGSVPENDEIAKWSPQDTSAWLLNQMQYFYVPRRSHVRHLFTFWIITDLNLAVGRQLMREAFEYVKSNTDVRISIIVNSVNNVDDEPEIDLNRIALAALSALPIEEATKFVNQLIIDDTVSRITAGSYEIQNEDVEKKLQEQTKILAVHRHYVRSALDLTNGVRAVICNGRIVGPFDDVEKFTSEDFALLERFSQISYGDELFKTLTKVDLLYEDDDEYEKTDLTDDMIMKIVALLVPRPQTRSRFDVIFHGDEHSAIKIPASNPDSVAFQLTAIVDPVSRGAQKLGPILNTLRHSLNCEIKVFLNCLDKNSDMPLKSFYRFVLEPELQFTADGQISGAIARFDKLPTSSLLTQHIHAPENWLVEVVRSVYDLDNIKLDNVAIGIQSEFELEYLLLEGHCFEAVMGNPPRGLQITLGTENTPVMVDTIVMANLGYFQLKANPGEWLLRLRQGRSSEIYDITSVDGQDVIQEGNNIKVVISSLRSHVLKLKVSKKPDKASADLLSEEEPSSGLWNSISRTFTAADESEDKDEKLNIFSLASGHLYERFIKIMMLSVIKHTKTPVKFWFLKNYLSPTLKDFLPHMANKYGFEYELVQYKWPRWLHQQTEKQRTIWGYKILFLDVLFPLDVKKIIFVDADQVVRADLKELANLDLGGAPYAYTPFCESRREMDGFRFWQQGYWRNHLQGRRYHISALYVVDLKRFRRIAAGDRLRGQYQALSQDPNSLSNLDQDLPNNMIHQVAIKTLPQEWLWCETWCDDDSKKYAKTIDLCNNPMTKEAKLQAAMRILPEWVGYDEEIKRLQQEIENENRQTEREEDEISEASVHHEEL

SEQ ID NO: 3854 - protein, 1507 aa, Sporothrix brasiliensis
MGLPRLPLRLANALFATLVLQPSLTSAGPSIDVSMIAAFPSPPYLTELLETAAQENATSYFPILDRIADGYFGGAATDHDLYEKFLALLTEDGHISDGEALSTFKLALSLRSAAPRIEAHFQFYNTAVKGSVDGDHTGCDQWILYDGAQHCSPSLDKEDSKIASHKTQVRELPFDVKQGHGPDAILYADITSPEFGPFHKLLSEKSRAGEVTYRLRHVRAAAETTADERLPVNGYGVELALKRTDYIVIDDREADETNPDAKKKPPVAAEVLLDGEAEVTDLKALSKSELAELGLKTADYIIHSENPFDSLLKITQDFPKYSSSIAAHNFSKEFVEEHRGNRAVLVPAGANVLWMNGVQMIERQIQPLALVDTVRRERTMINGVRELGLTGKEIVDVIGHEAVAASRAEAVPPRFDYRDEIEDGRVIIWLNNLEKDSRYSDFPKGLRRLLQGGMPGQLPQVARDIFNQVYAVDFSDLEDVRLVVEQILEFVRRRLPIRFGLVPLVSTPASVKQAKVVYHMLETYGLGSLSAYLTQSLADKKASSPDAKAFKVAVKDRELREDATALAFADIFRHEEYDKQIELARHWAHRLGANSEVPPIFVDGVVIPRDENWVATMSTKISSHLRSVQEAVYFGKVEEDAWVAGYFLEGALTRRNAYIFPENEKSLQVVNVHKLHTDHADLFEEIPVIEASEESTKETWAVLTAVLDLDTEDGTKLLYSALQFRVNNPGIRLDIVYNPAKTGSSHDLNSVLKSNLDKATDTASWKDLKTLLATEEPATAEYVAALERFRETAAVHSGTNVLILNGRVLGPIANADAFGEEDLLTFLEFEQAERILPVYMAVEDLNLTAKVSSPLAAAKLTSVTALSTISDLPEGIFESAPTLRISSFNLWNTTHTSFEVGDASTATIHFNAVLDPASEIGQRWGPILKVLSSLEGVYMRVFLNPREWLDELPVKRFYRSVLEPAPLFDDAGKVKGLGAKFNGLPSEALLNLGMEVPPAWLVAPKVSVHDLDNIKLSSVKSDVEATYELEHILIEGHSQERSGQAPRGAQLILGTEKDEHFADTIIMANLGYFQFKANPGYYNIKIKEGRSSDIYSIESVGSKGVVPTPGDEGTDVALMNFQGTTLYPRLVRKPGMEKEEILNEEGAPSAQGGAMEYVAKGLKFAEGILGKGKDGDKAVAASEAQADINIFSVASGHLYERMLNIMMVSVMRHTNHTVKFWFIEQFLSPSFKDFIPTLAEAYGFQYEMVTYNWPHWLRQQKEKQREIWGYKILFLDVLFPLSLDKVIFVDADQIVRTDMYDLVQLDLQGAPYGFTPMCDSRTEMEGFRFWKQGYWNNYLRGQPYHISALYVVDLRRFRELAAGDRLRQTYHTLSADPHSLANLDQDLPNHMQFNIPIFSLPQDWLWCETWCSDEALKTAKTIDLCNNPQTKEPKLDRARRQVPEWTVYDDEIAALDKRRRQGGSPASDTAPPPVRVGGDGVASQQKPLGDGREEAKEEPKAHDRDEL

SEQ ID NO: 3855 - protein, 1465 aa, Cladophialophora psammophila
MLPTQASPSVNVALQTSFSAGPYLVELLETAALENSSSYFPLLDRIADGAFADLQTEQELYTRFLDILQNDGHLSSPESLSSFKFALALHAAAPRVEAHFQYYNTSVQPHLMAAQDAACPVWVYLDGQQFCSPALDRAQQAVSIPDNADDLPFDRVLGASSDGPPSILYADITHPLFGQFHSVVSQTARQGKSTYRVRYRPSGLVSSRPIHVAGYGVELVLKRTDYIVIDDRDAQKLEDTTPDQLSLDNVQDGELNDLKPLTTSEVANLGVNAASFIVSSSSPLDTLMQVTSDFPRYSSLLAAANASREFILEHRANRERFLPSGYNVLWINGVQIEPRQINAYSLLDHLRRERRIIAELKDLGLTSSEAISLLSSEIIAEAQAHETPQRFDWRDDPETDKVLMWLNDLEQDKRYAGWPSSLRSLFQRTYPGQLPQVARDIHNLVVPIDMSNIKDIELAATSLQSLVRRQVPIRVALIPTGEGETADAYSKVAYHIFDTYGLAALMNFFADVVASKKLEVSPEKSFNAAIKGRATRQGNEPLSFQDVLTAESLDLRLRSRDEYIKRLALAGPNPPFLVNGVVLPRADNWLELLSARLYSDLQLVQQAVFQEAILEDTWVPEFFLVQAVKRRNEMVFPDDPKDAKIVDVGHLASEFADGFARVPRVPGAEATLLSDRAHLLVVVNLESDPGRSLLSEALLFHQRNPEVELLIVHNPGSESQTSTFARGLYVLLQEDGRDLTVARLEQLLRGDLSPSADDLADPSAEFWGSQADLVRTLSFSEGQNGLWLNGRLLGPLEQPFTCVDFESLLEFERRDRIAPVTTAITGLALEDRFAGALDLAKVTSLVARSLKSDLPEGLRESAPLIRMERFRIWNGTHTCIKMSNSDDITIQIVAAVDPASELVQQWVPILKSLSQLSGVSVQIFLNPKDRLTELPVKRFFRQVISAEPSFDTYGSLVVPNASFSGIPKDTLFNLGMIVPPSWLVAPKQSIHDLDNIRLNNLAEGENIDAIYELEHILIEGHARDVTNGPAPRGVQLLLGTEEEPHYTDTIIMANLGYFQFKANPGYWQISLKPGRSSKIFNIDSVGPHGYSAQPGDETTSIALLSFQGLTLFPRLSRKPGMEDEDVLQSSGFGGAMDYLSKGASFASSALSSLGFKKTSTNADINIFSVASGHLYERMLNIMMVSVMKHTKHSVKFWFIEQFLSPSFKSTLPVLARNYGFDYEMVTYKWPHWLRGQKEKQREIWGYKILFLDVLFPLDLDKVIFVDADQIVRTDMMELNKVDLKGAPYGFTPMCDSRTDMEGFRFWKQGYWETYLRGKPYHISALYVVDLKRFRQLAAGDRLRQQYQALSADPASLSNLDQDLPNHMQHTLPIHSLPQEWLWCETWCDDASLARAKTIDLCNNPLTKEPKLDRARRQVPEWTLYDEEIAGVIQAAKEKQESMVIHDEDLDKAGGDESQKRIRDEL

SEQ ID NO: 3856 - protein, 1819 aa, Trichinella nativa
MTVFCANFTVESLLEATVHSMWVFPLIVVCFVSPVLVSPRKAHKNVIVSVRSKWPSTSLIMEASEFMSKESNEKFWQFIEAVIDKHQNSLGNKTDREVYNGILQIGDQILKSKARLEFLKLALTVRVHSATVEMHRQIAATSLDVQNGKSVYAVVHGKQISDLQQLDTILKHAEALARPVTYEFDHIYPGSKQGSVCVLLYADIENPHFKPWHLQLKKLVQRDGISYILRHYPKMNDDMVALSGYAVELAIKSTEYKAVDDSDKQTGSESGVSSSEEEVTDLNGFNLHLLEADELTPLKVWQLQHLSFQAGQRVILAPKEEALRVLRDISQNFPIMARSLTRMSINPNFKNEVEENQADAFSKLNIEPGDSAFFIDGIVIDLEEKDIFNLIELLKNEEMLISGLLKLGIRRKDFTLLYAMKGNDPNAEYAVDYTQWSPHYINNLESDAAYRNWGNSIHAILQPYFPGMIRPIAKNFFTLIFVLRLGDRESQNLLSTAYQMYEHVLPIRIGFIFVVNNDKSVSGYDDAGVAMLNAFNFIKEDRSVSKAIMFLIKIYNTVMRETISVEDVHKLFKSSYRDENLKSVFNSEEYNQGRSSGVDFIKESGLSMVPMVLMNGYPFTAEEISPEHIEEAILSKVMRFTVDIQKDVYEGNLKENMDVQQHLLKKPTVLPKLNYNILQMENIFLDMTDTSMDMRIALIHNPKSEAQATKGTASLVQACIQFLPLYQSKAVIGKIFANKITTLEDLINLSPSGISWPEFKKAYNSMSDIWMQLHVHYAKFVLNLDPGVGAIVANGKVLAPLSASDFNSLKDFNFIERYLLTSGCNDIAQHLKIIPYLDKSPKAYAFLLLYSCVQIEASDPTAAQFDIVAIVDPLSPAAQKMSHLLVILSSVLNVHMKVCMNCKSKLSEIPLKNFFRMVLPSELEFADDGSLKAQSSARFSALPQKQLFTLNIIAPQSWMVESVEAVYDLDNIKMEEVKGDVVAKFQLEYILLEGRCFDERSGSPPRGLQFTLGTFHEPFMFDTIVMANLANPGAWILALREGKSAEIYEVKSVDGVVQNQTTSVVILDGFSGRMIHVKVAKKNDQLENELLAESEDAESESLWQSISKTFQSGEKYDVINIFSLASGHLYERFLRIMMLSVLKHTKTAVKFWLLKNYLSPGFKEFLPYMAGHYNFSYELVQYKWPRWLHQQTEKQRIMWGYKILFLDVLFPLDVKKIIFVDADQVVRTDMLNLMELDLEGAPYAYTPFCDSRKEMDGYRFWKQGYWENHLAGRKYHISALYVVDLKKFRQVAAGDRLRGQYHFLSRDPNSLSNLDQDLPNNMIHQVKIKSLPQEWLWCETWCDDKSKKFAKTIDLCNNPMTKEPKLQSAMRIIEEWKDYDSEIKDLLDQRTKDKWNITEQKIVDIGFQFTAYFLVFLEESWNRAMNKENQVQDNRKAEITRASQPDCFKRICFTKFRLSRRVLESCFAGLKCFPAYYSDQKVKNDSVDCSRNSDKFKNYYRKHWDTDITVEDETVVGLKNRILKGDRSALASAITLVESNHPTKRAQGECLLQSMLKISKKRFDEHGPKSLIFRIAITGAPGAGKSTFIESFGLYLTRELKKKIAVLTIDPSSVRTGGSIMGDVARMNELSKEPNCYIRPSATAGTLGGVRRGTHESVVLCEGAGYDVVLIETVGVGQSESAVANIADMVVLLLSPALGDELQGIKRGIMEIADLILVTKADGDLLNQARLTRAEFSSALKYSRSRFHCWRPQVLLVSSRTNKGITEIWNEMEHFRNALSENGVLLQQRHQQMLRWMWNHIDHALSGLFRHHPDVVKMV

SEQ ID NO: 3857 - protein, 1494 aa, Onchocerca flexuosa
MKSLWIVIILSALPSVIDSAVKKKSVITSLHAKWSQTSFIAEASEFMAQESDTLFWAYVDEIVEKLNVDEWHTYSDARQYELAIRLAGNLLEEARVNLLKFALSLRAHSPTVVLFQKLGAERDKSCTAFADVHGAIICDVNDLEKVIENGVRGSAPTVYSIDHVFPTTKEHNVTLIVYGELATASWRKFHLVAKALSRRGKDVRDDKLLLSGYGVELAIKSTEYKAVDDSNTVIDKITVEESSEEYTDNEEGNYGFNFTTLRKLHGDLKDSIEQFRLHLLERDELTPLKVWQVQELSYQAAQTVVLAGTQKALNVLIDSSQNFPLAARSLSRQLVRKEFISEVNTNQEQLIEYGVSEGESVFFINGIMVDVDALDVFQVLDMLKQEEKLANGFFRMGIKNEYLSMLMDLESSNEHISYAVDFRPAIPEYLNNLDTDKQYRQWANSVGLLLQPYFPGMLRPIARNFFTLIFVVDPSQKETRDLLQYALRFYAHEIPIRLGVVFVVNDEKEVSGFDDASVAMLNLYNFVKINDGIQKAMNILTEALKQESISPKNILSYFQKKYPDYDPNDVFGSNSDYNMGRSTGYKFLRDSGLGLTPKVLLNGVVLDDSGITSDHFEETVMMEIMRVTSRLQKAVMEKRLKDEDNVMNWILSQPEVMPRINKLILDSPLLPNALYLDLTSVQKCTNISPAQYYKLPPKDQNQCMLKRMRYFTRTEEMRTHFSTVWVVTDLESAEGRLLMYNAIKHLKHSHMMRVAIINNPKDIEAATSSDSITMLVNIASRLLIPRQMKSFITKLVKEEIVSKLLDKQIKLDDLADMNMTLFYKESRQINNEEIIADAKYSRRILDLKPGQLALVVNGLLIGPLGDGQVLNVADMELIDKLILLRGGKVIGDYMEKWKVRTRHGESSDMVARSMALIGSIGVTKKRRFIPLPEAKESALTISGTDEEGLITALCIVDPLSIQAQRLGHLLTVIQKVVNLEVKLVMNPKAKLSELPLKRFYRLVLQPTIVFDDSGRIDDAAYEARFTALPNKQLLTLAVVPPDAWMVQSVYAIYDLDNIKMENVAGNVVAKFELEHILLEGHCFDDLTGSPPRGLQFTLGTLANPNRYDTIVMANLGYFQLKADPGAWILNLRDGKSKDIYNIVSHVNTESNDEVGVNVLIDSFSGRTIRVRVSKKKGKEKENLLNEGKSKEENEDHHSVWSSISTSLSGGEKYDAINIFSLASGHLYERFLRIMILSVMKHTKYPETLPEMAKNYGFQYEFIEYRWPRWLHQQTEKQRVMWGYKILFLDVLFPLNVRKIIFVDADQIVRTDLMELMELDLGGAPYGFTPFCDSRTSMDGFRFWKKGYWANHLAGRKYHISALYVIDLVKFRQVAAGDRLRGQYQGLSADPNSLSNLDQDLPNNMIHQVRIKSLPQEWLWCETWCDDASKEKAKTIDLCNNPQTKEPKLDSAMRIIPEWKDYDTEIKTLLDERSKKHVKESKKSEHEISDGHVEL

SEQ ID NO: 3858 - protein, 1588 aa, Naematelia encephala
MRRAVLTGALAILFVSATPPPLSISLQTAWQAPPLLLEILETVCDENPSAYFPLLHLASIHLPSNLSDVSHEDLLIRARDIIISHELLPKPSSLSTFDLALALHTAVPRIQAFYSYYEDYVNEASLGVVECGSWVEWRGKGFCDSEDLRKDLELSIEGAVHHPDNRPSILPFDHIFRDDQVGNDSPFAIFYYDSGSPASASLLYYLAQHSRKDPAFRYVVRYRPSIIETDHEAHTTLSGYGVEMVLKKTDYLVVDDRSQGDTKPVTSSGHDIRTDDRSGPFTEALGEVADEAAGITKDELKLIGLKAATLIKSSSDPLDALQHLSQDFPKYSAAIADKISMSEAIQSKVPNMMRRGPSGPAFYINGKVLTEPELNAFSLLSVLRTERDLVLDLTSLGLTPKQAVDLISDPMIGETQIGDEPGEGVVDASDRIEGEGVITWWNDIEKDKRYQQWPAALQAFLRPLYPGQFHQVRRNAFNIVFVLDLSLGPSLDAIATSISTMIQRGLPFRFGVVPMYNRTEDSLSLQMAKLFLYSVKTFGRGATKNMLQQIVSQTPSTAITPGIVNLSIVRQAYEAIADGSDKPSLPFDTVIASNESDIQLRLIDVYNARLKATIQESPAGHLFVNGKHAPMTGAWTVHVQNELQVQIPFLQEQIAIGNAPEDVSTFFYDLPSASPRRNKLIVPTISDNKLKVFNLLDLFKRDSTHKLESDFIYTDSERGAPISMWVVGDLDSPEGRRVVRDALRHLQTPQCSSRLGFIHVPSVTSTALPGARLSTVIYQLLAESALSRTTPASMLQLLDELDSQRDNVDQDGRILQSEDDDPEQAVEGSPLNVFSSEGWSAPDTAAAAEFWKVGTAIKQRLGLRSDLPHLMVNGRLVGPLTPATFSYYDLDALEVYELRKRVKRVIDVLNTMYNDLSAFDRPTLARLISTASSVVATAYKSSDEQGIFIPSLESRNRYYERFDDGVLSFTVGDPDTALIRAVAIVDPISEQAQKWSHILKVLSEMENVSVSVHLEPETIVSEMKLKRFYRYALSSKMIFDVDGNEVTPGVTFGGLPSKPIFTLGLDTPPSWIVSPKTSPYDLDNLVLSQFQGPVHVLFTLKQLLIEGHGREANNAPPRGLQLQLTKNGLEVAGDTQVMANLGYFQFRATPGVYDLAIRPGRGFEVYDLESVGNEGWDSLNVTNTGTGLALVSFEGKTIFPRFTRKPGMEKANVLVEEVAAHQESIAENLWTQMKSFVGLNKLETLAVSKNRHADINIFTVASGLLYERFASIMILSVMKHTSSSVKFWFIENFLSPSFLKFIPHLAEEYGFQYELVTYKWPHWLRAQTEKQRIIWAYKILFLDVLFPMDLDKVIFVDADQIVRVDMKELVDVDLHGKVYGYAPMGDDREEMEGFRFWKTGYWKDALRGKPYHISALYVVDLKRFRQLATGDRLRGQYHALSADPNSLANLDQDLPNSMQDSIPIHTLNEDWLWCQTWCSDERLSRAKTIDLCQNPLTKEPKLVRARQIPEWDSYDREIAALAARLSGETGGLAASVDDLASDKSVVNDVVSEDSVANDTELESGIEVENGEEGVDEDDDPTGHLEDEL

SEQ ID NO: 3859 - protein, 1606 aa, Puccinia striiformis
MKRSAGLRAHLGLLLISTIDVLAGSPPISVSIQATWQEPPILIQVLESAALERPSLFFPSIDAVCSDWENSKSKLSTDKQKYEYLTSLLGSPGLLDGPGGLESLAFSVALKEAQPKIEAFRAWYASLPSNLTGELDSTDQCQSWTLINDSKICNPSELSELLDSNNFSEKIQSQPQVIPFDHQHGQASGNSRVPRVILYASSDPSSFCPLHQVLYKASTKLPSTATYIFRWKIPSGPLKTSSKSQSASLLSGWGASLDIKKSEYLTLDDRPVESSSSDDTQLIIDGTSATENLADSEQAKLKPLKAAEIFDIGAKATQHVLSSPSPLSALRKLTEDFPLVAHTLVNEWVPGRISTELRLELKENMANSIPPGQSVIWMNGLQISSLVSLENLNLFKLVEIMRNERRWIGSLSSLGLNSLQARNLIIDEKLNSAMNPEASSGSAIGEIDASSLGVRFDASDRQEGGGAIIWLNDLENDPRYSMWPSTLRAILRPTFPGQLHPIGRNLINVVLGLDLTQTQNLHTLGHVIEAFITRTLPIRWGIVPIPTKDPSEGEKISRSFWDMTEALGPMEALKFIKEFTQNLEEESRKIDIKKFVIQANERVSNENESSSKDIKSDQDEKFKIWLNKSQLYSSRLSLCSNDHSLPACMLINGRFFPMEENYRSHLQETATLHTGFIQHQVYYNLLKDDQNVADYLYDLPLVHRARNDLVFPSEARPLKFVNLVEALQSTPHVPAANTFFKNADASASDAEPRPIASLWVVGNLDSKVGMSAVAAALGLLKGSMHDVSVQVSFVHTPSDNSETPTELSSSLAELITASVDAKITTQDVIDQLSRHEYQITVSDDGSPTTPGKDNELVLTKIHAQGSDIPVARHQTWLGTHEFARTIGVKSDDGLAIIINGRLVHVSSTTKLLNEDLTLLVEYETQQRINPLMEALKTLDEFDLNKYHSNLPLIMSTVGVVLVGSDDGSSQTSSSEARSAKHLSRDGTHSSYQHGDKEKALFEFSVILNPTSEAAQRWSALLETLSHRSDVSMKIWFNPPLELNELPIKRFFRTAISNSLEFDKDGRSIPALVNFDGIPTETLFTLAIDTPPAWLALPHDSIHDLDNIMLSELPPAYSSQGVEAIFQLEHIILAGHAREVPSDIPPRGLQIVLSDLLRNQEVDTIIMANLGYFQFKSSPGIHRLSIRPGRSLELYQFEKTDSSLGIDDDEPYQFLCLTTFNGLTIYPRVRKRPDKISESLIQPLSASSTSSKKGPVGEFSKLMGQVKDLASGMLRGQGSDLANGTSRSVINVFTVASGLLYERMAYLMCVSVMRHTRSAVKFWFISNFLSPSFKRFIPHLAKEYGFDYQLVTYRWPSWLRAQKEKQRVIWGYKILFLDVLFPLEVDRVIFVDSDQIVRTDLKDLYELDLEGAPYAYAPMCNDRNETKGFRFWDTGYWKESLQGRPYHISALYVVDLRVFRTIAAGDQLRQHYQSLSADPGSLANLDQDLPNNMQSILPIYTLDQSWLWCETWCSDEGLKTAKTIDLCNNPLTHEPKLKRARRLIPEWDTYDQEVAALASRIKKNLNEDDSSAKITVQAGLKIDDEDLNHSVHQKDDQSSSVLDRDEL

SEQ ID NO: 3860 - protein, 1641 aa, Olea europaea
MRTRFRSGFCFLILVLVCISLPGHSVSADNRRPKNVQVALRAKWSGTPVLLEAGELLSNEWKDHFWDFIELWHQSLNEDSDSNTAKDCLRKIAKYGKSLLSDTLASVFEFSLTLRSASPRLVLHRQLAEESLSSFPLADDISSNPVDGGVPEPNETINNKKSEPLLLGMNPRSPGKRCCWIDTGGSLFFDVPELLLWMQSPNASADDTFQQPEIFEFDHVHPDSTTGSPITILYGGLGTECFKKFHLTLAEAARMGKVKYVVRPVLPSGCESESGSCGSIGADEPLNLGGYGVELALKNMEYKAMDDTAIKKGVTLEDPHTEDLNQEVRGFIFSKILDRKPELTSEIMAFRDYLLSSTVSDTLDVWELKDLGHQTAQRIVHASDPLQSMQEINQNFPSVVSSLSRMKLNDSIKDEIIANQRMIPPGKSLMALNGALINIEDIDLYLLVDMVHQELSLADQYSKLKIPLSTVRKLLSVVPPSESFTFRVDFRSPHVFYINNLEEDAMYKRWRSNINELLMPVFPGQLRYIRKNIFHAVYVLDPASLCGMETIDTIISLFENNLPLRFGVIMYSAKLIEKIEANDGQLPLAQLADDSGEDISSLIICLFIYIKENHGALMAFQFLSNVNKLRLDSSAEDIPERHHVEGAFVETILPKAKSPPQDTLLKLEKEQTLNELSRESSLFVFKLGLSKLQCCLLMNGLVHESNEEALMNAMNDELPRIQEQVYFGHINSHTDILDKFLSESGIQRYNPKIIADGKVKPKFVSLSASILGKESVIYDVSYLHSPESMDDLKPVTHLLAIRITSKKGMKLLREGIHYLIHGSKNARIGVLFNADEETNLPSLYFVKVFEITASSYSHKKGVLQFLDQFCSFYEREYMLASGVTASTQALIDKVFELADANGLPSNGYKSDLSGFSADKLRMHLNKVDQFLYGQLGLEYGVNAVITNGRVIQLLDGNTFLSHDLHLLESLELKQRIKHIVEIIEDVKWEDIDPDMLTSKFISDIVMAISSSMNLRDRSSESARFEVLSAEYSAVVLQNDHSSIHIDAVIDPLSATGQKLSSLLRILSKYVQPSMRLVLNPMSSLVDLPLKNYYRYVVPTMDDFSSTDHTVHGPKAFFANMPLSKTLTMNLDVPEPWLVEPVVAVHDLDNILLENLADTRTLQAVFELEALVLTGHCSEKDHEPPRGLQLILGTKSSPHMVDTLVMANLGYWQMKVFPGVWYLQLAPGRSSELYVMKENAEGSQETTLSKRITINDLRGKLVHMEVVKKKGKEHEKLLVPSEDDNHPTRKKGNENGWNSNFLKWASGFIGGKDQSKKGESTSMETGSVGRHGRTINIFSVASGHLYERFLKIMILSVLKNTHRPVKFWFIKNYLSPQFKDVIPHMAREYGFEYELITYKWPTWLHKQKEKQRIIWAYKILFLDVIFPLALEKVIFVDADQIVRADMGELYDMDLRGRPLAYTPFCDNNKEMDGYRFWKQGFWNDHLRGRPYHISALYVVDLVKFRETAAGDQLRVFYETLSKDPNSLSNLDQDLPNYAQHMVPIFSLPQEWLWCESWCGNATKSKAKTIDLCNNPMTKEPKLQGAKRIVAEWPDLDLEARQFTAKILGENVELQEHAAPSPLQTQDKVGDVSSEDEESKAEL

SEQ ID NO: 3861 - protein, 1507 aa, Biomphalaria glabrata
MYIININIVTGRKCDIILNKSMMYLWIFALFFAYANCKQKPITVSLTAKWNSTSLLLESSEFLAKESNEHFWNFVKRIADQDVSFFESATDEMKYKLVQKFASELISPLQLSFLKFSLALRAFSPTVEMFQHLAQQLDFNSDCEAFYEVNGKFSCSLSDLSDLLSSASTRSPSVLYQFDHIYPGSANQNTVVVLFAELGTKVFQELHKTFSEMAQNRKITYCLRHYEKKQSGKKLQLSGYGVELALKSTEYKAKDDTKVEGEKTGSPTDDDQDATEVEGIVFSKLGELHPDLKKELKEFKNHLLDSATELMPFKVWQLQDLAYQAGQKIMSASSEDSLQYLRDISQNFPTQARSLVRTSVTNEFKREVKENQEQFEGKGIGVGDSLLYINGLAIDLEVYDVFTLLDLMSSEAKLVEGLHSLGFKAENLQQLLQLDLSNGDDEKYAIDIRHSAVQYINDLLTEKKYRGWPSSVQDLLRPTFPGMLRHIAKNMFHLVFIVNPADSKSRNLLKMAEAFYVHKAPLRLGIVLTTSTDPSVTGFDNTGVALTRAFNFIAKDQNSASKGLSFITDVYEKTGSSELTPDFVIADFMSQYPDEDKENIFGASSEYDDVRKAGDDFMSRIGLSGLPQVLINGVPLEKNQLEDSFEESVVMEVLKQTQIIQQAVYKGEVNDNTDLLEWWMERDNVLPRLNSRILAPATIRLDLTGSTESSLVNIPSLASELNSKDLASTLISNINYLTKKDEESLRAVTLLVVCDLEDPISRSFLYTAIKHLKSSNNVRLGVIFNPKSLEADNVINKAVQVALGTLPAPIAKSLITKLVKEENIQDLMSRKKTLKDLEVHGMDMDAYITALNAATKDFLQVHQILASHLLSLRPGERGVIVNGGVEMCLYLCGFLYSRASDLTMKVSNLLMSKSKKEKRQRISYAGDKHSVIKLPADTNIPAFTIEAIVDPVSSEAQKMSAILLVLKQIANVDITIFMNPREKLSEMPLKSFYRYVLEPEVTFDSEGNLVAAPHAKFLDMPQKSLLTLNMKTPESWLVESVVSPYDLDNILLEEVEKSVNAIFELEYILIEGHCYDSNSMQPPRGLQFTLGTSKKAAMMDTIVMANLGYFQLKAYPGLWYLKLREGRSEEIYKIDSHEFTDSPNNLTDVVIAVNSFKSKIIRMKVSKKPDKMDVNLLQDEDDSVGIWDSISNTITGGAGKKEEEKDSTLNIFSVASGHLYERFLRIMMLSVIKNTKSKVKFWFLKNYLSPTFKDFIPYMAKKYGFEYELVQYKWPRWLNQQKEKQRIIWGYKILFLDVLFPLDVKKIIFVDADQIVRADLQELYDLDLGGAPYGYTPFCDSRKEMDGFRFWNSGYWNSHLAGRKYHISALYVVDLKKFRRIAAGDRLRGQYQGLSQDPNSLSNLDQDLPNNMIHQVAIKSLPQEWLYCETWCSESEKPKAKTIDLCNNPLTKEPKLQAAMRIVPEWKDYDYEIKVLWDEIYQTNTKAQIEYDPPVQKGSPNHIDDEL

SEQ ID NO: 3862 - protein, 1462 aa, Fusarium culmorum
MLRLLQYMAMAVLAATAASASPSVNVGMHAAFPHGPYLLELLETAAGENSTAYFPLLDKIASGHFASANSDAELYHQFLQVLQEDRHIITRDALSTFKLSLSLRAAAPRIEAHYQYYSTAVDPESQIDGAGNCQSWALIDNQKYCSPELDVAVEGKVVSKQAKVLPFDRVLGIGKDAILYADPTHASFGPFHDVLSKAARQGDVSYRLRYRRSPGVSNTPLPVSGYGVKLDLKRTDYIVIDDREATQETQKPHIVADVDLDTDEEVADLKPLSSSELASLGLKTASFILKSDNPLDALLKSTQDFPKFSASIASHEVTPGFAQEQEKNVAAGVPSGINFLWMNGVQLIERQIEPFTLIEMIRRERKLIDGVRELGFNGQQAVSLLGHSEIASSKADDEPPRFDWTDRLDGKAVMWLNDLETDSRYQKFPSDLTALLQRAYPGQLPQVALNLFHVVAPIDFTDLEDGRAFGQLAQFMQRGITIRFGIVPLATTPASIAQAKVVYHLMETYGFESLITYLQESEEGPEGAANKRSFAKAIDGREPMPGMTKMTLSEVLEAKSYAQKVKAGQAWASRLNAATPVRPILVNGMVIPREKNWVQVMGQRLTEDQQTIQKAVYFGHVNEDTPVSDLFLKTALSKRNAHIFPDDDKTLRILDVNKLYTDHAELFGKVAILPADVESAKEDWAVLTVIADLNTDDGQDLLLTALRFKRNNQGIRLDLVHNPSLPSNAHAINGAFKLSEVKLVEMKCKDDLKAVLEAPWTAEEDGFGTALANFLLTSNIQPGTKGLLLNGRFVGPLPSSVSFEDDDLKLLLEFEQRSRILPVYAAIKELGFADRLSDPISAAKLTSITALSTISDLPQGIFESAPSIRSTLYNTWNATHSAIEVGNPETASVHIAGLLNPTSEQGQRWAPILKVLSELDGIYLKLFMNPKELTGELPIKRFFRYVLDSTPSFDDSGHVQSPKATFKGLPSEALLTAGMDVPPAWLVAAKDSIQDLDNIKLSSIKSDIDVVYELENILVEGHSRDGKRGAPRGAQLALATEKDPLITDTIVMANLGYFQFKANPGFFSIRLKEGRSSEIFTIESAGAHGYAAVPGDEGTEIALMDFKGTTLYPRLNRKSGMEEADVLESVDSDNDGIVAKGLKFAESLLGGAKSPKEISAQEHAEINIFSVASGHLYERMLNIMMVSVMRNTKHSVKFWFIEQFLSPSFKEFIPHMAAEYGFKYEMVTYKWPHWLRQQKEKQREIWGYKILFLDVLFPLSLDKVIFVDADQIVRTDMIDLVNHDLEGAPYGFTPMCDSRTEMEGFRFWKQGYWANYLRGLPYHISALYVVDLNRFRQLAAGDRLRQQYHTLSADPNSLSNLDQDLPNNMQFAIPIHSLPQEWLWCETWCSDDSLTQARTIDLCNNPQTKEPKLDRARRQVPEWTIYDNEIAALDQRRKGVADKNENTRSRESEDKAHTKDEL

SEQ ID NO: 3863 - protein, 1576 aa, Armillaria ostoyae
MRTSAVWVLFSSLFVICSAGPPVKVSLRSSWRAPPVLVEIIETVALENPEAFFPFVDSLTNPETRALAKDLSPEAVHQLALQAAVAGGFLSEPGGLTAVEMNLAMHSATPKIEAFYQHYSDLNSKVDCGSWVDWYGTVVCDVETLVQLAGRETIDSNEGIPTPFSRPKILSFDHVNPSPSLTLDTPPRTAILYASLDSENFRELHSYLLSHASSNSIEYVLRYIPPKQADDAPRSFLSGYGVALDLKKMDYLAVDDRNMNGGAGASDDISEEIGKRIDAVASLIEAYPENTTAPEATVPLTEVEILELSWKASQIIAESSEPLDTLRTISQDFPKYATSLGRRVEVNESVTEELHNNQLRVQAGGHAFWFNGAPMAEKDVTPYGLLRMFRKERGIMSSLTSLGLSRAQAMELLTHPIIAAGQGDKAGFDGFVDASDRPEGGEVITWWNDLEKDSRYQRWEPAISTLLRPLYPGQFHNIKLNIFNIVLVLDLSQTSALTFIGGAVANIIERSFPFRFGIVPSIESEDGLKMARLFYFLVDNFGRKKTMGYLKKISLAGMPPQHRKPNVQWDLVRSEFEDLLDVEESELEDAIFDSVLEGQVGVSKFFDKIDAYAKRVGASMSSNPEGHCFVNGKHFEMGETFLRSMQMEVTKQIQHLQEQLYEGKLTDDNSSSMSTYFYDLPSTQKTRNRFIIPSNAIGSLRIYNLPELFARTGFDVGPGAFIYPPEGETPLTLFLIADFNTEEGLELLKSALASIGEQSETRLSFIHNPSDPKLDITAQRTPVAWLLMHLISKGLLSKSSPAQLMGALGLEAPLSMDGGRSQIPLSQEGTFQALAGQSEVDTEKIAQLMKSSRLLIRDIQLPAGSQGILVNGRVIGPLETKEFGSADFHALETYELRRRVESVVSAIHNVLPSAASLDRQVEITFQCTSNLQHIYLPDPSEAGLFDTAPKPRQRSYRILESEYTSFEYGDNTTALYQISAIIDPVGEMAQRWSSILQWISTFPDTYIEIHLNPGPHSEIPLKRFFRYNLIPSLSFDEDGHELPAQTIFEDLPVEPIYTLAMDVPSSWLVRPREALYDLDNIQLGNIAPEDSSVDAVFDLDYIVVEGHARETVTGAPPRGVQLELRSGDNAAVDDTLITANLGYFQFKTKPGVFKLEIREGRGRDIFTIDSVGNEGWNSPSVDAVGNEITVTSFEGLTLYPRFNRVPGMETVDVLDPRYKKADDSEGMLGGITSLFRSIFGSTDSSVAVVNKQADINIFTVASGLLYERFASIMILSVMRNTKSTVKFWFIENFLSPSFLEFIPHLAKAYGFQYELVTYKWPSWLRAQKEKQRIIWAYKILFLDVLFPMDLKKVIFVDADQIVRADLQELVDLDLHGAPYGYTPMGDDNTDMEGFRFWKTGYWKDFLKGRPYHISALYVVDLVRFRQFAAGDILRGQYQQLSADPNSLSNLDQDLPNNLQREVPIFSLHEDWLWCETWCSKDRLHRAKTIDLCQNPLTKEPKLARARQIPEWEVYDTEISQFTRKLAEKGLIKSRIAAADTNVLAGAGSAPSSSPESTADPTDTSGADPADGFREEL

SEQ ID NO: 3864 - protein, 1550 aa, Polyporus arcularius
MLRALLPLAWPILRATAGKPPVNVELRTSWPNTPILLESLESIAIEESGAFFPLLDAVTNPETFPDGRSPRDAHQHVFDTALSLDFLAQPGAYVAAEMHVALHSASPKLEAFYQYYNDHHATRRDDPEVCGSWVDWYGEVVCDGKTLARLVETESLDAPEDTRDNTTSYSATSPKLLPFDHILPDPARLLELPPHTAVLYADLDSANFRELHSYLYAAAHSPAPHLMYVFRPIPSAHRDPAVKTYLSGYGVALDLKKTDYLAVDDRLQGGAGTADDSNAAVQTEEVDPIVTLLQQYPVDESVDVTLPLTEEELLQIDLQAAQFIYDSEDKLSTLKHLAQNFPRYAGALARRVSVDELLLEELSTNQPRARGGVNVAWLNGVTLEEKDLNAFSLLRLLRRERNIMLSLMSLGLSSEQAIELLTHMSIAKAQSESGALDGLFDASDRAEGGGVIGWLNDFENDDRYAHWSNMLRTILRPMYPGQFPTLKRNIFNVVLAVDLSQLSSIDFIASTVQAVIERRMPFRWGVAPLVETEDGARMARLYYYLLQNFGPTETLAFLRTLSQRGTPLQDLSPSVDWSLVRQAFDALLAARDDTAETVETDLDTILEGTEGDLEKQRAYATRLSTTLESASQGHVFFNGKHFELDDNFLRSLQTESAEHLQHIQYKVYKNELTDEDDVSNYFYDLSTTAKRRNMYIHPSPGAGSLRIFSLPDLIERNGLKSSAGSFLYPAESEQVPLTTYVVADFDSEESQHLVKEALLSMTPGSLSRLSFIHNPSTVSLASKSDDFASPSRFLAQLVSWDLLSRLTPGQLLKTLGFGDVDAFSEGSTQEPFSLDDLVGTEAYTGEEYEKYLTACRLVVRQLELKPGEQALIVNGRVVGPMEPGKFVAGDFETLAAYEHHKRVKSVHEALLDVYEPLKDASKEDAAEMTSIASSIVSSIQLPDPSEAGLFNAPQRPRLRNYQMLSGTYTAFSIGDNTTALYHFGVLVDPLSEAAQKWSSLFEWISEIPGVYVEFHVNPTKYNELPLKRFYRYNLLPRLTFDDNGNEVHAKTQFTDLPVEPIYTLAMDTPQSWLIRPREALYDLDNIQLGMLSPRDRTQGLKAVFELDDLVVEGHARESATNAPPRGLQLQLVTSNSTPIADTLVMANLGYVQFRTKPGVYRLEIRPGRGREIFKMESVGNEGWNSPSVEEAGDEVTVTSFEGVTLYPRLARLPGMENVDVLQAHTEVHEDAGLVENLLSKVSSLFGSKQEERALVPVDDGQAEINIFTVASGHLYERFASIMILSVLRHTKSTVKFWFIENFLSPSFLGFIPHFAAEYGFQYELITYKWPSWLRAQKEKQRIIWAYKILFLDVLFPMDLKKVIFVDADQIVRTDLKELVELDLHGAPYGYTPMGDDNPDTEGFRFWKTGYWKDFLRGLPYHISALYVVDLVRFRELAAGDILRGHYQQLSADPNSLANLDQDLPNNLQREVPIFSLPADWLWCETWCSKDRLDRAKTIDLCQNPLTKEPKLDRARQIPEWEVYDSEIAEFTRRLREGNAGGSEVPKHDEL

SEQ ID NO: 3865 - protein, 1566 aa, Bombyx mandarina
MKIPGLRLSLVVLAIAVVSVASNIDPIKRDEKKSKSVTTFVSAKWEATPIVLELAEYLAGESSDLFWSFVDGINSLKSSLDSLENDKQIYDACIGVASTLLAPAQLRMAKLALSMHTTSPTVRMFDQIAIQNGAKEIQCDTFVNIATNNICDNDALRDILQTHNLKNVGDQNNEIYLLDHTHPSSDNKSLTAILYGELGTKDFAMKHKILAEYADKSAINYVVRWNIKTRGKPKLRLSGYGVELQLKSTEYKSQDDSTPKETEDKETAAQSEEEDENDPQNQIDGFNFGRLKNLFPALRTPLERFRRHLSESSEELAPLKVWQMQALSMQAAAAVVDANDAGGDEALRVLTSIAQNFPMQTKSLIHVSVPRAFRDEVLYNQDIWASALGLRPAEPLLLVSGAQYDAEDVDVMALLAALREDIGPMNTLHALGLPKKLIHTLMSLDLGESYTWEEYGLDIRDTSITWLNDLESDDRYRRWPSSFMELLRPTYPGMLRNLRRNIYNYVIIIDPTSVQSGPPLKLGETLLKHATPVRVGLVLASTKGDASLEAAVRSAFNYIAQEKNSNKEAYYFLTQLLNPSGDDVLDINYVKKQLKRHATSGASIEDIISEDSEYNFGRQISEEFVSKLGSDKYPQVLINGVPLMDEGPTPVTSSVELLEESLVTSLSRHTARLQRAVFRGELSDMDDAVDYLMKQSHIMPRLNRRILSSETSQYLDLTGASSPADLFTEDKIHKLLHLTGRDALATALPILKYFYKPGKVEKKITQTIWVIGDLNNHESRGLLRNALTFMRESSGVRVAFIPNVDSTNDQSLNKVVVAALTTLESTEATKYVVKLLEDEGCHERKDCDVLPEIIPALNKYEWVLKAARVLCARSFKLRPGARALAHNSRLIGPFLDNEQFTLDDFVLMERFSSQMYGDKIAEVLDKKKATITNEVTDDDEEESVEVTSDMRLKLVSVLGGRESRARTALPSGLHTEHSLIELPPVYDNEAAVEVVAVLDPASSAAQRLAPLLLVLRRVVNCNIKLFLNPQDKNSDMPLKSFYRYVLEPELQFTAAGALSGGALARFSRLPHAPLLSMELRTPTNWLVECVKSVYDLDNIRLADVETVVHSEFELEYLLLEGHAWDTTLGTPPRGLQLILGTREKPELMDTIVMANLGYFQLKANPGAWTLRLRPGRSEEIYEIVGHENTDTPAGSQDIQVLMSSFRSHVIKLRVSKKPDKQHLDLLVENDDKNSGGLWNSIASSFGGGDESEAQDDTINVFSVASGHLYERFLRIMMLSVLKNTKSPVKFWFLKNYLSPSLKDILPYMAQEYGFEYELVQYQWPRWLQRQRDRQRTIWGYKILFLDVLFPLHVKKIIFVDADQIVRADLKELVELDLGGAPYGYTPFCDSRTEMDGFRFWKQGYWRNHLQGRSYHISALYVVDLKRFRRIAAGDRLRGQYQALSQDPNSLSNLDQDLPNNMIHQVAIKSLPQEWLWCETWCDDDSKKYAKTIDLCNNPMTKEAKLSAAMRIVPEWKEYDGEVKALQARVRRGLYQSSDHEQEVEVNIDVTTSSQSTNTEHDAHTEL

SEQ ID NO: 3866 - protein, 1214 aa, Rousettus aegyptiacus
MMPLKVWELQDLSFQAASQIMSTPVYDAIKLMKDISQNFPIKARSLTRIAVNQHLRKEIQENQKDLQNRFEIQPGDAFLYINGLRIDIDAYDPFSILDMLKLEGKMMNGLHNLGINGEYMSKFLKLNSHVWDNTYVLDIRHSSVMWINDLENDELYVMWPTSCQELLKPILPGSIPSIRRNFHNLILFIDPAQEYTMDFIKLAERLYYHKIPLRIGFVFIINTDDEVDGVDDAGVALWRAFNYIADEHDVSQAFISITHMYQKVKKQNTLTVDNVKSVLQNKFPSANVQDILGIHSIYDDERKAGANFYKMIGLGPLPQALFNGESFNREELNIKELEMAVLQKMIDTTIYLQREVFMGTLNDRTNAVDFLMDKNNVIPRINPLILHSKRQYLNLISTSVTADIEDFSTFFFLDSQDKSAVIAKNMRYLTQEDDNAISSVTLWIIADFDKPSGRKLLWNALKHMKSSFHSRLGVIYNPTSKIREENTAISRGILAAFLTQKNTFLRNFLRKLAKEETATAIYSGDKIITFLSEGMDKNAFEKKYNTIGVNIFRTHQLFCQDVLKLRPGERGIVSNGKFLGPLDENFYAEDFYLLEKITFTNLVEKIKGIVENMAISSKNMSDLIMKIDALVSSLPKRASRYDVTFLKENHSIIMINPQENDVFFDVIGIVDPLTREAQKMAQLLNVLGKIINMKIKLFLNCRGKLSEAPLKSFYRFVLEPELTFVADDIGPVAKFLDIPESPLLTLNMITPEGWLVETVHSNCDLDNIHLEDIEGTVIAEYELEYLLLEGHCFDIMTEQPPRGLQFTLGTKNQPVAVDTIVMANLGYFQLKANPGAWLLKLRQGKSEDIYQIVGHEGTDSQPDQGDAVVVLNSFRSKIIEVQVQKKPDKIKEDILNDKDGKKGMWDSIKSFTRSLHKEKDKTETDVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLAVDKIIFVDADQIVRHDLKELRDFDLDGAPYGYTPFCDSRTEMDGYRFWKTGYWASHLLRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLEAAARIVPEWVEYDNEIRRLLDHLENKKKNESKSSFCSGI

SEQ ID NO: 3867 - protein, 1455 aa, Endocarpon pusillum
MIPSNPFAQLIEGRETAAEENSTSFFPLLDRVAEGIFTELDTEQALYERFLKLLEDDGHISDPEAVASFKFALAIRSVAPRIEAHYQYYNTSVQPSMMAAQDAACPVWVHFDDKQYCSPSLERAQQDMPIDGLADQLPFDRVLGDVSEGPPSILYADITHPLFGQFHETVSRTAKQGKSSYRVRYRPSTDTSPLFLNGYGVELALKRTDYIVIDDRKAGQDDEEVQKPISDKDLSDEGPADLKPLTTSELSTLGLNTASFVMSSDDQLDTLLKVSADFPRYSAMIASHNTSETFLNEYRTNRAVFLPQGYSIVWINGVQVDTRSLNPFGLLDHLRRERALINNLRDLGFTASQAIKLLSHKDIAQAQVEKEPQRYDWRDQTEGSNVIMWLNNIEKDKRYQIWPSQLTALLQRTFPGQLPTARRDIHNLIIPVNFADSKDLQLVVETLQSFVKRTIPVRFGLVPLLSSPDSAAQAKIAYHLLETYGLSSLFAYFEEQVTAKKPSTATKASFAAAIEGRKPRNEREVLGLDALLTSDPLEQRLQAVKSYLSRLELGNEVTSILINGVALPRNENWLEAMSARVSMDLRAIQRAIMEDAFNEESWIPEYFLFQASSSRNALITPEKLDSISVLDVSKLARDHFDVLDDIPRISASPDSDFEARAHLLLVADFESDPGKQLLKEAIEFRKGEPGVDFVILHNPTSSRPTSGLPFQLYHLLKEGKEISPENLLDIVSGSDWTQPTQAMAQRADDYWSVTQRLADAIGIEHGASGILLNGRYVGPIKDGTLFLKEDFDLLLNFERQQRINHVVSAVRDLGWESNVVKPLDLAKVTSLVARAHVSDLPEGIFESPPLIRIDNFNLWNSTHSAIHVSTSDDPAIQIVAAIDPASEVVQPWIPILRTLSQLHGVDLKIFLNPREQVLELPIKRFYRQVLDSAPMFDNSGALRRPQATFTAIPEEALLNLGMHVPAAWLVAPQVCDYDLDNIKLSSVPKDQNIDAIYELEHILIEGHSRDTGTGSPPRGVQLLLGTEKQPHFADTIIMANLGYFQFKANPGYWHISLMPGRSSRVYTIDSVGSKGYSPQPGDLDTSVALYSFHGATLYPRLSRKPGMETEDVLDSGSKARSAMDYLSRGASFASSALTSVGLSKSSSSANADINIFSVASGHLYERMLNIMILSVMKHTTHSVKFWFIEQFLSPSFKSFLPHLAAHYNFQYEMVTYKWPHWLRSQKEKQREIWGYKILFLDVLFPLHLDKVIFVDADQIVRTDMMNLNRVDLHGAPYGFTPMCDSREEMEGFRFWKQGYWKNYLQGKPYHISALYVVDLKKFRELAAGDRLRQQYHALSADPGSLSNLDQDLPNHMQYNLPIYSLPQEWLWCETWCSDEALQSAKTIDLCNNPLTKEPKLDRARRQVPEWTVYDEEVAQVMEAVKRAEAEASAQAAGPEEVIQERKPDRKKKDEL

SEQ ID NO: 3868 - protein, 1475 aa, Fonsecaea monophora
MRTLHKRWTWSLLALLSWDSLITLTRATSSVNVALQTSFSAGPYLVELLETAALENSSSYFPLLDRIADGTFTDLQTEQELYTKFLDVVQNDGHLSTPESVSSFKFALALHAAAPRVEAHFQYYNTSVQPHLMAAQDAVCPVWVYLDGQQFCSPTLDRAQQMVSIPDTVNDLPFDRVLGASSDGPSSILYADITHPLFGQFHSVVSQTAREGKSTYRVRYRPSTIVSSRPIYVTGYGVELVLKRTDYIVIDDRDAQKTGDSTPEQLSLETKDDEIKDLKPLTTSEVAKLGINAASFILSSSSPLDTLLQVTSDFPKYSSLLASVNASKEFVLEHRANRDRFLPSGYNVLWINGVQIEPRQMNAYSLLDHLRRERRIIAELKSLGLASSEAISLLSSEIIAEAQANETPQRFDWRDDSEAGGVLMWLNDLEQDKRYAGWSSSLRSLFQRTYPGQLPQVSRDIHNLIVPIDMGNMKDIELVTTSLQSLVRRQVPIRIALIPTGEGETADTYSKVAYHISDTYGLTALMSFFSDIVAAKRIDTSPEKSFKTAIRGRATREGKEPLAFHKVLNDESLGLRLQARDEYMKRLALARPNPPLLVNGVVIPRTDNWFELLSARLYADLQLVQQAVFQEAILEESWVPEFFLFQAVKRRNEMVFPDNAKDVEIVDVGQIAVDFADSFARLPRLAGAEATLLSDRAHLLVVVDLESETGRTLLSEALLFHQRNPEIEMLIIHNPGPESQISSFARGLYALLQEDGRDLTVDSLEQLLKGDLSSSADDLTDASAEFWSSHADLLQTLSFSEGQNGLWLNGRLLGPLDQGFTSVDFEALLEFERRERIAPVTTAITGLALEDRFTGALDLAKITSLVARSLKMERFKFWNGTHTSIKISNSDDINIQIVASIDPASELVQQWVPILESLSRLNGVSVQIFLNPKDRMTELPVKRFFRQVISAEPSFDSHGSLSIPNASFSGIPKDTLFNLGMVVPPSWLVAPKISIHDLDNIRLSNLAEGENIDAVYELEHILIEGHARDVTSGPPPRGVQLLLGTEDEPHFTDTIVMANLGYFQFKANPGYWQISLKPGRSSKIFNIDSVGPHGYSAQPGDETTSVALLSFQGLTLFPRLSRKPGMEEEDVLESSALGGAMDYLNKGASFASSALSSLGFKKTSSNADINIFSVASGHLYERMLNIMMVSVMKHTKHSVKFWFIEQFLSPSFKSTLPILAEHYGFDYEMVTYKWPHWLRGQKEKQREIWGYKILFLDVLFPLDLDKVIFVDADQIVRTDMMELNKVDLKGAPYGFTPMCDSRTEMEGFRFWKQGYWETYLRGKPYHISALYVVDLKRFRQLAAGDRLRQQYQALSADPASLSNLDQDLPNHMQHSLPIHSLSQEWLWCETWCDDASLAKAKTIDLCNNPLTKEPKLDRAKRQVPEWTLYDEEIAGVIRAAKEQASAVTDNSEGLEDAADGENLENVESERIRDEL

SEQ ID NO: 3869 - protein, 1425 aa, Kalmanozyma brasiliensis
MGMEEAWQKSSSGASCSESEPGSTPAADAEHTTLLSGYGAILDLKKVDYLVIDDRKLKDDSNVGDVGIAANSQSEEGDAARQASEESAWLQEHIGAEVGSTTSLSSLSDDQIAYLGIKAARLIMGSSDPLRALQELSQNFPSHAAALASSTKWDDPDATAELVESVLNLASMRIEPGHSDLWLNGQSTPTRDFMPLTLLETLHKERRWNHALQHRLAGGGLNVTEAGDLISSSLVGRAYMAGADGNVGSAIFDASDRIEIKDAGIDADVGAITWLNDLEKDEATSEWSNELMDLLRPMWPGKFPRLSINLFNVVLVLDLKQRETCRFMSDTVIQSLGRVGLHWGLVPGGLEDDANSDSTRMARLIWFLLDEASPQIVSDVFRKAAASRSGTADAIDTSLAVKEAKFALKSIDPSLAARLDEALAGSNPTYAQRETLARAYIKRLRATREESATGHVFVNGQHHPFHPQIVHIMHQAIQEQIQVLAPQIYYGQISSSTPGLETFFYDSVGALSFRSALVGGSSGGGSAEEGGVKHSAVDLFSALVDEENEEGSVEKLFNFFYPAEGASDAPLNSTVWVLADLDSPEGLALLTRSFEALAKDDAKFRLGLLHVPSSASTTSGHSSSISTIAQQVLAESRAEKIAPLTMLAALQQAHDDHSVSASQLANTLGLSHDLSNHTPPRQFWTSIAPRIATHLDLTTPSILVDGHLVTNLPVSTMEARDITALVEYEAGQKLSSITQALSLLRPSFGTLPPAQRQNLLFASLSVLNGVYAQSDSMFAAKTGTRSGLPEQLGTPAHAFEIGDRATADVRVTLLLDPLSEAAQRWSSIMRMLSSMKGVWMRVILNPQIKLRELPLKRFYRFSAPPRLQFREGRAVAEELRFFGMPEEAVLTLGLDAPAPWLTMPMEAVYDLDNVRLADVPAAARGKGVKAVHELRHILIEGHARDQSNGVPRGLQLLLETPDGSTSLDTIVMANLAYFQFKAEPGVWGLRIRPGRSDELYEMQSVGGSGWDSPSVGVTGEHVVLDTLSGLTIYPRVAKRRGREREELLEELDAQGRPVKKVVEPETVADAAGQLFASATAKLGSLARHMTGSTTPRATTAVGRKHADINIFTVASGHLYERMTYIMILSVLRHTNSSVKFWFIENFLSPSFREFIPHLAREYGFEYELVTYAWPHWLRAQTEKQRTIWGYKILFLDTLFPLDLGKVIFVDADQVVRTDLKELVDLDLGGAVYAYPPMGDDSEDMDGFRFWKQGYWKDYLRGRTYHISALYVVDLHRFRRFAAGDRLRGQYQALSADPNSLSNLDQDLPNNMQASLPIHTLDKEWLWCETWCSQDWLKDAKTIDLCSNPKTKEPKLDRAKRQIPEWTVYDDEVARLAQRLVEEKRVGSSVVAPKSQVLTKDGEAQQVPKEKAEGEVDTDVHVHDEL

SEQ ID NO: 3870 - protein, 1538 aa, Mortierella verticillata
MRTIGSPLRASVLALTLVAVQFGNHALANAEHSPSPPIEASIHTSWAAPPLLLEILEAVAVENKTAYQPLMRQLTDTAFLDSVSTPKALYEESLKVIEAQGHVAPQAISSLKWSLAMHTSAPWIEAHYHLYNSTIAPDRLSKSGFNSDCGVWVDWYGRQICTVAELKSAVTANGASTKRPNQRPTTMDLDHVNAPADASDPFTILYADVYDPEFAAFREYLDTLSNDHGLEYSLRYRPPVKRGKESPLTLSGYGVELALKNTDYIVIDDRDLGHGDDFLASGQTVFKNSAGTNLLGDDEPAVEPIGESLLTDIGLAAAQFVAMSEEPLKTLVSVSQDFPKYQAKISKMTFDPALKLIVRGNQGFLAGGAGKVWLNNQPVPSHKMNPFSLLRMMRRDRQTIASLATMGVSSRKAVELLTDASDTDSGSGAAKDPEGVLDIRDKSEDKNLVVWLNDLQSDNRYRDWNADLINIVRPTYNGQFHQVRRNLISSLFALDFSSPKALELVSFELTNYIQKLVPFRFGVLPLLKSDDGVEVRMAMLWRHVVSRYGIKGGLEFLKRTLINHIQQGQDLETASKMSFSVTLQSSKLKSTTTPELTYEEVVAPDSVYRSWLTSVRAMTDRVGITEESFFINGKYFAWEENHGQHLMQEAPSQTAYLANKLMQGEISVDTDLYEYFLTRPGVAENRNPYVFVSEEVPLKVVDLVQGQSRPFIDTLSYISTGEQTEQTTTVILAANFEEKEGVALALEALKAVESELTVRVALVQNGKTVETLPGLANFVRQSSVDGKALPLGFWKDLLEGISQGVSFLDSFQQAGSKHPEAALIGVEGSKGREKDADDSREKFLQDVVHVKDDEIFIIINGRVVGPILEPFRSSDFRLLVNYEQTSRINKINSLLASNNIAATASNIMKAGSIIYAAAQQLDQSLYDINESQISRDRTFAKLDTELVGFSVNSQVHADQDDVLYHFAAVLDPASQLTQRWAPILETMSRMANVKIDIVLQPSLRVTELPIKRFYRYVAEPELTFDSETGNLVAPTAYFAGLPQPTLLTLGVDVNPAWVVTSKVCIHDLDNLKLSSLTGSSRITGVQAEFELQNILVEGFARDISQKVPPKGAQFILGTKAVPHVADTLVMANMGYFQLKANPGVWEMVLRPGRTHEVFSIESIGSEGWVPGGVKNDKRDVVIANFEGLVLYPRLVRNPGMERANVQDEVAQESGIWSSIKTTIKGLANPAKPAKKKAEINIFSVASGHLYERFLSIMILSVIKNTDSRVKFWFIENFLSPSFKDFIPHMAEKYDFDYELVTYNWPHWLRAQTEKQRIIWAYKILFLDVLFPLDLDKVIFVDADQIVRADMKELVDLDLKGAPYGYTPMCQDRTEMEGFRFWNQGYWKDHLRGKPYHISALYVIDLVRFRQMQAGDRLRNHYQQLSRDPHSLANLDQDLPNNMQNDVPIFSLPQEWLWCETWCGDEGLAKAKTIDLCNNPLTKEPKLDRARRQIKEWEDYDNEATEFAKKVNAELKQARRQAEATPTNARDSHAFKDEL

SEQ ID NO: 3871 - protein, 1523 aa, Aureobasidium subglaciale
MVPYQYLAANTAFLLGLQAICTSAAPSVNVALKTSFNSAPYLVELLETAADENSTAYYPLLDRIAEGHFDQASTDRDLYELFKKTLQDEGHLAKAEDISSFEYALSIHAAAPRIEAHYQFYNTTVEPTLKRRTDKSCQTWLHFNGQQYCDSDLASSSGELLDQERVLDLPFDRIAGNKQSKTPAILYADIMSPTFREFHKTVSATAKSGKTSYRVRYRPSIDIAGSPLAVSGYGIELALKRTDYIVIDDRQAEDSDSVSSDGSSAKLTDEDVADLKPLSSKELLRLDMRASSFVMSSADPFDTLLKLTQDFPKHSAAMSTQEISEDFRKEHLVNREVFLPSGYNVIWVNGLQVLARDFDAYAMLEHLRRERKLIDSASELGLSGKEAVQLLSHSSISEASSSQEPQRYDWRDELEDGKVIIWMNDIEHDKRYAEWPSQVRALLQRTYPGQLPPVRKEIHNLILPIDFANYKDVEMVVESLQSFVKRKVPIRFGLVPKTTSAASSEQAKTVYYLLDTYGLGVALEYLQKLSSSQGRKLAGPVQSVFDGAAKGRKLRKDRTSAPLQEVLQNDDFNARVASARKYLGRLGASGNTPPFFVNGIPLPMSDEWLQEMSQRVSTDLRTVQKAIFEDELDDDSYIPEVFLARASARRNPWVIPEDENSIRQVNLASLSDLTEGAIGSVPSLPASKDTVSSDLVHLVIVADFDSEASQRMLSALLTLRKDEYDQVEILLVHSSTTPLSTSSFAVELFKTMILGPTVSLDALQALLSKGKVTVSEEDVVAANAFWSSADRFLEEIGFSSGDQGILLAGRVVGPLPSFEDFDGDDFETLLSYERMKRLMPAAAAIKGVNIADKANTALSFSKLSNLIALSSKSDVPEGMFDSSPPARSDVFSGWTGSHTLIERGDAESATIQIVASIDPASETAQRWVPILKVLSELSGVHLRLYLNPKERLDELPVKRFYRHVLESKPRFDKAGSLQGTLAHFGGLPADALLTMAMDMPPAWLVAPKDSVHDLDNIKLSSTQGRDIEATYELESILIEGHSRDVTIGTAPRGAQLVLGTNKDPHFADTIIMANLGYFQFKANPGFYNLTLQKGRSEEIFKIDSAGTIGYSPQAGDEITEIALTSFRGATIFPRLSRRPGMEDEDVLESAKTTADHIANKADAILSKVGLGSVKSGDVLSKAQKFGSGLLSKSGGSSTDLATLPHADINIFSVASGHLYERMLNIMMLSVTKHTSHTVKFWFIEQFLSPSFKAFLPIMAEEYGFRYEMVTYKWPHWLRGQKEKQREIWGYKILFLDVLFPLDLDKVIFVDADQIVRTDMYDLVKYDLQGAPYGFTPMCDSRTEMEGFRFWKQGYWKNFLRGLPYHISALYVVDLVRFRQMAAGDRLRQQYHQLSADPNSLSNLDQDLPNHMQHVLPIQSLPQEWLWCETWCSDETLGVARTIDLCNNPQTKEPKLERARRQVPEWTIYDDEIAALAQRKVGEGKSPIAGHAGGAGIQAEMQEADARAQREENEMKKQKSHDEL

SEQ ID NO: 3872 - protein, 1603 aa, Microcebus murinus
MKWVGYNVFFTNSSITNISPFHDILGHCHFGSLLLGLCSCRYLHTVCQSNRTCRQLRHELCLFEFTLYSPLQLAEATVLHFYVCARFYDGLWHPVHLDEGECEFLAEDSQEKFWNFVEASQNIGSSDLHGTDYSYYHAILEAAFQFLSPLQQNLLKFCLSLHSYSATIQAFQQIAADEPPPEGCTSFFSVHGKKTCDFVTLETLLLTASERPKPLLFKGDHRYPSSNPESPVVIFYSEIGYEGFYKFHRQLVSQSNEGKINYVFRHYISNPRKEPVYLSGYGVELAIKSTEYKAKDDTQVKGTEVNTTVIGENDPIDEIQGFLFGKLRDLHPDLKGQLKELRKHLVESTNEMAPLKVWQLQDLSFQTAARILSAPVELALVVMKDLSQNFPTKARAITKTAVNSELRTEVEENQKYFKGTLGLQPGESALFINGLHIDLDTQDIFSLFDVLRSEARVMEGLHRLGIEGLSLHNVLKLNIQPSEADYAVDIRSPAISWVNNLEVDSRYNSWPSSLQELLRATFPGVIRQIRKNLHNMVFIVDPAHETTAELINTAEMFLSNHIPLRIGFMFLVNDSEDVDGMQDAGVAVLRAYNYVAQEVDDYHAFQALTHIYNKVRTGEKVKVEHVVSVLEKKYPYVEVNSILGIDSAYDQNRKEARGYYEQTGVGPLPVVLFNGMPLEKEQLDPDELETITMHKILETTTFFQRAVYLGELSHDQDVVEYIMNQPNVVPRINSRILTAEREYLDLTASSKQHFRNNFVLFFNLCFRIFAFIGLIYTESSLALILVEKFYYFCFVSLNLSFLNFMHGFQKLFGITVVLEHIMCFFFFNSICYFCFSIDDSFIRPVTFWIVGDFDSSSGRQLLYDAIKHQKSSNNIRISMINNPSEEISYENTQISRAIWAALQTQTSNSAKNFITKMAKEEAAEALAAGADIAEFSVGGMDFSLFKEVFESSKMDFILSHAIYCKEVLKLKKGQRAVISNGRVIGPLEEGELFNQDDFHLLENIILKTSGQKIKSHIQQLRVEEDVASDLVMKVDALLSAQPKGDARIEYQFFEDRHSAVKLRPKEGEIYFDVVAVVDPVTREAQRLAPLLLVLTQLINMNLRVFMNCQSKLSDMPLKSFYRYVLEPEISFTSDSSFAKGPIAKFLDMPQSPLFTLNLNTPESWMVESVRTPYDLDNVYLEEVDGIVAAEYELEYLLLEGHCYDITTGQPPRGLQFTLGTSANPVVVDTIVMANLGYFQLKANPGAWILRLRKGRSEDIYRIYSHDGTDSPADADEVVIVLNNFKSKIIKVKVQKKADMVNEDLLSDGTNENESGFWDSFKWGFTGGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQVSCNNPMTKEPKLEAAVRIVPEWQDYDQEIKQLQTRFQQEKEGGALHEEQTEALSRAGPQKREEL

SEQ ID NO: 3873 - protein, 1492 aa, Caenorhabditis remanei
MNLFWSLLIVCQAVLLASADKKGVQTSLKASWDSTSLLAEASEFIADESEKKFFKFVDIVNNDAPTLNWNKLTDEQKYEYTIKTASKVISASSVDLLKFALALRQYSPRVQSFQQFQIAAEYEESCEVFAVAGDQVSCDYEKVDHLLRDAKRDTRVLESDHFVGDKQSKKAVILYGELGTVSFAKAWQNLSKNQKTGLIFRHFSKNVESNPVSLSGYGVELAIKNTEYKAVDESNEKKSVEEDETDLFGFNIKLLKELHPDSVEAIESFRVNLKESDELTPLKRWELQDLSYQAAQRIVNAGPAEAIGTLEEYSQNFPTHARALAKTTVDEKLRKEVQLNRKMLEEANIEVGETSLYINGINQDINSLDLFKLADLLKQENKLADGFHSMGINREYLSVLVGMDTSDDEKISYAVDHREGYPFFINNLDTDKKYKQWGNSVKLMLQPYYPGMIRPIARNLFSLVFVVDPSTADGRKFLRIGQTFNSHDIAMRIGYIFVVNQDAKASGENDLGVALLNLFNFVSIDSSNAEALKVLNNFLDGYRSQEPTVADLKDFFEGKFSDTNFKDVFGVDSDYDKGRKHGYEFLQKTGLSSAPKVLLNGFILDEEGVRGDNIEETIMMEVMKISPKIQKAIMEGKLTDRMNVGNWVLDQKEVMPRINKRILSAPSKKTYVDMFGAKECKTLKGAESLPDVDKASCLLHTTKYLQKATNDAILPVTLWTIADADSVDGRRFIYNSLQILKNSAKSRVGIIFNTENVEKSCESNSISSYIRAALEFLPMDQAKRLILKLSNEEYAADFISGKMTFDDLSVGGMDTAKFLADKKKLDCERTRAEANLVKSLLDIKAGDRVVVGNALQVGPLDKDEHFEAADFKLLESMLLSRGAEVISSHLSKWEFTAANGAGSNIAFSIAGVVGKHASSQKRTWVSIKGDEHSVVTLTADESNKPAVDVLAVVDPLTLEAQKLGTILQLIKKVTNCDIKIVMNPKDKHSELPLKRFYRYAAASELNFDHNGKLNGNVVRFDNLPSKQLLTLSLQAPDSWIVEAISAKYDLDNIKMEQASGDVTAVFALQHLLLDGQCFDEISGQPPRGLQFVLGTEKNPKQFDTIVMANLGYFQLKANPGAWNLEIREGKSSEIYKIGTHVGAEKIGEDTLQVVLDSFTGKSVRVRVEKREGMEERNLLADDEEGVWSSLSNLVTSKEKPQEVINVFSLASGHLYERFMRIMIVSVMKNTKHPVKFWLLKNYLSPQFKETLPTLAKHYGFEYELVEYKWPRWLHQQKEKQRIMWGFKILFLDVLFPLDVQKVIFVDADQVVRADLMELMKFDLGNAPYGYVPFCESRKEMDGFRFWKQGYWANHLAGRRYHISALYVIDLQKFRQIAAGDRLRGQYQGLSGDPNSLANLDQDLPNNMIHQVKIKSLPQEWLWCETWCDDASKKNAKTIDLCNNPLTKEPKLDSANRIIGEWKTYDDEIREVISGHTISEPVINETEDSHTEL

SEQ ID NO: 3874 - protein, 1625 aa, Puccinia coronata
MQRSRALRDRLGWFLVLTLQVLASSPPISVSIQATWQDPPMLVQFLESAALERPRLFFSSIDAVCSSWETSKSQLSTEQQTYEHLISLLRSPGLLDGPGEIESLAFSIALKEAHPKIEAFRAWYASLPSNLTGALESEDNASSETKDCKSWALINNSKICDISKLSELLHPNYRLSEKIQSPPQVLPFDHKQGHQSTQKSSVPTVILYASPDPSSFCPFHQVLHKASKKPQPDTTYILRWKIPSTPSASSKPSLLSGWGASLDIKKSEYLTLDDRPVESSSSEDAQLILDGTKKPAGNEMQVDSEQAKLTPLKAAEIFDIGAKAAQHVLSSPSPLSALRNLAENFPLIAHTLVNEWVPGRISRELRLELQENMAAGGIPPGQSVVWMNGLQLSSLVSLENLDFFKLVEIMRSERHWISSLTSLGISSLQARKLIVDEKLNLAMNPEASSASEIGEIDASSLGARFDASDRQEGGGAIIWFNDLEHDERYSMWPTTLRAILRPTFPGQLHAIGRNLLNVVLGLDLTQGQNLHNLGHVIEVFISRNLPIRWGLVPIPTRNTSEGEKMARCFWDMIQALGPMETLKFIKEFTQDLDPQAGAIDVPKFIAEARERVSSEEESAEEAQSHEEKFESWLKKSQLYSSRLSLCSNDDSVPACMLINGRFFPMDENYRSQLQETASLHIGFIQHQVYFNLLKDGVNVAEYLYDLPVVHRARNDFVFPSEARPLKFVNLVEALHATNVLAANTFFQNLALPAQDDSPRPIASLWVIGNLDSNIGLASVAATLGLLIKSSPDASVQASFVHIPSNDPETTKGISTTLAGFLSASDEEKIHTSDLLDQLSRHGHHVIASDDGNQPIPDKTTKLILKKVQTEIVDTPGTNDLPWFGTEEFARTMGVKSDGVAILINGRLLHVSPSTKLLSEDLVMLVEYEAQQRVNPLMEALKNLDGFDLAKHNLNVPLIMATVGFVLVGSSDDTSSQTFSLEARSSKHLSRDGNYSSYQHGDQSKALFEFSVILNPASEAAQRWSALLETLSHRSDVAIKIWFNPSLEVSELPIKRFFRSAIWNSLEFDQNGRATPALVNFRGIPTETLFTLAIDTPPAWLALPHDSIHDLDNIMLSELPATYSSQGVEAIFQLDHIILAGHAREVPSDIPPRGLQVVLSDLLRNQEVDTIIMANLGYFQFKSAPGVHRLSIRPGRSLELYQFEKTDSTDGNDEPYQLLSLTTFNGLTIYPRFRKRPDKSSESLIQPLSTSSPKGPVGEFSKMMGHVKHLAAGMLGHHGLDLANGTARSVINVFTVASGLLYERMAYLMCVSVMRHTRSPVKFWFISNFLSPSFKRFIPHLAREYGFDYQLVTYRWPSWLRAQKEKQRVIWGYKILFLDVLFPLEVDRVIFVDSDQIVRTDLKALADLDLGGAPYAYAPMCNDRNETKGFRFWDTGYWKESLQGRPYHISALYVVDLRVFRTVAAGDQLRQHYQALSADPGSLANLDQDLPNNMQGILPIFTLDQSWLWCETWCSDEGLKAAKTIDLCNNPLTHEPKLKRARRLIPEWDVYDQEVAALAARIKDNDKGDLSSKITVQAGEKIEDEVPENNKRTEHDGGDDELESSVLDEEGKGSTDHDEVGTRDEL

SEQ ID NO: 3875 - protein, 849 aa, Caenorhabditis brenneri
MIGNQFLVKSGFQLKPLALLNGYPLDTSSPETFETSLAENVQQQTLRLQLYLYHRKIDDSVKIDEWWLTPENNKDIVKRISENVATAFNEKKILKLDKDSSELLKNLRYFSENPGIVKAIVNVTTWIITDFESTSNRLFTIKALKSIATQKNNKVALISNPKDSKKPCSFNLDEAFSLNELIEVLEREDSELDYCSSTKIPKEFLEKYGGKPGDTAVISNGLIIGVKDDFEIEDFEYLDKLWKEKGAGKATEYLNKKFKEDVSVNFYSTLSRTHQKDRTKIRFDDFKSADETNLMVFPPKNPNSPALTITWIANPITREAQHLISIVKLLGRVLNSKIEIIFNPPFEISEMPIKRFYRFVGSEELEFDESGAVKNHVATFSNLPQKQLLTMSMETIDSWMIEVKQAEYDLDNILLETIIGDVEAVFSLEHILVEGQSHTESGEASVGMELELKSKNAQYDTIVMKNLGYFQLKAEPGIWNLRLRNGTSSQHYRILEVDSKNIKKDARIVVDSFTGKWTELTVEKLDRNDDESSIEKLMRSAKGYFTTPESTESINVFSLASGHLYERFMRIMMVSVMKNTKSKNVKFWLLKNYLSPKFKETIPILAEFYGFEYELVEYKWPKWLHQQTEKQRVMWGYKILFLDVLFPLNVDKIIFVDADQVVRSDLLELMNFNLNGAPYGYVPFCENRKEMDGFRFWKTGYWESHLMGRRYHISALYVVDLKTFRKVYAGDRLRGRYDSLSSDPNSLSNLDQDLPNNMIHEVAIKSLPQDWLWCETWCDDKSKKTAKTIDLCNNPLTKEPKLNAAQRIIGEWKDLDEEIAEVIRNDGHIENPVVTEEKKMGGREEKDEL

SEQ ID NO: 3876 - protein, 1652 aa, Stereum hirsutum
MRAGRVLGSSVVGLLCTVGHGARAASPPVKVALRSSWPSPPFLLELIETIALEDPSAYFPVLDILTDPTTLPSTTPLSHEALHQLAFQSTVSLGYLSKPGAPEYAEMQLALHAATPKIEAFYQHYTDTTRGRILDTEQGEEGGAKCGSWVDWYGEVVCDVERLAHLAGPETIDAESYEGSAHSDMFPRPHILPFDHIYPALSQSSIHPPRTAIFHADLSSPNFRELHTYLMRLSSAPSPRIEYVFRPIPPPNRDSKEKTYLSGYGVAMDLKKMDYLALDDRRSRGSQESSQEEKNSEEDKPGISLRSEQIVSLIEKYPLNTTLEPTEPLTSDELMLIGFQATQLIADSPTPFSTLKELIQDFPQYATAIARHVEVSEGLAVEVYMNSQKATPGTSMVWLNGLAVGDVDMNPASLLKILRKERDFMLSLTSLGLSSSQALDLISHNAIEAANGGSDLLDGLFDASDRPEDGDLILWWNDLEKDSKYARWPPSIFALMRQTYPGQMPAARLNLFNVVLVLDFSQPGSLYYIASTISNIIQRGNPIRFGVVPMAVEGERKEEGERMARLIWYLVDRYGRAKTMGFLKNILQLPKPAKDLPTNIDWSLVRSEFESLHEQFPPLNGTTILPYDSVITPNANAGASEGQDEGKETEAEQIYAVEMHERLEKAATYGKRLGVVPAVGVKNPKGQAFVNGRHFYMNDAFLSSLQEEVTKMIQFFQQQIYEGLITEETAVGVDFSTFFYDFPSTQARRNKYVFPKSDVKIFSVPNLLEKAGAEELGDVFVYPEAETVPMTVYVVADLDSPKGLSVVRNALEFAESSEVRLAFIHNPNSSTSGSAGAHHQISSLFSHLHAKSYNGVTPTRLLRALGLDHTHSRHTSEQSQHEQIVLSPSTDEALHELMNGVDLAEVMKSGVYEEFVDVGKRVVKELGLSEGEAGLVVNGRLVGPFDSDEFGVEDFKVLESYEMARRAGPVLEALESVGISSENLDRASYANLVSSASSIIANMHIPDPSEAGLFNTPPTTRNTRYKHMEGKYSAFEMGDSETALHRFAVVLDPLSEHAQRWVSLFEWMLYLPSVHVTFYIHPAAYNEIPLKRFYRYNLVPTLDFDDNGRELPTTAVFDNLPIDPIYTLGLDEPSAWIVRPREALYDLDNIQLGVLSGEERIRGVEVVYELDYLVVGGHARDLSSSAPPRGLQLQLTTSDGTAIADTLVAANLGYLQFKVTPGVYQLQIREGRGRDIFEMQSVGNEGFVSPSVEEVGYEVTVTSFEGLTLYPRLVRKPGMQNQDVLHVPEEEEEPKGIVGDIINKVSSLFGSSKSTELAVVPQRHADINIFTVASGLLYERFASIMILSVLRNTNHTVKFWFIENFLSPSFLEFIPHFAEEYGFKYELVTYKWPTWLRAQREKQRIIWAYKILFLDVLFPMDLDKVIFVDADQIVRADLKELIDLDLHGAPYGYTPMGDDNTDMEGFRFWKTGYWASFLRGRPYHISALYVVDLVRFRLMAAGDVLRSHYHQLSADPNSLSNLDQDLPNNLQAQVPIYSLHEDWLWCETWCSKDRLDRAKTIDLCQNPLTKEPKLSRARQIPEWEEYDSEIARFTRKLAAEGRIHASAAAADINELANSASSIPTVESESSDVKDMGEDAAKDTEDSHARDEL

SEQ ID NO: 3877 - protein, 1329 aa, Saccharomycodes ludwigii
MKHCLLLLILLGYIVSVLAGYTSIPVSSKIASLPPNIKLLQVIKSIGLISIETFQEIYGILTDIENEREDSAFDFKIKYNTVLQFLNNTHPTIVPLVELNYKLGIHDFPESGGYHNHENFFVLNNRKYFQADDLFYLKTKELKSALLSEIEPKRGEIPIGTDANAPIIYFYGCDEDEDFYEFNYNLWSESQGGKIQYIWRYTCGSIEYAELGANLDLSLKLDDLEDRKTLLDFVAQDSNLTRISITNKYNNDMKLLDLQTVSLIFEDYQINGDFWKAFDYAKDIIYNLPLKTNDLVNTNIDPYIELIQKEMEENEKKGLDYGMLGCYINGMQLRYSELNINSFIKSIIREWGFIKKLKKTCSESLALKTFQIKNLLTTYSLISLPYLQSSQPLKFDVTDINNEDLIVYFNDLESDQIYNDVLSKDIISFFEESPYGELPAYSENWSELIFLIDFDDENSIDILRGMLRVIEVVKNGYPQRVGLIPMGDCRIVSEIYRHKSDDLEELIDFFQNIHVNKKKFSANTTLCEELDVFLQNVAINGNSFIINGEIYPFRQNSWNYLVNKVIVKDTTFLRKEIKRYLHQSLDEVVTARKLLHSDSQPFKRRDLKYTPDYFGDSTYTTENVKAITGLQGRILVIVPNLEYNILNTLTLVDNFDSCESWKFLCNFLNLKLYGIRIRLIHNGSTKSKYWKQLLDLFFDGVPSIETFQKSMPKIRNIKRSYKNIENANYIKSMRKFLPDLPDSQITAQRFLLLNGKYIKLDMDEIPSSQTIKNLLKRESKRTLNVIIALEQIVPNYSENLIEPDFVEQLSSILTKSFFDDYLNQNGIYFTSESSLPRLALSKILGFKNKLMSFEEVNYPTVKPVDITLLLDPTEERTQKMLSLVSMVRSLSFVNVQLYFLPTKELQLYPVERIYYDNIGEFSSVSIDNDIFEAKLEYLLPNLHVIKELDLNIISEIWVEANVYNIPPNRNIVESDVSGMCLNVIRRSSNKNDTVISQFINMRTFGYGSFKLPMDAYYDEYYVKSCSPEYKVKAFGLDIKADFSGWDSFNLNDVLNNNNRIYIEVTNETYPSLGNSLSTNNTNKINMVMNIFDKRYEDEFFQFMEYLLHRNNQHIYDIKIWILDHQGISVAFKSKLSQFMKAKGPMLFEYEFVSYHWPSWMRPEKYLHRELDLARVLLLDVILPLDIEACIYIDIIKIKNWNLIEQVALNYDKSYSNASGIIYLVPYPEIEYGYWKTGYWEKYLDKNDLLFYQTDFVMVNMTNFRKAEAGDKLRVHYQRLSSDIFSLRNVAQDLINNIQLQVPITSLNKFSTMPSEEKNKLNDFPTNDEL

SEQ ID NO: 3878 - protein, 1511 aa, Dimargaris cristalligena
MGRFPYRRLLCWALAPLGLAHAQSPPVQVSLTAQFPAPPLALEIAEYISTENRTAYLPLLDHLVATPTAPPQVIYERALAFIHQEHMLPGAPAQALLEWAMALHIAAPAVQTFYQYYTGTVVPEMHRAESEFDPNCPVWVWYNLRQYCSWGSLRQALGGPASVAPPRLPFDHLDSSHSARSGGTSAGPTFIFYADITDPDFVFFFRQARHLARAVTGTLIFRPRPPRAAGLSAPAPLDLTGYGVSLTLKSTEYKVIDDSQLATDVPLVRALSPSEIKDLGLIAAQYIINQSQSTVDPLRALTLVAQNFPKYAAQLASQTYSPALAQEARALIMKRLNPGIWLNGLPLKHSTLRPLDSFGLVQSLRAEAQTIEFLLRLPLTPCQARQLLGSSFLDPKQGRTAVPIYDVREDPLSPAPALVWYNDVERDPAYAAWSKLEYFRNSLYSNGLRPMSKNLCSILFVVDLASHRGLEILVDDIAVSLRQRLPLRFGILPLIPANPEATTPSAVMARLFYHLMATLTRDEVSQYFAQVLRLKRLHPQQDITTVAREVFDEQFPSATVDFATITGSEGPYRASMDSATTLLARLGVNPADSGALFVNGKYFELAEGYRTHVMEVYQSDSMLLAQAYFQGQIDNDTDLYEYLLTQPGALTERNPYIIPSPARPLTVYNVFAAGVESTSGDWIHRLGYFYPFTLTDTTSLPIVSIWVVGDLKAPASRQDLQASLQLCLRDPTVRVAWLPSPVATDALDASPLARLVGAVQRLAQDLYNAKVFSQELEASNQAIAPFAPYLYHALSFALEHSDINDTTRTLVVNGRRLPDLPDSLPLTATALQLLVSYEIKTRIQPIANALDILDGEILAGPASFNDLSAIADKILAAGSIVHSCVTPAATYPTSELPIYRQDLQSMLSNLNQLKFTRGDLKQAWFHIQVIVDPLSEEAQKWGAILETVTSLPRVAVEVYLRPDLSLDELPLKQFYRYLAPAALQFDPEDGQVYPPSLTFNGLPTQPLFTLAIDAPSAWMVTPVACAYDLDNIQLATVPSAQASEGIRAHFQLKHIMVEGHCQDLTLGYPPRGLQLVLGNPAQPHVADTIVMANYGYVQFLADPGVWTLRLRDGRSSDIYVLEDIASDGWSGDALRDVQAQIIVNSFQGAKVYPRVRRRPGQEAAQLLQTTEETANPSPPGYFGSTSGLLRTLQDWVGQAAHRIHIPFLGSSSSGVGPLRTIHVFSVASGHLYERFMAIMIVSVLRHTEHPVKFWFIENFLSPSFKQFLPTLAAHYQFTYQLVTYQWPYWLRPQKEKQRTIWGYKILFLDVLFPLDLDRVIFVDADQIVRVDLAELANIDLQGAPYGYTPFCDNRPEMDKFRFWKGGWWAQHLGHKPYHISALYVVDLRRFRQLAAGDRLRQQYQLLSQDPNSLANLDQDLPNNMQHEVPIFSLPQDWLWCETWCSDESLGTAKTIDLCNNPLTKEPKLKRAVRLLPEWEVYDSEIRQLREPLPDSTPTPSVSTVSPTHDEL

SEQ ID NO: 3879 - protein, 1514 aa, Diabrotica virgifera
MKFLTLSTVFIIFLSISENVNGKAKKSKSVTTLLEAKWQATPLVLETAEYLADENIDFFWGFVDSISSLETPLSSIGSEHEQYKTVIKHASKFLTPSQIAVLKLGLSLHVYSPKVQMFAQIAQELRLPDCPSVADIGGTVVCNVEDINSLINEPSENHKRIELHRIDNHFPGSANRSLAVVLYGQIGTKSFGKFHRVLKQAAVDGKIDYVIRHYVKGNDSKNLRLSGYGVELQMKSTEYKSQDDTELHEDQNSAEASQEDEDTELEGFDFAKLKQIFPNLKNQLDKFKTHLEDTSSELAPLKVWQFQELSLQAAERIMNAPREEALKILTNTAQNFPMQAKGLAKTTVNADLKAEMKKNSNMFAAHLNLQPSDTALFINGMFYDIDLVDVYGILEILRQELKTMEGLHGLGIGNKRMSSLLELDFGDDQNGQDFAIDIRDSAINWINDIEQDPKYARWSSSLMELLRPTFPGMLRQVRRNLYNLVLIIDPTDKSSAELLKLVESFVVHTAPIRVGLVFNVTAKSDVTGLEDVGVAMQCALNYITQSKDAATALTFVRTLLKSVEEKLTVEDIKKQLRKDYDDDPVDILGEDSVYDFGRQLSADFIERVGLKVFPQALLNGVPFPQEQVNVDDFEETILQEVMTQTHSFQKSVYRGKLSDSDDVFDYIMNQPKVMPRLNDRILNKDRSIHLDMTGTASSINNLESLLKLNTRDMTATAIENVRYFSAPKKSGQYHSMTYWIIGDLNCKKSRTLLLDALNHLKAETHVRVSFLPNVNGGKDNTLNKIVLAALQELPSEKALPLVISLLKDDAAARKLENGEKLDLPVEVSSKINAQELNLKMLRIYCQRVLQLKESQRSVIANGRVLGPLEENEVFTSEDFSLLDRFSSSTYWEKIKAALDKNSDDEDDISSNSLMKLISLLIARPQSKSRFEINFSGDEHSVIKIPPAHPDRVAFDIAAIVDPVSRGAQKLGPILQVLQEVLNCRIRVFLNSVEKNSDMPVKSFYRFVLEPEIQFGEDGKQLPGPIARFNNMPTSPLLTQNYHVPENWLVEVVRSVYDLDNIRLENVESNVHSEYELEYLLLEGHCFEQSSGSPPRGLQITLGTESQPVIVDTIVMANLGYFQLKANPGAWLLRLRQGRSADIYDIVSHEGSDTPENSTDIKVLISSLRSHIVKLRVQKKPDKANVDLLSDDDNNNGIWSSITSSFKGSEDESDEKLNIFSLASGHLYERFLRIMMLSVLKHTKRPVKFWFLKNYLSPQVKDFLPYMAKEYGFEYELVQYKWPRWLHQQTEKQRIIWGYKILFLDVLFPLDVKKIIFVDADQVVRADLKELQELDLGGAPYGYTPFCESRKEMDGFRFWKHGYWRNHLQGRRYHISALYVVDLKRFRRIAAGDRLRGQYQALSQDPNSLSNLDQDLPNNMIHQVAIKSLPQEWLWCETWCDDASKDKAKTIDLCNNPMTKEAKLTAAVRILPEWKGYDDEIRNLQKKIDSGLLDADPAENSDVSEKERTDTHQEL

SEQ ID NO: 3880 - protein, 1444 aa, Candida viswanathii
MILMRGIAAFLACVLVPTIASSSLQNNITIQLDAPWQKIDFLPILLETVAAHNDSLYFDAIETIYGLGESDTDWDDEFSDRIIYEEVTKNLDEYTKSFIDFDLVNKKYTPRIVSHYDHYEQVLHQLGDRLETECKHDSFGNEVERKNGQLRTWLLYNDKIYCSASDLFALRTDISKEHELLFDRVIGDNKDAPLVVLYGNPVEELTKEFLKVLYPDAKAGKIRLVWRYIPAAHKKAETLPGYGVALKVKNYDYLASDKTPVLNLAKDLKKINESNELFPVPEKDRDELGVKLTSFILSNRYKIPKFDLLLTLLNNFPKFIPYVAKLRKPLNYEKVKTKVLANEDVGMADESYGLYINGSPINGLQLDVFKLGTKIQEELKIIQNLVKLGFDTAQAKLLLTKFALLSAVKQTQFRSGNTLMGNNENRFKVYQNEFSKGDPGYGGVVFFNNIEVDVTFSEYTSNREEAYLGVNSYKLKPNQIPLLKENVHDLIFALNLANKSQLRVFFTIAKAILDSGIPQQVGLIPVIGDDPLDEEIARKFFYIVENSNTPEALALLYKYFESANADEAADILKKVKVPEAFQVDYNHVLDKFSISEASVIFNGVIYDLRSPNWQIAMSKQISQDVALIKSFLRQGPVEGKLKDQLYSNAKEKRNLRVIPLEPSEIIYKSVDSELLKHSVTFKKLDKEDGISGTFWLVSDFSKPEVINQLIDLLGLLKTKPIQVRVVNTGDSRVFNHLQKNFKLSALSNSQIDEIIEALEEAELSKNGDAEVWQLLEKKHLPVHHSFLLFNSRYFRLDVPLESAELEELLEYEFSQRLNLFNDILHAYPDEFEAKQLGEFNLIVSGLDTMDWFDLVSSIVTKSFHVDDKMFIVDVNRFDFSSLDLSNSVDVTTNKDENPIDILAIVNPMDEYSQKVINIVNSIKSFPFVNIRILLQPKVELNEQIRILQFYRGVFPSSAVEFDESTGKWADNNVAEFNNLPGDVALSSELNVPAKWITISKLSPIDLDSITFKESSNIQGKYALKHILIEGFARDIHTGKMPDGLKFKLTHNNLTTDTQVMSSLDYFQLKATPGISLLSSNPEYGLLSASENKYDSNHEAFDAVEVPVFALDGLTLYPRITSADGVTKRTSTKHADINIFTIAGGQLYEKLASIMIASVRKHNPKVTIKFWILENYITPEFRDLMKLVSEQYNVDYEFINYKWPQFLRKQKTKERTIWGYKILFLDVLFPQDLDKVIFIDADQTCRTDLTELINMDLQGAPYGFTPMCDSRKDMEGFRFWKQGYWSEVLKEDLKYHISALYVVDLKKFRSIKAGDRLRAHYQKLSSDPNSLSNLDQDLPNNMQRQIKIFSLPQEWLWCETWCSDESLGGAKMIDLCNNPVTKENKLDMAKRLIPEWAGYEQEIEELRKRLTVEEQAEDDEVDDGAATGAAADDDDDDDEGYHDEL

SEQ ID NO: 3881 - protein, 1513 aa, Leptinotarsa decemlineata
MNIILTLALILCFNVRDFVKGKTKKSKSVTTLLEAKWEATPLVLEVAEYLADENEDFYWNFIDAISSLEPPLTSIENDRDQYHKVMGLTSKLITKSQLSVLKLGLSLHIYSPKVQMFGQIARERKLPSCSTVADVGGVLTCDLKELESLLRKQEGNLAQIEVFKVDTHFPGSANRSMTAVLYGQLGTPEFSQFHRLLKQFALEGKIDYIIRHYVKDNNSKPLRLSGYGVELQMKSTEYKSQDDTKVHEDEKSDDNSEEEEDLELEGFEFSKLKKIFPHLLKELNEFKTHLEETSNELAPLKVWQFQELSLQASERIMTSPKEEALKVLINIAQNFPMQAKGLVKTVVNSDLKYEMKRNSDKFSTNLNLQPSDTALFINGMFYDVDLIDIFGILEVLRQELRAMEGLHSIGISNKRMSTLLGLDFGDDSGSQEFAIDIRDSAINWMNDIEHDSSYARWSTSFMELLRPTFPGMLRQIRRNMYNLVLIIDPTDPKTRGVLKLVESFVLHTAPIRVGIVFNVTDSSNLSGLDDAGVAMQCALNYVTQSKDAPTALSFIRTILQAAEERVTVEDVKAHLRSQYDEDPVDILGEDSVYDFGRQLSFDFIQRTGLKVFPQALLNGIPLPQKQITVDEFEEAVLQEIMSQTPSFQKNVYRGKLSDTDDVFEFIMNQPNVMPRLNDRILNKERSFHLDMSGTASSTNNLQALLQLSSRDMTATAMENLKYFSVPRKGKNPHSMTYWIVGDLNCLKSRKILLDALENLKSASDVRVSFLPNVNGGKDNELNKIVLTAVQELPTEKALGLVLSLLRDDSAAETLKKGEKLDIPFEVSSKIESQELNLKMLRVYCQRVLKLKESDRAVVANGRVLGPLDENEEFTAEDFNLLERFSSSSYLEKINGILSKDAEDEEEITSDSMMRIISLLISRPQSRSRFEIVYAGDEHSVLKLPAAHPDQVAFDIVAILDPVSRGAQKLGPILQVLQEVLNCNIRVFLNSVEKNSDMPVKSFYRFVLEPEIQFSEDGRQLPGPLARFNNMPASPLLTQNYHVPENWLVEVVRSVYDLDNIRLENVESNVHSEYELEYLLLEGHCFEQTTGSPPRGLQITLGTESQPVIVDTIVMANLGYFQLKANPGAWLLRLRQGRSADIYDIVSHDGSDTPENSTDIKVLISSLRSHIVKLRVQKKSDKQNVDLLSDDEGGSGIWNSIASSFSGTEEEPDQKLNIFSLASGHLYERFLRIMMLSVLKHTKTPVKFWFLKNYLSPQIKDFLPYMAKEYGFEYELVQYKWPRWLHQQNEKQRIIWGYKILFLDVLFPLDVKKIIFVDADQVVRADLKELQQLDLGGAPYGYTPFCESRKEMDGFRFWKHGYWRNHLQGRRYHISALYVVDLKRFRRIAAGDRLRGQYQALSQDPNSLSNLDQDLPNNMIHQVAIKSLPQEWLWCETWCDDASKEYAKTIDLCNNPMTKEAKLTAAVRILPEWKGYDDEIRELQKRIDSGELDADPSEEKEVVDKGATDIHSEL

SEQ ID NO: 3882 - protein, 1529 aa, Pangasianodon hypophthalmus
MAASSKPRHQTMRVLGLLLVLMQLQHAHSASKGVTASLKAKWPMTPLLLETSEFIGEGGDDKFWQFVDTVKELTVYKHGESVRSYYNLIIKKAGQFLSDLQVSLLKFSLSLRAYSPTVHAFQQIASDEPPPDACSAFVSVHGQHACSTKNMKKLLKGAAGRPKPYLYKNDHKYPGVNGTDLPVAILYAQIGTKKFNTFHKVLSEKAEEGKLIYVLRHFVAEPKKQHMFLSGYGVELAIKSTEYKAVDDSQVKDSKSTASFEEDDTDDVQGFLFGKLRESHPELREQLGELRRHLLESTNDMAPLKVWELQDLSFQAATRIMSVPKFDSLKLMRDLSQNFPSKARSLTRVAVNQEMRKEIEENQKRLSKSLGIHPGDASLYINGMHIDLDLHNPFSLLDIIRGEAKLLEGLHSLGITGTTLGKFLRLPVTTVEDSYALDIRHAAIMWVNDIETDSTYRNWPSSIQELLRATFPGVIRQVRRNFFNLVLFLDPVQEDSIELVKLAELFYKHKIPLRIGFVFVVNTDEKVDGYMDAGVAFFRVLNYITEEYDVTQAFLSMVSMYNKVDVGDSLSVDTVTAYLKKKFPKANAAKILGVDSSYDDKRRAGAVFYRKSGLGALPVGLFNGVPLSTDEMDPDELETILLQHIMEATNFFQRAVFTGQISEGTDVVDFLMEQPNVVPRINPLILNSDRRYLDFTASPVADDWDDSTMFSFLDSKDKTAVVSKRVKYLTKHEEEMVYGVTFWIVADIEQASGRQILLNALKHMKSSSSSSRVGVINNPSDQPTEDNSSLYRAIWASFLTQSTKNTLDFTLKLLKEESVQLLTQGTKIKELLLKGMDQDAFEKKFNTMELGFLHSQQRFCQEVLKVKAGQTAVVSNGRVLGPFAEEEEFSTDDFHLLEKLTLSTSADKIKAKVKQMSLTPKNACDLIMKVDALLSAAPKTEARKDIKFVKDKHSVLHLSAREDEVFFDVVATVDPLTRDAQKLAPLLIVLGQVVNMRLQLFMNCRAKLSEMPLKSFYRFVMEADMAFLGNDTLSPGPMARFTEIPESPLLTLNMITPESWMVEAVQSPYDLDNIHLQEVSGVVNAEYELEYLLLEGHCFDLSTGQPPRGLQFTLGMKQEPLMHDTIVMANLGYFQLKANPGAWILRLRKGRSEDIYQIQEHDGTDSPADAGDVIVMLNSFHSKIIKVRVQKKPDKLNEDLLSETIESKSLWDSITSLTGGSSGEEGDTKKEDVLNIFSVASGHLYERFLRIMMLSVLQHTKTPVKFWFLKNYLSPSFKESIPHMAEAYGFQYELVQYKWPRWLHQQTEKQRIIWGYKILFLDVLFPLAVDKIIFVDADQIVRADLKELRDLDLEGAPYGYTPFCDSRREMDGYRFWKTGYWASHLGHRKYHISALYVVDLKKFRKIAAGDRLRGQYQALSQDPNSLSNLDQDLPNNMIHQVAIKSLPQDWLWCETWCDDVSKASAKTIDLCNNPKTKEPKLSAAVRIVPEWSRYDSEIKQLLKRVKDQKESTNSSASPTQRTGSHRDEL

SEQ ID NO: 3883 - protein, 1545 aa, Denticeps clupeoides
MYLPNMAAAAGSLEAGFGTMWKVLSALLALLHLALAGTDSKAVTVTLSTKWQSTPLLLEASEFLAEESQDKFWDFVEANQNILNEHDETDLAYYELILKRAGALLSPVQLSLLKFALSLRAYSSTVHSFQQIAHNEPPPSGCAAFFNVHGQKSCDLAKLDGMVDTASERQKPHVFKSDHKFPSTNPEAPVVILYAEIGKREFSVFHQRMLFNANKGQINYILRHFVVSPSYKKVFLSGYGVELAIKNQEYKAKDDTQVEGAGVNATVIGENDPVDEVQGFLFGKLKTLYPDLKEQLKELRKHLVESTNEMAPLKVWQMQDLSFQTAARILAAPSVDALTVMRDLSQNFPTKARSITKTVVNSEIRKEIEENQKFFKGTLGLQPGDSALFINGLHIDLDVQDIFSLFDVLRNEARVMEGLSSLLIETPFIHDILKLNVQPTDSDYAVDIRSPAIYWINDLEMDSRYNSWPSNVQELLRPTFPGVIRQIRKNFHNLVIIVDPTHEDTAELLSVAEMFYSNNIPLRIGLVFVVNDEDFVDGMQDAGVALLRAFNYIVDEVDNQHAFDAVISIFNRIPSGGTLKLEHVLRFLEKRYPYVEVSSILGPDSAYDKNRKEGKGYHKQTGVGPLPVVLYNGMPYQKEQLDADELETVTMHKILDTTPFFQKAVYLGELASDHSIVDFIMNQPNVVPRINPRVLTTNRQYLDLSNTNNHYIHDYARFFVLDTEDKSTAVANSMNYMTKKDDGFIRPVTFWVVGDFDQPSGRQLLYDAIRQMKTSNNVRLGMINNPSESPSKENSRVARAIWAAMQTQTANNAKNFITKMAKEDTAKAINDGADITDFAVGGMDLTLFRSAYDSPKLDFLLSHTTYCREVLKLQSGQRAVISNGRIIGPLEDGELFNQDDFLLLESIILKTSGERIKNKIEQLGVEEDRASDLVMKVDALLSSQPKGEARIEHGFSDDRYSAVKIRPEEGEVYFDVVAVLDPVTRDAQKLSSLLMVLKQLVNVNLRVFMNCQSKLSDMPLKSFYRYVLDSEISFMADGSFSPGPMAKFLDMPHSPLFTLNLNTPESWMVESVHTRYDLDNIYLEEVDGVVAAEYELEYLLLEGHCFDVSTGQPPRGLQFTLGTPSDPVRVDTIVMANLGYFQLKANPGAWVLKLRKGRSDDIYKIYSHDGTDSPTDADDLIVVLNNFKSKIIKVKVQKKPDRMNEELLSEGSSENDSGFWESLTRGFTGGTKVEEIKQEKDNVINIFSVASGHLYERFLRIMMLSVLKHTKTPVKFWFLKNYLSPAFKEFIPYMAAEYGFQYELVQYKWPRWLHQQTEKQRIIWGYKILFLDVLFPLAVDKILFVDADQIVRTDLKELRDFDLEGAPYGYTPFCDSRREMDGYRFWRSGYWASHLAGRKYHISALYIVDLKKFRKIAAGDRLRGQYQGLSQDPNSLSNLDQDLPNNMIHQVPIKSLPQEWLWCETWCDNASKQKAKTIDLCNNPQTKEPKLQAAVRIVAEWSNYDQEVKKLYSRFQKEKERPGAVDSWQTKAQDAKQGADSHSEL

SEQ ID NO: 3884 - protein, 1492 aa, Aspergillus rambellii
MVFRLGSVASWRLSYVVVSTLLLSTAQASPTVNVALQASFDSAPYLVELLEAAAGENSTSYFPLLDRVAEGAFDDVVTDKELYDRFLQVVVNDGHLSNPESLSTFKLALAIRSASPRIAAHYQFYNASVQHSMMAAQDAACPVWAHSDGKQYCSSTMERAQQDIMGELDTRELPFDRIYGIESLPPAILYADIASPMFKDFHKTLTALAKEGEISYRVRYRPPQHWSSRPLFVSGYGVELALKRTDYIVIDDRDAEKRESNTPESTKSDAKEEEAPDDLRPLSSSEVARLGINTASYVVDSEDPLNTLVNLSQDFPKYSSKIAAHNTTMELLRDIRSNRLGMLPSGANAMWVNGVQVDPRQIDAFSLLDNLRRERRLIDSFRNLGLSAQEAVDLLTHELIGESMANDSPQRYNYRDEIEGGGVIIWMNNLEKDARYESWPGDLSAFLQRTYPGQLPAVRRDFNNIVFPVDLTNTEDIDLLVTTIQVFVKRKIPVRFGIVPLASSPGSTAQLKVAHYLQDTFGLSSLVKYLEESGSRNKIATPDKNSFLAATHEETPRAEKVALTFDEILKSDELEILVSRTAKYQERLGISNDASLAFINGVPIARNENWPQHMSMRVEKDLRLVQQAIVEGLFEEDIWLPGFFLSEAFSRRVPWIIPEDPKEIQVIDIARITQSPNNLLDEVPRIAPEQGDAVESTHVIVIGDFDSQPGLTFLTAALETREKHAKAEVHFIHNPEIFTPHVKASATLFRSLVGAKDSDASQILADINSSMPMELDNAEAEDIFAFWTRYRPLAETLGFAPGASGIVVNGRAVIPSQDVTSEDLGQLLTYEEMNRIAPVAKAAKALGFSSRLTDPLSFAKLTSLVALSSVSDVPEGLFETPSDARVNLFQKWTDGGSVITVSNSDDPTITIAASIDPTSESAQRWLPILRVLSKLDGVKLKLFMNPRDEIQELPIKRFYRYVLDSEPSFGADGSVLRPTASFSGVPVEALLTLAMDVPSSWLVAPKDSIHDLDNIKLSSVSGDSNVDAIYALEHILIEGHSRDMTTKAPPRGVQLVLGTEDNPYFADTIIMANLGYFQFKAQPGLWNINLKPGRSERIFNLDSVGRLGYTPQPGDESNEVALLSFQGKTLFPRLSRKRGYENEDVLETGAKSGSAMDFVSKGFNFASGVLSSVGVGSKSSSEKNADINIFSVASGHLYERMLNIMMVSVMRNTKHTVKFWFIEQFLSPSFKSFLPHLAEEYGFSYEMVTYKWPHWLRGQKEKQREIWGYKILFLDVLFPLSLDKVIFVDADQIVRTDMYDLVSLDLEGAPYGFTPMCDSRTEMEGFRFWKQGYWKTFLRGAPYHISALYVVDLNRFRALAAGDRLRGQYQMLSADPNSLSNLDQDLPNHMQHHIPIKSLPQEWLWCETWCSDEALTQARTIDLCNNPQTKEPKLDRARRQVPEWTEYDDEIAALSRRIEQQRQNQGQMQEEVLSNSRDGYKEEKDNWKKDEL

SEQ ID NO: 3885 - protein, 1512 aa, Callorhinchus milii
MVILPLIFILLKLCRTEAARKGVSASLDMKLPSMPLLLETSEFMADESDEKFWQFLDTVKEITSYLHGDSERNYYNLILKKAGQFLSELQLNLLKFALSLRAYSPTVQMFQQIAADEPPPEGCASFVAIHGEHTCSTGDVKKLLKKAADRPKPYLFKGDHMFLAINPNAPVVVLYAEIGTKEFSKFHKILTKKAVKGEVAYILRHYVQKPSSEKVRLSGYGVELAIKSTEYKAVDDTRLEGTNSTVLEDDDDTDEVQGFLFGKLKQLYPDIKGELRELRKHLIESTNEMAPLKVWELQDLSFQAAARITSAPVYDALKLMRDLSQNFPTKARSLTRTVVSQEMRNEIEENQKHFAETMGLQPGDSALFINGLHIDLDTHNLFSILDILKVEGKVLDGLNKLGIKGKTLSKLLRLNVHPIEENAALDIQHSAIMWINDLERDQKYRSWPSSYQELLRPTFPGVIRQIRRNFFNLVLFIDPTQEDTVELVKLAELFHKHNIPLRIGFVFVVNTAEEFDGNQDAGVALLRAFNFIADDSDLSHAFSSIASIYNKVQDGEVLTMDHIASFMKKKYPMVDVKNIFGIDSEFDDQRKEGGTFYKKTGLGPLPQALFNGVPFNIDELDAEELETFLLQKMMDTAGFFQKAVFMGHLNEHTDVVDFLMDEPNVVARINPIILNTVRKYLDLTPKAVISDWNDFSTYSFLDTRDKSAVIADNMEYLTRKGEDIIYAVSIWIIGDFETLAGKRLLSNALQYLKTSSNMRIGIVNNHADELSEGNTPTARAIQAALLTQNGNTAKSFITNLVKEETAEALTLGAKILKFAVKGMDNDAFEKKYNTIGINFIRTQQLFCQDVLKLLPGQEAVVSNGRILGPFNEGEEFQPEDFSLLEKTTISTSAEKIKTQIKEIGVNSKSGSDLVMKTDALLSSTLKEESRRDVKFPKDRLSVVKIPPQEGVHYDVFAIVDPLTREAQKLAPLLRVLAQVINMKLDVFMNCRSKLSEMPLKSFYRFVLEPEVVFTGDNHLSTGPVAKFAEMPESLLLTLNMITPENWLVEPVRSSCDLDNIHLQEVEGMVSAEYELEYMLLEGHCFDASTGQPPRGLQFTLGTKKNYDMMDTIVMANLGYFQLKANPGAWLLRLRKGRSEDIYQIFEHEGTDSAADSDDVVVVLNSFKSKILKVQVQKKPGKVNEDLLGDGDLEGKGIWESLTSFAGGLQSEEIQKEDNTLNIFSVASGHLYERFLRIMMLSVLKHTKSPVKFWFLKNYLSPTFKEFIPEMAKHYGFQYELVQYKWPRWLHQQTEKQRIIWGYKILFLDVLFPLAIDKIIFVDADQIVKADLKELRDLDLEGAPYGYTPFCDSRKEMDGYRFWKSGYWASHLGGRKYHISALYVVDLKKFRKVAAGDRLRGQYQALSQDPNSLSNLDQDLPNNMIHQVTIKSLPQEWLWCETWCNDDSKKIAKTIDLCNNPKTKEPKLEAALRIVPEWAEYDHEIKHFLKQIEEQKKIATPKTKPPAPKRDEL

SEQ ID NO: 3886 - protein, 767 aa, Neolecta irregularis
MGPFIRDDTAQMIHAVQEEKISDDISDLLDLYLSSAPKVRNRWIFPEEEHRIVDLVKALQGNSTQSESRFILVDTSKVDDCSSLVEKFGLKKSDKAIVINGRVIGPFAPDEEFTGEDIELLLHQEFERITPIISATKGLSYLGSRADFLAKLASILNLAAAKQDNGIFESEDHIRRKPYENFDAEYTSFTSGGNDGWLQVVGVVDPLSEIAQRMSELLKVLSEMDGVGVQVFLNPKKHMKELPVGRYYRYVLSSEINFNDDGSIATPEALFDDLPQDPLFTLGLEVPHPWLVMQKESIHDLDNIRLANLPSVSAVYELKYLLVDGHAKDITNNSPPRGVQFVLGNDKNEHILDTIVMANLGYFQFKASPGIWKLTTLKGRSSEIFDIVEIDHFNNFQTIELTSFDGMTLFPKLSRKHGMEGEDVLAHESESSIRQGVIKSKQADINIFSVASGHLYERFIYIMILSVKKHTASSVKFWFIENFLSPSFKIFIPHLAAKYDFEYEYVTYKWPHWLRHQKEKQREIWGYKILFLDVLFPLSLDKVIFVDADQIVRIDLQELVDLDLHGAPYGYTPMGDSREEMDEYRFWKSGYWRDYLKGKPYHISALYVIDLKRFRQLAAGDLLRGHYQSLSSDPNSLANLDQDLPSKSLFSGCDLIYIDHLQHQLPIFSLDKSWLWCETWCSDEDLKTAKTIDLCNNPKTKEPKLDRARRQIPEWNDYDSQVAALAKQVKNVGNIAADVDAVQKPDDILASAGDTTQPKEARNRDEL

SEQ ID NO: 3887 - protein, 1564 aa, Trametes coccinea
MLGVLLPLLTWPLLCTFAAKPSVNVDLRTSWPAAPLLLESIEAVSIEEPDAFFPLVDAVTDPEVFPLAQDRSTAKHVHKHVFDTALSLGYLADPGAYVSAEMHVALHSPSPKLEAFYQYYDDHNAARVDNRATGTCGSWVDWYGTVVCNVETLARLVEIELIDSSDVVVNHTAARILKTLPFDHVLPDPSRLIDTPPRAAILYASLESPNFRDLHSYLYAAARSENPTISYIFRPIPPAIRDAKARSHLSGYGVALDLKKMDYLAVDDRLQRGGASAANADDDLASGTQEDETDVIVTRLQQYSIDDTVDVTEPLTEAELLEIGLQATQLIYDAEEPHERLATMKHLAQNFPRYAGALARRVIVNQSLLNEVAENQARAPGGASAIWLNGVTMEEKDLNPFALLRAIRRERGIMLSLLSLGLSPEQAIELLTHRTVAQAQAGGGMLDGLFDASDRPEGGDVIGWLNDFENDARYERWGGTLRILLRQMYPGQFPSVRLNMFNVVLAVDLSQASSIEFIGMTVNSLINRGLPFRWGVVPLVETEDGARMGRLFYYLMDNFGPEDTLNFILSLTQRNVPLDLLKPSVDWSTVRLSFNRLLAAQEELDDDIEKDLDVILEGTEGDLEKPRAYARRLGASLATAPQGHVFVNGKHFDLDDEFLRLLQTEYLEQLQHIQMKVYKGELTDDDAGSISTYFYDLPTTAKRRNTYIHPTKKAGSLRIFALPELIEKNGLNSTAGAFIYPVDSEQVLLTTYIVADLDSEDSRQLMKEALKSMPGSFSRLSFIHAPSTASAVRDLPETAPSHILGRLIAGDALSKITPEQLLNVLGLNEPLENGTQQPLTQGSVEELLVDLPGSGAAYEKYLNACRLIARQLELKPGEQAIIVNGRLVGPMPSGDFLADDFETLFAFEHHRRVQPAYEALSSVYEAIREASKEEVAELTSIVSSIISSIQQPDPSEVGLFNAPQRPRLRNYRRLSGTYTAFTLGDNTTALYHIGALVDPLSESAQKWTSLLEWLAEMPGVFIEVHINPARSTELPLKRFYRYNLVPRLSFDEQGNEVRASTRFTGLPTEPIYTLAMDAPQSWLIRPKEAVYDLDNIQLGLLSPQDRVQGLKAVFDLDYLVIEGHAREGETNSPPRGLQMQLVTSDSTPIADTLVMANLGYLQFRTKPGVYKLEIRPGRGRDIFRMESVGNEGWNSPPVDEAGDEVTVTSFEGVTLYPRLARNPGMERADVLLTGLEASEEPKSVLDNLVHKVSSLFGGKKEEKAVVAVDDGQAEIDIFTVASGHLYERFASIMILSVLRHTKSSVKFWFIDNFLSPSFLEFLPHFAAEYGFQYELVTYKWPSWLRAQTEKQRIIWAYKILFLDVLFPMDLKKVIFVDADQIVRADLKELVELDLHGAPYGYVPMGDDNPDTEGFRFWKTGYWKDFLRGMPYHISALYVVDLVRFRQMAAGDILRGHYQQLSADPNSLANLDQDLPNNLQREVPIYSLPEDWLWCETWCTKDRLDRAKTIDLCQNPLTKEPKLDRAKQIPEWEVYDTEISAFAKRLHERAEDPAPEKPRSAHDEL

SEQ ID NO: 3888 - protein, 1531 aa, Aphanomyces invadans
MLAARMWMGLAALAASSRMADGRQVHVNLTTSYLASPLYPILETSEFLSQDDPALFFKYLSAVNMRHNAIKDKHDVNYTKVALEAAADVLPEDSSVSRLLPFVLQTRAHSPSIELFHQLAIESAFKGCPNETVSAWAIIYRSAGCADAVMCDVEDFDSSVLDAAAPALDDSERTCAASGQHDFYLPVDHVYPSTASVAANAPHVVVYGELTSPSFQAFHSKLLPLAVAGSIKYIVRHAPTNNTLPVLVHGYGVTLHVKNMEYKTFDDSKTSKSSSNGTSVDIDDDQDDFVVSVMMKKHDEVAQALRNYLEDFDDASAVDEFASDDVDDAKKKAPWQLTQLGYLAMQYIMASADPLKRLQLLSQNFPKYASSLVLTSKPVAAETIEAMGLVRNQVISQRLHNRIVVNGLPVDFNEYGFNAFDFLKSLSGELRLADTLAKLDPSGTIRGAVGSLSSAPADVRITLRGPVDGFAPLYLNSIETDEETEDWPTDMGILRAPTWNLIYLRKVMYELILVVDPTTKEGIEALNEVNFLRNRQAPIQFGVLWTSPQLLALSAEERAAYTPSVRDEDLATVFHVAKMFHAAKKHSKAARDKYLREVVSVNDLKVKEVLQMYSQAVGERFSNDAWLEDAKAILTDGDNDPVWAMTDLVAAKKLPINSHVFNGVVRNHVHVQEDIMSHFGRDQSLYQELVRGDKITDDADMLNELVGSEESYAVYCPWFDPRYQAPRTVPEFSWDEPAWKQVGSFHAAGTASKPKRQNVLLLANLDTATGAQSAYQALKRVPDYPDLGLTIVHTGASSNTLGHRVSYMLSQLGHTDSTTYMAVVLEVLRLMSKKPEADVLTHARLFLQLHLDAAPNDKILTKLNEWLTSTPSFSHPFSFKVDPHNHVIYVNGRPLDLAASPLSAEHFDVLVVHEASTRSKAVSKAYVAQFKHDNLSVEDAADKSLAFNLVMNAIDEYLKVRRVPSVLPEVNPLYSYETPTSQPSGLDVVAYLDPLSETAQRASGILRMLASVLHAKITLVLLPSPSYEEFPLKRFYRFLWGGSESSSVDFLRLPRKPVLTLNIEPPELWNVQMIQSDVDVDNIQDDASATFYIKDVLVYGQCVDRTIVHYPSLPNGLQLTLERSAGTVHSHKDTVVMKNLGYFQLQAAPGVWELGLAKGRHSKLYELVIQEDRATTVPVIVYDFLSSTLQLVVKKQHGQESVRLLDEDEPAHKTTGEAVEEKSYWRSLVQWGSDPPSSKRDARSGDTIHVFSLATGHLYERMLKLMMLSVMKRTKNPVTFWLLENFLSPDFKNSVGALQAEFGMDIRFITYKWPNWLRRQTEKQRIIWGYKILFLDVLFPLGVEKIIYVDADQVVRADLNELWTMDLQGRPYGYTPFCDSRNVGFQFWRTGYWKDHLRGKPYHISALYVVDLVKFKRMAAGDSLRAIYDQLSADPHSLSNLDQDLPNYAQHQIPIFSLPQEWLWCESWCSDESKRLAKTIDLCNNPKHKEPKLDMAKRVISGDLFPESWLELDAEVKAAEAAYAEGPHLDV

SEQ ID NO: 3889 - protein, 1470 aa, Yarrowia lipolytica
MKLLKYAAAALFASSVAANVTVELKAQWQSDFLLELVETLSTEHTYFDFINHIAEQVEDGANYTDKEWYDNLTAFAASKSEISDFQKSLTDAALAFRRESPLIETFYQLGDSQESECDIFFTYNGKKYCDSNDLFTLKTTKMPKNPSVYFFDHVARSVQANKHLKNIPVTVLYADLRSPEFPLFHKILYQEAQDGKMVYILRYRRSDRSERVTMTGYGAELSLKKTDYLVLDDDANTEKLTDNKNPVYTKRELQNMGLNAAQFVLNHRKDPEAALKALKEVSFDFPLLSSSLNNTKPVKGFQKALQENTAAGDFMPGANQMFVNGALLSTSASNLQSLFDLVALEHSRLEVLAKTLKGAISAEQLASILNDYPLQHALESQPQRIDYRDADALLWLNNLATDIQYQEWPRSVASLLQNQINLAHNAQTVVMPFNMDDFADVKVDKETGELINMHPINRGKLTVLLTMLQRSMPIQFGVVPYGSTLKGKKLSQYLHYLARNVDATASLRFLFALGAGTPVEEIFTQIPAEITQESVDEALKEESYEPYVTASREWMKKLGMNEAQTQEPAFVMNGIVMPFSEKWQNLVGARFQQDLPEMLKLVQKQIIKVSKEAPVGEDDEDEDDENAGNPVDKYFANHEIKDLLVEGSPTRRNLILSPASFTNLQYLESDLNLKDVSTATIAGTTASIFSNSILAGNFASTQFVSQLLALIEAQQEEKDRFAFRTQFVHIGQTDSAKGQVINGVVQKLTELAGEEQVSLLKDALAYLEGDNASFSAKKVPFDKTITASEEVKYLKQFKTTESSTLLIIDGLVNDISSKAMLLDKSEVIALYEREAVRRLELTSVALSDLKLLTKSVENNLDLAKVHIPLAKIFYGDATEQESTLYDVRAFHHIRWNKDVSSFVLGDESTSLVKIVAAVDVLSDGGQRLVSQIEAISKVTGVSVRVFPSPKAPDARQEPTLPLKRFYRAHNSVVPEFDAEGAHKVPNLNFEGLPAQNLLTFGLDAPSSWIAMPADNTHDLDNILLEEDSEDFVDASYSLQNILIEGSIIDITKNSYAPGTDLLLKSTLTGESSDTLVMSNLGYFQLQAGPGLWELNLGPSASDVYETEHEVIIPVTDVLGPHISLSMERKKGKENVVVGASQDKAKLWSKLKKSTGVSTKKQADINIFTVASGHLYERFLSIMTASVMAHTDHTVKFWLIENFLSASFKAFLPHLAAHYGFEYELVTYQWPHWLRGQTEKQRQIWGYKILFLDVLFPQDLERVIFIDSDQIVRTDLYELVEMDLEGAPYGFTPMCDSRKEMDGFRFWKQGYWDTFLGDDLVYHISALFVVDLKVFRAQQIGDRLRVHYHQLSADPASLSNLDQDLPNNLQRQVPIFSLPQDWLWCETWCSDESLKTAKTIDMCNNPLTKEPKLDRARRQVPEWTKYDDEIRKLRKEAEGIEGKKKEEEERAGPVEVEVEIDEPEADLHDEL

SEQ ID NO: 3890 - protein, 1437 aa, Pelodiscus sinensis
MARCQALTVVVKMSGPASIFLNFVPPVSWATLDPDKWEYEETALKRKITVEPQNYEQQSYKLTSQSQILFEAGSTQPRPYLFKEEHIFPTLNENVPVVILYAEIGTKDFVKFHTVLSEKVQKKEIVYILRHYVQKPSSRKMYLSGYGVELAIKSTEYKAVDDIQIKATNDTTEKEDDEASEIQGFLFGKLKQMYPDLKDNLKEFRKHLIESANNLEPLKVWELQDLSFQAASQIFSTPVYNVLKVIKGISQNFPIKARSLTRIPVNQQMRNEIEKNQKHFHEKLRIQPGEARLFLNGLPIDLDIHDPFSILETLKLEGKVLHGLHELGIKEEAFNKFIRLQIHPVDDICALDIRHSSIIWVNNIEEDNIYNKWPTSFKELLKQTFPGVIQQIRRNLYNLILFIDPVQTHAVDFVKLAELFFHHNIPLRVGFVFILNTNEEVDGNKDAGVALFRAFNYIREESDTTQAFISMINMYHKMKDGEVFTVNHVRNVLRNEFPHADIQSILGVDSDYDDKRKAGATFYKKTGLGSLPQALFNGVPFIGKEMTAAELETVILQRITDATGFFQRAVFMGLLSDHMDAVDFLLDQHNVVSRINPTVLDTKRTYINFISTSVPVGVEDFSTFSFLDAQDKSAVISQNMKYLSKKGEDVIYAVTIWIVADFDKPGGRHLLSKALKHLKTSNHMRLGIVNNPMSKIMEDNTAIARAILTAFLTQKNSNLKSFLSKISKEETAKALATGTKIKKLLVAGMDDSTFEKKYNTIGLDIIQTHQLFCKEVLKLLPGQMAVVSNGRVLGPLDENEFHTDDFHLLEKITFSTSAEKIKGIVKEMGISSQRGSDLIMKVDALLSSLPKRGVRQKVEFLKEQHSVVKIDPKENEPFYDVIAIVDPLTREAQKMAHLLIVLGDIVNMKLRLFMNCRSKLSEVPLKSFYRFVLEPELSSGADKLFPSGPVAKFLEMPETLLLTLNMIIPESWLVEAVNSSYDLDNIHLQDVEGVVTGEYELEYLLLEGHCFDVATGQPPRGLQFTLGMKNNPVMFDTIVMANLGYFQLKANPGAWTLRLRKGRSEDIYHIFAHEGADSPVHMEDVIVVLNNFRSKILKVQVQKKPDKVDEDLLSIGVIEEKGAWESITSFSGDIQTEEKEKKNNVLNIFSVASGHLYERFLRIMMISVLRHTKTRVKFWFLKNYLSPMFKEIIPHMAKEYQFQYELVQYKWPRWLHQQTEKQRIIWGYKILFLDVLFPLAVNKIIFVDADQIVRSDLKELRDIDLNGAPYGYAPFCDSRREMDGYRFWKSGYWASHLGRKKYHISALYVVDLKTFRKIAAGDRLRGQYQALSQDPNSLSNLDQDLPNNMIHQLAIKSLPQEWLWCETWCDDESKKKAKTIDLCNNPKTKEPKLQAALRIVPEWVQYDSEIRKLIKQIEKEKKNLTHTSRKVLKHDEL

SEQ ID NO: 3891 - protein, 1627 aa, Jaminaea rosea
MTSWRPCSLFLLIAATQSLISIVCATADRSPSSPPVNVRLQSPWDSSPLLLEALEAAYDEDSDAFWPLLSHVSQPSQSPESTAPPAQVYDVVKKALDDVGVLSERGSRDNWEMALALHSQSPKVAAFWQVARTTGAEERWAKHVQENGLAAGECESWVDWYGRVVCSETELQVVLSEEARQQDKVATYPFDHVHPSQPSASAIPTAVLYGRPLSPNFHSLHTTLFRRASAYSEQPLRYVLRWRPDSTSNATSGFLAGYGAALDLKKVDYLVIDDRKLTHAADAPSLSASEGGVDDSIYSQLRDRQWLDDQLLGNGKPTNMSQPLEEAEISRLGLQAVQTIIDSQDPLRAFAQLTQDFPLHAPSLARGPVTPSIDLDNELHALQMTKIRPGMGDVWLNGKPLSKNEQVPLGLLKVLRKERALVDSILAASSTLGLNASQAIDLLSQPSVGRPQTPEAEQVVFLDASDRIERSATADETNFASPITWWNDIEQDEAFADLRQMSSLRSLLRPMHPSQFPQAAKNLFNVVLTLDLADRKACSFLAEHVAPLLERITVRWGLVPAGLEKGEEADSTVVARLYWHLWENHGLEGGVTFLHALAASGPPSRRVDARTAQKTFTKLLARLDPSGDHSSLAKEVTSVPSSREEVTKSYVRRLRLTIAEEPRGHVLVNGQHFPLVEPRSFFQLLHQVAAMQLQQIARPIYFNEVTDDDDVSTWFYDLPLAFASRSELVFPTVDAATGQAKGPKVRAVDLAKALAALPDASPAKTSFLYPTGDSQVNATMWVIADFDTEGGVHLLREAVSTMVGEKAPAFRLGFIHTVDAGQSKLATPGVSLSGFIAHLAQSGALDAITPSELLEVLKEPSTLNDAKLAGWNVPANTDGSQLWDGSHNFFSTLGLDTTAFPALLINGRLLSHLSPLGISSSDLSSLVKNELARRIDPVVAALHTLLPGDKIASLNRSALADSISIVSSAIAVTYYRDETQEGIFSPPSVQRTNIFDRLGVEFSRFEVGDPAKAKLRFQAIVDPLTETAQRWSSLFQLVATMPDVHLQVIMNPVRKLQEMPLKRFYRYSAPSRLRFDAKTGEEVPATLSFQDMPQDAVLTMGLDAPPAWLTMASEAVYDLDNIRLRDVPEDGRRKGVLAVYELKHLLIEGHAREAGKESKNAIPRGLQLELQTPDGSETLDTIVMANLAYFQFRARPGLYRLRIRPGGKSEELYEMRSVGNLGWDSPGVEETGDDITLDSLDGLTIYPRVVKREGKEKEELLVDLEAEGEDDEDEDPYGEKGAAAPLSNAASGLSKMLHRAADSVKSVVTARPPAKEHDRIHIFTVASGHLYERMTYIMILSVLRHTQSLPVKFWFIENFLSPSFKSFIPHLAQAYNFEYELVTYAWPHWLRAQTEKQRTIWGYKILFLDVLFPLDVEKVIFVDSDQVVRADMKELLDVDLKGAPYGFPPMGDDSEDMDGYRFWKRGFWKDFLRGRPYHISALYVVDLNRFRQVAAGDKLRGQYQALSADAGSLANLDQDLPQTLMFNVPLHTLDQRWLWCETWCSHDWLHEAKTIDLCSNPKTHEAKLDRARRQIPEWTELDEEVQALARRVGVAEGAREAADAGPGVHRQHGEGDGDQEPRQHDEL

SEQ ID NO: 3892 - protein, 1488 aa, Penicillium steckii
MMVSSRFHIPWHWYAVIGALLPGLAVNASPSVNVALQASFDSSPYLVELLESAAEENATSYFPLLDRIAGGAFDDAITEKELYDRFLQVVHDDGHLGTAESLSSFKLSLAIRSPAPRIQAHYQFYNTSVQQSLMAAQDAACPVWVHYDDKQYCSSAMERAQQDVEGEMDPKALPFDRILGDLSLPPAVLYADVSAPMFKEFHEILSDMAKSGQISYRLRYRPPQHWTSRPLFVSGYGVELALKRTDYIVIDDRDAEKRDETAEEATDILKEDAPTDLRPLSSSEVSRLGLNAAAYVMDSKDPLETLLKLSQNFPKHSSTVAAHNASKELIQEIRVNRARMIPAGYNVMWINGVQIDSRQIDAFSLLDILRRERKLIQKFRDLGISGRDAVRLLSHPALAEARADDEAQRYDYRDEIEGGDVIIWLNDLEKDSRYEDWPSDLEAFVSSPYPGQLPPVSRDLHNVVVPLDLSNPDDMLLVFRQIYTFVKRMIPVRFGLVPMASSPESISQLKVAHYLHETFGLSSLIKYLEESAATSKGGSPDKTAFASATQDQEPQGEKEALSLDEILSSERYEAVAARVTKYQRRLSLSNDAPSFLVNGIPTSREGNWMQEMSMLIGRDLKLVQQGIMEGVFPVDAWLPEFFLVASLGRRNTFLMPEDPKSVGIVDLADILGSPTDGLDQFPSIAATDGSRNGIHLVVIGDFETEQGQQLLSNALSVQKQNKNIETLLVHNGVSDAEPSSPLLDRIHQSIIKGEDIDQIINIIEDSSEVKDSESTTTTSLAAHRRLAEKLGFEPGVEGLIVNGRAVGPIDKEEGLAADEINQLINYERTKRVDAVSKAAMNLGLNMRIAKPLDLAKLSALVSLSTISDVPEGIFESTPDFRLDVSEKWRIDHSVITVSNSDDPAINVVAALDPASENAQRWLPILKVLSELAGVKLKVFLNPKEEMKEIPVKRFYRYVLDSEPSFTSEGSLSRPDASFSGVPVEALLTLGMDVPTSWLVAPKESIHDLDNIKLSSLKADSNVDAIYALEHILIEGHSRDLTTKTPPRGVQLVLGTEDNPHFADTIIMANLGYFQFKAQPGLWQINLKPGRSEKLFNLDSVGGLGYRPQLGDENNEVTLLSFQGRTLFPRLSRKPGFEDDDVLETGPRSGSTMDFVSKGLNFASGVLSSVGVGSKNSEHADINIFSVASGHLYERMLNIMMVSVMKNTKHTVKFWFIEQFLSPSFRTFLPHLAAEYGFSYEMVTYKWPHWLRSQREKQREIWGYKMLFLDVLFPLSLDKVIFVDADQIVRTDMYDLVNHDLEGAPYGFTPMGDSRTEMEGFRFWKQGYWSSFLRGRPYHISALYVVDLKRFRALAAGDRLRGQYQMLSADPNSLSNLDQDLPNNMQHHIPIHSLPQEWLWCETWCSDEDLAKARTIDLCNNPQTKEPKLARARRQVPEWTVYDDEIAALAKRVDAEQVKFVQTGDDVDRKEAVGDDVQGEAGEDRKDEL

SEQ ID NO: 3893 - protein, 1551 aa, Guillardia theta
MVQSRSETMPKNALKIPIVLCLILLVQSVCSSPSKSKFVDVSVVAPWAPTPLIIEASEYFADKADEGKFWEFVESLPNDIYEKTDKQHYDTSIELASKIVSNVQLSLIKFALSIRNFSPKLQAYKQLWQAALNFGCSIKDKDGAVVLIGGKCVSDPSLLRDAIESCHPAKAGVSAPSIQEFDHIYPSPSSPSHCSTAFLYATIGTQAFVNFHKYLSQAAAAGDVKYVFRHSWPGAREEEEKAHQDMLLQGYGVELAIKNMEYKAVDDRHKEGEAGSSLEDDLEDEVGGFDFKTLLQRKPNLEVELLSFRDRLLSEAKSDEGTDIKVWALKDLGIQASQRILQADEPLRLIRDLSHNLPAVVSSISRMRVNASVRAELENNRNFIQPGANMVHVNGRQLQKDDMNPFSLYRFIRHEINVIEKFMQLGMDSRSTKKILYAPAEQMEGGGSTFKIDVKNDNFVMWMNDLEKDDMYRQWPRSLDTLLQRGWPGQLRFIARNIWTAIFLVDPSDMQSLTFLSWAFEQMEQQLPVRFGVAFKYSKSLDEQWEASPRNAESEDEAEELGDAVILHRLFRALHLGHGGRAAWSFLAIYAEGMQTAGKASKSEVRKDSFKRAAKMFRAQYRDADGKLMRAKYKPSLLNSTHDAFLKKSTEFVERSGLSLTEPVCVLNGNVLAGQALDPNQFHYMLQMQMMVLQRMAYFGQLDERRDLHNQIINHNGKAHRRFHAQIVSGPATSRQMLKAEVSTKTMEDLDRIPFFLCGKDDGSMRGVTHIVALDLSSKIGRDLLVASAKRMSQTSSDRCKRVRLAYLDNSEGSPEAEGAFSVLVEAIRSMKNDKDKGNKFLELCRTIVKLLDESAWSTAQAHEEVKTLMEAAEKSKEGGLSKADMKRMISDWFQLTAGESAVSTSGRVFKVTADVAFRMGDFVLAEDTEWNDRSKHVSSVLDVASFSISSDKVTSEYISSIALLGSNMIGIERNDNIQRTDQEANRQWTSRMTGFKVGPEDSILQVLAFIDPLCAEAQRLSPMLMALADAFGAHIHVILNPVAEVGSLPIKGYYRYVLKPQLEFDEEGKLVSNTRATFSNLPMSKLLSMIIHPPDAWFVSASQAVHDIDNILLEKLSAHETVLSAVYRLDHILVTGHCIDDRREPPAGLQLNLNLLDEHAAKGKSKLVSDTLVMSNLGYYQLKARPGIFNLTMAEGKSSEIYEIEDKGNFGSSRVISVLSWEPDAFPTSVRKRKGQESKSLQDAKGGRDGDGSVWSSLSNWFSGDSATAEQAVTDKSGEDTIHVFSLASGHLYERFLKIMMLSVVRNTKSHVKFWLLQNFLSPQFKAFIPRMAKNFGFDYELVTYKWPSWLHEQTEKQRIIWGYKILMLDVLFPLSVPKIIYIDSDQVVRSDLKQLWDMNLRGRPYAYTPFCDDKREIEGYRFWKQGFWQTHLGDMKYHISALYVVDLNRFRAIGAGDELRVVYSQLSRDPNSLANLDQDLPNYAQHSVPIFSLPQEWLWCETWCSNSTKVKAKTIDLCNNPMTKEPKLDQARRIIGEWEELDKTISSLE

SEQ ID NO: 3894 - protein, 1584 aa, Rhizoctonia solani
MRSLSALGTLGAASLVAAQSTFSPPVKVSLTTSWAAPPFLIEILETAAAEYPGRYFEILDALTDRSSDGLLGPITEPVHKPKYVYHTALAHLIAHGFLTEPRALSAFEKNMALHSATPKIQAFYQLFGDPSKAPECQSWIEWSGKQACTSEEADTLLAEASTGGRTHTFPFDHVQQSTSGECASPAIFYASLSSPNFYDLYLYLRSKSETPGFCYILRYTPPKDTAIAGEHSRNTLSGYGVALDLKKMDYLALDDRGLRGKDGDSDSTAEESTVWEDYVSSLLSEHPHEDLDLTTPLTEEEISTLPLRSTHLVMSSEDPLKALLHLSQNFPKHAVSVARRWDPGRGEDLKAKYESVEAEVQANMHMVSGAGNMIWLNGVALPEADVNPFSLLRLLRREHQTVNSLIKANLTSEQAIRVLTNPEIGKASAASGPTDGVFDASDREEGGGAIVWLNDIEKDKRYSRWPSSLTVLLRPMYPGQFPTLRRNCFNVIAALDLSRTSSISFIAQIANNLISRSLPFRFGYVPLIETAESRQVARLMKWMMDEYGFEKTAQYFSVALNPSDTVDLRLLETAYAQFTTQMPPESGNVPEFASFSADPLQIQMVGHEFVPDEGLQSAAAYAKRLRLGAQDGTGKGHVFINGKHFAYDDTFLRHLQTEMGTQVNFFQEQLYTGALVDAPETDVSVFMYDLPTTAKRRNKFIYPSGNLRIYALENLSNSAGAAKLLDDSFVYPTGEHVTPVTILVVGDMDNEETLTLAIEGLRGMSDDAKYRLGLIHTPSVDPSDLPSTQQPLVSPMLARLAATGNYADFPPSELAQILEEAKQLVGSAAVLNVQDNPVLINLNNRLTGITNEGVDFEELKLTNAAGNALAKNIGLKSGERALIINGRVIGPLAGSDFVAEDFGALVNYETAKRINPVVSALTAVRQDLPELDRRAYANLVARVSSIVSSVSVPDPSEEGLFQSKSLARQRPYNELIGKDCTFEIGDNSTALFHIGLLLDPLSESAQKWASVVEWLATVPQTHIHVRLNPSAVLTEMPLKRFYRYNLQTRLTFDQDGFETRNPVEFHGLPVEPIYTLAMDVNPAWLVRPYISEADLDNIHLASLSDPKAGVEAIFHLDHLVIEGHAREENNAPPRGVQLQLTSLDGNPTADTQVVANLGYFQFRTGPGAFRLEIRPGRGRDVYAIESAGNEGWNSGHVNVTGTEITLTSFEGHTIYPRLSRQPGMESADVLAEPEKDESIWSRVSSLWGSKPTETVSESKQADINIFTVASGLLYERFVSIMILSVMRNTKSSVKLWLIENFLSPSFLEFIPHLAEKYGFQYELVTYKWPSWLRAQKEKQRVIWAYKILFLDVLFPMDLKKVIFVDADQIVRTDLKELVDLDLQGAPYGYTPMGDDNEAMEGFRFWKQGYWKDALRGKPYHISALYVVDLVQFRKMAAGDRLRGQYQALSADPNSLANLDQDLPNNMQDQVPIFSLDKDWLWCETWCDSARFDRAKTIDLCQNPLTKEPKLARARQIPEWTLYDNEIAEFARSLADSGKIRSRAISGSVDALASVGKKVTTSNTEESPAPTPDEQAEPHQAHEEL

SEQ ID NO: 3895 - protein, 1583 aa, Galdieria sulphuraria
MSKSLFVLYFFSYCILYSLARSTLTTSLNSGWSITPIELQFSEWIAQRGSSCFWQWVQDLFQREQHLDSDRESFEWCEEWIARRWDIASGQVAVWSVLAVEQLGSVVLQDQWASHVWYYRQPKATTTWVQEKPSVFAEWNDQLYIDLDTLIADLRSVNHSTKLKADAQPDIDIGHCYGSSRKDIPLVILYGHLGKMEMKPWHDFLFSMANKGKVCYMIRHSYLSSSHRSMYLQGYGVEVFMKNTEYWVQDPLAYPCAKVEQANHTFDISTISDQRCLLQNDDCQLGGIDWPALVDHYSLSQEDKLTLQNALDNWEQSRASFKEWKPWQVGDIGLSATHLIVHSQDPLSTFERIANNIPLYAPLLAGPWHLSDSQVLSYRQILQSLEDWEEQVTLNGRSLSLPWGLLPPTLTNCMDAITLARHVALKESITNQSILSHNMIDNHLWSASLSTPSIRLSLVHPNTPVVFIQNENDILSLLKDTKMSASSSSVVFYEYAAYLRSLDKLSSSQLVDVIFLWDPLDGNQLVVIEWMKQVLEQGWPIRMGIGLIPSSAADERDDDDDDDHRYPGSVDWKSYMEEDSTSEQQHIWYHLASHYFPSKRKMSLHDEETMTEIVLIALEYLTNQVPCPIAGYYFLAKLKQKMTVPMDIFTLLSDGGRMASYEKLQWSHLQEAFLFAYHRRFSCSLHNKEQQEDDTSTAEEIWKGWMNKAMHSSIVKRHRQWANAMGFQRLPMVIINGIPLGDIASQLIVTLEQEMKEILKQASSSRIQKWIPRQNTRLQATTPYNPSILKEILQHNEYAQFKYFKTNAAVQNSVGLATIWIAVDLESLQGLKLMALALEWLTCPLSIPGRIAFLSSTHTHHSSHISCSDQQDQIQQMKQLVITRMKKSFQGQQMLTTDDSLEFLSYVPGISDQWIQKDQVFINGFGYSSHLFTFPTDFDLACSMMDIGLSMEDADAQLLWSFTSRWLDESCSLSFSRPGSSLFSSSSSTALRMNEWKQLLGQSYDLLSFHSISSTTNETQKYTSVFHVEAILDPLSPNAAKAATMLSILRTYFDVSISVLLLPSSYTSIETIRKASFYRTVLIPRPRFEKNTGALISKPSGVFTTLFKNRTLTVSMDTPPKWLIGASHAEEDLDNLVLQNDTQVYAEYQLEAILVEGTCIDVSNLSFVPPQGLPLSLVPRTSDWMQTQDTLVMANLGYFQFQTHFGVWNLQVGQRQGISYQLKVEESKIADTTASIASSLIFGSSIPNIISQPMSSNVFLLVKQLQGKTLTLYVRPSSFSSPDKVRMQLPAIIPPTWLSKLLDKIQLFSWWSSEQQHISSNDRMVHVFSVASGYLYERLIRIMILSVVKHSSVPVKFWLLKNYLSPSFKKILPHFAAKCGFDYQLVTYRWPAWLTAQTEKQRIMWAYKILFLDVLFPLNLSKVIFVDSDQVVRGDLYELFQLDLHGAPYGYVPFCDSRKEVEGYRFWKQGFWASLLKDQRYRISALYVVDLKQFRKMAAGDNLRAIYQRLAQDPASLSNLDQDLPNFASVPQPGLPHVPIHDLPPEWLWCETWCDDESKKRAKTIDLYESYLNGMRWIKKQQK

SEQ ID NO: 3896 - protein, 1599 aa, Gossypium arboreum
MDTCFRSRFCILILLTCLLSSGFTFVGAQNRRPKNVQVAIRAKWSGTPLLLEAGELLSKESKNLFWEFIDDWLLVGKTDNDSHSAKDCLVKILKHGSSLLSEQLASLFEFSLTLRSASPRLVLYRQLAEESISSFPLSDDSYSHNASGVDDSEAVGTKKLDPLLVGVNPKSPRGKCCWVDVGEELFFDVAELQSWLLGPNEVNGDSFQQPELYDFDHIHFDSNIASPVAILYGALGTECFREFHVTLVQAAKEGKVKYVVRPVLPSGCEGEVGLCGAVGARDSLNLGGYGVELALKNMEYKAMDDSTVKKGVTLEDPRTEDLSQEVRGFIFSKILERKPDLTSEIMAFRDYLLSSTISDTLDVWELKDLGHQTAQRIVQASDPLQSMQELNQNFPSVVSSLSRMKLNDSVKDEIIANQRMIPPGKSLMALNGALINIEDIDLYLLIDLVHQELSLADQFSKLKLPRSTIRKLLSTMTPPESDTFRVDFRSDHVHYLNNLEEDAMYRRWRSNINDILMPVFPGQLRYIRKNLFHAVYVLDPATSIDMITSFYENSFPMRFGVILYSTQFIKKIEQSGGELHSSEHDGELEDDKSSLIIRLFIYIKENHGIQSAFQFLSNINRLRTESADSTDEALEMHHIEGAFVEALLPKAKSPPQEILLKLEKEQSFKELSQESSLFVFKLGVSKLQCCLLMNGLVFDSSEDALINAMNDELPRIQEQVYYGQINSHTNVLDKFLSENGVSRYNPQIIAGGKVKPRFVSLASPVLGGESVLNEINYLHSPGTVDDVKPVTHLLAVDVTSRKGIKLLREAIRYLIQGSKNARVGVLFTTGQDANLSNILLVKTFEITAASYSHKKKVLEFLDQVCSFYEHNYILRSPAAAENTQAFINKVYELAEANELPSKTYKSSLSEAYNLKLIEHLNKVAQYLYRQFGIASGVNAVITNGRITSLDAGVFLGDDLHLLESVEFNHRIKHIVEIVEEVSWHGIDPDMLTSKYVSDIIMLISSSMATRDRSAESARFEILNAQYSAVILNNENSSIHIDAVVDPLSPSGQKLSSLLRVLAKYVHPSMRIVLNPMEDFSSTDYTVNGPKAFFANMPLSKTLTMNLDVPEPWLVEPVIAVHDLDNILLENLGDIRTLQAVFELEALVLTGHCAEKDRDPPRGLQLILGTKNTPHLVDTIVMANLGYWQMKVSPGVWYLQLAPGRSSELYLFRDGGDDGNQEKSLSKRITINDLRGKVVHLEVVKKKGKEQETLLISSDDDKHSKEKGHNGWNSNLLKWASGFIGGSEKSKKSSDSSVDHGKGGRHGKTINIFSIASGHLYERFLKIMILSVLKNTNRPVKFWFIKNYLSPQFKDVIPHMAHEYGFDYELVTYKWPTWLHKQTEKQRIIWAYKILFLDVIFPISLEKVIFVDADQVVRADMGELYDMDIKGRPLAYTPFCDNNKDMDGYRFWRQGFWREHLRGRPYHISALYVVDLVKFRETAAGDNLRDLPNYAQHTVPIFSLPQEWLWCESWCGNATKSRAKTIDLCNNPMTKEPKLQGARRIVSEWTDLDFEARKFTAKILGDELENPDPLPSPLSSSPETSSNDQSTDDLESKAEL

SEQ ID NO: 3897 - protein, 786 aa, Pelecanus crispus
DEDALYAVTIWIIADFDKPAGRRLLSNALKHLKTSSHTRVGILNNPSSKIKEDNTAIARGILAAFLTQNNSNFKSFLSKLTKEETAKSIAAGTKIAKFLIPGMDDNTFEKKYNTLGLDIIKTHQMFCQEVLKLLPGQMAVMSNGRVLGPLDENEFYAEDFSLLEKITYSTSAEKIKAIVKEMGNSSKSGSDLIMKIDALLSSLPKTEMRQGAELLKEQHSVVKVNPQQNEPFYDVIAIVDPLTREAQKMAHLLIVLKDIINVKLRLFLNCRSKLSEVPLKSFYRFVLEPELTYGINKHLPSEPMAKFLELPESPLLTLNMITPESWLVEAVNSSCDLDNIHLQDIKGMVIAEYELEYILLEGHCFDVTTGQPPRGLQFTLGTKANPVMVDTIVMANLGYFQLKANPGAWTLRLRKGRSEEIYQVFSHEGTDSAADLADVTVVLNNFRSKIIKVQVQKKPDKMNEDLLTDGTGKKGNRESVTRFSEEIPTEEKEKKSDILNIFSVASGHLYERFLRIMMLSVLRHTKTPVKFWFLKNYLSPTFKDVIPHMAKKYGFKYELVQYKWPRWLYQQTEKQRIIWGYKILFLDVLFPLAVDKIIFVDADQIVRSDLKELQDLDLNGAPYGYTPFCDSRKEMDGYRFWKSGYWASHLGKRKYHISALYVVDLKKFRRIAAGDRLRGQYQALSQDPNSLSNLDQDLPNNMIHQVAIKSLPQEWLWCETWCDDESKKKAKTIDLCNNPQTKEPKLKAAARIVPEWVDYDSEIRTLIQQIEKETKNLTSFFQKGSL

SEQ ID NO: 3898 - protein, 1711 aa, Microbotryum saponariae
MAFGPRSSTVYRQRITATTRLMMLVLVLGWVSVMQICLAGSPSSTSSSGGARSVQARIKTPWVGSSLVVQYLESLATEDRHLLHPFLTHLIQSNASTLLTTSPTTSSSSSSSSSSATAHDPSRAWAVLSHQLQHFLDQKHPSHSNALVESLGLAMGLKEASVRLQAMEVVAKRAWASTTTPPVLVEAPPSECDNWVQVGGYRLCSVAEFWKVLGEEQRHAKGGLSLPNTGNSSNRPKLYPFDHLSPRPPTSTSTSAPPPLVIFYASPSSPAFIEWYELLTRLAIEEPPRIEYALRWKSAAGSADEPLVLSGYGAGLDIKKSDYLAIDDRLTSGEAAHDAATDEPIDSSEAIKMEPIKKKDIPLLGVRSTSYILSDPSPLSAFTRLTSSFPLLASKLSSLVPTVPIDLLQEIQTNSLLPTGLHPSFKLNGLLIPEAQVDPFVLVRLMRKERKFLTQLQHLLANANEDDLPLFEISPFQARGLIMNPSISKAMKRGAKIITEPSGRVSSHVLGQLFDASDRDEGRGVVFWWNDLEKDKKYQSWGKDLKKLLQPTYPGQMNNVALNLNQAVFILDLTQPATLQLLTRQVQNFVSRGIPIKFGLVPKLGQSGGQDGAESAEETLAKMFWYLTEAIGRGGTMRLLGQLLDTLHTDRVTTPHLRKTYETFMLENTHLSGGPLASFAQVLELPIGVERVNKARAYAKRLGVAGSDEASSVGAFLINGAFFEFDEEWTQHLQQTLSAHVQYEQQEVYFGKLTSETDVENFFYDLPTTHKRRNRFVFTSEANPLKVVNLVEVLEGVERGFVEGTWIEAAPSLEDEQGSELGEGLELDQVVSLHVVADLDSSDGRQLVHTALEYVQAHPEARVSLLHNPALDDEQEFPSRWAVSNLIYLLHADDELVELLPSELSRFVRLGINQTNIDDVSQLILSLWDDDNPIKKHVKLGANHKTSILAREWWTSAMVMAKRFGFERGQSGVVINGRVVGPLRKDDLTIADLEALVSYEREERIDAVVEALRSVDLDLQSLDRSSWAHMVALATSVIAQAYEVDPSGGLAGEESIERSRDYLEFQAEHSAIIGPNEEEAMFEIAVVVDPATELAQRWAPIIETLSKLESVHLRVHLIPTMKNHQDLPIKRFYAFTFASSPQFDPSTGREQPPQVQFTDLPEDVLFTFAMDTPKAWLAFPKKSVHDLDNIRLKDLPLWARKAGVDAEFELENLVVEGHARETPGNTPPRGLQLELVKEGTGEEDQHRVDTIVMANLGYFQFKASPGPWRLAIREGKSSQVYSIETTGAEGWNSRSVEEAGDEILVTTFEGVTLFPRFKRNKGHEMTQLLDDTDKGVATKGPQESVVDRVKNLFPFLRKSELAIKKKAEINVFTVASGLLYERMAFLMVVSVMRHTQSTVKFWFIQNFLSPSFRAFIPHLAKEYGFEYELVTYKWPHWLRAQTEKQRTIWGYKILFLDVLFPLELERVIFVDSDQIVRTDLKQLVDLDLQGAPYAYTPMGDDRAEMDRFRFWKSGYWRDHLRGKPYHISALYVIDLDRFRAMAAGDRLRQQYQGLSADPNSLANLDQDLPNNMQDQIPIYTLDQSWLWCETWCSDASLAQAKTIDLCNNPLTHEPKLRRAKRLIPEWTVYDDEVAALAKRVAAEQTQTGGMEKDEGVGVFGGKADELGQAKGQKEDLDAFVKEKSDEGEKVELRPVGEHVQDTVVGPGKDEL

SEQ ID NO: 3899 - protein, 870 aa, Wuchereria bancrofti
MPRINKLILDSPLSPDALYLDLTSVKKCTSVSPTQYYKLPPKEQNQCMLKRMRYITRTGRLYKNKSSKTWSYHFRRNENLFSTVWVVTDLETADGRLLAYNAIRHLKRSYTMRVAIINNPENIEKATTSGSITMLVNIASRVLIPKQMKSFITKLVKEEIVSELLNKQITLDDLSVNDMNMTLFYKEAKQINSDEIIVDAKYSKSILGLKPGQLALVVNGLLIGPLGDSEVLDVADMELIDKLTLLRGGKVVKDYMEKWGIQTRYGESSDMVARSMALIGSVGVTKKRRFIPLLREKESVLTISGNNEEGLILALCIVDPLSTQAQRLGHLLTVIQKVVNVEVKLVMNPRAKLSELPLKRFYRLVLQPTVTFDNSGRINDVAYEARFTALPNRQLLNLAVVPPDAWMVQSVYAVYDLDNIRLENVPGNVLAKFELEHILLEGHCFDDMTGSPPRGLQFTLGTLVNPSRYDTIVMANLGYFQLKADPGAWILNLRDGKSKDIYNIVSHVNTESEDEDGINVLIDSFSGRTIRVRVAKKKGKEKENLLSEGKSEGESEDHHSVWSSISTTISGGEKHDAINIFSLASGHLYERFLRIMILSVMKHTKHPVNFWLLKNYLSPNFKETLPQMAKHYGFKYEFIEYRWPRWLHQQTEKQRVMWGYKILFLDVLFPLGVRKIIFVDADQIVRTDLMELMELDLGGAPYGFTPFCDSRTSMDGFRFWKKGYWANHLAGRKYHISALYVIDLVKFRQVAAGDRLRGQYQGLSADPNSLSNLDQDLPNNMIHQVRIKSLPQEWLWCETWCDDASKEKAKTIDLCNNPQTKEPKLDSAMRIIPEWKDYDAEIKALFDIRSKNHTGKTKSGHEGTDKHTEL

SEQ ID NO: 3900 - protein, 1515 aa, Dasypus novemcinctus
MAAMAKAAYVVRLLLSSTALWLSLLGAGTASASKAVTARLAAKWPETPLLLEASEFMAEESNEKFWQFLETVQELAIYKQTESDYSYYNLILKKAGQFLDNLHINLLKFAFSIRAHSPTIQMFQQIAAEEPPPEGCNAFVVIHKEHTCKINEIKKLLKKATSRPRPYLFKGDHKFPTNKENLPVIILYAEMGTRAFGKFHKVLSDKAQNGEILYVLRHYIQKPNSRKMYLSGYGVELAIKSTEYKALDDTQVKAINNTIEDETEINEVQGFLFGKLKEIYSDLRDNLTAFQKYLIESNKEMMPLKVWELQDLSFQAASQIMSTPTYDAIKLMKDISQNFPIKARSLTRIAVNQHMREEIQKNQKDLQNRFEIQPGDDGLFINGLSIDMDSYDPFSILDMLKFEGKMMNGLQNLGIHKEDMSKFLKLNSHDWEHNYALDIRHSSIMWINDLEHDDLYVSWPASYQELLKPVFFGSIPSMRRNIHNLVMFIDPSQEYTLDFIKIAELFYYHKVPLRIGFVFILNADDEADGTTDAGVALWQAFNYIAEQHDVSQAFISIVHMYQNVKDQSILTVDDVKSVLQNEFPHDNVWDILGIYSEYDKERTAGASFYKMSGLGPLPQVLYNGEPLNHEEINIEELEMAVLHRMIDTSLYLQRAVFMGTLNDQVNVINFLMDKNTVVPRINSLILHTKRQYLNLISTSVTADVEDFSTFFFLDSQDKSAVIAENMYYLTQEDDDVISSVTLWIIADFDKPSGRKLLLNALEHMKTSVHSRLGVIYNPTSKIKEENTAISRGILAAFLTQKNNNLRSFLWKLAKEETATAIYSGDKITTFLTEGMDKNAFEKKYNTVGVNIFQTHQLFCQDVLKLHPGERGIVSNGKFLGPLDENFYAEDFHLLEKITLSDLVEKIKGIVKNMEMNSKNMSDLVMKVDALISSLPKRVSRQDVTFLKENHSIIKINPQENNMFFDVIAVVDPLTREAQKMAQLLIVLGKIINMRIKLFMNCRGKLSEVPLKSFYRFVLEPELMSGTNDILSSGPMAKFLEIPESSLLTLNMITPEGWLVETVHSNCDLDNIHLKDIERTVTAEYELEYLLLEGHCFDIMTEQSPRGLQFTLGTKNKPVIVDTIVMANLGYFQLKANPGAWVLKLRQGKSEDIYQIVGHEGTDSQPDLKDVIVVLNSFKSKILEVQVQKKPDKIKEDILSDKDEKRKGMWDSIKSFTIRLHKEDKKETDILNIFSVASGHLYERFLRIMMLSVLRNTKTPVKFWFLKNYLSPTFKEVIPHMAKEYGFQYELVQYKWPRWLHQQTEKQRIIWGYKILFLDVLFPLAVDKIIFVDADQIVRHDLKELRDLDLDGAPYGYTPFCDSRTEMDGYRFWKTGYWASHLLRRKYHISALYVVDLKKFRKIAAGDRLRGQYQALSQDPNSLSNLDQDLPNNMIYQVAIKSLPQDWLWCETWCDDESKQRAKTIDLCNNPKTKEPKLKAAARIVPEWVEYDTEIRQLLEHLEYKKKNEILTHDEL

SEQ ID NO: 3901 - protein, 1765 aa, Punica granatum
MKTPLRSGFCLVIVLVCLGLLVGVHGETRRPKNVQAAVRAKWSGTPLLLEAGELLSREWKDLFWEFVEVWIQNEEDHTGSYTARDCLKKILSHANSLLSDSLAPLFEFSLYLRSASPRVVLYRQLAEDSLSSYPDAEEISSGDYGPGVTGKFDNTESRKVDSLLVGKNPESPRGKCCWVDTGASLFFDVADLKSWLHGHSKHDGDVAGQPELFDFDHLYFDANIASPVAILYGALGTSCFKEFHLTLAEAAKKGKVRYVVRPVLPTGCETKAGVCGAIGAGDPVNLGGYGVELALKNMEYKAMDDTTVKKVSQGKANLENFHWSILLLMRKLAGQPELFDFDHLYFDANIASPVAILYGALGTSCFKEFHLTLAEAAKKGKVRYVVRPVLPTGCETKAGVCGAIGAGDPVNLGGYGVELALKNMEYKAMDDTTVKKGITLEDPRTEDLSQEVRGFIFSKILERKPELTSEIMTFRDYLLSSSISDTLDVWELKDLGHQTAQRIVRASDPLQSMQEINQNFPSIVSSLSRMKLNESVKEEILANQRMIPPGKSLMALNGALLNIEDIDLFLLLDLVHQDLSLADQFAKTKIPESIIRKLLTSVPPSESSMFRVDFRFSHVHYLNNLEEDSMYKRWRSNINEILMPVFPGQLRYIRKNLFHAVFVLDPSSVCGLEAIDMITNLYENSFPMRFGVILYSSNFIKKIESGAELHGAVANSQNEEDLSSLMIRLFIYIKENHGTHSAFQFLSNVNRLRMESESDDAIEMHHVEGAFVETVLPKAKTPPQDMLLKLEKDQSFKETSQESSLSVLKLGLAKRQCSLLMNGLVLDANEEALVNAMNDELPRIQEQVYYGHINSHTDVLDKFLSESGISRYNPQIIGDSKTRPKFVSLASLILGGESVLNHIDYLHSPETMDDLKPVTHLLAVDVTSNEGIKLLREGIRYLMAGTKIARLGVLFNAKQDADLSSLLFVKVFEFTVSSYGYKKEVLNFLDQLCSYYEHEYVLDPSAAVQDGHREKLQSTIYELAHENGLSTDAFKSMLGEYDIDKMRERLNKVAEFLYRLTGAGSAVNSVITNGRVMFPVDANSFLSDDLRLLESMEFKQRTKYVLEIIEEVNWKDVDPDLLTSKFLSDVVMYVSSAMATRERSSESARFEILHADYSAVILGNENASIHIDAVIDPLSPMGQKLASLLRVVWKYSQPSMRIVLNPMSSLVDLPLKNYYRYVLPTMDDYSSTDSSINGPKAFFANMPLSKTLTMNLDVPEPWLVEPVIAIHDLDNILLENLGDTRTLQAVFELEALVLTGHCSEKDHEPPRGLQLILGTKSKPHLVDTLVMANLGYWQMKVSPGVWYLQLAPGRSSELYTLKDEEDGNSLKRITIDDMRGKVVHLEVMKKEGKEHEKLLVSTDDENQSEDAKGGRNSWNSNILKWASGLVGGNEQAKKSRDTSVVRGKGGRQGKPVNIFSIASGHLYERFLKIMILSVLKNTRRPVKFWFIKNYLSPQFKDVIPHMAQEYGFDYELVTYKWPTWLHKQKEKQRIIWAYKILFLDVIFPLSLEKVIFVDADQVVRADMGELYDMDLKGRPLAYTPFCDNNKEMDGYRFWRQGFWKEHLRGKPYHISALYVVDLVKFRETAAGDNLRVFYESLSKDPNSLSNLDQDLPNYAQHTVPIFSLPREWLWCESWCGTATKSKAKTIDLCNNPMTKEPKLQGARRIVPEWTDLDSEARRFTAKILGDEPDLQVPVQSPAQSKPEEAKVDSSLEDDLESKSEL

SEQ ID NO: 3902 - protein, 1491 aa, Pseudogymnoascus sp.
MVRPGSVWSLTGSALAFSCLRFIKVSASPTINVALATSFTSAPYLLELLETAGDENSTSYFPLLDRIAEGHFKDATTDLGLYNSFVKVLRNDGHLDSQGLASYSFALSLRTSAPRIEAQYQFYDTAIEQSVDDSSCPVWVLFEGNKHCSPALNEAHGTYNGRRGTEQLQFDRIIGNLSAPASILYADITSLEFSKFHKKLIQKAQKQEISYRIRHKKPNVQESRPLVIGGYGVELALKRTDYIVIDDREADAQVQEESINTEVVLEDEEFADLKPLSASELVSLGLKASSFIMQSENPFEILTRLSQDFPRYSSAIAAHNVSSSFVEEHEYNRGQLVPAGANVVWINGLQVPTRQMDAFSMLDILRKERKLLNKFSQLGLTGSQTISLLSHKDIAFTKADDEPARYDWRDDVVSRDDDGNAIIWLNNIEEDKRYEGWPTTVRALLQGGYPGQLPQVQKDLFNLVFPVDLSNLRDVELVVEQLSDFVKRALPLRFGLVPLTNSNAALEEAKIVYYLLESYGLSTMVAYLNGFYASKGIQSSRNANFEAATKERKLQKDKVARSLEEVLDANEANTSIASSKRWNSRLGTNGKIPPVFVNGVAVPRDENWMQGMSQRVQMDVRLMQRAVFENIVTDDEWPPMLYLKETTYRRDPFLMPENDKDLQLFDVNAIYSDHAEALEGLPVIKISPSEKQDEWAHMILIADVETEQGKQLLKAVTEFNKRNPSVELAIVPSSESPAGILSIYEYMAERSFQSLEYDLGLDGLVEAVSKFTSNEETQHKYGQGVAEKWTAIEGLLGSLGLKPGQQGLLLNGRLVGPIPNEIELGFHEMEQLLSFERTKRLNPVLAAIKDLGFSEAISDPLASSKLTSLVTLSFISNVPEGIFEQAPTLRIDSFKAWKSEYTAIEIGDESTASIHIQVALDPASQESQRWIPILKALSELDGVYLKLFLNPKDVLKEIPIKRFYRYVLESKPVFNSDGSLKDIKAQFASVPQEALLTVGMDVPAPWLVAPKQSVVDLDNIKLSSINGDVNAVYELEHILIEGHSSEKETGQAPRGAQLLLGTAADAHFADTIIMANLGYFQFKANPGFYKINLQEGPSSKVYSIDTLGAPGRDASKPDDSTEISLISFQGLTLFPQLSRNPGQETEDVLEPSTADLKDDIVSKGRKLAESILGFGKKEVVAQTTQAEINIFSVASGHLYERMLNIMMVSVMKHTNHTVKFWFIEQFLSPSFKQSIPALAAAYNFSYEMVTYKWPHWLRSQPEKQREIWGYKILFLDVLFPLSLDKVIFVDADQIVRTDMRELVDIDLQGAPYGFTPMCDSRVEMEGFRFWKQGYWKSYLRGLPYHISALYVVDLRRFREIAAGDRLRQQYHQLSADPNSLANLDQDLPNHMQTLLPIYSLPQEWLWCETWCSDESLAGAKTIDLCNNPMTKEPKLDRARRQVPEWTVYDDEIEGVFRAAREGREQKGEVKNTKSRTLEAEAEGTGRVKDEL

SEQ ID NO: 3903 - protein, 1562 aa, Pieris rapae
MKAVGFSTLLFLILTQVFHSIASNADTKREEKKSKGVTTFVSAKWEATPIVLELAEYLSGESGDIFWSFVDGINSLKSSLSSLNTDKEIYDTCIGIASSLLAPAQLRMAKLALSMHLNSPTVRMFDEIATQNGAKQVNCDVFVSIASQNICNNDILRDVLKTTSQYDADEHRLETYLLDHTYPSSNNKSLTAILYGELGMPEFTVKHKILSTYADKGLINYVVRWNVKPRGNPKLRLSGYGVELQLKSTEYKSQDDATPKESDTDTPVPSEEEDENDPQNQIDGFNFGRLKNLFPALRTPLERFRRHLSEMSEELEPLKVWQMQGLSMQAAAAVIDAHDAGGDEALRVLTSIAQNFPMQTKSLIHVNVPRSLREEVLYNQDIWASSLGLRAAEPLLLVSGAQYDAEEVDIMALLNSLKEDIGPMNTLHAIGLSKKLINKLMSLELGESFTWEEYGLDIRDTAITWLNDLETDERYRRWPASFMELLRPTYPGMLRNLRRNIYNYVIIIDPTSPASLPPLKLGETLLKHSTPVRVGVVLAPNNTPLGIAIRSAFNYVAQDRNSNKEAFFFLTQLLSSSEEEELNFDLLKRLLKKFTNSGANVNEIISEDSEYNFGHQLAEEFVGKLGADKYPQVLVNGVPLWDEGPISLSASVDSLEEALVTSLSRHTGRLQRAVFRGDLSDSDDATDYIMKQPHIMPRLNRRILATDPSQYLDLSGVPSSPELFTEDKIHKLMHLTGRDALATALPLLKYFAKSAKAEKITQTIWVIGDLNDKRTRDFLKNALNFMRESGGVRVAFIPNVDGESKVDQSLNKVVIAALTTLEPAKATKYVAQLLDDEGCHERQDCDILPELVSALNKHAWVLKAARILCVRGMKLRASERALVYNARYIGPLAENETFSSDDFVLLERYSNQVYGEKLAEVFKKKRTLTNIEEDDDDDTISDIDTEKYFKVISILASRSPRTRTPLPTGLKTEHSLVELPPLYTDEAAIEIVAVVDPASTAAQRLAPLLLVLRRVINCRVKLFLNPQDKNSDMPLKSFYRYVLEAELQFTPSGSLTGGAIARFNRLPHAPLLSMEMRTPPNWLVECVKSVYDLDNIRLADVESLVHSEFELEYLLLEGHAWDTALGTPPRGLQLILGSRDNPEIMDTIVMANLGYFQLKANPGAWILRLRPGRSEEIYEIVGHENTDTPMGSSDIQVLMSSLRSHVIKLRVSKKPEKQHLDLLAENDEKNTGGIWNSIASSFVGGDEQEGQDETINVFSVASGHLYERFLRIMMLSVLKNTKSPVKFWFLKNYLSPSLKDILPYMAEEYGFSYELVQYVWPRWLQRQRDRQRTIWGYKILFLDVLFPLHVKKIIFVDADQIVRADLKELVDLDLGGAPYGYTPFCDSRREMEGFRFWKQGYWRNHLQGRSYHISALYVVDLKRFRRIAAGDRLRGQYQALSQDPNSLSNLDQDLPNNMIHQVAIKSLPQEWLWCETWCDNKSKTYAKTIDLCNNPLTKEAKLSAAMRIVPEWKEYDAEVKGLQARVRRGLYQRNDSDQEIEHRVEDSTNTEKNSGDHEHTEL

SEQ ID NO: 3904 - protein, 1487 aa, Aspergillus fumigatus
MAIGLGSVTSWRLCLVILAAFTPLVCGSPSVNVALQASFDSAPYLLELLETAAEENSTSYFPLLDRIAEGTFDDATTEKQLYDRFLQVVYDDGHLSTPELLSSFKLSLAIRSAAPRITAHYHFYNASVQHSLMAAQDAACPVWVHSEGKQYCSSSMERAQQDVMGESDPRELPFDRVLGDLSLPPAVLYADIASPMFKDFHHTLSALAKDGQVSYRVRYRPPQHWISRPLFVSGYGVELALKRTDYIVIDDRDAEKRSQKDSGSSEWASVEEESPDDLGALSSSEVARLGLNTVSYVMDSEEPLDTLVRISQDFPKHSAKIAAYNASDALLKDIRTSRLGMLPSGVNVMWINGVQIDPRQIDAFSLLDHLRRERKLIDKFRSIGLSAQEAVDLLCHQTLGETLAKDSPPRYNYRDQIEGGGVIIWMNDLEKDTKYQSWPDDLSAYLQPMYPGQLPAVRRDAHNIVAPVDLTSSDDMELVVKTLQVFVKRKIPVRFGLVPLASSPGSVAQLKVAHYLHETFGLASLIHYLEESAAKKKIGSPDKAIFQHAIKDRTSRPNKQILSFDEILKSDELEILVSRTKQYQDRLGIKGNAPYILVNGVFVPRDDNWPQEMSMRVGRDLQTIQQGVVDGSIEEDTWLPELFLSEAFDRRNPLIIPEDSKDIRIVDISKLAKSRGDSADTLRIASEMDTLDSKHLIVVGDFDSENGLKLLVEALELRATHGEVEMVLIHNPAPDVETESGSALIYNALKGTDKVDASRVLRHLKTAENTNFPEAEAKKMSQFWEAQQALARDLGFLPGTNGVIVNGRAIGPLPDGSTLSKEDLDGLLTYEEARRIGPVAKAAKDLGLESKLSGPLALAELSSLAALSTVSDVPEGIFEQMSSIRMDLFKKWNDLLSVITVSTSEDPAIIIAASIDPTSETAQRWLPILKVLSRLAGVRVTLALNPRDQIQELPTKRFYRYVLDSEPSFNDDGTLARPTATFSGVPVEALLTLGMDVPSPWLVAPKESIYDLDNIKLSSLKPDANVDAIYALEHILIEGHSRDVTVKTAPRGVQLILGTEDNPHFADTIIMANLGYFQFKAQPGLWKINLKPGRSQRIFNLDSVGGQGYSPQPGDENNEVALLSFQGKTLFPRLSRKKGQEMEDVLDTDVKSGSAMDYVSKGFNFAQGVLSSVGVGSKDGLAEKQADINIFSVASGHLYERMLNIMMVSVMRNTKHTVKFWFIEQFLSPSFKSFLPHLAREYGFSYEMVTYKWPHWLRAQREKQREIWGYKILFLDVLFPLSLDKVIFVDADQIVRTDMYDLVSLDLEGAPYGFTPMCDSREEMEGFRFWKQGYWKNFLRGLPYHISALYVVDLNRFRALAAGDRLRGQYQMLSADPNSLSNLDQDLPNHMQHHIPIKSLPQEWLWCETWCSDDSLSTARTIDLCNNPQTKEPKLDRARRQVPEWTKYDDEIAALAERVALEQQRQQLEEMESADEDEESGWEKDEL

SEQ ID NO: 3905 - protein, 351 aa, Trichonephila clavipes
MTKSPFLIPLIALHDLELDVLHELILVTQLCFPFSFSVFASSMPIIGGIVEEWRTIWREVTSTFSGNKSDLENGDDKINIFSLASGHLYERLLRIMMLSVLKNTKTPVKFWFLKNFLSPTFKDFLPVMAKRYGFEYELVQYKWPRWLNQQSEKQRIIWGYKILFLDVLFPLDVKKIIFVDADQVVRADMKELVDLDLMGAPYGYTPFCDSRKDMDGYSALYVVDLKKFRRIAAGDRLRGQYQGLSQDPNSLSNLDQDLPNNMIHQVSIMSLPQEWLWCETWCSDATKQYAKTIDLCNNPKTKESKLASAMRIIPEWKDYDTEIKQLYKDYENNKIEPSEKGNKKTDQHEEL

SEQ ID NO: 3906 - protein, 1577 aa, Brachypodium distachyon
MAAARGSRSGVSGAALALLAAVLVGCLAGGASAAEIRRQKNVQVALRAKWAGTPLLLEANELLSKEGKDLFWGFVDHWKELDKGSECLTAKCCVQKIVEDVHSLIGEPLASIFEFSLTLRSASPRLVLYRQLAEESLSSVPVEDDALEQISGHGPVEGTCCWVDTGSALLFNSADLHKWLEGSGKRTMDSTGQPELFDFDHVYPRSNVTAPVAILYGAVGTKCFKELHVRLAEASKKGKVRYALRPVLPSGCQATSSFCASIGAVDAVTLSGYGVELALKNMEYKAMDDTAIKKGVALEDPKTEDLGQEVRGFIFSKILERKPELNDEAMAFRDYLLSSTVSDTLEVWELKDLGHQTAQRILHASDPLQSMQEINQNFPSVVSSLSRMKLDDSIKDEIIANQRMVPPGKSLMALNGALINIEDLDLYLLMDMVREELSLADQFIRLKLPKSAVHKILSAAPPAESNSFRVDFRASHVHYLNNLEEDDLYKRWRSNLNELLMPVYPGQMRYIRKNLFHAVYVLDPASACGAETIDTIMSLYQDSVPVRFGIIMYSSRFINVIEENDGTHQVNDGSKSEDDTSTLIIRLFLYIKETYSTQLAFEFLSNIHKLRNGGDDYSEEPVEAHHVEEAFVDSVLSGAKSHPQDVLLKLQKENMYKQEAEENSRFVHKLGLYKLHCCLLMNGLVHESNEDATMNAMNDELPRIQEQVYYGHIQSHTDVLEKFLSESSYKRYNPSITGKSTEKKRFVSLFASYHQEDSVLHDINYLHSDGTTDDVKPVTHLLAVDLSSKIGTKLLHEAICYLMDGSNRARVGLLLYARSDSASNILLMKDIIDRTISSFSDKEKVLGFLHGFCKFYESQHMPASTAVGDRISPMMDEVYNLAAETDLPVDDYKSWLASFSADTVLKRIDKLNDFLFGQLGLEFGSNAVITNGRIFVVGVGDSFLTDDLGLLESMEYELRTKYIHEIVEEVEWAGVDPDYLTSKFYSDITMLVSSSMSVRERPSERAHFEILHAEHSAIKLNYMNSSIHIDAVIDPLSPAGQKLSPLLRILWRQIQPSMRIVLNPISSLADLPLKNYYRFVLPSMDDFSNTDYSVHGPKAFFSNMPLSKTLTMNIDVPEPWLVEPVVAIHDLDNILLENLGDVRTLQAVFELEALLLTGHCMEKDREPPRGLQFILGTKQMPHLVDTLVMANLGYWQMKVSPGVWYLQLAPGRSADLYELPSKLIAIDSLRGKLIHIEVQKKKGKEHEDLLNADDENHFQEKMDLKDARQGETINIFSVASGHLYERFLKIMILSVLKKTQRPVKFWFIKNYLSPQFKDVIPHMAQEYGFGYELITYKWPTWLHKQKEKQRIIWAYKILFLDVIFPLSLRKVIFVDADQIVRTDMGELYDMNLKGRPLAYTPFCDNNKEMDGYRFWKQGFWKDHLRGRPYHISALYVVDLAKFRQTAAGDTLRVVYETLSKDPNSLSNLDQDLPNYAQHTVPIFSLPQEWLWCESWCGNATKARAKTIDLCNNPMTKEPKLQGARRIVPEWVDFDSEARQFTARILGENLESAEATSVPSDAPKPDDKDSRQDVKDEL

SEQ ID NO: 3907 - protein, 1820 aa, Leptomonas seymouri
MKMCTVKSPALQQLVVLLTLSVLLCIIQPTNAKGIRVTVEASWNETSFLQEGCEWAGRTFGPTAFYHCVDALWNFELPHAGGDGGDSSVNAAAGHEAVSARYSTQQVQYSALRKLVQTVTEAQLADKALFEMEMASRVYSPAVEAHYAAARKTLSEVAALTSTTEEGANTLASLRSRCSCGEPFGVLYTRALSADGQMSAQQVCSAAGLKEVLAALQQHHDIAGTSSPASSAPLVSVHDVSLPRLDYRHPSLAVQKKVSAVFVLYGLLGSSVTREMHTAAVEWLESCEGALGTTSGAAATPTLAYFFRHLPVSRTRLCGPKTSQDVSEGNDRAAFLSEQWDTPLAVQGYGVTVDIKNMEYKVLDEKAAAQQRAKEEAERKDAASSNSSVTDLPPSGQTDVVVGGFHIQRLKERYPDLALPLSELATLMEDEVGTKDLKVDFGVWELQNLGHAAAQYIREVKNNSHRLHALKDLVNRFPLYAATLSRIATQPSRFEVVQKALDSVRARLPSGLSALFVDGWRVEEKDLSLFGVLDALRANEILSHHIKRSLTTRLIPRSKEEGVTGVIEGAGDVATVKVKPALLEEVSNYLKRSVGRKAHTHDASSTGGIALAIPDQYVMWLNDVEAEEELKDLPKKLSTLLTRTPGITAFPRRNLLNVIFIWNVLKVSHVQKLNTIFHFGSQGQVARYGVLLLDPEWSPEVAQEKITDAAGQAPGFGGKSSLSWDILTIASIAYHLDAAGKPEAFLKVLMGLLQASMTSQTKLSDVISSDTVQQVCREVADSMLGESLDDLISNVDFLNYYHGTQELIRRFPMDAHPTTLLNGMVLGPSVGQYTTVLHNELTQLRKWVTSGALRDDMENLYAQILLLRGAVDHLQPALFRPPKTMLWTTTQALVAFIESAPYLYSAAYAFDVSSLTQILALPCHATQATLQQLQTVLSALQSCGDVTNEGAAHYAVCRRLRVSIVLCPDAVASGSSTSASIAAVPTSPAALDHILALLQKMAQRDVKETKRFIAVQRYISHLLKALSTSPTVSKAYRRTGVLDHETVTAALAHDPLPDDLKTEKTGAAAYMSQRSGGGKDFWVALEDAAPVSDFSVTLVTNGRIVTMDSTFTDWDVLYAASQALPMARAVEEVVLVVNFAEMAPSSAGVASYSSDEMDNAFYSGKIACLTTVFEHEINTRVSSTPPSPLSQEKSLFASAEDQKRMRVLLFSLNNTPNGAAAPGEDDAAGEQGELHQITAVVDPSSRDAQPIVSIVSYLMQSPLKLRLKVLLNPSPAVMLPIRNFYEYVANAKVNFDPLSGRVVAPVATLAPLPKHLLLTIGAEEPPSWTVFSQEAEVDLDNILLSKLSPGIPFVSAVYRMHSILVTGDTTDVLTGNPPVGLPLSLIPAHGGRYSNDAYMRSTDTQVMANQNGYYQLQAAPGQWYLSVKPGPVAAAYCIEAVDTYSIPACAEGRREVNFSQGHHIPVVIDSFSGRHLSLRVRHTPLRSLAASAESGGNVEDLHEFLKKMAANVTYVWPPKWNSRGAQAHPPKKPTLNIFSVASGHLYERFLRMMFYSVHKTSSDKYGANTTRIKFWAIENFLSPQFKRYIPLLAAELGFEVGFVTYRWPLWLPRQTEKQRKIWAYKILFLDVLFPLDVDRIIFVDADQTAQADLHELYNMNIGRSPVAMTPFCQTHRNEDTARFRFWEHGFWAEHLKGKPYHISAIFLVDLRQFRAMLAGDIYRSVYASLADDPNSLANLDQDLPNYLQAKIPIFSLPEQWLWCETWCSADSKSAAKTIDLCNNPLTKMPKLDNAKMVIPGWEELDNKLQNMSDSLLGLYG

SEQ ID NO: 3908 - protein, 1299 aa, Mesocricetus auratus
  MOD_RES (290)..(290): Any amino acid
MGSRGDANAAGASAARWVTGLCYNMRLLIALASLCLFSLVEANSKAITTSLTTKWFSAPLLLEASVRTLRMQTLSASCTGLTHRQIAVDEPPPEGCKSFFSVHGQQTCDFDSLESLLLTAPDRPKPLLFKGDHRYPSSNPESPVVIFYSEIGHEEFSNIHYQLKSKSKEGKINYVFRHYISNPRKEPVYLSGYGVELAIKSTEYKAKDDTQVKGTDVNTTVIGENDPIDEVQGFLFGKLRELYPTLEEQLKEFRKHLVESTNEMAPLKVWQLQDLSFQTAARILAAPVEXALIIFLFFRAITKTAVSSQLRTEVEENQKYFKGTMGLQPGDSALFINGLHIDLDTQDIFRIGFIFVVNDSEDVDGLQDAGVAVLRAYNYVVQEVDGYHAFQTLTNDARGYYEQTGVGPLPVVLFNGMPFEKEQLDPDELETITMHKILETTSFFQRAVYLGELPHDQDVVEYIMNQPNVVPRINSRILTAKREYLDLTASNNFFVDDFARFSTLDSKGKTAAIANSMNYLTKKGMSSKEIYDDSFIRPVTFWIVGDFDSPSGRQLLYDAIKHQKTSNNVRISMINNPSQEISYSNTPIFRAIWAALQTQTSNSAKNFITKMTKEETAEALAAGVDIGEFSVGGMDVSLFKEAFESSKMDPILSHALYCRDVLKLKKGQRVVISNGRASYKDNHKPHLIRVDTTYWYPHLPPPPTLFPLISMLMFCSFDFFFSAIKLKPNEGDTYYDVVAVVDPVTREAQRLAPLLLVLTQLINMNLRVFMNCQSKLSDMPLKSFYRYVLEPEISFAADNSFAKGPIAKFLDMPQSPLFTLNLNTPESWMVESVRTPYDLDNIYLEEVDSVVTAEYELEYLLLEGHCYDITTGQPPRGLQFTLGTSANPTIVDTIVMANLGYFQLKANPGAWILRLRKGRSDDIYRIYSHDGTDSPPDANDVVVNLNNFKSKIIKVKVQKKADMVNEDLLSDGTNENESGFWDSFKWGFSGQKTEEVKQEKDDIINIFSVASGHLYERFLRIMMLSVLKNTKTPVKFWFLKNYLSPTFKEFIPYMARKYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQILFQEEKEMGTLQEVRTQEGPQEHEEL

SEQ ID NO: 3909 - protein, 1414 aa, Colinus virginianus
MAALPLGRKRKRGARKRRQRREPEGRVAARLGGLPGRPARPRPRGGQRERQRKVDLFSSSLLDLPYKMGILIAILGAWFSCSFVKGDSKAVTTSLTTKWSSTPLLLETSEFLSEESQEKFWNFVEASQNIRTAEHDGSDHSAYHEMLKVASQSLSPLQQNLLKFSLSLRSYSATVQAFQQIAADEPPPEGCTLFFAVHGEKTCEYDSLGALLKAASGRPKPFLFKGDHTYPASNPDSPVVILYAEIGTEGFYRVHKLLVKKAEAGEITYVLRHYIANPSEEKVYLSGYGVELAIKSTEYKAKDDTQVKGTDVNATVIDEDDPIDEVQGFLFGKLRQLYPDLNEELKELRKHLVESTNEMAPLKVWQLQDLSFQTAARILAAPSVDALMVMKDLSQNFPTKASLFDVLRNEARVMEGLHSLGIEGFSLHNILKLNIQPSDSDYAVDIRSPAISVLIVDPAHETTAELLNVAEMFLSNHIPLRVGLVFVVNDCDDVDGLQDPGVALLRVYNYVAQEMDNNYAFQTVMSIYNKVKTGDQLKVEHVVSVLEKEYPYVEVNSVLGIDSAYDQNRKAARSYYEQTGVGPLPVVLFNGMPFQKDQLDPDDLETVTMHKILETTSIFQRAVYLGELSNDQDVVEYIMNQPNVVPRINSRILMSDREYLDLTAMNNFYVDDFARFSTLDSREKTAAVANSMTYLTKRGMSSKEIYDDSFVRPVTFWIVGDFDKPSGRQLLYDAIKHQKSSNNVRISMINNPSEDPNSSNTVVAKAIWAALQTQTSNNAKNFITKMAKEEVAKALEAGADILEFAVGGMDTNIFKEAFESPKVDFILSHAIYCRDVLKLKKGQRAVISNGRIIGPLEDGEMFNQDDFHLLENIILKTSGQKIKSQIQQLGFEEDLASDLVMKVDALLSAQPKGEARIEYHFFEERHSAVKLRPKEGETYFDVVAIVDPVTRDAQRLAPLLLVLNQLINMNLRVFMNCQSKLSDMPLKSFYRYVLEPEISFTAENSFASGPIAKFLDMPQSPLFTLNLNTPESWMVESVRTPYDLDNIYLEEVDNIVAAEYELEYLLLEGHCYDITTGQPPRGLQFTLGTSTNPVIVDTIVMANLGYFQLKANPGAWTLRLRKGRSEDIYRIYSHDGTDSPPEANEVVVVLNNFKSKIIKVKDFIPYMAKKYNFQYELVQYKWPRWLHQQTEKQRIIWGYKILFLDVLFPLAVDKILFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAMRIVPEWQDYDQEIKQLHNLFQKEKETGTPAQMSGQHTQDAAAHVEL

SEQ ID NO: 3910 - protein, 1657 aa, Micromonas pusilla
MTCWSAFACIHAIFFTCVIIVVAEESTSASKVVSVTLTTEWQLTLSPSHHTGHRFSKATSSLLEAAEFFADEGDDQYWAFVEDWNESGEKDCQGNVYEYLERRAASEETLKVLKLSLSVRNYSPRLEMFRSLWSSTITAVKRTDGEKETAGCCLVMVGDKFARTKEELASLLATTSSGTPTAGRQATRLDHIYPGKASIPSSRRIFDSTQVFTSIPIVTFYGAMGTPCFGHFHALLKSASAQGQVHYVHRPVIMNAECARKGCIGLGTHVDTIGIDGNVGRLHVVGYGVELAVKNMEYKASDDSIMNDIGALLLAPIASESHDSLAFEVVKGFNFSRLNYRYPELNRELTSFRHYLVGKTAEDETLKIWDIKDLGLQATQRILLADDPFQMMMDISQNFPSLASSLSRLDLDSTICAEIENNQKHVSPGSLFMSINSEPIELDTVDIFTLADKITSEIREAARFRDIGLGSTAVRELLRLRIAPPGSELNFPRLNLFDSTTVPIISFNKNIESDRNYAHWSPDIMQLMRHSQLGQVPPVRRNMFNVILILNLGQSNSWRLVDALHEYTRAGVPLRLAYVLVDDSEGDTVKELWNPTSFLTDFAEFEEKEELDINFPRGLSLGTVIGRAGNLILRRFGGEAQVDFVNEVANARGVMFPGNHFIPAVKSKVTWSLVQKAFTRIFIQWYSKVDSVDSDDLVAPDMTKVHSLIDAHVANILSLAGATESEPGAYLSEAKALIADKGVAAPSALVNGIYFTLDDAERLGAEMEQVVMHFVQQEANSIAEAVLSGVLSNEILDKYPGGIFGWLHRTAVAKNTPFIVDNVKYPPTYVEMRPPQDNSEGLLAYIENCDVKASKGNTLWVVADAGTRKGMDLIASACECAARTRADGESTNSRVAVLHPPGVVATHRARAVALVSRWKTGYYCGNYSTFLSEILSSDAPETIKSALSALGMEQYASDSGMDDEELNTLLEQQGNFVASLIGMDANDSSESGTDSIVIANGRVIQIPTGYHMDADDFALLISKESSARGATVRNILESHSPVIPVSSSFNIFDQYMIACSLVAIRQTKSVSRSQVRTLESLESKHSAVIVQGDGVVVMDAVLDPLSKEAQRIAPLFYVLRDALFPHISIRIILNPRRELMEIPIKSYFRYAAPNPSLDAIPRVHFSQLPHHQTLTAHLDVPEAWLVTTVVATYDLDNLKLSDLPEEQDTMDAEYRIEALLVTGYCSESGAKDPPRGTQLILGDAGTVVMSNLGYFQLPAAPGVFELSLRPGRSADMYVFAEHVESTNSDVLLTVKEEHSARDVTYSSVEIIVSSWQGMTTQISLQRRPGMEREDVLPIHRGKDKDGGLWNKIISKWRNAKRSRLETINVFSVASGHLYERFLKIMMLSVRRNTNNPVKFWFIKNWLSPQFKDILPHIAAKYGFEYELVTYKWPTWLHKQTEKQRIIWAYKLLFLDVLFPLTLNKVIFVDADQVVRSNLKELWEMDLRGAPYAYTPFCDNNPEMEGYRFWKHGFWQTHLAGKPYHISALYVVDLETFRHTAAGDKLRLIYETLSKDPSSLANLDQDLPNYAQHQVPIFTLPQQWLWCESWCGNDTKTAAKTIDLCNNPMTKEPKLIGAARIVEEWTSLDEEVRSFTKQLEEHLLADKYVFTPPVRALS

SEQ ID NO: 3911 - protein, 1335 aa, Zygosaccharomyces bailii
MKIYLAFFTVLLYLKAVQCVLLSSIGTSVPESAKIWSIASYLLRNCNENILQSIYPMILQLDDETEDSLGDSLCYTVAKLISDLGEPHLASLMPLYCKWYPMGNQDPHERYTYVPNELYFILNGKKYENPDDVYYLKSGELKKQAQLPDSKMLAPGEVVIGNNREAPIVHFYGCPDEKGVFQEFNRNLFSEATQTGKLRFIWRSTCSLEKTALGPFPVALTTKEQSNLENLPQEILKIPESFDKSKYDLLTPREDEFTNVDLKAAKLIADHYQNNQNFDAAFLYAKDFVNNFPILVSELLSLSGDTDVISKSNDELANKGVDHNLLGLYINGQNWKVSSLNEVTLLDALEAELHKLRQLSFSLSKIDNRVSLLTAKNLINDFARISLPNLQQSQPVKLDLHRIRGFSESVIYFNDIEIDDQYHDLSQDIEKFFEKSKFGEIPEYRHNWSELIFVIDFNNLEDPDTKLALEGLQRAISVITQGYPQRIGLLPLNTGEAESIIKKIYHLRDKDLLLLEDFLKDLPIGRGRISADYQNTPDTAKLLRNLQIDQTSIIINGEIYPFRKNTWHYLVAKTIKKDTGFLKRELSKYIKHDEGKVRPMIDVRGILHLKSSETRHKKYTPDYFADSTYTAMDNTVLDVWNDRLCEYFKGKEYNVLHTITIVDDFNTVQALKRLYNLVHVKFVGIRFRAIHTGILSSTWNKVKDSSSKSSFNSILKSIIKKCSHYEPKYQLDDIVLQSWLPDLTPLFFSAKSFMIINGRFLHFEIDEIPQTKLFEATIKREAQRTLDTLEALEISYPGFSEKKIDSELVESISAILTKMFYQGTDIYHNGPDYSTETSLSRIDLTKILEINNFTIFQNVNHELRPIDLVLIVDPLEERTQKFYSLLEEVKGLSFVNLKIVLYPTKDLKIMPINRIYVQDFKNELGSKLPELSKIFDVEIEAPSNLAITSNQRVIGYVIEVHAFDKDDAVSEGVVDGIGGVCLELVDAKENVVDQTITMKTFGYAQFIAPQLWCQYYVRSCDPQYKVISFSSDARSDYLPVKSFDLKNFNPIKVYVQLEKTAAPVISAERENIINIFTVLKNDIAAEGNYKKMVLSILLSPQRHQQDVKFWILDQPYLSASLKKFIEDVNSDPQLDAKIELIQYKWPSWLRPQRFIARRIDALKILLLDVLFPQTVQKVFYMDPEISQLPDPFKLNEKITTKLPFAMFKMVGHGYWETGYWAKRIGEHNLKFHSVEPMFAINLKKFRDLDGGDKLRIHYQRLSADANSLAKVDQDLINDVQEEVPIRTLSRSTIKYLKTDPHVIEAWLEKKEAGTSLSGDDTELLSESNEVLHDEL

SEQ ID NO: 3912 - protein, 1584 aa, Acanthamoeba castellanii
MPDEPWGLNSSPPGMPLPSISKLHCAPGSLTKPVNRREFFAEETSQGFWAVVDGLHPGAAEDTDDTATTEETLYGKVMQLANALLPSSSKRLLHYALLSRYYSPKVEMFRQYSRGQAEHCRNAAWVHAGTHMLCTPEEVQRYLEQPNSRNESGSVPEATLVFGDQEHLFPNAAPSSAPLLVLYGQVGSSKFTQYHSVIRVAASASTVRYAVRHYTPEEPAKRLMNVQGYGVELAIKSTEYKVIDDKVPEKDQDGDDEQQSGQEQDTTIEGFQFDKLKQRKPELATELDAFKEHLEMVSQQNEGFQQLRAWQIKSLGYQAAQRIMSAGEPLQLLRDIAHNFPPIANSLARLRVDADIRSEIEDNQEQLAGLHHLPGNFINMNGRNLAADQLSPYVLYEFIKDELSKLDALSVFGLGRKDSEKLLSLVPSTPTIRFDLRDREVFPSGGTPATDDPNNVNGAIQFANNLEKDAMYGHWPGIHALLQPVYPGQMRYIKKNIQTMILVIDPSSPQGLSVIGNFLYMLRQGLPFRVGFVFSSGSTTESASTWEHSAENLAKLAKGESGDASQGSTESADNAPLPENLAATIIKTYFLLKQRSGEGVRPLDFFGFLGQSEEEATEVTEERVWQAFAAFMHQQGGSITQSEWREGMKSEAVATEYRTMQRYIEQKGIALLDRGSQYIFTNGKFQQIPADSSVGSALQNLLMQETFYGYSRFQEAAYKRELQHVDDLWSWILQESSPVFDRFSSLIFQTTGEDENGWVSLARHRELLAPATAYLSFPASEFNLKEYTHLVVGDLTTRPGLTQALEAVMRLAEEGSEKVRVGFLHNTEQDSQQVPPERRENEFLVARALQAALTSGKTLKRVFPFVTRLLATALAVGPENVRAAHIEELALAAELKDLPALMSKTVAAAYAQFERDRNLASSALGLLPGQRAVVTNGKVTRLPDQVMLVQDLKLLEAFEGLARVDQIRATLDGVSEHFGVDPDDLTSEFYSNELAAAVSVLSAETASSEQRVNLPQLTPSFVAGEQNDPTLKIVAVLDPLSKGAQQIAPLLLSLVNNDMGIQVQVVLNPKRDLTELPLKTFYRYVLQDELVFDAAGRLARKGEAVFNNLPTSLLLTMNMDTPHSWVVQAVRSCIDVDKGSPAVGLQINLGNHQQSHITDTTVMANLGYFQLKANPGLWWLSLGKRFGDEQQEGVSPYQLLSTDGRTPVPRLAAKIDRFTNTEYLQPYKVKRGAAQQVEGTKEELAKQDGGMWGQWMSYFQDSQKDTAEAEAKKDETIHIFSVASGHLYERFLKIMMLTVLKNTKSPVKFWFLENYLSPKFKEYAPVFSQAYNTSIELVTYQWPSWLHHETEKQRVIWGYKILFLDVLFPMDLRKVIFVDADQIVRTDLKELYDMDLKGAPLAYTPFCSSRTEMNGFRFWDSGFWKNHLGGRPYHISALYVIDLKRFREMAAGDVIRATYQQLSQDENSLANLDQDLPNFLQNRVPIFSLPQEWLWCETWCDDESKARAKTIDLCNNPLTKTPKLENAVRIIPEWRDLDEEARSIEERYSSSFASSATATATTAPDAAAADHVPPPTAPFEEIHA

SEQ ID NO: 3913 - protein, 1648 aa, Trichuris trichiura
MLRMWRIVVHGGVLPLLLVWFYAARPSSCRATQKNVIAYVQSKWADTPLVVEASEFMAHEGDGYFWKFIEVLGKNESNMGSGIGLSMVSLTLSLLICQHFPATDEIMYERLIGIAKSVLDSKSRVKLFQFALAIRCYSPSVEMYRQLSLSLSGRPAGHVFVDVHGQLSANINSLDELLNQAIERSPPIFSFDHLYAARSNKAKKWAILYANLESNDFITWHNLLKSRAKKGELNYVFRHLPRLRIAFKVGKGKVPLSGYSVELAIKSTEYKAQDDAKIRSKPTAGTNLTDDGDEEETDLDGFNIRLLKLLHPELRDKLDEFKLHLLEADELAPLKVWQLQDLSFQAGQRILLAAKEDVLHTLQELSQNFPLMASILNGCQARIPQRSGDQSSTVWRVVSRTYSLRLKEAFSEFGIEPGDSAIFINGMRIDLDEMDIFALLDKLKKEERLLAGFFDMGFRVNGRQNMQIASFVFLFVQKETQSLLYRISSETSSSKFAVDYTQWLPDVSWRLAECCDFASLVYFQFVNDLEKDPQYRQWGNSVQLLLQPYFPGMIRPIARNFFTLVRSRHFRWLLVIHFAATDARRYLPFNLATTAQEIFCKLRNRFTSTKAHWEDDFTSCRVGLILATNPDKKVSGYSDGGVALLNAYNFVKGDKSIERALKFVLHVYSRVPSGNVTSSDVIDVFKQKYPDEDLTTVFDVDSDYNTGRQRWAQFAQSSGLNKLPSVLLNGFPMADNDVTSDQFEEAVVLEVSQVTSELQRAVLEGKLTDGVDVQRFILNKPFVLPKLNPKVLATDNKALILTDVMGRAYVGIARSSQSVAVSEYKVSTVGEFKKLERKQQNQYIVQSRRYLTKNDESILRPVTLWVVANVATKDGRDLYLAAIRSLKQLPNERVGLIHNIARKDKVGYAIASLIQACLKLPLHQAKVVITKMLEKQLKSMEELEKLDIHGVDWNFLQKELNKKGEDIVAIDSYYSTRILNIPSGKVGLIINGIILSDVTSKDFSSAEDFALIEKYLLSSGCKVIASQIRKWNVPHEDGRSSDLVMRVFSLLKAYASDTKRQWVTPLMQNDSCVDILSKDMMSATFEIVAIVDPLSASAQQISHLLSTIGHVINADITLCMNCKPKLSDIPLKRFLRVAIPTQLEFNQDGSLKRQPVARFSILPQKQLFTLNVIAPHSWLVEATEAAYDLDNIKMSDAFTDVVGIFELEHLLLEGHCFDEVTGSPPRGLQFTLGTAEQPVMFDTIVMANLGYFQLKANPGAWLLRLREGRSKEIYKVNSLDGAQVSNDERMVVILDNFGGLSKSRSLLPNFASRSNFGSLLQVAKKPDKFEEELLPTSGEEDEESSLWQSISKFVTKFTSSKDDYDVLNVFSLASGHLYERFLRSAVYSESVDMHCSKIMMLSVMKHAKSPVKFWLLKNYLSPHFKAFLPFMAKRYKFSYELVQYKWPRWLHQQTVKQRVMWGYKILFLDVLFPLDVKKIIFVDADQVVRTNLMDLMKLDLEGAPYGYTPFCDSRKEMEGYRFWKTGYWKQHLGDRKYHISALYVVDLKKFRQIAAGDRLRGQYHGLSKDPNSLSNLDQCNNPMTKEPKLQSAMRIIEEWRDYDAEIKKLLDEYDRQRGIERSASNEKEEEEEEEPQQPSGTLADKLST

SEQ ID NO: 3914 - protein, 1480 aa, Exophiala spinifera
MQLPSLLRQSAAGGLLCAALLTPLIGASPSINVALETSFSAAPYLVELLETAALENSSSYFPLLDRIADGAFVDLQTEQQLYNKFIEVLQQDGHLSNPESLSSFKFALALHAAAPRVEAHFQYYNHSVQPHLMAAQDAACPVWVYLDGQQYCSPALDRAQQAVSMPEAEELLPFDRVLGSNIEAPPSILYADVTHPLFGQFHTIISQTAREGRSTYRLRYRPSAVAASQPLYVSGYGVELVLKRTDYIVIDDRDAQKSEASKPEQVSLQQAEDDDLTDLKPLTSSEVVSLGVNAASLIASSPDPLERLLQITSDFPRYSSVLASTNASKEFLAEHRANREQFLPSGYNVFWINGVQIEPRLINAYSLLEHLRRERRIIGNLQKIGLTPSEAVSLMSSEVIAETQANESPQRFDWRDDLEENKVLMWLNDLEQDKRYAAWPSSLRALFGRVYPGQLPQVARDIHNLVVPIDVTDLKDIELVTTALQNLVKRSVPIRIALVPTGVGAIADTYSKLSYHILDTYGLGTLMSFFTEITTSKKLPENPQKVFTATTKDRPVREGKQATPYEEILKAETLNDQLKARDNYVKRLALASSSRPFIVNGVVLPRSENWFEVLSSRVFSDLQLLQQAIYEGAIEEDGWVPGILLFAAATRRNELVFPSDPKDVEIVDVSRLTNDFADQFASLPRVPGNAAALLSDRAHVLVVTDLNTAGGRGFLQQSLDFWETHPEADLLLLHNPSSKTEPTSVASGLHALTRQSRDLTIEQVRTLLEQDTTSSEGEEEAGRFWASYQNLLNEVGLAAGQNGLWLNGRVIAPVDESFEATDFESLLEYERRERIAPVTTAITGLGLEERFGDALDVAKVTSLVARSLKSDLPEGLRESAPLIRMDRFKVWNDTYTSFKTSNGDNPTIQVVAVVDPASEIVQQWVPLLRTLSQLRGVNVKIFLNPKDRLTELPVKRFYRQVIGSEPTFDSDGFLQKPTASFQRIPRDTLFNLGMTVPPSWLVAPKECTNDLDNIKLSSVADGENIDALYELEHILIEGHARDVTTGPPPRGVQLLLGTEQEPHFTDTIIMANLGYFQFKANPGFWHITLKPGRSSKIFNIDSVGPKGYAAQPDDETTSVALLSFQGVTLFPRLSRKPGMEDEDVLEASGGAMDYFNKGASFASSALSSLGLKTGSSNNADINIFSVASGHLYERMLNIMMVSVMKHTKHSVKFWFIEQFLSPSFKSTLPDLARHYGFDYEMVTYKWPHWLRGQKEKQREIWGYKILFLDVLFPLDLDKVIFVDADQIVRTDMMELNRVDLKGAPYGFTPMCDSRTEMEGFRFWKQGYWETYLRGKPYHISALYVVDLKRFRQLAAGDRLRQQYQALSSDPNSLSNLDQDLPNHMQHVLPIHSLSQEWLWCETWCSDESLGVAKTIDLCNNPLTKEPKLDRARRQVPEWTEYDEEISGVLKEAAGKRRIQSPEADAAAEEIVVDERKRDEL

SEQ ID NO: 3915 - protein, 1365 aa, Saccharomyces arboricola
MRLLALVSIILCAPFWALAHSLRYGVPESVQVWSILVHLLGDFDVQLLAELYPLVTGLDEEVEAQENLVALTSNVLRERYAREDVADLLDLYARLYPMGVVHDSARSDTTQEPADGNYFVLNSKRYEKSDDIFYLKSKDLVSQQKLPDFNVIQPYDVVIGSNPEAPILVLYGCPTVDNLDFEEFNRNLFMEAMNEEGKIRFIWRPTCSLDGEDVEQPLNFPLAITLQDDCNVSSIPQLNKILSTVPSGLSVETAHNDRLHELKPEELRELDLKVTSLFSKYYQDNHDTLATLNFMKNIVNNFPLLDKQLAGISSVDNEIIVSNEKLDSKGFDFNMLGLYINGQNWKITSLDSYNLLNALKIEYENLLKIASLLQNLDSSKGILDSKLLLNKFSQFSLGKLQNLQPIKMDLHTIPGFSESIIYFNDIENDPQYNELINNVQTFFDKSKFGELPEIRQNWSEIIFVIDFAHLEDNDVKEALSGLVRAIGVVSQGYPQRVGLLPFNSGSDKSIVNKIYELKNSINGPAELKTFLETMLLADELTANTENSKYESVPDVHSLLSDLQIDETSIIINGEIYPFRKNTWNYLIAKVIKKDTEFLRKELSTSSSKNKQVSVRDLLHYKSANLRHNKYIPNYFADSLYSSVNNTALKSIGQDRIMTYTKDKKYNILHTITLVDDFNSINALERLQNLLGISFVGVRIRVIHVGDVSNSWAQLRDSLSKNDPIISINKFIDGLKTKIGRSNKYSKDSLNQVNLHKWLPDIPLFELETGSFIVLNGRFIHLDQKEVPEVKHFEAILKREAIRTIDSVFSLDLFFHDFSQKRIDPDFIEMISSTLTRLFYQSTHIYGNGIEYTTESSLPRMDLSQFFEPNNLTMFEDGKSAPIDLLLILDPLEERSQLILSLVEQVKSLQFINIQVVLMPTLELNIVPIRRIYVDDTEIVKTITSESNGIYQELDIEMDVPNSFVIDNNYHMKELLIELHAFSNKTALSAGNIDGVGGVCLELVDHAGKVIDRTTTMKTFGYGQFRTDKFLKGCSIRSCDSRYTVQSYSVDGHPSFIPSDYLDILSYTPYRISVKLAEQFSYEEDNEESDSYESSVNIFTVLEAGLREEEKYKQMVLSILSKCSESQQVNFFILDQPFISDSLKKYCEYINVSNEMRGNITFLHYEWPQWLRPQRFSSRRRDVSKFLFLDVIFPQNVSKILYMTPTETPFNPFDLFQFHGLRRAPLGLFRMNGNGYWREAYWEKMLRENNLEFYSTEPGFLINLERFRELNAGDKYRIHYQRVSSDARSLVNIGQDLVNDLQLEVPIRFLKGSYKKKLIIDEKLVAEWSDNINAFISSVDDGKSAEGDHGSEDQDYGDSTFLHDEL

SEQ ID NO: 3916 - protein, 293 aa, Thermomyces dupontii
  MOD_RES (19)..(19): Any amino acid
  MOD_RES (23)..(24): Any amino acid
  MOD_RES (28)..(28): Any amino acid
  MOD_RES (65)..(65): Any amino acid
  MOD_RES (116)..(116): Any amino acid
  MOD_RES (134)..(134): Any amino acid
  MOD_RES (141)..(141): Any amino acid
  MOD_RES (208)..(208): Any amino acid
  MOD_RES (211)..(211): Any amino acid
GSADINIFSVASGHLYERXLNIXXVSVXKHTKHSVKFWFIEQFLSPSFKKFLPHLAKEYGFSYEXVTYKWPHWLRGQREKQREIWGYKILFLDVLFPLSLDKVIFVDADQIVRTDXYDLVQLDLEGAPYGFTPXCDSRKEXEGFRFWKQGYWKSHLRGRPYHISALYVVDLNRFRALAAGDRLRGQYHTLSADPNSLANLDQDLPNNXQAXIPIKSLPQEWLWCETWCADEDLKTARTIDLCNNPLTKEPKLDRARRQVPEWTEYDNEIAELAVRVRAASKQSRREEDEKKDV

SEQ ID NO: 3917 - protein, 1715 aa, Vitis vinifera
MGTHFRSGFWVLVVLACASLCWNGSVVADNRRPKNVQVAVRAKWSGTPLLLEAGELLAKERKDLFWRFIEVWLSAEKDDADSFTAKDCLKKIVKYGHSLLSESLASLFEFSLTLRSASPRLVLYRQLAEESLSSFPLTDENPFLVGVNPKSPGGKCCWVDTGGSLFFDGAELLLWLRSPTESGSFQPPELFDFDHIHFGSSVSSPVTILYGALGTDCFREFHVILAEAAKEGKVKYVVRPVLPSGCETKIGHCGVVGTKDPLNLGGYGVELALKNMEYKAMDDSMIKKGVTLEDPRTEDLSQEVRGFIFSKILERKPELSSEIMAFRDYLLSSTISDTLDVWELKDLGHQTAQRIVHASDPLQSMQEINQNFPSVVSSLSRMKLNDSVKDEIIANQRMIPPGKSLMALNGAIINIDDIDLYLLMDMVHQELSLADQFSKLKIPQSTVQKLLATQPPPESNMFRIDFRSTHVHYLNDLEEDARYRRWRSNINEILMPVFPGQLRYIRKNLFHAVYVLDPASVCGLESVDMIISMYENNLPMRFGVILYSTTFIKMVEMSGGELQVSKAEDGQVEEDISNLIIRLFIYIKEDQGTQMAFQFLSNVNRLRTESEDSSGALEVHHVEGAFVETLLPKAKTPPQDILLKLQKEQNFKELSQESSIFVLKLGLSKLQCCLLMNGLVFDTNEDALINAMNDELPRIQEQVYYGHISSHTNVLEKFLSESGIQRYNPQIIADTKVKPRFISLASSVLGGESVLNDISYLHSPDTIDDLKPVTHLLAVDITSRKGMKLLREGIRYLIGGPKSSRLGVLFSVNPGPDSPSLLFVKVFEITASSYSHKKKVLNFLDQLCSFYASEYMLASSIVVEGTQAFIDKVCELADANGIPSKGYKSILSEFSVDEFRGHLNKVAQFLYRQLGLESGSNAVITNGRVMVAVDEGTILSHDLLLLESVEFKQRIKFILEIIEEVKWQDMDPDMLTSKFISDVIMFVSSAMATRDRSSESARFEILNAKYSAVLLNNGNSSIHIDAVVDPLSPSGQKLASLLRVLWKYIQPSMRIILNPLSSLVDIPLKNYYRYVVPTMDDFSSTDYTINGPKAFFANMPLSKTLTMNLDVPEPWLVEPVIAVHDLDNILLENLGDTRTLQAVFELEALLLTGHCSEKDHDPPRGLQLILGTKSTPHLVDTLVMANLGYWQMKVFPGVWYLQLAPGRSSELYLLKEGGVGSQDSPLSKRITINDLRGKLVHLEVVKKKGKEHENLLISSDDNHLQDGKKGNHDSWNSNLLKWASGFISGGEQLKKSESTSVSLVLDHIVYQTFAMGSALVVTQVSLIKCMIQVHALINFGGCVKIPALIGSQMQRTYNKLNKKSTIILNTPLKAFKRSSVYFITFLYTLEGSLILLGHGKGGRRGKTINIFSIASGHLYERFLKIMILSVLKNSNRPVKFWFIKNYLSPQFKDVIPHMAQEYGFEYELITYKWPTWLHKQKEKQRIIWAYKILFLDVIFPLSLEKVIFVDADQIVRADMGELYDMDIKGRPLAYTPFCDNNKDMDGYRFWRQGFWKDHLRGKPYHISALYVVDLVKFRETAAGDNLRVFYETLSKDPNSLSNLDQDLPNFAQHTVPIFSLPQEWLWCESWCGNATKSKAKTIDLCNNPMTKEPKLQGARRIVPEWQDLDFEARQFTAKVSGEVDPQEPVTPPKQSQDPITDSSPEEDDQESKSEL

SEQ ID NO: 3918 - protein, 1631 aa, Cicer arietinum
MGYRSARSSLLLLFVLFFVSTLADTRSPKNVQTALRAKWSGTPLLLEAGELLSKHQQNLYWNFIDIWLNANSNADSQTQTQTQTHTAKFCAKQILEHGRSLLNEPLASLFEFSLILRSASPTLLLYRQLAHDSLSSFPLTHHDHEIFETLNNNTQLDPLRVGVSLQSPGGKCCWVDTGEHLFFHVSELLSWLQNHPLHSQLVDDSFQSPPVFDFDHVYFGSTTGSPVAILYGALGTQCFQEFHNVLVGAAKQGKVKYVLRPVLPAGCEAHIGHCGSVGVSESVNLGGYGVELALKNMEYKAMDDSTIKKGVTLEDPRTEDLSQEVRGFIFSKILDRKPELTSEIMAFRDYLLSATVSDTLDVWELKDLGHQTVQRIVQASDPLQSMQDINQNFPSIVSYLSRMKLDDSVRDEIIANQRMLPPGKSLMAINGALVNVEDIDLYMLIDLVHQDLLLADQFSKLKIPRSTVRKLLSTLPPPESDMFRVDFRSTHVHYLNNLEEDAKYKWWRTNLNEILMPVFPGQLRQIRKNLFHAVFVLDPATSCSLESIDMIISLYENTFPVRFGIVLYSSKYIRQLEDHSAKEDGDKFEDDLSNMIIRLFSYIKGNYGIEMAFKFLSNVNKLRIESDDHVDDAQLEQHHVESAFVETILPKVKSPPQEILLKLEKDPELKELSQESSKLVFKLGLSKIKCPLLMNGLVIDPNEEALLNALNDETQRIQEQVYYGQIKSDTDVLAKFLSEAGIQRYNPRIISDNKPRFISLSTFTFGEASILNDINYLHSPGTMDDLKPVTHLLAVDITSGSGLKLLRQGLNYLIEGSNDARVGLLFSGNQSTDLFSLLFVKVFEVTTSSYSHKKNALDFLDQVCSLYQQKYILTSAVKADDIQAFIAKVCELAEANGLPSEGYRSSLSEFSADDVRRHLSEVEKFLSTSLGSESGVNAVFTNGRVTSPIDENTFLSADLYLLESIELKKRTKHIVEIIEEVNWQDVDPDMLTSKFISDIVMSVSSSMSMRERSSESARFEILNDEYSAIILNNENSSIHIDAVLDPLSPTSQKLSGILRVLWKYIQPSMRIVLNPLSSLADLPLKNYYRYVVPSMDDFSNIDSSINGPKAFFANMPLSKTLTMNLDVPEPWLVEPVLTVHDLDNILLENLGDTRTLQAVFELEALVLTGHCSEKDHEPPRGLQLILGTKTSPHLVDTLVMANLGYWQMKVSPGVWFLQLAPGRSSELYIFKEDDDGSKNKQSSKLITINSLRGKVVHMEVMKRRGKEHEKLLIPDEDEDLQDKKKGSSWNSNLLKWASGFISSNEQSKNAESNSPEDGRGRRHGKTINIFSIASGHLYERFLKIMILSVLKNTHRPVKFWFIKNYLSPPFKDLIPHMAQEYGFEYELITYKWPTWLHKQKEKQRIIWAYKILFLDVIFPLSLEKVIFVDADQIVRTDMGELYDMDLKGKPLAYTPFCDNNKEMDGYRFWRQGFWKDHLRGKPYHISALYVVDLKKFRETAAGDNLRVFYETLSKDPNSLSNLDQDLPNYAQHTVPIFSLPQEWLWCESWCGNATKSKAKTIDLCNNPMTKEPKLQGARRIVSEWPDLDFEARKFTARILGDDQEPIQLPIQSKDLTNEDSLKEDLESKAEL

SEQ ID NO: 3919 - protein, 1527 aa, Durio zibethinus
MGTGFRSRFFILISLAYLIFCGFNFVGAQNRRPKNVQIAIRAKWSGTPLLLEAGELLSKESKNLFWEFIDNWEHVAKTDGDSHSAKDCLKKILKHGSSLLSEPLASLFEFSLTLRSASPRLVLYRQLAEESLSSFPLSDDSYSNNVNGMDASEAIETKKSDPLLVGVNPKSPGGKCCWVDTGGALFFDIAELQSWLQRPNELSGESFQQPELYDFDHIHFDSNIVSPVAILYGAPGTDCFQEFHVTLVRAAKEGKVKYVVRPVLPSGCEGEVGLCGAVGARDSLHLGGYGVELALKNMEYKAMDDSTIKKGVTLEDPRTEDLSQEVRGFIFSKILERKPELTSEIMAFRDYLLSSAISDTLDVWELKDLGHQTAQRIVQASDPLQSMQEINQNFPSVVSSLSRMKLNDSIKDEIIANQRMIPPGKSLMALNGALINIEDIDLYLLIDLVHQELSLADQFSKLKIPHSTVRKLLSTVTPPESDMFRVDFRSAHVHYLNNLEEDAMYRQWRSNINDILMPVFPGQLRYIRKNLFHAVYVLDPATVCGLQSIDMITSFYENSFPMRFGVILYSTQLFKKIEGSGGELHSFALEHDSEIEDDKSSLIIRLFIYIKENHGTQSAFQFLNNVNRLRMESADSTDEALEMHHIEGAFVETVLPKAKSPPQEILLKLEKEQTFKELSQESSLFVFKLGVGKLQCCLLMNGLVFDSSEEALVNAMNDELPRIQEQVYYGQINSRTDILDKFLSENGVSRYNPQIIVDGKVKSRFVSLASSILGGESVLNEINYIHSVETVDDVKPVTHLLAVDVTSKKGIKLLHEGIRYLIGGSKNARVGVLFSASEDANSPSILLVKTFEITVASYSHKKKVLEFLDQLCSFYEHDYNLRSPAAAESTEAFIDKVYELAEANELSSKAYKSSLSKASALKLREHLNKVAQFLYRQFGIASGVNAVITNGRVTSLDAGVFLSHDLHLLESVEFKHRIKHIVEIIEEVNWQGIDPDMLTSKYISDIIMFVSSSMATRDRSTENARFEILNAQYSHDLDNILLENLGDTRTLQAVFELEALVLTGHCAEKDRDPPRGLQLILGTKNTPHLVDTIVMANLGYWQMKVSPGVWYLQLAPGRSSELYLFRDGGDDGSQEKSLSKRITINDLRGKVVHLEVAKKKGKEQEKLLISADHDNHSKEKRGHNGWNSNFLKWATGFIGGSEQSRKSDDSLVKHGKGGRHGKTVNIFSIASGHLYERFLKIMILSVLKNTRRPVKFWFIKNYLSPQFKDVIPQMAEEYGFEYELITYKWPTWLHKQKEKQRIIWAYKILFLDVIFPLSLEKVIFVDADQVVRADMGELYDMDIKGRPLAYTPFCDNNKDMDGYRFWRQGFWKDHLRGKPYHISALYVVDLVKFRETAAGDNLRVFYETLSKDPNSLANLDQDLPNYAQHTVPIFSLPQEWLWCESWCGNATKPRAKTIDLCNNPMTKEPKLKGARRIVSEWTDLDFEARIFTAKILGDELDNPEPVASSEPTSNDRTLEDLESKSEL

SEQ ID NO: 3920 - protein, 1441 aa, Candida haemulonis
MLLSPIWLLATAATAKSVSVKLHADWPEAPFAVQLIEAVSSYDDTLYASAVRALYQSGEEEEALEWDEDDDAFEDAGDAEGDALPKSDKDFYNAVAANLSPVEKGMADLNLVNKINTPRIETHYKHYKNDVEPALEAKVLKQCAQDSFGNAVEDPLGAWVKYGDRIYCSDADLYALQLSKVSEEAKAFDRVVGTADKKPLLVLYGSSSSPRFGQMFETLYQFAESDKLRFAWRYVPSGTEKLTSVPGYGVVVTPKVPLNGTKVSKVRYTGDLPKFLAEVRKQDKPLRALEEDRYHDLSVKITALVLEQPESTRHAVLEDILNNLPLYAPYINLIKDPVGLESVKTVAESNEKKGASDQSVGLYLNGASVHKLEMDLPHVIRKLETELRLVDEMKKLGFSTEQSKFIFSKFALMSAFREVQYRTGDRENRYAIYKHAYDPTDSTSGGVVYFNNLEKDDPYDLFDVNRREAYLGADARRLQFGQVPALRENSHELVFAINFSSSIQVKVLFTFAKIILDRNLPQQVAVVPLVDSDEDELVAEKFYHIMEVSEAKEAFALLYQYYEAPTQEEKQEILDKVEVPEEKKGTFKNYERTVREFSLDHPSVIINGVIHDMKSPWQAAMTKQMGSDVRLLQKKIKDGEDRGQDLKSVLFHDAKDSRNSRVSPRDLSNIRYKEVSKELIDNSYSFRKVTKPNDSPATFWLIGDFNSRIILSQFAKLLELLEVYSERSLEIRILNISEDSSLIDKLSKKYAKDSLTGDDIAKLRTEVSKARSKAYTKISPSKAKLLEKHQIQAHSPGMLFNSRYLKLNELYETPELTELVDFEQRRRLSIFKDLTDTYPDMFSWRGIMFFKKSGFDNFEWFDIMSSIVAKSFFLEDSQVQGDVDRFDFSALSFSNSLNLTKQRRDAPVDVLAIVDPMSDISQKIISMVGALKDLPFANVRILLQPLEAVSESASTSRFYGSAFVSSLPEFGKDGSFLGGNYAASFQALPSKYGFSSELDVPSRWLHVKDSTPNVDHEEFYPKDVEELNYKLDSLIVEGYAKDVKTAQSVATLTFDASNKDTIIDGIVMHTLGYVQLQLKPDIWSLRIQKGSTGSQIYNLLSASVNKYDTNDKTVEEVDLPVLSLHGEVIHPRLLEKSDKERAKAKKDVAKTNNADINVFSLASGKIYERFMSTMMLSVKKNTKSTVKFWLLRNFLSAEFVESLPKLANAHGFEYEFVTYKWPLWLRQQKEKHRQVWGYKILFLDVLFPNQLDKVIFVDADQTARTDLKELVNTDLKGRVYGFPPMCDSREEVEGYRFWKQGYWKTVLQEDLKYHISALFVVDLNEFRKHYAGDRLRTHYQKLSSDKESLSNLDQDLPNNMQRSIPIHTLKQDWLWCETWCSDESKSRAKMIDLCSDPFRKESKLERVQRSIPEWKDYDKQIQRLQNNEDGKSPVNVGHDEL

SEQ ID NO: 3921 - protein, 1574 aa, Serendipita vermifera
MKPSIGAIKTLLALTSLAVSTYASAPVTVGLRTSWPAHNLLLEILETAALEDSASFFPLLDTLTNPDEFTTPLPKLAPEAIYQATLSTIKAQGYLVDETEVKRFELALSLHVASPKLQAFYQFYEDKHLERGGKVLGGDGVAEQDCASWVDWYGTKICGADDLSNVLAREGLDSGKAKPKPNQAKLLPFDHIIPDPSSTIFRPARTAVLYGDLTSSNFRSLHELLLASATSMPPKIQYIFRHVPPPKVVADVKVKPKKQFLTGYGVGLDLKKMDYLALDDRRTKGSGSSEEVTEVSTEEAPAIDPIRELLDSLPPKDGEPINLSNPLTKEEFASLGVQAAQFILNSSKPIETLVQLSQDFPRYATELSKKVEIDPELQFEMAKIESMVPKGTSMLWLNGKVIDNHNDFNPFKLINLLRSERQIMQGFTDLGLTPGQAMEVLTGRPVFESFSQGSALDGIFDVSDREEGGDVIIWLNDLENDDRYSRWPKELESILAPIYPGSFHSVRLNLWNIVLAVDLSNRESLVWIFKHVSNIINRKFPFRWGIVPLVDTPEGEKAARIFYYVQKHYGPKEVMDFIRSLIAAQNEGDTLDFLIANAFFNNLGINVAPLLKLELDQSFSHDYDTVIEGQEPHSIEQLNKAKEWARRIDVKNQQGQLGHGFLSGKYYPLDETFLVNLQQELPLLLNHLQGEVAAGRLNSHNKDIRMSTYFYDLPSTPKRRNRYLFPNPETAPLKVHRLDTLFRHAGFEYPYKDLVYPYSSSPLVVTTWVIGDMDEASTMELIELTLTVLSKQKDFRLGLIHAPQRLPMSDATSTPRVSTLLQQLSGKYDNMSPDELLLRIKSGVPTPVHSGDYLDYCISGQLLAREIGFQPGDLGLLINGRVIGPIEPNVFQMADFEPMIAYEKRRRVDPLLNALTEAGKRYADMTSTAASIVAAVHIPDPTEAGLFKMPLRPRQRGYRQLAASHSRITLGDEQSALYHFVVLLDPVSEIAQRWSSLLLWLSRLDSVYLELLMVTDQTREELPLKRFYRSALWDRLAFSEDGEETPSLVSFQNLPEEPIYTLAMDVPPSWLVRPRESEHDLDNIHLASLSGYERITGVKALFDLDFLVIEGHARDVTTSSPPRGLQLQLKTNDLTPIADTLVVENLGYLQFKAKPGVFLLEIMKGRGEDIYQIESVGNGGWDSPPVNSVAGAEITLTSFEGLTLYPRFRRHRGQASADVLKPQREGFISSAVQKVVQAVSTWIQPPAEKPQADINIFTVASGHLYERFASIMISSVMKNTNSTVKFWFIENFLSPSFLEFIPHLAEEYKFEYELVTYKWPSWLRSQREKQRVIWGYKILFLDVLFPMDLKKVIFVDADQIVRTDLQELVDLDLHGAPYGYTPMGDDNTEMEGFRFWKTGYWKDYLRGKPYHISALYVVDLVRFRQLAAGDRLRGHYQQLSADPNSLANLDQDLPNNMQFEVPIFSLDKDWLWCETWCNKDRLDKAKTIDLCQNPLTKEPKLSRARQIPEWSQYDAEIAAFARRLVKEGKIGSSALSAEVDALAGEKQKPATPNMSTEGEEGVPKEESRMQHEEL

SEQ ID NO: 3922 - protein, 1481 aa, Wallemia mellicola
MLGRSVFLTALLAFASADIHAPPPISVDVQASWNQPPYCEIAMEIAHKLEPGILNKLLPKVDCSATPEEIYSKTRQQVKKSKQSLFDLHIALESSSPAIVAAYNVAEDAGFYYDPSCPNFVVYQGRKLCDVDEIDRLDQQAWPESDTFYTTGSTLDHVLSEPTSEDPPIIIHYADPTAENFKPFFDYFIKRSKRLQYILRWAPTRDHSFRPQKLSGWGVKMDLKKREYLSHDDRVNAEKINNIQTNVASDMSDEEYGVLQPFLKEAFTKPLQTIETKEDIRSLSGNLIALLQKSDNPLGLLTAITQNLPLLAPQLAETDLDGSNDILKELSYNQEKYIEAGQNAVWLNGRRLYDVDIEPFSLLRQLENENKLIDSISTLGFSKSDAIKLLNHRALYAAQVTRPDSIAEGLVDASDRIEGGDVVRWINDLEKDEQYRNKSWSPYLRSLLSPLGRVARNYINCVLVVDLSKNEAIEMLSRNVRAFIDRGIPVRWGVTPYINSLNDDSLMATKLFYNLIDKRGVKTCLDYFSDIAIRTGTFAERAEAAYLDLPILNDVPLQDEFDTVMEDMAKNKILKKAQKYARRLGVSPGEHEIDFIGEIFVNGRPIMFDDRLILSLQEHISAQTDAITKAVYKAEIDERSDVSLYFYDKPSTLKRRNKYLQPSSKIMNYVHSESDFFETTFVVPDTPERIDVTIWLVSDFNKPESMELIKHALSGMIVSPTFRLGFVHNPSELETPTGSISQTIKGLPERVSPLEFFEALQDRGEIPEDAEGMEGASEWIYETDIEPGESGLIVNGRVIGPIPPNGLEEEDYSHLFQYDYAERVLPIVTALEEIAPHRLKGNVDDVANLLTQLGSQLWKNIQNEQPEGIYEPPHTPRARVLERLHSKHTSIRLGKELSSQYSLDVILDPFSEQGQKWSKILHAIAEAGDTYIRIVFNPNLDSDKIAANRFYRFNMHAKPRFDENGHVIDYATKFSQMPVDALFTLELDPPQAWLTRPVYAPVDLDNLNLATAPYKNLNAIYQLDKLVVDGHARDSRTSLPPRGLQLSLKDTTIDTQVVANLGYLQLAVVPGRWELEIREGRGRDVYELESIGSAGWNSPSVKEGLKDFIVDSFEGVKLYPRFLKKPGMEGIDVLSEQHEDGLLPFVKQSITSLKSFFGLRSKSEHADINIFTVASGLLYERFASIMILSVLKHTDHTVKFWFIENFLSPSFIEFLPHLAKEYNFKYELVTYKWPSWLRPQKERQRMLWAYKILFLDVLFPMSLDKIIFVDADNIVRTDLKELIDVDLHGRAYGYPPIGMDRQEMDGYRFWTRGYWKDYLRGRNYHISALYVVDLKRFRQMAAGDRLRGQYQGLSADPGSLANLDQDLPNNFQTEVPIHSLDKSWLWCQTWNSDESLADAKTIDLCNNPMTKEPKLERARKIPEWTDYDRDIQDFSAKLASEKLIKSLLVTETEDLAQGPKVTWEEKTEEGDIKNNHLKDEL

SEQ ID NO: 3923 - protein, 1156 aa, Python bivittatus
HLRESLELQPGEARLFLNGLPIDLDLRDPFSILETLKTEGKVMHILHSLGIKGDLPSKFMRLAAQAQDASYALDIRHSSIVWVNNIETDPMYNKWPSSFQELLKPAYAGMMRQIRRNLYNMVLFIDPLQEEAAGFMKLIEIIYTQKVPLRIGFVFILNTDKVVDGNEDAGVALWRAFNYVAEEVDIPQAFVSVINMYHEVKDGGVLSVDHVKRVLRRQFPHADMEEILGVDSDYDHKRKAGAMFYKKTGLGPLPQALFNGVPFNRKEMNIAELETSLLKIMDATEAFQRAVFMGLLNDHKDAVDFIMEQQNIVSHINDRILGDEKRYLNFESPSVPVDTNDYSTFSFLDSQDKTFVISENMNYVTRQDDALIYPVTIWIVADYDKPDGRQLLSTALKHLKTSSHIQLGIVNNPTSKITEDNTIIARAIMAAFLTQKNSNLKNFLGRILKDETAGALAAGTKIKKFFFPGMDNDALEKKYNTLGVDIIQTHQVFCHEVLKLLPGEMAVVINGRILGPLKEDELNTEDFDLLEKITLNTAAAKIKTLVKEMGVDNKRGSNLVMKVNALLSSLPITDDRQDVEFFKDQHSILKINPEQNEPYFDLIGIVDPLTREAQKLSHLLIVLGQIVNMKLRLFMNCRSNLSEVPLKSFYRLVMEPELSVGSNNFFPLSLGANFLEMPESPLLTLNMITPESWLVEAVSSPYDLDNIHLKDVDGMVSAEYELEYLLLEGHCYDVTTRKPPRGLQFTLGTRNNPVKVDTIVMANLGYFQLKANPGAWILRLREGRSEEIYQVFKHEGADSSEGLEEVIVVLNSFRSKIIRIQVEKKTDNDNEDLLNEVTTEEKEVSMTSSTGGTWKAEMEKKTDVLNIFSVASGHLYERFLRIMMLSVLRHTKTPVKFWFLKNYLSPTFKEVIPYMAEEYGFEYELVQYKWPRWLHQETEKQRLIWGYKILFLDVLFPLAVDKIIFVDADQIVRSDLKELRDINLKGAPYGYTPFCDSRREMDGYRFWKSGYWASHLGKRKYHISALYVVDLKIFRKIAAGDRLRGQYQALSQDPNSLSNLDQDLPNNMIHQVTIKSLPQEWLWCETWCSDESKEKAKTIDLCNNPKTKEPKLEAAVRIVPEWTDYDSEIQKLINRIRKEKRSRTLFHPKESKHDEL

SEQ ID NO: 3924 - protein, 1677 aa, Capsaspora owczarzaki
MRHSKIHTMRRLVAVLLPLLLLLAPATSCASSASPPVHLTLRAKWHATPLIAEASEYMARAGKFWEFLDTTVRLPFAAPSSSTGAAPTDRAMYAALVHAASEHITLTEIAVMEFALAMRYYSVAVDTQFQLASSHFAAVINRADSGADTAPRNPCDHDLAVVRPGVGIACRIADLDALLLGSTNAPNALAASVADTIFPSDHVFPAARGASAPIMTIILYASFESQLLGAFSTRLRELANNGQIQLVFRHLAPSTLASTTASVTRASSQPAQLSGYGVELAIKSLEYKAVDDSKISEALHKQSDLSGIETSDELGGFLFGRLREIYPDSQADLVKLREHMWKEINTLTELKQWELAELGLQASQTVLQSQDPLASLLDIARNMPSMYRPLSRMKLNSTVQDVIIAGSSKVGQLGFGQGTSALFLNGLSIPLDEDVFTILDRFDAETRAYNQLLRIGVPSEQIVSLVHLGVRPQPVPVVAVDVNSPAVIWINNLERDDVYARFPPLLRDMLRPSYPGQMKYVRKNVFHYLFVADLSSPTSYIGIAQLIDAVARMTPVRFGVVFVSGNELLGPNSSPFSIAMREEVSLGKGHVGSLLEVILRLFLHALDEHDRLAAMRFLHSINPTARQDQAVSLKAVRARYEEMGFDSEEFDTVILPTSGYNQAIGDWNDMVNQRGIYQYPATFLNGVYRPFDMVDAPGQMHQDYFQQLYPILMDIHHRVVHEQTDMYAHALSKNQAMARLSLRVIPTDEASIRFASYETTAAEHFLASVRWLYRNEVEHTGATSFSHLLVVSDFVAEHNLRLLRQAFTYLSTGHARKSSRMAVLLNPSRGDVDQVTVFWGLVMQAVSQSQAPVVAGEFAMILFQRLHEQLGGAAEIAHTLPEAVSLLSKVKNSKPDVFAKVFESLDDATFRAGLLSNNAHVQGMFDTSAGTTVIVTNGRIYGPISSADRLSWHDFKLIEENQTRESVRQLTSVVNGLTTSQDKSILLIRAHAVLGSFKGERSRIIGHVSAAPGAIETSSVIADPVLPKFHVVALVDPLSQEAQRLVPLLHTIRDALPVTMRIILTPVHKIDAIKVNRYYRMVLDPRVVFDAQHRMSNVPAAHFSGLPTAPLYTLAVDTPNAWLIGSVSCSYDLDNIRLSDVKTAVTAVFELEHLLIQGSCFEQSGAAPRGLQLIAEPLVADGAAKAKDTVVMETMGYFQLQLSPGVWRVAVRPGRPAEMYSIGFVAEDPNQQFLQLMSRGKQDVVLRTASTVYYPDAHVDSELVAAMTDLRGKNVVFLAQRRPAAVQQDLLYELYQASIAEQKEQRARRAEASAAAAAAAEAAAAAEAPATTAEEKPQEGGVWASFTNLLGGQKAADQKAEAADSEVAMIQPRMPDPNLETIHVFSVASGHLYERFLRIMLLSVVNNTRHPVKFWLIKNYLSPQFKESIHFLAEQFHFEVELVTYKWPAWVFAQTNKIRTIWAYKILFLDVLFPLGVHKIIFVDSDQTVRADLAELAAIDLKGAPYGYVPFCSDRREMDGFRFWDSGYWKTHLAGRPYHISALYVIDLIRFRAISAGDQLRASYQQLAPDPNSLSNLDQDLPNNMMHQLPIFSLPSEWLWCETWCSDEAKKRAKTIDLCNNPLTKEPKLAAATRILPEWPSYDVTIKAVLEQFEANQTAAAQPVVADSEPTESHTEL

SEQ ID NO: 3925 - protein, 1592 aa, Serpula lacrymans
MHYFLALALALFPFANASPPVSVQLRTPWLSPGPLLETIETISIEDPSAFFPLLSLLSTNPPDPNASPKTVHAHVLDLASPLLDGPARASVDALLVLHAASPRIAAFEQHFLARTHEQAVEDASGETCAAWVDWYGHVVCTVDGLKRAVSSISFEHKPQPRSLPFDHVYPSPHSQKPTAIFYASLTAPNFPALHHALVDLTQSAGIEYVLRWAVSPDPQSTRAHDKDALGASLSGYGVSLDLKKMDYLALDDRGRSASTGQGERDRWYVLYSRLSQLIRVHLHPAYTDLGLRATQLIYSYSSPSKREDDKSHENSVTASLSPLTLLRQLTHSFPLYATKLARKDLLDEHDAWAGHQPTGVLSPLFDSVRSNWEKVAPGTSLFWVNGRVLGEGEVGVFGLIRTLRKERSLVRALMQLGMSTREAVEVVVHDAHSRTGADGDYADKDITRRGKGGGVVVWWNDLGADARYARYSSSLSVLLRPLYPGQLPMTRFNLFNAILVLDLAQPRTLSFLAMSLEGIVARGWAVRWGIVPFVEWKEGEGTKMARLFYFVSEKYGRDVIIGFLKRVPAHVQTPTLSWPLVRMAWADFGMPDDFDSVVEGRVVASVGDEAEKDGGNVDTLHKARLYARRVGITDASGHAFVNGRYIGMSDAFLRDLQVEVTQQLQYLQELVYTSILTDSYVPTISTFFYDLPWTPARRNAHIYPLISSPASGGVQPAGSSARPLRMFSLPELPKVVGKGGFVTPREFPMYVIADFDSESGLALVKEALDFIQGSGPSSRVTFVHNPAPSTHSHSVSSLLSQLISKDVLATISPARLKRALGLDEAGSVSTPDESAQVALKADLLREYGVDGGEVVVAEDAYAGYVGSCKALARELRLLPGEQAILVNGRLVGPFDASEFMVEDFEMLETYEMRKRVGSVVVALEDVLGEKADDLDSSSYAHLVSTSSSLISAIQLPDPSEAGLFDTAPKPRSRKYKLLDGNYTSFEIGNADDALYHVAAVVDPLSETAQKWTSLLEWLVEFPGVYLELYLNPSQHSEIPLKRFYRYNLAPRLTYDENGLEVPAKVVFNGLPIEPIYTLGMDVPSSWLVRPREALYDLDNIQLGSLSPQDRVTGLEAVFALDYLVVEGHARETLLNSPPRGLQLQLSTPDGTPVDDTQVVANLGYLQFKAKPGVYELSIREGRGRDVFEMESVGNEGWESPRVEEVGSEVTVMSFEGLTLYPRLVRKPGMEMVDVLDELSYKEEETHGVIEDIVSRMTSLFSHKGEKSLQAQGDGQADINIFTVASGLLYERFVSIMILSVLRNTNKTVKFWFIENFLSPSFLEFIPHLAEAYNFQYELVTYKWPSWLRAQKEKQRIIWAYKILFLDVLFPMDLKKVIFVDADQIVRADLQELVDLDLHGAPYGYTPMGDDNYDMEGFRFWKTGYWADFLRGRPYHISALYVVDLVRFRQIAAGDILRGQYQALSADPNSLANLDQDLPNNIQQQVPIFSLHEDWLWCETWCNKDRLHRAKTIDLCQNPLTKEPKLARARQIPEWEEYDAEIARFARKLAEEGKIRASAATADTNVLANVGATPQAAESVGDNSEEARPRDEL

SEQ ID NO: 3926 - protein, 1305 aa, Trichomonas vaginalis
MLSFLLFSLATSTFRPDHEVVMSVVAPWDETPLFEHILFFMTDFSSEMATQFLRDIVKNHDQLNNETFIWETAFRILPKFHHAFLKSQISIGFYTPRGEMYREMARTKGGSNYNDLMIIGEKLNTFGILCHYLPSDDLDVQPFELQYGIPQSIVYANIYNKEVAEYVIKLIDENIPFSFRPTSKTGKFGVNLRGFGIEMRPFKYSMEYGVKDSIVLESSKEVSLHKDETTENITGIPESYYDLLKEDMFAEKFTSWLENHNDTSLVKRMRDFTNNYPLYINEILKTNISNSSIGSLDQLYRMRYNGQTLSSLNGRVLSLPNLDIFTLIDVINKERVSRQILTDEFKLNETQLDVIFKSYKEDSRSIFFDTRSKYVHYYNDVMTDPHFDDYTDDFSIFYTPLNQMPRVRRPLAQYVLYIDPTTNNGFTELYYATNLIEEGYTVNLGLVPYFNLGSKLSKRIAFAFHHIARNVNSSEAIQFLLDAHYVLGVDMDSRTLYPTSPATYKAAYQLHANSKCLKWDELYKLFAGSPELDAILDTISYIKNAQIAIPCSYMNGKKVETSNGMNVIYYHAQTAITELAGLIRRFRITKDDDFDVFDIISRRYFVAKSLNEEVLYSTPKSLKISTLTYDRQLEYIDLISKTKWDYSNEGRLTNYFFLFCNDSVDTTTFFDFAKRKRFNSAQFKVNPEIPKNLRSIFPSSNSTCSLVVNGRVYEDIDPNDFEFYQLADDWNTYFILDGLFALDQSVKRRRVECLAYSSSLIIDWMAQSVVRRHDSDDFFQVKNPMIYATQNSTSDIVWELVVDPLTREFQRIASIINWVEKNNLAQIRLCLVLPFALNDSLTTLTTYYRSALDEDIAVFTMLNDTTTYSAMPDMPMSWVYESMRASTDLDNILLSQLKTHSQEGVYVLTNILLEGNCQTSDYQTAEGTELAIENEMGERLSDTTSMMNGYFQLQANPGKFNIEIGGARSASIFELPKTTVIIGSFVNPVAKILLNYRPGKEGMKANNVTASGDFATTDRVDVFSVASGHLYERLMKIMMLSVRKRSTHNVKFWIVKNFLSPTFKATLPIMAEKYNFSYQLVSYKWPTWLRGQVEKQRIIWGNKILFLDTIFPLDLERVIYIDADQTVRADLNELMRMDFQGAPYAFTPMCNSRNETEPFRFWKQGYWLNHLQGKPYHISALFAIDLLKFRQMAAGDLLRYHYHHLSSDPGSLANLDQDLPNYAQHQIPIFSLPQEWLWCETWCSDETMAKAKTIDLCNNPLTHAPKLHIAQTRIEEWPGLDELARNISAGPDDYQYKFFKKQETE

SEQ ID NO: 3927 - protein, 1404 aa, Naegleria gruberi
MEGNIIVDGSFVSFKFSEFVYRNLLFSEYFSDKLPDRKTSFLKSIPCEKVDQIKNDRNAILTLAQQSKATVAEVSLLDFALDTRHYSPRVKVQYTKNTNIVKSNLNTIVPKNVEDIEVLDHTFNINSETQINFIYSDITTQEGCKFVKENIDSIKPIVLRLVRLDSTGSIDKEEMIKEKYMEEASSDLLSIRGYGVELQIKNMEYKQTADDDVVSGNDTFYKGVNFNKLKKNYPHLSNDLDTLKLHIQQSDSKSEKLKVWEMKYFGVQAMKKISDQPSFDEKIKMLQDISQNFPSYMKELKNTAFENSFKDQIQSHLSRYDGEFKSRNPNNPQEVIRRNALFLNGLELDLTKLSVFSLFETMDKELKLVKSLSSDYHLSSNSVESVLFTPSTASKDLRFKFSSELEKQVIWFNNIESDSYNNFPRDLKSMLHPTMYGQMRFVRRNLFNVVFILDPASTQKQVAQLLYILGNIMNRGYPIRIGALFIPKVSSGFVDVDLTGSSSASPETVDELSLHAVSLLERMAKENRAVFPILREFMDRESFDSQFVDDLQKRFFGSVRLMSQQELISRYRSFTNMGFDVKSSPIVMVNGAVIQGEEQDSGDQLVMKGVREQYDAVKNLIENNVVVDNDKNLLEKIINHYGGFDKFNSEIFSKKQYGIVSLGDIDQINFVQHPESGGVVKKTHIVCVGDNQDASLLVKEAISFISKNQKTRIGFLNVADSSFSSLAKYHVLYKPNGSNQLSGKNFCSKHFNAKESGIISMNGRIIPLTNLFTSKDITILDAFEDVNSAIISTIESNSYSTVDPDIVTSDYLSDVLFGVSSVLKVFNQYKRQDLNHVQSSSVATLETESNPSAEIKLIAILNPLSKFAQKISPLIRFVKEKLGKSVNVVVHLNPDLETSNLPLQSYYTYVLSGSSVAEFNTRFSDVKGRIFTMWMDVPESWLVDSTYAKEDLDNLKLDECASQKCYARFQLEYFVASGTCIDDNGRPVRGLQLQLVHNYGVNATNVDDTTLVMANYGYFQLRASSPNIYSVNLPKGRHSDIYSVQSTKQVDFYSQSELQHSDGYGSADTKKFLISVHSFDAPFARVVVKRNSGMEKEDLLAPTPSSGGWSSWLSSNSNQEKKTIHIFSLASGLMYERLLKIMILSVRKHLKRSDVKVKFWFLKQFLSPSLKQFLPEYAKAYNFEYGLISYQWPHWLHKQQTKQRLIWAYKVLFLDVLFPLQEVNKIIFVDADQVCRTDMSELFFDLDMQGKALAYTPFCESRKEMDGYRFWKTGYWANHLGGRPYHISALYVVDIDMFRRNYHGDQFRMVYDNLARDPNSLSNLDQDLPNYAQHNVPIRSLPQEWLWCESWCSDESKAKAKTIDLCNNPQTKEHKLASAKRIIPEWTDYDNEIKDFQKKLVVGK

SEQ ID NO: 3928 - protein, 1628 aa, Steccherinum ochraceum
MRSSPLFGIALLVCRSFASPPVQVRLHSSWPAPPVLLEAIETVSDNNPNAFFPLLHETTSEDSLLALQNSIPQELYQYVLDVALRQGYLADTSTTTLAATKMNLGLHSAIPKIQAFYQYYQDRHARRDADDCGSWVDWYGQVVCNAETLAHLAGVETIDASEGHGGDSNYDPPPLLPFDHVHPAVSQLSRPPRTAIFYASLSSSNFRSLHEYLFKASSGSSPHVEYVLRPIPPKDRDASKRSYLRGYGVALDLKKMEYLAVDDRRSSQNDASDTKTETDTSTEVDPIVTLLHQYPENSTADYTSALTSTELLHIGLQSAQLIYDSTNQDLEDASTPPTRDPINALKTLKQLAQYFPKYASTLARRVTVDAGLQSEVAQNGQKVQGGANAAWLNGVVLQEKDMNPFSLLRFMRKERGIMLSLLAQGLSSEQAITLLTHRTVGAAQSESGALDGIFDASDRPEGGDLIMWWNDFEKDERYARWGNTIRLLLRPMYPGQFPSIKLNLMNIVLAVDLSQTSSLNFIGTAVDNIINRSFPFRFGVVPIVETEEGLQMARLFYWLIENVGREKTMQFIQRIGQVDVPPQFLTYHVQWPLVRSEFSAVLTSLTPEDVQPDALSFDALKNTKLDDILKGTGTVGDTVVGAIESKVEKAKEYATRLGVSLEGGSQGSTFVNGKWFELNDEFLRNMQMEIGEQMQHLQAELYADTITDDDSASMSTYFYDLPSSLKRRNKHIFPSKKTGSLKILSLPDLNARFGLPLSEGAFVYPKAADREDEESEKEADIPISTYVIADLDSQGGKKLVREALESLASSHNARVTFIHNPSATPEDHQHPVSSVIGQLISSNALSQLTADRLLNGLPLADSLKNTEQGDEAVFQADDTLLDDLSLPISDSPFLKASSAVVHELQLKPGEQALVVNGRVVGPFADGDFAAGDIQALNSYEYRKRVQPVVQALEDIFGTLKNHTRESLATLIASASSIVSSIRLPDPSEAGLFNAPLRPRLRNYQLLGNDYTKYEFGRNETAMLHFGFVIDPLSEIAQKWSSIIEWLLNDPSVFVELHINPAKYRDLPLKRFYRYNLPAELSFDQHGAEAQSFAVFSNLPVEPIYTLAMDVPQAWLVRPRKAQYDLDNIQLGVIPASEQAQGVLAVFDLDYLVIEGHARDAVQMAPPRGLQLQLSTPDANEDSLAIADTQVVANLGYLQFRVKPGVFKLEIREGRGQDVFTIESVGNEGWDSPGVEEIGDEVTLTSFEGLTLYPRFKRVPGMESVDVLASEVKKEEESKGLLGDVLSGFSSMFSSKPPPPPSTEVIAVDHADINIFTVASGLLYERFASIMILSVLRNTNSTVKFWFIENFLSPSFLEFIPHFAKAYNFKYELVTYKWPSWLRAQKEKQRIIWAYKILFLDVLFPMDLNKVIFVDADQIVRADLKELVELDLHGAPYGYTPMGDDNTDMEGFRFWKTGYWKDFLHGLPYHISALYVVDLVRFRQMAAGDILRQHYQALSADPNSLANLDQDLPNNLQREVPIFSLPEDWLWCETWCSKDRLDRAKTIDLCQNPLTKEPKLARARQIPEWSEYDSEIARFAKQLAERGDIDSGIAAVDTTVLADQAAGVAKAKTPDTKEREEDEHVRDEL

SEQ ID NO: 3929 - protein, 1571 aa, Lottia gigantea
MVLKLLTSILIVIHTIVYVEGKAKSVNVALDAKWRSTPLLLEASEFLAKESPDYFWRFLQDVTNLDPKQISKESNQSLYNSIQKFAGRHLSPLQLNLLKLSLSLRAFSPKVQVYQQLGNEAVSSKKCSTFVNVQSEETCDVDKIVDLIKSAGDRSPPVVYSFDHSYPGPQQHKIKVILYGELGTQDFKQFYSKILNLIVDEPIHFIVRHFVQTPANVNVRLSGYGVELAIKSTEYKAKDDTKVEGMRESDNGSKDQDIEGEEVQGFIFSKLRERHPELKENLREFRHHLIDSETELAPLKVWQLQDLSLQAAERILSSDNKESLSVLTDISQNFPTQARSLVGTSVSSELKKEISKNQEVFERHHSLGVGESALYLNGLTIDLDVFDIFTVLDTMNSEAKLIEGLHSLGFKGDNLDKLLHIDLKSGDDTRYAIDIRHSAVQYLNDLENDRGYQGWPNSIQDILRPTFPGMLRHVAKNIFHLVFVVNPVEDKSKDLLKMAEAFSVHKAPIRIGIIFVTNQDEKATPKTDASMAMARAFNFIKLDQNPSKALSFITDVYEKASTADELTSDLIIKEFQSQFPGEDNDIVFGEDQDDYDDIRKAGLDFISRSGLSDFPQVLMNGVPFKKQFLSTDTFEEGVVTEIMTATPTIQKAVYNGELTDRENVLDWLMSKDNVLPRLNSRILSPEFKTLDLTENVDSSIFEDVSTFSRMTVKDMVAIVSDRMKYITKKGRFIKFELIIIIIDESSIRAVTLWLVCDVETPQGREIFYNAIKELKHSNEIRLGLVFNPASLTEDHIISRAIYVAYNTLGNNHAKSFITKLVKEENVAELKAGTKTLKDLEVHGMDMNKFMTDFNKQNKDFLKSYKSFVVKVLNFEENDRGVIANGRIVGPLGNDEMFTPEDFNLLEKFTLQQAAAKIREQIKTMDLDSKQGNELVLKTCSLLTGQPQIESRKKVQFHSDKHSVLKLSADESSPAFILEAIVDPVSREAQKLGPILMVLREIFNVEIRVFMNCRDKLSEMPLTSFYRYVLEPDVQFLSNGSLASGPEARFTSLPQKSLLTLNMNPPESWLVEAVRSVYDLDNILLEEVETGVSADFELEYLLLEGHCHDSNTMQPPRGLQFILGTDTQPAIVDTIVMANLGYFQLKANPGVWNLKLREGRSREIYDIQSHENTDSPDNSKDIITAIQDFKSKIIRVKVAKKADKQNEQLLVDDDKQSGLWDTLSSSLSGGGTNGEDESDKTLNIFSVASGHLYERFLRIMMLSVYKNTKSKVKFWFIKNFLSPSFKDFIPHMAKEYNFEYELVQYKWPRWLNQQKEKQRIIWGFVKVFVEISTNPIIFQFFFYKDRSFIVRTDMQELHDLDLGGAPYGYTPFCDSKREMDGFRFWKSGYWASHLAGRKYHISALYVVDLKRFRRIAAGDRLRGQYQGLSQDPNSLSNLDQDLPNNMIHQVAIKSLPQDWLYCETWCDPNTKKDAKTIDLCNNPLTKEPKLKAAMRIVPEWKNYDYEIKVLWDRIYGTNTRSQIEYNPPGVEAENIGWYTNLSICSSHSLISDLRSPTTVRERVCCGKRAMSY

SEQ ID NO: 3930 - protein, 1627 aa, Pyrrhoderma noxium
MRKSRRAKVVLCTCLSLVGCVTASPPVRVGLHTSWPKIPLLLEAIESISIEEPNAFFPLLNALVNSDTLPTLGKLSSEAIHQASLQTATELGYLQDPGAYASAELQISLHAAAPKVQAFYQFYKDQYSDSVPETNCGSWVDWYGERICDVDTLARVAGHETIDAEDPTSNNTYTRPKLLSFDHVTPDPSRIFQLPSRTAILYANPFSKNFQELHNYLYRLSSGRQPRIEYVFRHKPANSNSHQEKSYLSGYGIALDLKKMDYLVLDDRRAVNTENDGSSSQESLESDDDLILSLIEQYPLDDTDTSSPLSGEELKDLSLKATQLIVNSSDPLVVLKQLSQNFPKYASALSHHVVLNQSLVDEVQDNRLKVPGGINMMWLNGLSIQETDLTPLGLVRLLRKERSIARSLASIGLSPIQAVELLTNKYLAKSQSESAEALEGFFDASDRQEGGETIIWWNDITKDSRYARWNPSLTGLLRQVYPGQFHNIRQNLINVIIGLPLRFGVVPNVETEDGTKMAKLFYYMINTFGRAKTMNFLGHIGKIQASESFVDWTLIRNEYTKLKQGSDSTLSIAEFDSIFDGSIDESPSTEDEDSEEDKSQKDTEKTAVTLAERVERANAYIRRLDATQKSFPGGHAFVNGKHFDLDDSFLKLLQTEMNTQITIFQEKIYLGELGDANVDKIDTYFYDIPEAYSRRNRYVFPSSTINGLSGSARRDLRIVSLPEVFEKSDFTISPNSYIYPEGKEASTTIFVIADLDSESGVTIALEALKSLDAGLEARLSFIHNPVIETSRINDRRHHISPVISNLVSRGLLSNVPLNELKAILSLESSDYKDFMEALEQVAFSEDHGIKEILREAGSPTDGTKNSGAHEKYETASKLLLRDIGIAPGDLGLLINGRVIGPIEYGSFDDGDFATLVEYEKRKRTGPIIEALKNTSILLGDVSSYEYSEFISLASSVVSSVLLPDPSEQGLFNGNQRPRQTNYKQLADNYTSFSFGDPETSIYHFGILLDPLSETAQKWSSFLELVASVPYVYAQVYLNPGIYTEMPLKRFYRYSLPPRLSFNENGDETQAQIVFSDLPVEPIYTLGMDVPPSWLVRPKEAYYDLDNIQLTALSPEDKTSGLNAIFELDYIVIEGHARDVLTNAPPRGLQLELSSLDGSPIDDTQVVLNMGYIQFKAFPGVFQLDIREGRGRDIYLLESAGNEGWNSPTVSDAGTEITVTSFEGLTLYPRVRRRPGMERADVLDEFVIGDEEPEGILNDIASRIKSFFKSQEPEVKAIAPRQADINIFTVASGLLYERFASIMILSVLKNTDSSVKFWFIENFLSPSFLEFLPHFAEAYNFEYELVTYKWPSWLRAQKEKQRIIWAYKILFLDVLFPMDLKKVIFVDADQIVRADLQELVDLDLHGAPYGYTPMGDDNTDMEGFRFWKTGYWKDFLKGRPYHISALYVVDLARFRQVAAGDILRHHYQQLSQDPNSLANLDQDLPNNLQREVPIFSLHEDWLWCETWCSKERLHRAKTIDLCQNPLTKEPKLSRARQIPEWEEYDAEIARFARKLADEGKIRSHVSAADANALANAASGAGTPESHDKPVNREADTGEDKDIGRQSNAEFEGVNEAAGDEEQHRKDEL

SEQ ID NO: 3931 - protein, 1523 aa, Dinoponera quadriceps
MGVLIFFYTLLCLCSVQLRADKKINKYVTTLINAKWNETPLVLEAAEYFNDENPTYFWKFVDAFSKKTNGLAIATEKESYDIIMELAKNYLSESEIAVFKLGLSLRIYSARVEMFSQMAVNKNISSYACDSVVDIGGTFTCSLEDIDELLDSSQITEQDTWETTDTYNIDHRYLSTSETDKTIILYGQIGTPTFIEFHEKLKNIAETKGINYILRHYVKERANKKLCLSGYGVELQMKSTEYKATDDSDIKDNTGKSSEVTNDGVEEIEGINFMTLKKLYPEQHVELDKVQTHLLETSHEIGALKVWQFQELSHQAAERIMKSPSTESLNVLTDISQNFPMQAKSLIRTKVNSDMKKEMKLNQEIFMASLNIQPTDTALFINGLFFDLEAIDVLTLLESLRSELRVMEALHKIGFNNKKMSKLLALDLSGGMDSQNFAMDIRDSAINWINDIENDSRYSKWPPSLTELLRPTFPGMLRNIRRNLYNLVLIIDPLSEDSMPLIALAQSLYSHSAPLRVGFVFVTIYTTTVTGLTDAGVAVNNAYHYFADTKSTKEAVHFLAELGNYIGPYGLDVEDVKKTIKSRDSSANINYILGEESEYDVGRHLAGDFIKRCGFKKFPQALLNGIPLTPSQLNSESYEEAVLSTIMSQTPALQKAVYRGDVTEGDDVIDFLMNQPNVMPRLNERILKVDKHAWLNLIGTLPEDEDYTKWSNQDLSTYLMKKMQYFFVPRRTNTHHMYSFWVVADLKSLLGRQLLREAFIYVESNTDARIGVIINTKDDSDDSDLKSDINRIVLAALDALSPERAILYIRKVIKEENAALIANGNFDLENDAVAVLLKIQNSILQLHQHYVKSVLNLEPGARAILCNGRVIGPLDSDEEFTNEDFSLLERFSQSTYGAKLFMRLLKDQFFNDDEYEENDITDDMIMKIASLLVPRPQTRNRFDVPFHGDDHSVIKIPAANPDEVAFNFIAIVDPVSRGAQKLGPILKTLQQALNCNIKVFLNCLEKNSDMPLKSFYRFVLEPELQFTAEGDISGSFAKFTKLPTSSLLTQYIHAPENWLVEVVRSVYDLDNIKLDNVAIGVHSEFELEYLLLEGHCFEAVMGNPPRGLQFTLGTKKQPVMVDTIVMANLGYFQLKANPGEWVLRLRQGRSAEIYDFTTVDGQDAIQNGNDVKVLISSLRSHVLKIKVSKKPDKASMDLLSDNEKDSGLWNSISRTFATTDESEDQDEKLNIFSLASGHLYERFLKIMMLSVIKHTKTPVKFWFLKNYLSPTLKDFLPHMAEEYGFEYELVQYKWPRWLHQQTEKQRTIWGYKILFLDVLFPLNVKKIIFVDADQVVRADLKELATMDLGGAPYAYTPFCDSRTEMDGFRFWKQGYWRNHLQGRAYHISALYVVDLKRFRRIAAGDRLRGQYQALSQDPNSLSNLDQDLPNNMIHQVAIKTLPQEWLWCETWCDDASKRYAKTIDLCNNPMTKEAKLQAAIRILPEWVGYDEEIKALQQKVENENRQTEKDGETIEDAAKHEEL

SEQ ID NO: 3932 - protein, 1613 aa, Diversispora epigaea
MKFKYNLIKFVIWIINIIIAIDSLSLSSNAETPPVQIWLKTSWNAPQLVLEILESVSAENSTAYFPLVEEFLKQGLFSSKLTNYEIYKSALDIIEKKKFLYTPTTKSLFEFGLSLHTTAPTIQSYYHYYNSTIIPTRNSSNEEFNPDCDVWVDWYGNQACNVESLTRFIDTKLDISNPTPNLLSFDHIRKSKVNESEYMIILYADLSSPKFPEFFNFLNSGINNINVNYVLRYIPPKENQESLYLSGYGVELALKNTDYIVIDDRKVEAETDDVDKEKESINDSESSNDHLFDQNISEIKPLKAGEIKSLGVKTAQVILESQDPLKTLTQLSQDFPKYSHYISQVPLSHPLVKEIEMNQEHSHLESNLFWLNGLVMNPLSVDPFSLLKLLSRERQTISSFLNLGLNPGQAIGVLSSPIISESQSLQDSSRGVFDVRDISPNNNVVVWLNDIEKDSRYSSWPNRIQDLLRPVYPGQLRMIRKNIFSILFILDFLSPDNLDIITDQVKTFISRNIPLRFGLIPLFSKDQPDAIAISRIFYYIVDQFDSSIVMKFFEMIFEIRKSSKIEFLKTFEQEFNKLIKKEVSNNEKLVNSFEEIINGDNTLVEEQIHESSNFIKRFKINTNDRGVLFVNGKFFDLDEFYQRNMVQTVNELTVFLQQKVYLGEINDETDIYEYLLTLPNIPNRRNPYIFTSELQPLQVINLADDDDNGFSLIDNLKYIYSENDDKVPVTIILISDFDNVNGISQIIEALKYLKSTKNVRISIIHQSNQSSTKLDSENHFNPSTMIYHLLYEEEPITSNSSHFQNIFEEYLEHLEGNSRIGGDDDKQIPIGQSFYNLAHSSGWQIIENIKAEKFWQDLSDLKIFEKFEKDKTTIIVNGRIIGPFAQEDIFYEDDFQLLIDIELSERISPVIRVVDEYKLTKLEGNDYSNFMAKISSIISASSVSDVPMGIFDEQEHKRDISFMKLKGDKSRIKIGNAGDAIYNIMAVIDPISEIAQKWSTILMILSQMEGVYIEIYLYPRLHMEEIPLKRFYRYVLNPRLNFDSNNGTIIPSSAHFVNLPDDVLLTLGMDVISSWLVTPKSSIYDLDNIKLSNLDIKSRVKGIEAIFELKNILIEGHARDLTSNNRPPRGLQLQLGTNSYPSMVDTIVMANLGYFQLKANPGVWTLSLREGKSTDIFDIQSVGNEGWLSRNISEIGNEIVLNGFEGLTIYPRMIRKSGKENDDVLKTENDNDNDGIWDYLKHKFTPKKDEKKKAEINIFSVASGHLYERFLSIMILSVLQHTNSTVKFWFIENFLSPTFKDFIPHMAKEYNFEYELVTYKWPHWLRAQTEKQRTIWGYKILFLDVLFPLDLDKVIFVDADQIVRTDLKELVDMDLQGAPYGYTPFCDNRPEMDGFRFWNHGYWKDHLRGKPYHISALYVIDLQQFRLMAAGDNLRGQYQALSVDPNSLSNLDQDLPNNMQHLIPIFSLPQDWLWCETWCSDESLTTAKTIDLCNNPLTKEPKLDRAKRQIPEWESYDKKVADLAARISQQKDSILTSNEIQDQKIKETNDDGTNVDETDEVIIGDVTIDDETNYETDVVYDGTNDESKEKIIVEESTNVISSASPTTHRKDEL

SEQ ID NO: 3933 - protein, 714 aa, Sporisorium scitamineum
MYRLLAEGRTEAVSPTQVLEALEQAHSHPDVSVQQLEGALGLTASDANSNQKARHFWQSISPSITSKLAIPPGPAILVDSHLVTNLSPSTIDARDITALVEYEAGQTLPSLIQALHLLRPNLSDLPPHQRQNLIFASLSVLNGIHHQAGSSMFTSKAASRSGLPEQLGTGDHVFEVGNRAEADVRITVLLDPLSEAAQRWSSVLLMLRELEGVYARVILNPQIKLRELPLKRFYRFSAPRALKFSEGRVVAPELRFFDMPEDAVLTLGLDAPAPWLTMPMEAVYDLDNIRLADVPSGSRGKGVKAVYELKHLLIEGHAREERAGSAVTVPRGLQLLLETPDEGTRLDTIVMANLAYFQFKAQPGLWKLRIRGGRSDELYEMQSVGSQGWNSPTVEVTGQHVVLDTLSGGHLYERMTYIMILSVVKHTSSTVKFWFIENFLSPSFKEFIPHLAVEYGFEYELVTYAWPHWLRSQTEKQRTIWGYKILFLDTLFPLDLGKVIFVDADQVVRTDLQELVDLDLEGHVYGYPPMGDDSEDMDGFRFWKQGYWKDYLRGRPYHISALYVVDLHRFRLFAAGDRLRGQYQALSADPNSLSNLDQDLPNNMQSSLPIFTLPKEWLWCETWCSNDWLDRAKTIDLCSNPKTKEPKLERAKRQIPEWTVYDGEVGRLAQRLVEEKVGKSVVAPDSQVETKSGNTQQQAADANANADAHVHDEL

SEQ ID NO: 3934 - protein, 749 aa, Castor canadensis
GILNDQVNAIDFLMDKNNVVPRINSLILDNKQQYLNLISSSDKSAVIAKNMYYLNQEDDAVAVVTLWIIADFDAPSGRKLLFNALKHMETSVLSRLGIIYNPTSKINEENTIISRGILAAFLTQKNSLLRSFLWKLAKEETATAIYSGDKIKTFLIEGMDKNTFEKKYNTVGVNIFRTHQFFCQDVLKLHPGEIGVVSNGKFFGPLGEDFCVEDFYLLEKITFSDVVEEIEDIAKSIEVNSKNISDLVMKVDALLSSLPTRASRYDVTFLKENHSIVKINPQESDEFFDVIAIVDPLTREAQKMAHLLVVLGKIINMKIKLFMNCRGKLSEAPLQSFYRFVLEPELMSETNNSPSPGPVAKFLDIPESPLLTLNMITPEGWVVEIVQSNCDLDNIHLKDIERAVTAEYELEYLLLEGHCFDTTTEQPPRGLQFTLGTENKPVMVDTIVMANLGYFQLKANPGAWILKLRQGKSEDIYQIVGHEGTDSQSDLGDVIVVLNNFKSKTLKVQVQKKPDKVKEDILTDKYERKGMWDSIKSFTRRLHEDDQKNDVLNIFSVASGHLYERFLRIMMLSVLRNTKTPVKFWFLKNYLSPTFKEVIPHMAKEYEFQYELVQYKWPRWLHQQTEKQRIIWGYKILFLDVLFPLAVDKIIFVDADQIVRHDLKELRDFDLGGAPYGYTPFCDSRTEMDGYRFWKTGYWASHLSRRKYHISALYVVDLKKFRRIAAGDRLRGQYQALSQDPNSLSNLDQ

SEQ ID NO: 3935 - protein, 1572 aa, Stemphylium lycopersici
MRASASTLSAKALLALGAFKHIGALASPSINVALQAAFNPAPYLVELLETAAEENATAYYPILDRVSEGYFDEKTTEQELYTAFLDLLYSDGHITQPEALASLELALSVRSAAPRIESHYQFYKTSVEPSLVAEQTKACDIWASFHGKQYCSVHLAEPFGAIESERTYQLPFDRILGNSSALPVILYADITAPRFKKWHRTLSNTAKEGKTSYRLRHKPSSKSSASPLVVNGYGVELQLKRTDYIVIDDRQAEEGDENTAQKPMGSGLNDEEEVADLKPLSKDEVSDLGLKAASFVTQSEQPMDTLMKLVQDFPKYSSIIAAHNASDAFVDEHTKNREQLLPTGYNVIWINGVQIPARDVNPYSLLAHLRRERKLINGIRNQGLSGPEVISLLSHSAIADTQTANEPQRYDFRDAAEGGNVIVWLNDIENDDRYESWPTNLRALLQRTFPGQLPSCRRDIHNAIVSVDLTSPEDVTTVLDTVWSLIRRGIPLRWGIVPQTRTPEALEQAKIVYHIQDVYGMSAVEVYLQASRDGKKLAQPDKSIFDATVKTSTLRDEHTSLSFEDVLGSEEIGQRIAGAKQYLSRLAAEGPKAPVFVNGVPIPANDEWLGTISQRIGMDLRQIQKAVFEGALTDESWVPQQFLFQAASRRNPLIIPENEKNVTLVNMAEFEEVNGNIYSKMPRIYASESASKSDWVHITLVADFDSENGFALLKAMANFREANPNVEAVLIHNPQVGAEQSRFSEAVLKSFVESGHKLPIETMLELLARDPSHEPIPATSTLFWKAAEPIYEAFGLQPGQHGLLVNGRFVGPIPKDYEFSQDDMETLVSFEANKRIEPLNKALEDLQLLGKIESPFDVAKIQSLVALSTVSDVPEGIFETASTLRMSTYKNWTAEHTAIVKGDQEKAVFQIVVSVDPATELAQKWVPILKTLSDMEGVHLKLFLNPRQMLQELPVKRFYRYVLEARPHFNSDGSVGSLKAHFSGIPKEALLNLGMDVPPSWLVAPEESIYDLDNIKLSTIPAGTNVDAVYGLESILIEGHSRDTTNGGQPPRGAEVVLATEKDPHFADTIIMANLGYFQFKANPGFYNIQLKSGRSQEIFNLDSAGPISWAPQPGDETTEIALMSFQGATIFPRLSRKPGQEETDVLAPEESLTSELVGKTSQKVNKFLGKMGLNFDSEKVFQKGADLLSGGKVVKKGTQADINIFSVASGHLYERMLNIMMLSAMKHTNHTVKFWFIEQFLSPSFKSFLPHMAAEYGFEYEMVTYKWPHWLRGQTEKQREIWGYKILFLDVLFPLDLEKVIFVDADQIVRTDMYELVQHDLQGAPYGFTPMGDSRTEMEGFRFWKTGYWSNFLRGRPYHISALYVVDLNRFRQLAAGDRLRQQYHALSADPNSLSNLDQDLPNNMQFNLPIHSLPQEWLWCETWCSDEDLAKAKTIDLCNNPQTKEPKLDRARRQVPEWNVYDEEIAALARRVKGEQKLADLVDVQEQEQLREKKEKDAERIEHNEFKSDSELTCLGHDVQRSVTSSTLIGQDLNTTEGPIEPSFPRAMSMIGNPPYAVITLKRCTSRKRR

SEQ ID NO: 3936 - protein, 1410 aa, Cyberlindnera jadinii
MREFLVFLLTLGYGLAQISIQLVANWEKSPFELLLLETVSSENESYFIPALSKVSNVLFNEEDDDEADLSAIDTRSDEKLFNEVFDLLTPEERSLYEIPLATKYYSPRIVAHYKYYNETILPKFSDILRKKCGEIPQTWLELNGVVYCEPDDVYALQIDKEGNFDQEPFDRVIGDRGPVLALYGTVSDPKFPQFLSTLYQSSLSGKLRFVWRYTPQPHTQRELLSGYGVDLTLKRTDYIVIDDRELTGSEPQIVLKDDKLLDDQTDTFLDTYDNDIKPLAKGELSSLDLKAASFVLDSKSASDAFNRLLKLTQDLPKFASYLSDQEINEDIFAQMEYNEKLGITSSSTGIFLNGAPLNSVRSNIFDLYKQLKTEMKFIELLKELDVDLTDAKNVIGKFALLSAYGSQSRGIKRYKIPQGLEGAVVYLNDIEKDEVYSEYSTNVGDFLKRFQFGEIPDVKANLHSAIFVMELSNKEDVSNFIHIVDSITRDQLSQHIGLVPLIKSKEDRSLANQLYKIYRTGTREDILEFLKYLKKEEHYDDVDYVSTLVEPFVQNFDVKRPCVIVNGVFYDLHGNWASLMSRQVFADNNFIAGMVYQRSVATLKDIKEKLYEDSLESRNLLLVPSNDADVSQVIITPEFVRQCEHQFSNVVFTFSETSHGSITPTLTFGANFGSLYALEQLSEILKSLDESKIALRVRLVHTGADVSFIGKLRQASHASLKHLSETVNSIINEHQFNNDEEPLSSTKYLLDSIGVDSQSFILLNGRYIDLKGTIARAESLKSFYEYEMTTRLKNAINLINTIEIEKDGDISDWFESFSSVLSASYFNGENRITRFDFSRLQTDPSIKFGDKKESLVNILAVFDPINEYTQKLLPLVGAVKDLPFVSVDIVLVPQEDLAELGIKRFYRGNIPKGVSFKNGSFVEDSVVTFNNVPEDTLFTLDMDVHPSWIVMAKEGATDLDNVLLKKTGTVTGIYELENIIIEGNLFDYTNEEPPAGLSVSVPGSDTNVMMAEGYFQLKANPGLWELSLMDGNSRTLYTFVDPNTKAPVSNVDVDILTIDGVKIRPQVKKNPGKESISLNDLVTGEESKGGILSSWFGGKHTTGKHADINIFTVASGHLYERLLSIMTVSVMRHTKHTVKFWLIDNYMSPTFREFLPYLAEQYGFEYELITYKWPSWLRGQREKQRTIWGYKILFLDVLFPQSLDKVIFIDADQIVRTDMNELVTLDLEGAPYGYTPMGDSRKEMEGFRFWKHGYWEKLLGDDLKYHISALYVIDLKKFRSIYAGDILRQQYQILSADPESLSNLDQDLPNSLQRTLKIFSLPQDWLWCETWCDDASLKTARTIDLCNNPLTKEPKLDRARRQIPEWTVYDDEISALRESAFKRNFEAQLLEVSSRQIGSDPAPIEVHDEL

SEQ ID NO: 3937 - protein, 655 aa, Camelina sativa
YWFSFCRTCSKYFSDVFMFVSSAMATRDRSSESARFEVLNSEYSAVLLGNENATIHIDAVIDPLSPTGQKLASLLQVLQKHVQTSMRIVLNPMSSLVDIPLKNYYRYVLPNTDDYSSTGFDVDGPKAFFANMPLSKTLTMNLDVPEPWLVEPVIAIHDLDNILLENLGDTTTLQAVFEVESLVLTGHCAEKDHEAPRGLQLILGTKNKPHLVDTLVMANLGYWQMKVSPGVWYLQLAPGRSSELYVLKGGNDGSQDQSSLKRITIDDLRGKVVHLEVVKRKGKEHEKLLVPSDDDDGVQQNNERRSWNSNFLKWASGFVGGRQQSMKGDSKKEHEKGGRQGKTINIFSIASGHLYERFLKIMILSVLKNTNRPVKFWFIKNYLSPQFKDVIPHMAQEYNFEYELITYKWPTWLHKQKEKQRIIWAYKILFLDVIFPLSLEKVIFVDADQIIRTDMGELYDMDIKGRPLAYTPFCDNNREMDGYRFWRQGFWKEHLRGRPYHISALYVVDLVKFRETAAGDNLRVFYETLSKDPNSLSNLDQDLPNYAQHTVPIFSLPQEWLWCESWCGNATKSKAKTIDLCNNPMTKEPKLQGARRIVTEWPDLDLEARKFTAKILGEDVELNEPVAAATDKPNPPPSNDISEDSEQDLESKAEL

SEQ ID NO: 3938 - protein, 1633 aa, Glycine max
MGCLWRSRCWVLIVLVLLNIGSAFADTPQRPKNVQTALRAKWSGTPLLLEAAELLSNEKKDLFWDFIEIWLNTEKDAARSEAAKDCVKKILECGRPLLREPLKSLFEFSLMLRSASPRLVLFQQLAEESLASFPLGDENYSDDETEEKLLTEKKIERRKLDPLHGVNLKIHGGKCCWVDTGEHLFLDVHELLAWLQGSVELVGDSFPRPEIFDFDHIYYELSVGSPVAILYGALGTNCFKEFHVALVKAAKEGKVKYVLRPVLPAGCESKINHCGSVGAGESVNLGGYGVELALKNMEYKAMDDSTVKKAQLRIAGVTLEDPRTEDLSQEVRGFIFSKILERKTELTSEVMAFRDYLLSSTVSDTLDVWELKDLGHQTVQRIVRASDPLQSMQEINQNFPSIVSSLSRTKLDDSIRDEIMANQRMVPPGKSLMALNGALVNVEDVDLYLLIDLIHQDLLLADQFSKLKIPQGTLKKLLSTSPPSESSIFRVDFHSSHVHYLNNLEEDAKYKRWRNNLDEFLMPVFPGQLRYIRKNLFHAVFVLDPATRCGLVSIDMIISLYENNFPVRFGIVLYSSKFVMQLENHATKEHSDEDISTTIICLFSYINENYGAEMAYRFLSNVNKLRIESDGNADDALELHHVEGVFVETILSKVKSPPQEILLKLYKNQKLKELSQESSKFVFKLGLSKLQCSLLMNGLVIDPTEEALINALNDETPRIQEQVYFGQIMSDTDVLAKFLSEAGIQRYNPKIISDSKPRFISLSMFTFGEESILNDIVYLHSPGTMDDTKAVTHLLAVDITSRNGMKLLQQGIHYLIEGSKNARVGLLFNANRSPNLFSLLFVKVFEITASLYSHKTNVLDFLNQLCSLYEKNYILSPPMEAESTQAFVDMVCELGEANGLPSKGYRSALLEFPAGEVRKHLTKVQNSLYRVLGLESGANAVFTNGRVTYPIDESSFLSADLHLLESIEFKQRTKHIVEIIEEVEWHDVDPDTLTSKFISDIVMALSSSMAMRERNSESARFEILNDQHSVIILNNVNSSIHIDAVLDPLSPTSQRLSGILRVLWKYIQPSMRIVLNPVSSLADLPLKSYYRYVVPTMDDFSNTDSAINGPQALFANMPLSKTLTMNLDVPESWLVEPVIAFHDLDNILLENLGDTSTLQAVFELEALVLTGHCSEKDHDPPRGLQLILGTKTAPHLVDTLVMANLGYWQMKVSPGVWYLQLAPGRSSELYILKEDGEGSYDKQSSKLITINDLRGKLFHMEVLKKKGKEHEELLLPDDNAQDEKKGSGLNSNFLEWASGFIGGNKLSKKAEKSSQEKGRGGRHGKTINMVSIASGHLYERFMKIMILSVLKNTHRPVKFWFIKNYLSPPFKDLIPHMALEYGFEYELVTYKWPTWLHKQKEKQRIIWAYKILFLDVIFPLSLEKVIFVDADQVVRADMGVLYDMDIRGKPLAYTPFCDNNKEMDGYRFWRQGFWNDHLQGKPYHISALYVVDLKKFRETAAGDNLRVIYETLSRDPNSLANLDQDLPNYAQHTVPIFSLPQEWLWCESWCGNATKYKAKTIDLCNNPMTKEPKLQGARRIVSEWPDLDFEARRFTARILGDDQESESILPPNQSKNLNSEDSSNEDMESRAEL

SEQ ID NO: 3939 - protein, 360 aa, Poeciliopsis prolifica
MMNEDLLSETSENKGIWDSIVSITGGGSKKDEGEKKKEDVLNIFSVASGHLYERFLRIMMLSVLRHTNTPVKFWFLKNYLSPSFKETISHMAKSYGFQYELVQYKWPRWLHQQTEKQRIIWGYKILFLDVLFPLAVDKIIFVDADQIVQADLKELRDLDLQGAPYGYTPFCDSRREMEGYRFWKSGYWASHLGQRKYHISALYVVDLKKFRKIAAGDRLRGQYQALSQDPNSLSNLDQDLPNNMIHQVAIKSLPQEWLWCETWCDDASKATAKTIDLCNNPKTKEPKLMAAARIVPEWVDYDKEIKEMLRQVQEPTPTPSLHQKGKGGGKGCPSTVLSCCINQTAAFVCYSSARLNLFHL

SEQ ID NO: 3940 - protein, 1861 aa, Chara braunii
MDSFHRVRDAVTLFDRVSLSSLSPSFYPSSSASPSASSSSSSSSSSSSPTLSARRLSGYGVSVLSSARCGPLAMAAMAVSVLIFAVTMMTVVIADGSPGVTYLPKGVQVSLRAKWSGTSLLLEAGEFVGATREDLFWPFVEEWIHGQPPPQSIGATGESLPADERCAAAMGGSVRRLLGPAFEPIFLLSLSFREYSPKLVVYRQLAWQSLRRFGFTSSSPSDDDATAAEDGGRSGRHVARPGPANSAAAKDRHRLDSSDPFPTNGSCCWVDVGGQKPLLDPAELDTWIERAKLGATVADEAEHLVEVHSFDHVISDGSSVAAVAVLYGAMGTACFEKMHAALSAAAREGYFKYVYRPVLPHGCGGDGGNCLLMGAGADVTLGGYGVELALKNMEYSAIDDSSVKKDVATESGKPTEDLDRAVNGFIFSKLLARRPEKAAELLTFRDHLMSAADIDDKINVWDLKDIGLLASQRIAQASDPLRLLQEINHNFPSVVSSLSRMKLNKTVSDEILSNQRMLMAGKNLLAINQAVIDLENLDLFTLMEIARKEIALGSQLSKLKLPREVMKQMMNLPEPSLDMVVRVDVRSDEFLHFLNDLETDAKYRRWGNNLFELLMPMFPGQMRYIRKNLFTAVYVIDPGSPKSLRAVDSIMHYYNNNVPVRFGIIIATGEVLSIVEEKGGAGGEAVVKKALQEENGTVSQSVSLMTARVFYHVVRNFGAKEGFSFLAKLNEVRGGEEGGDAPSAGADSEEEDDAISQEHLEEALRATLKRLLAKEKKEKVAADELIAELRGNLDYLDDVILSTLFAHRKGLDNAAIPCLVMNGLVFPSNQVLIAMNEELGRIQEKVYYGLISQKTNVLDRLLQEHGFARYNPVVLSSDGTKPKYVELASAAVEEKSILRKLRYLHHPGGDDEVKAISHLVVVDIERKEGKQLVLQALRHLASDVEGKSRVGILHNPRRTRDRTSAPGADDDPERPAAAAAAAAASLLPRILLAATSLPGQSAKLLPFLQTLLESSAVAELMTSTNKLQAEASVRDTLLDSVAAMAKSAGLRPDGLLKSLTDPTAIRDALQRIQEEQEFVKSLGIEPGLDAVVTNGRVLLLGRDCKQLTAEDFELLGKVEYSQRVSEVETLMEDLEWSDADPDDVTSEFLSTMIMAASSAVSSRTKTSETAKFEFLSDQHSAIVHQDDNSLLTVDAILDPISTTAQAITPLLILLRDWLHPSFRIILNPQTNLADLPLKNFYRFAQPLNKDLVSSLQDGAAARFINMPASRTLTMNLYVPEPWLVEPVVAPYDLDNLQLQKLDAGTMHVAFELEALMVTGHCFEEGSRDPPRGLQLLLGTKENPHIVDTIVMANLGYFQLKAAPGVWALRLAPGRSALLYSTVHADADNTLIPEKGDAGEEEVVSVRVVVSDLKGKVVRMKVKKRPGKETEKILWEEGDWNNEDEEQGATIARHGAGGSNKRGSSWSDWFLGLGGRKKEGSNLSSLEASSPEGLPPSSRRTGEMIHIFSVASGHLYERFLRIMILSVIKNTNRPVKFWFIKNYLSPSFKDLIPHMSREYDFEYELVTYKWPSWLHKQVEKQRIIWAYKILFLDVLFPLSLKKVIFVDADQIVRTDLGELYDMDLKGKPLAYTPFCDNNKEMDGYRFWKQGFWKDHLRGRPYHISALYVVHLAKFRLIAAGDHLRVVYESLSRDPNSLANLDQDLPNYAQHKVPIFSLPMEWLWCESWCGNATKAKAKTIDLCNNPMTKEPKLEGAKRIVAEWPALDEEQRIFTAKIERMYMQLQPDAELPEVDMKSPEEPASAPSSMLSEQSMEGEGQKGTTDSVVDTSTNGRSSCPSGVHQEEGKGSGSAVTRSSGERDEL

SEQ ID NO: 3941 - protein, 1569 aa, Vanessa tameamea
MKATGGIVFLIILAHVLFTFATNSDSLKREERKSKGVTTFVSAKWEVTPIVLELAEYLSGESTDLFWSYFDGINSLKTNLNTLETDKQVYDACIGVASSLLAPAQLRMAKFALSMHLTSPTVRMFDQIATHNGAKDVSCDTFVSIASRKICDNDALRDILKSSAKYDPEDHKLETYLLDHSYPSSDNKSLTAILYGELGMADFAAKHKILSGYADLGLINYIVRWNVKPRGKPKVRLSGYGVELQLKSTEYKSQDDTTPKESESGESSVPSAEEDENDPQNQIDGFNFGRLKNLFPALRTPLERFRRHLSETSEELAPLKVWQMQALSMQAAAAVIDAHDAGGDEALKVLTSIAQNFPMQTKSLIHVNVPRSFRDEVLYNQDIWASSLGLRAAEPLLLVSGAQYDAEEVDVLALLNALRDDIGPMNTLHALGLSKNFINKLMALDVGETYTWEEYGLDIRDTAITWLNDLESDERYRRWPSSFMELLRPTYPGMLRNFRRNIYNYVIVVDPTCPSSAPPLKLGETLLKHATPVRVGLVLAPPARAAARRAALALAVRAAFNYVAQEKNSNKEAFYFLTQLLQTAPEDGVDIDHIKEHLKKYASFSANLDDIISEDSEYNFGNQLAEEFVSKLGTDKYPQVLINGVPLWDDSATPVTSSVELLEEALVTALSRHTGRLQRSVFRGELADTDDAVDYLMKQPHIMPRLNRRVLSSDPSQYLDLSGVPSSTELFTEDKIHRLLHLTGRDALATALPILKYFSKPGKQEKITQTIWVIGDLNEKDTRELLRNALTFMRETGGARVAFIPNVDGTSSEDQSLNKVVLAAVTALDSAAATKYVVRLLEDEGCQERQDCEILPELVPLLHKYEWVLKGSRVLSVRGARLRAGARALVHNARLVGPLARGERFSLDDFVLLERYSNQVYGDKLSEVLNKKNTVSKNDVDEDDDAVELSTEKYLQVVAVLSARSPRARTALPAGLRAEHSVVDLAPLYDDEAAVEIVAVVDPASTAAQRLAPLLLVLRRVVNCRLRLFLNPQDKNSDMPLKSFYRYVLEPELQFSSSGALGAGAAARFSRLPHAPLLSLELRTPPNWLVECVKSVYDLDNIRLADVDSVVHSEFELEYLLLEGHAWDTNLGTPPRGLQLVLGTRDKPETKDTIVMANLGYFQLKANPGAWTLRLRPGRSDEIYEIVGHENTDTPAGSDDIQVLMSSLRSHVIKLRVSKKPDKQNLDLLVENDEKNTGGIWNSIASSFGGGEDQETQDETINVFSVASGHLYERFLRIMMLSVLKHTKSPVKFWFLKNYLSPSLKDILPYMAQEYGFQYELVQYQWPRWLQRQRDRQRTIWGYKILFLDVLFPLHVKKIIFVDADQIVRADLKELVDLDLAGAPYGYTPFCDSRKEMEGFRFWKQGYWRNHLQGRSYHISALYVVDLKRFRRIAAGDRLRGQYQALSQDPNSLSNLDQDLPNNMIHQVAIKSLPQEWLWCETWCDDNSKQYAKTIDLCNNPMTKEAKLSAAMRIVPEWRHYDDEVRALQARVRRGLYQHADGEQEIDANHEEITKTGTTSDDEHKHTEL

SEQ ID NO: 3942 - protein, 1493 aa, Cimex lectularius
MEFKSLFLLLLINLNHAYSKKKPKSVTTVIDAKWEITPLALEMAEFLADENPSLYWKFVNSLSSLEPPLVDEKTDKDYYERALGLLDPLLSQPQISLMKFSLSLHVYSPRVEMFCQIAKEKGVVCPAAVELGGELYCDYDEFQNALTEGVKSSNVTSNLIRLDHKFLKGDKGPLTILYGEIGTPEFAKFHKLLSQKATDNELQYVARHWVKERQPRKLRLSGYGVELQLKSTEYKAQDDTKVESGTLEDAEEDEDEEVEGFHFSKLKFLYPDKTQNLDKFRQELLESSSELAPLKVWQFQELSLQAAQRIMSAPKEEALNTLSFISQNFPSQAKSLVKTTVNQDFKNEMRKNQDRFTSSLHLQPSDTALFINGMFFDLETQDIFSILEYIREELRVMEGLNDIGIFEKKVFKSLLTLDLSSTGVDFGLDIRDSAVLWINDIESDKAYSRWSSSLLDLLRPTFPGMIRSVKKNLYNLVIIGDPSKNDVIPLVKLMQSFLVHNAPLRLGLVFAIDYKKNGLEDAGVAMLNAYNYIAEIKDNSQALNFLTDIYAAVTDDIKPEDVHELLSVKFPGHKKDEIFGPDSDYNTGLKLSAEFVEKSGLRKMPQVLLNGVPLPEKSLTSEDFEEAVLSEIVNQTPILQKAVYKGELSDTDNVVDYLMERPNIMPRLNERILTTTKSKYLSLTKFTDQSILDLIDKHLFYGSSKKGQGKRSVHFLSNWLIVDLTTEQGRNLLANSLEQIEGNSKVRTSLIINQKEPGYKNINKIALSVLMQGSEKVGSTLRQILNDHSLIESGSKTFSDYGVKEVDEPKVEWVLKFHAQFVKDVLDFQPGKHGVVSNGRVLGPFEPHESFTQDDFGLLERFSSTSYIDKIYQAILKNSEDLESVTSDMLMKAVSLLASRPESKSRFEVNSFGEEHSVVKLPPASEGSAFSLVAIVDPVSSGAHKVGTILSVLQQVINCDIKIFFNCVEKNSDMPLKSYYRYVLEPAIQFTPLGQLASGPMAKFSNMPGAPLLTQNMLVPDNWMVESIASPHDLDNIKLDQVNSNVHSNFELEYLILEGHCFDSLLGTPPRGLQITLGTERSPTEFDTIVMANLGYFQLKANPGEWTLRLRHGRSAALYDIIGYGHAGVDYPVNSSEIKILLSSFRSHTIKLKVNKKPDKTNVDLLGDEEEQQGLWGSIASTFGGSGDNGENKEEVINIFSVASGHLYERFLKIMMLSVLKHTKTPVKFWFLKNYLSPTLKDFLPRMAKHYGFNYELVQYKWPRWLHQQTEKQRIIWGYKILFLDVLFPLDVKKIIFVDADQVVRADMKELVDLDLGGAPYAYTPFCESRTEMDGFRFWKSGYWRNHLQGRKYHISALYVVDLKRFRRVAAGDRLRGQYQALSQDPNSLSNLDQDLPNNMIHQVAIKSLPQEWLWCETWCDDESKKVAKTIDLCNNPLTKEAKLTAAMRIVSEWKDYDNEIKEVLLKIGETEDHEEENIEPVPKPTPDVHSEL

SEQ ID NO: 3943 - protein, 1555 aa, Drosophila serrata
  MOD_RES (71)..(71): Any amino acid
  MOD_RES (227)..(227): Any amino acid
  MOD_RES (1389)..(1389): Any amino acid
MLRAASMCVSVLGLLGLLAAPSSAESSQSYPITTLINAKWTQTPLYLEVAEYLADEQAGLFWDYVQGVTKXDTALNEYDTESQQYNAALELVKSHVSSPQLPLLKLVVSMHSLTPRIQTHFQLAEELRSGGSCQGYTFVQVGTELACSFNELQKKLDLPLAKDSLDAPVVTYSFDHIFPGSENNTRTVVLYGDLGSSQFRTYHKLLEKEANNGKIRYILRHQLAKKXTRPVRLSGYGVELHLKSTEYKSQDDAPKPEAGASSDEDLANESDVQGFDFKVLKQKHPTLKRALDQLRQRLLQGNDEIAQLKAWEFQDLGLQAAAAIAEIQGDETLQILQYTAHNFPMLARTLLAHKVTDALRAEVKHNTEAFGRSLNVAPPDGALFINGLFFDADTMDLYSLIETLRSEMRVLESLHSNNVRGNLASSLLALDLTASSKKEFAIDIRDTAVQWVNDIENDPQYRRWPSSVMDLLRPTFPGMLRNIRKNVFNLVLVVDPLQPTARSVIKLSESFVIHQAPIRLGLVFDARDASEDNREDYIAISCAFNYVSQKKDARAALSFLTDIYASVGETKVVTKKDIVKQLTKEFTTLSASRAEEFLEEDGTYDYGRELAAEFIQRLGFSDNKGQPQALLNGVPMPSNIVTADSDFEEAIFTEIMSHTTNLQKAVYKGEMTDSDVAIDYLMNQPHVMPRLNQRILSQEDVRYLDINGVAYKNLGNVGALNRLSNRDMTATLMENLKYFGGKKSTEQIGRSSLQFLTIWVFADLDTEEGRSLLTHALEYVQSSESVRLAFIPNTESVSAKSDKKNLNRLAWAAVQSLPEPSQATELVLKWLKKPKEKIEIPAQLEDILGSTELHLKMLRVYSQRVLGLTKSQRLVIGNGRLYGPLAAEETFDSADFALLARFSSLQYGDKVRQVLKESAQDVREEFTSDTLLKLYASLLPRQTKTRFKLPTDLRSDHSVVKLPPKQEKLPHFDIAAVLDPASRAAQKLTPILILLRQVLNCQLNLYLIPVPQHSDMPVKNFYRYVVEPEVQFESSGSRSEGPLAKFSGLPANPLLTQQLQVPENWLVEAVRAVYDLDNIKLTDIGGPVHSEFDLEYLLLEGHCFDAASGAPPRGLQLVLGTQSQPSLVDTIVMANLGYFQLKANPGAWSLRLRDGKSSDIYGISHIEGTNTHHTAGSSEVQVLITSLQSHVIKLRVAKKPGMQQAELLADDNEPAAQSGIWNSIASSFGGSNGNQAVTDEDTETINIFSVASGHLYERLLRIMMVSLLKHTKSPVKFWFLKNYLSPQFTDFLPHMASEYNFQYELVQYKWPRWLHQQTEKQRTIWGYKILFLDVLFPLNVRKIIFVDADAIVRTDIKELYDLDLGGAPYAYTPFCDSRKEMEGFRFWKXGYWRSHLMGRRYHISALYVVDLKRFRKIAAGDRLRGQYQALSQDPNSLSNLDQDLPNNMIHQVAIKSLPDDWLWCQTWCSDTSFKTAKVIDLCNNPQTKEAKLTAAQRIVPEWKDYDGELKTLMARIEDHENTHGSRDSNDDDPIVQDPLEVTTVTPSHEPKHGEL

SEQ ID NO: 3944 - protein, 1558 aa, Sorex araneus
MSGGVGSVLFSRSAHQAHCFTWSPKDVSNWKINDDFEFMAEESNEKFWQFLETVKQIGIFKETESAYSYYNLILKKAGQFLDNLHINLLKFALSIRAYSPTVQMFQQIAADESPPDGCNAFVVIHKKYTCKVHEIKKLLRKASSRPRPYLFERDHEFAPKKEDLPVVILYAEIGTRAFGTFHEVLVAKALNKEIVYVLRHYIKNPSSQKMYLSGYGVELAIKSTEYKALDDTQVKPVTNSTEDELQTNEVQGFLFGTLKEKYSDLIDNLTAFQRYLIESSKEMAPLKVWELQDLSFQAASQIMSTPVYDALKLMKDISQNFPIKARSLTRIAVNQKMKAEIQENQKDLLSRYEIQPGEACLVLNGIRLDMDSFDPFSVLDMLKVEGKMMNSLHSLGINAEDMSKFFKLNSPVWDDNYALDIRHSSIMWINDLENDEMYVSWPTSCQELLKPVFPGTIPPVRRNFHNLVLFIDPTEEYALDFIKLAELFYHHKIPLRIGFVFVVNSEDEVDGAADAGVAFWRVFNYITKEYDVSKAFHLMPLMYEKVKNQNLLTVENMKEVLQDEFPQADVGEILGVGSVYDKGRKGGASYYRMTGLGPLPRALYNGELFDDEELSIKQLEVAVLQKMMDTLIRLQKEVFMGTLNDGTDTVEFLMAKNNIVPRINPLILQSEQEYLNLISTSVTADIEDHSTYYFLDSQDKSAVIAENMYYLTPKDDSGISPVTLWIIADFDEPSGRQLLSNALRYMKLSTVSRLGVIYNPASKINEENTAISRGVLAAFLTQKNQFLSDFLSKLAEEETATAIYSGDKIRTFLTEGMDVDAFEKKYNTIGVNIFRTHQLFCRDVLELNPGEMAVISNGRFLGPLDEAFCVEDFLLLERMTFTDLVKKIKGIVETMSLSPKNMSDFIMKAAALISSLPRHASRSDIRFLKENHSIIKINPLENDMFFDIIAIVDPLTREAQKMAQLLIVLGKIVNMRLRLFLNCKGRLSESPLKSFYRFVLEPELTFGTKSSLGPVAEFVDIPESPLLTLNMITPQGWLVETVHSNCDLDNIHLEDMESSVRAEYELEFLLLEGHCFDADTEQPPRGLQFVLGSRWNPAVVDTIVMANLGYFQLKANPGAWILKLREGKSEEIYQIVGHKGTDSSPDHGDVVVVLDSFKSKILQVQVEKRPGKMQEDILAEKDEERKGMWDSIKSFTTGLHKKEEKPGTDVLNIFSVASGHLYERFLRIMMLSVLRHTKTPVKFWFLKNYLSPTFKEVIPHMAGEYGFQYELVQYRWPGWLHQQTEKQRVIWGYKILFLDVLFPLAVDKIIFVDADQIVRHDLKELRDLDLGGAPYGYTPFCDSRTEMDGYRFWKTGYWASHLLQRKYHISALYVVDLKKFRRIAAGDRLRGQYQTLSQDPNSLSNLDQDLPNNMIYQVAIKSLPQDWLWCETWCDDASKQSAKTIDLCNNPKTKEPKLKAAARIVPEWVEYDTEIRQLLDQLENKKKSAKRCPSGGPQEGSVALGVPVGSVDSGRRRALDTTASFSSLKAGRLLGEDPDVFPVTPSVEELPGTRSCGC

SEQ ID NO: 3945 - protein, 1006 aa, Tinamus guttatus
RIGVVFILSTKEEIDGNEDAGIALWRAFNYIAEETDTSQAFTSIINMYHEVEDGKVLTVNHVKNVLGREFPYADVQSILGVHSEYDEGRKAGATFYKKTGLGPLPQALFNGVPFNREEMDGTELETVILQRIIDATGFFQRAVFMGLLNDHVNAIDFLMEQHNVVSRINPTVLGAERKYIHLRSTSVPFDVQDFSTFSFLDSQDKTAVISDGMKYLTKKDEDILHAVTIWIVADFDKPAGRKLLSNALKHLKTSRHTRVGILNNPASKIKEDNTAIARGILTAFLTQNNSNLRGFLSKLIKEETAKSLAAGTKITKLLMPGMDGDTFEKKYNTLGLDIIKTHQMFCQEVLKLLPGQMAVISNGRILGPLDENEFYAEDFQLLEKITYATSAEKIKTIVKEMGISAKSGSDLIMKIDALLSSLPKTEMRQDVELLKEQHSVVKIDPEQNQPFYDVIAIVDPLTREAQKMAHLLIVLKDVINMRLRLFLNCRSKLSEVPLKSFYRFVLEPELTYGINNHLPSEPVAKFLELLESPLLTLNMITPESWLVEAVNSSCDLDNIHLQDIKGNVIAEYELENILLEGHCFDVTTGQPPRGLQFTLGTKNNPVIVDTIVMANLGYFQLKANPGAWTLRLRKGRSEEIYHVFSHEGTDSEADLADVIVVLNSFRSKIIKVQVQKKSDKMNEELLTDGITEKKGHLDSVTSFSEEIPTEEMEKRSDILNIFSVASGHLYERFLRIMMLSVLRHTKTPVKFWFLKNYLSPTFKEVIPHMAKKYGFKYELVQYKWPRWLYQQTEKQRIIWGYKILFLDVLFPLAVDKIIFVDADQIVRSDLKELRDLNLNGAPYGYTPFCDSRREMDGYRFWKSGYWASHLGKRKYHISALYVVDLKKFRKIAAGDRLRGQYQALSQDPNSLSNLDQDLPNNMIHQVAIKSLPQEWLWCETWCDDESKKKAKTIDLCNNPQTKEPKLQAAARIVPEWVEYDSEIRKLIEKIEAENKNGTSFFQKGDL

SEQ ID NO: 3946 - protein, 1464 aa, Anas platyrhynchos
SEFIAEDGNEKFWQFLETVRELTIYKQGDSEHSYYNLILKKAGQFLSNLQINLLKFALSIRAYSPTVQMFQQIAADEPPPEGCSAFVVIHEKHTCKINEIKKLLKKATKRPRPYLFKGDHKFPTLKEDGPVVILYAEIGTKDFVKFHKILSEKAQKEEIVYVLRHYVQKPSSRKMYLSGYGVELAIKSTEYKAVDDTQVKGSNDTQKEEDDDDEESDVQGFLFHKLTQMHPDLKNNLKEFKKHLIETTNNMEPLKVWELQDLSFQAAARIMSTPAYDALKVMKDIAQNFPIRARSLTRVPVDKQMRNEIEENQKHLHETLGIQPGEARLFLNGLHIDLDFHDPFRKSKLSALSSLFHKNYKKIRGVKFSLKIPWIILGMLWINDIEKDHSYSTWPASYQELLKPTFPGVIQQIRRNLYNLVLFVDPVQEDTDDYMKLAELFYHHNVPLRIGFVFVLNTKEDIDGNEDAGIALWRMFNYIAEESDTSQAFTSIINVYHEVKDGNVLTVNHVKKVLRNEYPYADVQSILGVHSEYDEGRKAGATFYKKTGLGPLPQALFNGVPFNREEMDAAELETVILQKIIDATGFFQRAVFMGLLNDHINAIDFLMDQKNVVPRINPTILGAERRYIHFRSTSVPFDVQDFSTFSFLDSQDKSAVISDNMKYLTRKGKRKKILNIQLYDNEDALYAVTVWVIADFDKPAGRRLLSNALKHLKTSSHTRVGILNNPSSKIKEDNTAIARGILAAFLTQNNSSLKSFLNKLTKEETAKSLAAGTKIVKFLVPGMDDDTFEKKYNTLGVDIIKTHQMFCQEVLKLLPGQMAVMSNGKILGPLDKDEFYAEDFNLLEKITYSTSAEKIKAIVKEMGISTKSGSDFIMKIDALLSSLPKTEVRQDAELLKEQHSVVKVDPQENEPFYDVIAIVDPLTREAQKMAHLLIVLKDIVNMKLRLFLNCRSKLSEVPLKSFYRFVLEPELMYGINKHLPSEPVAKFLELPESLLLTLNMITPESWLVEAVNSSCDLDNIHLQDIKGTVTAEYELEYILLEGHCFDVTTGQPPRGLQFTLGTKNNPVMVDTIVMANLGYFQLKANPGAWTLRLRKGKSEEIYQVFSHEGTDSVADLADVIVVLNNFRSKIIKVQVQKKPDKVNEDLLTDGITEKGNLESVTSFSEEIPPEEKEKKSDILNIFSVASGHLYERFLRIMMLSVLRHTKTPVKFWFLKNYLSPTFKDVIPHMAKKYGFKYELVQYKWPRWLYQQTEKQRIIWGYKILFLDVLFPLAVDKVIFVDADQIVRSDLKELRDLDLKGAPYGYTPFCDSRKEMDGYRFWKSGYWASHLGKRKYHISALYVVDLKKFRKIAAGDRLRGQYQALSQDPNSLSNLDQDLPNNMIHQVAIKSLPQEWLWCETWCDDESKKKAKTIDLCNNPQTKEPKLKAAARIVPEWVEYDTEIRKLIEQIEKEKKKQTSFVQKG

SEQ ID NO: 3947 - protein, 920 aa, Ustilaginoidea virens
MSLDAILEAEEYIEHLRYAGQWVSRLQGDTAVRPLFINGITVPQDQGWMQSMSMALAGDLQTLQKGLYHGVLEEDTSVVDIFLDRAAPRRNVYISLADEKSLRVLNLAKLHSENRAFFDILPVIDSDPTASKEDWAVVTVLANMTSDSGLSLVQSALQFRRLNPAVRIEFIDTQEDAMASSRVNAAMKDVEEKLKDVKSLEELKSLVRAAPEYDASEFYARDVIKVLAESKLTLGSQSVIINGRVVGPIAPSSPFLADDFEELLSFERTRRILPVYAAIEELGLREKINDSTAAAKLGSIIALSAISDLPEGIFESAPATRSTVYNTWNTEDIAIEKGDPKTASIHIIGLLDPASEKAQRWAPILKILSELDGVYVKLILNPRDEIEELPVKRFFRYVFEPKPIFDEDGRIKALEATFAGLPSDVLMTAGMDVPPAWLVAPKSSAQDLDNIKLSAAKSDIEATYQLKHILIEGHSREDKGSAPRGVQLVLATDTQPFLTDTIVMANLGFFQFKANPGVYSIRLKEGRSHDIYNVESIGAHGWEPVPGDEGTELTLMDFQGVTVYPRLKRRKGMERADVLENHDRHSGTNIVARGFKYAESLLGKFGNEKSKSLLQKEQAEINIFSVASGHLYERMLNIMMVSVMRKTKHSVKFWFIEQFLSPSFKEFIPYLAREYGFKYEMVAYKWPHWLRQQTEKQREIWGYKILFLDVLFPLSLDKVIFVDADQIVRTDMIDLVNIDLNGAPYGFTPMCDSRTEMEGFRFWKQGYWANYLRGKPYHISALYVVDLRRFRELAAGDRLRQQYHALSADPASLSNLDQDLPNHMQFQIPIHSLPQEWLWCETWCSDDDLSKARTIDLCNNPLTKEPKLDRARRQVPEWTIYDEEIAALQTRLKERNTTSRTVSVHPKEPQTDIQLQRDEL

SEQ ID NO: 3948 - protein, 1494 aa, Geotrichum candidum
MKGNTFFSALSLALLFSCSCAADVPATRNKNVQVSLVANGPKIPFQIELLEAIAAENASVYYPLLNEFTTLYEGPAPSDKQLHDFAVSYALDNDYIQPDQVAFIDLALAIHTHSALIHSYYQFHDTLAEPAAQHLEPDCSTWVAYNGKTSCNSDLVFALETAGKSARMPLLLPIDKVLRAPLTNDDSLPYAVLYTDLVDFEGFAKFHTHLYGSALAGKLNYVVRYRAPTTTAESNSARQQLTGYGAELYVKRTDYLVIDDRDTKASESSENSEDSDEVEQLSKAQTVLQPVNEGGTISKANLKLLGFKASKFILESNDPFGALVNVSLDFPKYSFSLSEMPGTRRDWANMVSDNVRPGSNLLYINGAPVATSDDNIFSISKAIDRERTYMNKFKSLGLSSEDALDLILSEIDPKDGDNGDKKKVRYDYRTPSLVWLNNLKTDKRYKQWSADPKRILNLPPNQILPPVRLNIHTIVYVIDFSRPAQYNNLAELLNLMARNSAIQIGVIPIVHTKAAEVIAREFFAAQLEAGSEGAVAFISGLMQSEDHQTIYKHVVGPDSDRDVENDEEVNQLIQEARVFAERLDIDTSAQTVFTNGLITPITQRWFYDITDIVGKDMATLKKFVRKNNGKFEGEPKDLFLENALTKRNSLINPTDASAISFLDISNLYIQKEKYGYVGFSSSGSAENTDNENENLYSFWVAGDPSMSQFKSQVVNALEYVKDTKLNVKVNIVPVVSSVDSVSETGLKVISALTKNNSIDTVLKSLSDLDSADAIRPDELAKFQAHSDIFTSSSVTLVSGGRVISLPTNKLFSPSDLEMLYEADFAGRIQPISELASVNEISINGLTGLDKFDLQDLLVSLVWFVKTTFEEKNSFFVSGPAARVDTTDYLGLEQASFDIPNIYDDDENHEPLVHITAVLDPISEKGQVYTALLKSLSQIPEIKISVILSPKPGLTEIPLKRFYRANIPAKPEFDKDTGKRSQDYLVFTDMPQSTLLNLDLNVPGSWIALPESSVHDLDNIILDQINEPVLEAEYLLKNLLLQGHAIDVTTNTAPRGVALELGTVSTVMTDTSIMANLGYFQLKANPGLWSLNIKKGSSAEVFEFKTVGIPNKNSRVEVADESLVFITEMTGLTIYPTFKRKPGMEHQDVLELTPSIGGFIKNTWNSLFGSTKANDDNAEINIFTVASGHLYERFLSIMTISVMKHTDHTVKFWLIENFLSPSFKQFLPHLAEEYGFKYELISYKWPSWLRPQAEKQRTIWGYKILFLDVLFPQSLDKVIFVDADQIVRTDMIELTEVDLQGAPYGFTPMCDSRKEIEGFRFWKQGYWKNYLGSDYKYHISALYVVDLARFRKLAAGDQLRQHYQMLSADPGSLSNLDQDLPNHLQKQLPIFSLPQDWLWCETWCSDESLLTAKTIDLCNNPMTKEPKLDRARRQVPEWVEYDNFVASLSSKVQSQAVKADVDVSTPSKDAEDEDISKAPTAEDNEGDDEDLYDEL

SEQ ID NO: 3949 - protein, 698 aa, Camelus dromedarius
MPGRLHLAVAPGTAMHNPDLQLAGRFSSRKLSCGLFGHGVHPSPRNQMPIDVFCDSVDTSQETNGLFYMYFRVRSEKCQERASDLVMKVDALLSAQPKGDARIEYQFFEDRHSTIKLKPKEGETYFDVVAIVDPVTREAQRLAPLLLVLTQLINMNLRVFMNCQSKLSDMPLKSFYRYVLEPEISFTSDNSFAKGPIAKFLDMPQSPLFTLNLNTPESWMVESVRTPYDLDNIYLEEVRISLLPSGYFQLKANPGAWILRLRKGRSEDIYRIYSHDGTDSPPDADEVVVVLNNFKSKIIKVKVQKKADMVNEDLLSDGTNENESGFWDSFKWGFTGGQKAEEVKQDKDDIINIFSVASGHLYERFLRIMMLSVLKNTKTPVKFWFLKNYLSPTFKEFIPYMANKYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKKAKTIDLCNNPMTKEPKLEAAVRIVPEWQDYDQEIKQLQTRFQEEKESGTLFRDKTTKEPSREGPHIMNSVYLVAESVDEGLTARDGDAVSRIIGRKQRGSSFADIVTWNRSDTSLIA

SEQ ID NO: 3950 - protein, 1489 aa, Oidium neolycopersici
MGGSNLASRITTFLLINVFQKCVYGFERPSIDVELRTAFPSPPFLLELLETAGNENSSSYFPILDRIADGDFSTTSTDEELYKRFLKFLIDDGHLADPESVSSYQLSLSLRSSAPRIESHYQYYETTAETSFKSDPNESCLNWYLFQGFKYCSPSFDKAPGSVRLALKEEKLLFDRVLGNSSTPVTILYADITSSSFASFHKLLAKNARDGKSSYRIRHRKSTNSQVKPLTIPGWGIELALKKTDYIVIDDRNDDDDDSKTVIPVAEKVAKLEDDELDELKPLSTSEVSLLAVKASSYIMQSNSPLDTLVKLSQDFPKYSSTISSHNVSMEFLTEHHNNRAQLFQDGRNTIWLNGIQLTERQMEIMDLIDIMRKERRLISGMSILGFAPSEAIKLLLHTEIASAQSPDGMDRFDWTDNIEGGNIIIWLNNIEKDKRYSDWPVSLNAMLQRGYPGQLPFVRRDAFNLIIPVDLTDHLDLELILVNALNIVNRRIPIRIGLIPIINNSDTTNQAKVLYHLVDTYGLQTAIAYLRSLSESKPSTNSQETFHQVTQKAKVKTDKTQLSFEEVLRLDDLNSRILASKKWADRLCADDVVPPVFINGVIIPKDESWLQKVSQQIYTDLQLIQQTILLGTESVKSKDFWVPSIFLDEAIHRRNKLIVPENPKDFKFFDLNVLEKSSLEAFKNMPRFISGSSSPNLDSVLMVLIVDLDSESGENLLANTAALHKLLPSIEVLILHNPTSENESKLSHDLFVYLQNKNFTGLEGIENIATIINRQETIHDSSKLEESRMYWQRFAPILRSLELAPGQNAILVNGRLIGPILHAKNFGLEDLKLLVLFEQKRRIAPIYKALKDLGFENKIQSLLQAAKLSSIIALSIFPETKNSIFEEASSIRVNKFNILKSQHTAIEVGDAVNDSIQFTVLLDPASHLGQRWASILKVLSKLKGVYLKIFLNPKNRLTELPVKRFYRYVLDSKPLFDETGAIQSPNGSFSGIPQEALLTVGLDINPAWLVAPKISAHDLDNIKLGSVKSSVGAIYELKHILIEGHSRDVTGDQPPSGAQLILGTKKAPYMGDTIIMSNLGYFQFKANPGYYTISLQKGRSSEIYHIDSIGARGWGPVPGDDEAEVVLMSFKGATIFPRLSRKPGMEREDVLEIKSGPETSFVSQGFKYAQSILSRGNNSPESQASINIFSVASGHLYERMLNIMIVSVMKNTKHDVKFWFIEQFLSPSFKNFIPHLAKEYGFSYEMVTYKWPHWLRAQSEKQREIWGYKILFLDVLFPLSLDKVIFVDADQIVRTDLIELVNLDLHGAPYGFTPMCDSRTDMEGYRFWKKGYWAKFLRGLPYHISALYVVDLRRFRQMAAGDRLRQQYHALSSDPASLSNLDQDLPNHMQNVLPIYSLPQEWLWCETWCSDEALKDAKTIDLCNNPLTKEPKLDRARRQVPEWTKYDDEINALDKRRRGINDLAEKVSESRSFETISEIKTTSKKDEL

SEQ ID NO: 3951 - protein, 1589 aa, Myotis davidii
GVCCKMGLLIVFTGLWLFSLVKADSKAITTSLTTKWFSAPLLLEASEFLAEDSQEKFWKFVEASQNIGSSDHHGTDYSYYHAILGAAFPFLSPLQQNLLKFSLSLHSYSATIQAFQQIAADEPPPEGCSSFFSVHGRKACDVDALETLLLTAPERPKPLLFKGDHRYPSSSPESPVVIFYSEIGYEAFYNFHRQLVSKSNAGKINYIFRHYVSRPRREPVYLSGYGVELAIKSTEYKAKDDTQVKGTEVNTTVIGENDPIDEVQGFLFGKLRDLHPDLKGQLKELRKHLVESTNEMAPLKVWQLQDLSFQTAARILAAPVELALVVMKDLSQNFPTKARAITKTAVSSELRTEVEENQKYFKGTLGLQPGDSALFINGLHIDLDTQDIFSLFDVLRNEARVMEGLHRLGIEGLSLHNVLKLNTQPSEADYAVDIRSPAIAWINNLEVDARYNSWPSSLQELLRPTFPGVIRQIRKNLHNMVFMVDPAHETTAELMSIAEMFLSNHIPLRLGLIFVVNDSEDVDGMQDAGVAIMRAYNYAAQEVDHYHAFQTLTQIYNKVRTGEKVKVEHVVSVLEKKYPYVEVNSILGIDSAYDQNRKEARGYYEQTGVGLLPVVLFNGMPLEKAQLDPDELETITMHKILETTSFFQRAVYLGELSHDQDVVEYIMNQPNVVPRINARILTAEREYLDLTATNNFFVDDYARFTALDSQGKTAAIANSMNYLTKKDDSFIRPVTFWIVGDVDSPSGRQLLYAAIKHQASKSSNNVRISMINNPKEDINYENTRISRAIWAALQTQTSSTAKNFITKMAKEGTAEALAAGADVGEFAVGGMDFSLFKEVFESSKMDFILSHAMYCRDVLKLKKGQRAVISNGRIIGPLEDNELFNQDDFHLLENIILKTSGQKIKSHIQQLRVEEDVASDLVMKVDALLSAQPKGDTRIEYQFFEDRHSAVKLRPKEGVTYFDVVAILDPVTRESQRLAPLLLVLTQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSASPVVMDTIVMANLGYFQLKANPGAWILRLRKGRSEDIYRIYSHDGTDSPPDAGEVVVVLNNFKSRIIKVKELNPVLTPGKAYRSRTSWRETALPVLSRSPAGSASESGQRLRTQCLLPGRTQLRLPRAGHRVVQKKADMVNEDLLSDGTNENESGFWDSFKWGFTGGQKTEEVKQEKDDIINIFSVASGHLYERFLRIMMLSVLKNTKTPVKFWFLKNYLSPTFKEFIPYMADKYSFHYELVQYKWPRWLHQQTEKQRTIWGYKILFLDVLFPLVVDKVLFVDADQIVRADLKELRDFSLDGAPYGYTPFCDSRKEMDGYRFWKSGYWASHLAGRKYHISALYVVDLKKFRKIAAGDRLRGQYQGLSQDPNSLSNLDQDLPNNMIHQVPIKSLPQEWLWCETWCDDTSKKRAKTIDLCNNPMTKEPKLEAAVRIVPEWQDYDQEVKQLQTRFQEEKAAAARGKEPRADGPQTHEEL

SEQ ID NO: 3952 - protein, 1616 aa, Arachis duranensis
MVSRSIHRTWLLIVAACLPLLLIPQPALSQTPRPKNVQASLRAKWSGTPLLLEAGELLSKEDQRLFWDFIEVWLNADEDAGGSHSAKDCLKKILEHGRPLLREPLASLFDFSLMLRSASPRLILYRQLAQESLSSFPLSDDDSFSENDKIGENKFNPLHDGVDLRSPQGKCCWVDNGDQLFFDGSLHVLKFVIRVGDSFQRPEVFDFDHVHFDSGFGSPVAILYGALGTSCFKEFHGALVGAAKEGKVKYILRPVLPAGCEAGIGHCGSLGASESVNLGGYGVELALKNMEYKAMDDSTIKKGVTLEDPRTEDLSQEVRGFIFSKILERKPELTSEVMAFRDYLLSSTVSDTLDVWELKDLGHQTVQRIVRASDPLQSMQEINQNFPSIVSFLSRMKLDEAVQDEIVANQRMVPPGKSLMALNGALVNIEDVDLYLLIDLVHQDLLLADQFSKLKIPHSTVRKLLSTSPPSESSTFRVDFRSTHVYYLNNLEEDAMYKRWRSNLNEILMPVFPGQLRYIRKNLFHAVFVLDPATSCGLKSIDMIISLYENNVPMRFGIILYSSKYIMQLENHSTKDGDKFEEDISDMIIRLFSYIKENYGTPLAFQFLSNVNKLHTESDGHADDALELHHVEGAFVETILPKVKSPPQEMLLKLEKEQKLKELSHESSMHVFKLGLSKLECSLLMNGLVIDPNEEALFNALNEETQRIQEGVYFGQINSHTDVLDKFLSEAGIQRYNPQIISDNKPRLISLSTFIFGEGSILNDIDYLHSPGTMDDLKPVTHLVAVDVTSSSGIKLLRHALNYLVSIVLFRLKIIVLLKLFGPINSTKVFGITTSSYSHKKNVLDFLDQLCSIYQQKYFHTSAVEVDGTQAFIIKVSELAEANGLPSKVYESSLLEFSADEVRRHLSKVENFLYRALGSESGVNAVFTNGRVTYPIAEGTFLSADMHLLESIEFKQRTKHIVEIIEEVKWQDVDPDMLTSKFISDIVMGLSSSMATRERSSESAHFEVLSDQHSAIILNNENSSIHIDAVLDPLSPTSQRLSGILRVLWKYIQPSMRIVLNPVSSLADLPLKNYYRYVVPTMDDFSNTDSSVNGPKAFFANMPLSKTLTMNLDVPEPWLVEPVIAVHDLDNILLENLGDTRTLQAVFELEALVLTGHCSEKDHDPPRGLQLILGTKSTPHLVDTLVMANLGYWQMKVSPGVWYLQLAPGRSSELYILKDGGDGNLDKQSSKLITINDLRGKVVHKEVVKRKGKESEKLLIPDEGEQDKNEGGSWNSNFLKWASGFISSNELSKKAESSSSDKGSSGRHGKTINIFSIASGHLYERFTKIMILSVLKNTNRPVKFWFIKNYLSPPFKDLIPHMAKEYGFEYELITYKWPTWLHKQKEKQRIIWAYKILFLDVIFPLSLEKVIFVDADQVVRADMGELYDMNLKGKPLAYTPFCDNNKEMDGYRFWRQGFWRDHLRGKPYHISALYVVDLKKFRETAAGDHLRVFYETLSKDPNSLSNLDQDLPNYAQHNVPIFSLPQEWLWCESWCGNATKSKAKTIDLCNNPMTKEPKLQGARRIVSEWPDLDLEARKFTARILGDDQETMQSPNQSNDMSSDDSLQVDAESKAEL

SEQ ID NO: 3953 - protein, 1560 aa, Cynara cardunculus
METRIRSGLRILLLIAVCIIVCGYSVSAETQRPKNVQVALRAKWPGTSLLLEAGLDIRYSKLTGYHMHAFMGTNGMRLTLRVPELSFYSGVAESLELLSREWKDLFWEFIDVWLNNESGNTDPYTAKDCLQKICNYGKSLVTGPLASVFELSLTLRSSSPRLVLYQQLAEESLSSFPLSDDLSTSSIDGGVSELNEGKKDKKADSLLVGVNPSSPGGKCCWVDTGGALFFDLPELQLWLRSPHKDGDIFQQPELFEFDHVYFASSIGSPIAILYGALGTDCFKEFHLSLVEAAKEGKVKYVVRPVLPSGCESKSGHCGAIGTKDPLNLGGYGVELALKNMEYKAMDDSEIKKGVTLEDPHIEDLSQEVRGFIFSRILERKPELTSEIMAFRDSLLSSTVSETLNVWELKDLGHQTVQKIVHASDPLQSMQEINQNFPSVVSYLSRMKLNDSIKDEILSNQRMIPPGKSLMALNGALIDIDEIDLFVLLDMVHQELSLADQYTKLKIPSSSVRKLLSTLPPPESNMFRVDFRSEHAHYINNLEVDAKYRQWRSNLNELLMPVFPGQLRYIRKNLFHATYVLDPASICGLETVDMIISLFESALPIRFGVILYSTKLIETLEANGGEFPLSSLENDNHTPIPLRQRESWDAERLSISQQCKQIADGVRRGRCTFAAPCGGGICRNNILEKDQSFREPSQASSLFIFKLGLAKLECSLLMNGLVHDYNEDSLMTAMNDELPRIQEQVYYGQINSRTDVLDKFLSESGIQRYNPQIVGDKAKAKFVSLTASFLGDESLLNNIEYLHSAGTIDDLKPVTHLLAVDVKSRKGVKLLHEGIRYLMAGSANARVGFVFNSDVDPDSNSLTFMKVFEIATSSYSHKKKVLNFLDQLCSFYGNEFRLGSSQDAQSTQALLNKISDLADANGIQSKGFMSALSEFTVAKLTSHLKKVGQFLYGQVGLENGINAVITNGRVVRVPDDVTFLSQDLHLLESVEFKQRIKHIADIIEEFLFLLNASCSKFLSDVIMSVASSLSTRDRSSEGARFEMLSAEYSAVVIGGQNATIHIDAVIDPLSSSGQKISSLLRILWKCSQPSMRLVFNPMSSLVDIPLKNYYRFVTPTMDDFSNTDITVHGPKAFFANMPLSKTLTMNLDVPESWLVEPVIAIHDLDNILLENLGDTRTLQAVFELEALVLTGHCSEKDHEPPRGLQMILGTKKNPHLVDTLVMANLGYWQMKVSPGVWYLQLAPGRSSDLYIMQDGLDMRSTKRITIDRLRGKPVHLGVVKKKGKEHEKLLIPSDDDDSSRKQVGFLLFGDQDSWNSNILRWASSLIGGNVQSKKSGSTKVDVIPHMAQEYGFEYELVTYKWPSWLHKQKEKQRIIWAYKILFLDVIFPLSLEKVIFVDADQIVRADMGELYDMNLKGRPLAYTPALYVVDLVKFRETAAGDNLRVFYETLSKDPNSLSNLDQASANSHTFQHVPICQTMPSTRYQSFRFHKNGCGVSLGAGAKRIVAEWPDLDLEARHFTSKILGEGVSPVEKVVSPIEKIVSPPAQPQEPEEDLESRAEL

SEQ ID NO: 3954 - protein, 1620 aa, Coprinopsis cinerea
MKRGLQLLLAAAALSLSAADEIPQVEISLKTSWPAPPLMHEILESIALENPYEYFTFLDALTDPTAVPKNTELNPEDIYKAAIELGISRGFNLATGWIANLKANLALHSTSPKIEAFYNYYTNYVNNTKGNECGSWVDWYGEVVCDVDTLTRLTAKDPIGDGKYPRPQSLSFDHIYPPPDRVAEKPPRTAILYAQFASPNFRALHSHLYDLARQEDARVEYVLRYVPPPPSDKPREPNVLSGYGVALDLKKMDYLALDDRFQQENSVAQHNGWGRPYDPVLDLIEAHPEKPDAPNATVPLTEEELAGLGAQAIQVISEGYAPMEIFQQLAEDFPKYATSLARRVVANESIVEELKENSVKAKGGVNMFWLNGALVENYDVEALPLLRMLRKERDLMLSLTRLGLSREQAFDVLTHPIISAAHRDTSDALFDASDRQEGGDVVFYFNDIEKDSRYSNWAPSLHELIRPMYPGQFPNIKANLFNVILALDLSQVTSLNFIAGPVSNIIERGMPFRFAVAPIIETEDGKKMARLFYYATKTFGKKKTVELLRNGAVHDLQPDDPIPPVRWSAIEEGFNQIASALETEDPEKKILPFKQVLEGKAMAEGLEDKIQAYHKRLDTTLATGPTGHAFFNGKHIVFDQTFLKHLREGGMEQQQFLMEQVYRGVLKDDILKEKGMGDYWYDLPKTNKRRNRYIFPTSHKDLKVVNLPDALHTKAEMSFGAESFVYPKNAQIQTPIFTTFIVGDFESEAGLALAREALKLVESEKSQSRITFVPNPAEWAAVKDESANALVSKLVTKKALKAASPSIVAKALNVDISSPVSSGDDKQVPLSSKVAITQLLGSEPGEVDKKEVRRYLKRSRIFAREAGVKPGETAIIINGRVIGPIPVNDFSVSDFEALEEYEAVKRTGPVLGALNAVAGSLNEDKDKFADAIYLASSIISWTQIPDPSQAGLFDAPPRPRTRNYEQLNDTYTSFEFGDREYALYYLTFLVDPLSPTGQKWAGIMRWLSMSANVYIKVYLNPDTYKEMPVKRFYRSCLEPQILFNFWSREDPAKVQFKGLPTDPIYTLSMDVPASWLVRPKESRYDLDNIQLTQLFPEDKSLKAVFSLDALILEGHARETATQTPPRGVQLQVVASDPSKEEKAVPVQDTLVVANLGYFQFRLNPGVYGLEIREGNGRKIYDMESVGGLGWDSPGVDEVGNQVALTDFEGVTLFPRLKRKPGMEKVDVLEEDKASSGVLENISTKVKSIFKGKETGVVPVKEQAEINIFTVASGLLYERFASIMILSVLKNTKSTVKFWFIENFLSPSFLEFIPHFAKEYNFDYELVTYRWPSWLRAQTEKQRIIWAYKILFLDVLFPMDLKKVIFVDADQIVRADLKELVDLDLQGAPYGYTPMGDDNKEMEGFRFWKTGYWKDFLQGKPYHISALYVIDLVRFRHDILRGQYQALSADPGSLANLDQDLPNNLQRQVPIFSLDEDWLWCETWCSKDRLHRAKTIDLCQNPLTKEPKLSRARQIPEWEEYDAEIARFTRRLAEEGKISSGLSTADANVLAGASNTEPEEVAKPEEVKPETKEESSPVPETKEEPAVPEKKEEPKETVEEEAAPSSATSVEAEAARPTDEL

SEQ ID NO: 3955 - protein, 1516 aa, Microplitis demolitor
MWYFRIICLLLISSCIAIVDKKHNKYVTTLINGKWKDTPIVLEVAEYLNDENTNLFWSFVDLISKQDDDFITKGTDKEIYDKVMSLAENFVTPTGLAVLKLSLSLRIYSARVEMFSQMAENKEKIPDCNNFIDVGGSKFTCSADQVEELIKNSKENLDTYSVDHQYPGSSKVNKNVILYGQMGSTGFNQLHNKLKSIADSGKITYVLRHYVKDRPDNNLRLSGYGVELQMKSTEYKATDDADIKDSSGKESEENNEGVEEIDGINFGVLKKLYPEKKSQLDELLTHLLDTSDEVSALKVWQFQELSHQAAERIMKSPPSEAVKVFTDIAQNFPMQAKSLIRTKVSNEMKKEMKRNQEIFFGNLHIQPTETVLFINGLYFDIDVIDILALLEALRAELRVMEALLKIGFSNKKMDKLVALDLSSNLDNQDFAIDIRDSAIMWINDLETDKRYQKWSSALTLLIKPMYPGTLRQIRRNFYNLVLIIDPLSDKIKHLLNTVDTLNKHTAPIRVGFVFVTNFNTSVTGFTDPSVAVNNAFHYLMEERNSMEAFKFLLTLQNYISGDSIDVSDVKKALRIRDPSADIDDIFGEESQYDVGRHLAMDFVRRTGFKSFPQVLLNGAPLGNIDDADAFEETVLTTIMTQTPMLQKAVYKGEVVESDDIVDFMMSQPNVMSRLNDRILQPENSKWLNLIGDLPKNDEVSSWSQQDTATWLMKNSNYLVMPRRVAKQHLYSYWIAVDLEDKKGRELLRDAIKYLDSNADVRITIIVNSADKSGDTDSDVNINTIVLAAMEALSQQKVVKYIDNILQEDNVALIKDRKFDLNDDSVKEKLNNQEFKLKVHKHYAKTALKLVPGDRAVVCNGRVLGPLDKDEDFTRDDFSLLERFSHNTYGEKLVKNLQTLQSADDDDDDTEISDDVIMQITSLLVLRPQTLNRYDVPYSGDEHSVIKVPAARPNEAAFNLIAIVDPVSRGAQKLGAILSTLQQSLNCNIKIFLNCVDKNSDMPLKSFYRFVFEPELQFNADGQLMGAQARFTKLPTSSLLTQYMHTPENWLVEVVKSVYDLDNIKLDNVAMGVHSEFELEHLLLEGHCFEASMGNPPRGLQITLGTEKQPVMVDTIVMANLGYFQLKANPGEWLLRLRQGRSADIYDIHSVTGQDVIQDNNEVKVLISSLKSHVLKLKVSKKPDKLHTDLLADDDIQSGIWNSISRTFGSDDTEDKDEKINIFSLASGHLYERFLKIMMVSVIKHTKSPVKFWFLKNYLSPTLKDFLPHMAKEYGFEYELVQYKWPRWLHQQTEKQRTIWGYKILFLDVLFPLDVKKIIFVDADQVVRADLKELVNLDLEGAPYAYTPFCDSRKEMEGFRFWKQGYWRNHLQGRSYHISALYVVDLKRFRRIAAGDRLRGQYQALSSDPNSLSNLDQDLPNNMIHQVAIKTLPQEWLWCETWCSDGSKKSAKTIDLCNNPMTKEAKLQAAMRILPEWVGYDEEIKALQLRIENENKQLEREEKDEHVSEDHSKHEEL

SEQ ID NO: 3956 - protein, 1507 aa, Lygus hesperus
MEFTRLRFLVVLSILLMLTLTVVNCKKKQKSVSTVLDAKWEITPLVLEMSEYLSDESQTSFWNFVDVLSEQKEPIVFEKTDKAYYDRAIELIGSFLSEAQVSLLKFALSLHVYSPRVEMFCQIASQKQLQCPVAAYVDGNFECDVLQLQSAIKNAQAAPVKNHTADILTLDHKYPGSDSGPLVILYGELGSPEFSEFHKYLSDKAKRGEIQYVIRHWVKERQQRKVRLSGYGVELQLKSTEYKAQDDTKVEGGGSEVTEEDEEEEIEGLNFSKLKSLYPDKASELEKMKLDLVESSNELAPLKVWQFQELSLQAAQRIMSAPKEEVLHVLMYIAQNFPTQARSLVKTVVSQEMKNEMRQNQDRFATTLHLQPSDTALFVNGMFFDLETQDIFTILEYIRDELRVTEGLNDVGVTDKKASKSLLALDLSSTGVDFGLDIRDSAVTWVNDIELDKQYNRWSSSLMDLLRPTFPGMIRSVRKNLYNLVICGDPSKQEVIPLIKLVQSFLIHNAPLRLGIVFAVDGTKTGLEDSGVALLNAYNYVLEMSDSAEALNFLTDVYAAANNVEITPALIHDLLKSKHSKADKDEVFGADTDYNTGLKLAMDFVEKSGLRYMPQVLMNGVPLPQKSLTAEDFEEAVLSEIMNQTPVLQKAVYKNELKDNDNVIDYLMNRPNIMPRLNDRVLSTSKSKYLTLTKFANPTIRNLMDGKLNYVSSKSHKKVHLISNWIITDLETDRGRALYLNALNHMSGSSGMRTALIINNANPEADKNLVNKAVLCALSQVNGDKVTKKIKNILENANDVAKGLKGLKDFNLDDTCLKTVDETLISHEIFIADGIGFPRGARGIVSNGRLLGPFDDGEIFTLDDYDLLERFSLSTYVDKIYRALTKNAEDPDLIDSDVIMKSVSLLASRPESKSRFEIKAFSEEHSVVKLPTATNGPALDIVAILDPVSNGAHKAGTILSTLQQVVNCDIKIFLNCVEKNSDMPLKSFYRYVLEPFIQFTPSGQMAPGPMAKFLNMPGAPLLTQNMLVPDNWMVESIASPHDLDNIKLDQVDSNVHSHFELEYLILEGHCFDSALGSPPRGLQIILGTENDPNEFDTIVMANLGYFQLKANPGEWTLRLRHGRSAALYDITGYSHLGNDFAFNATESGIKILLSSFRSHTVKLKVTKKPDKVNVDLLGEDNEENQGLWGSITSTFGGRDESPNEKDEVINIFSVASGHLYERFLRIMMLSVLKNTKSPVKFWFLKNYLSPTLKDFLPRMSKQYGFQYELVQYKWPRWLHQQTEKQRIIWGYKILFLDVLFPLDVKKIIFVDADQVVRADMKELVDLDLGGAPYGYTPFCDSRTEMDGFRFWKSGYWRNHLQGRKYHISALYVVDLKRFRRIAAGDRLRGQYQALSQDPNSLSNLDQDLPNNMIHQVAIKSLPQEWLWCETWCDNSSKKKAKTIDLCNNPQTKEAKLTAAMRIVPEWKDYDNEIKQFQLKLGATEDHEEENEDHTSSKSAHGSSHTEL

SEQ ID NO: 3957 - protein, 791 aa, Colletotrichum higginsianum
MTAFVLGKALAFRRSNPGVRLDVVYNPLTPASASAVNAALKNGGDKFTEAESLPEIRSILDNAAGEPDGIFAAALNEFLSFAAIKPGSNVLILNGRVVGPFTEAEPFQTDDFQYLLEFEQKARILPVYAAVDELGLTEKISGPLAAAKVTSVTAISTISDLPAGIFESAPSLRVSAHDTWSSSYTAIEIGNPETSSIHIVGVLNPASEQAQRWAPILKVVSELDGVYLKLFLNPKDKIDELPVKGFFRYVLESEPSFDETGKVRALEASFKGLPSEALLNAGMDVPPSWLVAPKVSLHDPDNIKLSSIKSNVHASYELESILIEGHSREGGQSQPPRGAQLVLGTEKEPHFADTIIMANLGYFQFKANPGFYNIQLKQGRSSDIYTIDSIGARGWTPVPGDEGTEVVLMDFQGTTLYPRLSRKPGQEEADVLAEPEDKSIVGRGLKFAEGILGKKKSASDEEHAEINIFSVASGHLYERMLNIMMVSVMKNTKHTVKFWFIEQFLSPSFKDFIPHMAKEYGFKYEMVTFKWPHWLRQQKEKQREIWGYKILFLDVLFPLSLDKVIFVDADQIVRTDMISLVNHDLEGKPYGFTPMCDSRTEMEGFRFWKQGYWANYLRGNPYHISALYVVDLRRFRELAAGDRLRQTYHSLSADPNSLANLDQDLPNHMQFQIPIHSLPQEWLWCETWCSDESQKDAKTIDLCNNPQTKEPKLDRARRQVPEWNVYDNEIAALDRKRKGLPVEAPKKGENKVGGGDKGEQQEPDVAEEEKNTKSRNWEEPPAEKTHVIDEL

SEQ ID NO: 3958 - protein, 1662 aa, Micromonas commoda
MSFKISHAVVLCMLFPAICAANYQDVEVSFTLTTRWQATSFLLETAEFFADYGPDSYWAFTESWLEPGDHDCRARILNAARGASDSEDIFKALQLALRVRQYSPRLEMFRSIAQESFKNNFNRNFEEKQMLKCCWAELGTSGFVATTEEELRNLIFSSSKINVSGIRRSSVFDHVYGGLAVYMNMSKTGTGQLESQNMTPLGSPTIILYAALGTSCFNSFHNIMAAASLRGQIQYVHRPILLAGCEVSGCVGLGATDDELRLGGFGVEMVIKNTEYNSVDITRIRSKDDGDMSKMRHVLSRHVEVGGCNLTALVVRFPGLASKLTTIPNHPQHENIRENLDIWHFKNIGLQATHRILSAADPFQMLEDISQNFPSLAASLSRVEPGNILMTEIIENQKVIRPGAHVMHMNRRPLNLDTIDLFSLVEHIWTDIREGHSLKDFGLDSEQIRALLQPQLPMQIAFGEGQPRINLEDSDRLVSWTNNIELDKNFEDWSRSIELLISAQQDGSIPRLRRNIFNIVAVIDLSQREGLNLVSTVQRYINKFDVPLRLGLVFVDREAESESEWKRDANDNGVFQNKKQNGDFELPFGISIGTALARAGTLLSRRYGGKYAGEFARGIGETHKLISRVNVLNDPFYNNATWAAAKEIFNQIFKRAFVAREYSTKGVRPDEDTIDMQLQFALADILSFDLDERDDLTPSSALYVSQAKDLIAAKGITVPSVLVNGLYCSLANARKLESELEQVAMHLVQLEIQTFATAISEGNLTDKILDTYPGGAYGWVLRDATPRYVPFIQDAVIFPSTYLVMRPPSNRVESHTYPIENFVNYICKDSLKVKDTTVWFVSDASRPAAKAVIDAAIDFNKRTWKGAHCQANVRFAVLHPPGVAPSQEAREAAQKFRSHHLGDYDLDSLLVQQGNFVARLLGQEHMATFRPPEVGLLIVNGRILDIPRDYQMDAEDFCLLLSQEHRAHIDLVRQIVGRSVPRSLTATDTTRISDMYMLSTSLLAWRRSEYGVRREEAEILKVLEFTKSAVSISGHGTVAFEAVLDPLSKDAQRVISLINVIKETLTSSVTVRIVLNPINTLHYLPLSSYYRYAVPLAPISIHPRAYFTGLPLKEKYTAHLDIPEAWLVTTTATQYDLDHLSLEELPDGFNLVEAEFQVEALLVTGHCVDINSNEHPRGLQLTLKNPSERAGTIVMSTLGYFQLPAAPGVWSLELRPDQSASNYYMVPNDEFGKYAQKYVYQQPTQDRGVEFMSNHAELYVASWKGISLNLYVKRRPEMESQDVLSGIDHPASLETERKSRITNVQLYVPSVKLNGRFSFSSILASFLGRWKLHTFADTGPSDSLKKLTNSDMPRSRIAENASRDLTLAEACHGEKIHIFSVASGYLYERLIKVMMLSVRRNTKNPIKFWFVKNWLSPRFKQYLPHFASRYRFEYELVTYKWPTWLQKQTDKQRIIWAYKLLFLDVIFPLSLEKIIFVDADQVVRADIKELWEVDLHGAPYAYTPFCDDNKVMDGFRFWKQGFWERHLDGKPYHISALYVVDLKRFRQLAAGDTLRVIYENLSKDPNSLANLDQDLPNYAQHQVPIFSLPQQWLWCESWCGNQTKLSAKTIDLCNNPMTKEPKLKGAVRIIAEWSSLDNELQQHTLEVEQLMSNISGSKSNWV

SEQ ID NO: 3959 - protein, 1535 aa, Coniosporium apollinis
MRAWLRPGRARTLLLLGAIAPFHITASPTVNVALRASFSSAPYLVELLETAAEENSTAYFPLLDRIADGYFDKAATDYELYTTFVQLLHDDGHITDPDTLSSFEFALSIHSAAPRIEAHYQYYNTSVEQALATVQDKPCESWVAFGDNQYCSPELDSAQGTLKSHRTDDLPFDRILGDSSGALPSVLYADITSPSFGRFHKTVSRSAKEGKTSYRIRYKRSASGSNEPLVINGYGVELALKRTDYIVIDDREAEQAGTKEAPKPAGDTLQDEDVSDLKPLSASELSGLSLKTASFVLNTEDPLDTLLRISQDFPKHSSAVAAHNATAEFLAEHSNNGELALPPGYNVFWINGVQVDPRKIDAFSLLDHLRRERRLINGLQSLGFSGPEAISVLSHSAVAEAQAEDEPQRYDYRDGPEGGNVIIWLNDIEKDKRYEDWPTSITALLQRTYPGQLPPVRRDIHNAIVPIDFSNPKDVSTVVETLQNIIRRNIPIRWGLVPYTGSPAAAQQARVAYHLLDAYGLGALMTYLENSSANKKLLMPHQTTFDSVTTDRRLKKDRVSRSLQEVLQEESLEDRLQGAKKYLMRLGAYGDSAPVFVNGATIPRTEEWLQTLSQRVGLDLRRIQKGVFEDEFTETTWLPAQFLAYASLRRNPLIIPEDETNITLLNMGEIISEHGDLFSNCPRIAVAEGSDKEQWATLMLIADFDSLAGQQLWVDAINFRKQHSNVELIFVHNGEASSKVLDTSARLYRFLEHGSSDSLESLEDVLASEVSSEDTKEAAHFWTSVQPLIRALKLKPGKSGLTLNGRLIAPIPEDNAFSAEDLETLLAYESRKRVQPVFTAVKALDLVDKLNSPMAVAMLSSIVALSTVSDVPEGIFETAPTQRSDVFNTWSAEHTAITTGDQATAAIQVTVSLDPASEVAQRWVPILKALSELSGVYLRLFLNPKERLDELPIKRFYRYVLDSRPSFDDNGALQGLKARFTGLPEEALLTMAMDVPAPWLVTPKECVHDLDNIKLSTLKGSSDIDATYELENILIEGHSRDVTQGIPPRGTQLVLGTERDPHFADTIIMANLGYFQFKANPGFYELGLQAGRSSEIFTIDSAGTKGYNAQPGDETTEIAFMSFQGVTMYPRLSRKPGKEDEDVLEPPKSAAADMASKSTELKDKVLSKLGLSGTKTEKAIAKGLKRVSGLLTKTILPTSAVTRSAHADINIFSVASGHLYERMLNIMILSVMKHTTHSVKFWFIEQFLSPSFKAFLPSLAAKYGFQYEMVTYKWPHWLRAQKEKQREIWGYKILFLDVLFPLDLDKVIFVDADQVVRTDMYELVTLDLHGAPYGFTPMCDSRTEMEGFRFWKQGYWANFLRGRPYHISALYVVDLRRFRQIAAGDRLRQNYHQLSADPQSLSNLDQDLPNHMQHVLPIYSLPQEWLWCETWCADEELGKARTIDLCNNPMTKEPKLERARRQLPEWTEYDEEIAALARRLKNGDGVGGRAPIKEGVDERGSETGYEEDDEGEGEAVKIGVPPPQGGIKSRVVDEL

SEQ ID NO: 3960 - protein, 2124 aa, Parasitella parasitica
MPTSRIHRAILGLVAVGLCNFVSADASPTVDLTMIAPWSAPNLLIEVAETIATYNESAYLDSIHDFISLEQQSTSWTPHQTYKEALKIVSALGADETNFFKLSLAVHEASPRIEAYNQFYKENVVPSIAQYNDECDVWAQIENQQYCDEAQFTDALLSTESATPKKPIEILPFDHIVSNAASEPTVALYTDRFSNKFALFLDALRHHNVAHVIRYRPSITNVPVPLYLSGYGVEMALKKTDYLVIDDRSSQKASSIKDKISNMGKKFGQSLFQATQNEAIEPVTPSEIHRLGFKAAQYVSKSSNPLTTLNQLVQDFPKYAKSVSELDIDTAFEEEILDNQLNFLRAGMSAVWLNGKGLEFSQMDPFFLIRALRSERKLVAAFENLGFTAKDAIEVMSNPALTIATQAGNAAHNEIFDMRDTAAEPFVVWWNDLEKDTRYSEWTSSLEGYIRPQYPGQLLPVKRNVFNLIMIEDLGQRDSIARVVNELHMMIKRLVPVRFGIVSIIKEKDSLSTKMAQSLSYMIQEHGKGAGMNFLTLVLETIHSEGEGELTLETIANSFAKTVSRSGKPKSGKKTSFEEALATQDAYTQASSSFLKRMQIAELGPQDGVMFINGKLLEFNEERPWVQVLMPALHEITREIQRMVYLGDFLDESFDFYEYTMSQPNVVKHRNSYIVPSNVHPLVIQEFATAKRSDKLRYFQTAANTTQQASINLWVLADLDTASGARLAFEALSYAQTNPKVRIALIHNSADARNDQDATAPIVDHDNQPTVSDLLGNLIFANKAIGIEQLSKFVENAIEQVNKRSSSGNLAPESIIPGSPIIEMEAKAQSENWKALVDALGKDGLDKSFNGIVVNSRLVGPLPPSAVFSKENFAALVDLEYSKRIAPVEQAIAQVKYAIPASDDLADVITRISVLIEKDKAITSKSVVEENEPVYRHRVYDKIPKTKHTRLVIGDPDNSFLQIGFIIDPLSETAQKWVPLINTLATIEGVSVIMHLNPINGLEELPLKRFYRYVFDNEPHFDPATGVQEIPTAYFGELPTDPLYTLGVETSNAWHVTVREANMDLDNILLNSLSKEEHGVSAVYELENILLEGHCLDSSSKSPPRGLEFEIATPSNHSRKDTLVMANLGYFQLKALPGVWNLGLREGRSSDIYSIQDIGTKGKWNWDTSKENETAEKAGGVLALTSFEGITVMPLVHKNPGMESKDVLESAADKKHGDGLWSSLSSKLFGSRKAQDLVASKAKQAEINIFSVASGKLYERFLSIMIASVMKHTQSTVKFWFIENFLSPEFKDFVPYMAKEYGFDYEMVTYKWPSWLRAQREKQRTIWGYKILFLDVLFPLDLDKVIFVDADQVKHGHIARFARCCINQSHYQIQIVRTDLKELVDMDLQGAPYGYTPFCSDRTEMDGFRFWSEGYWKSHLRGKPYHISALYVVDLVRFRQLAAGDRLRAQYQQLSADPNSLANLDQDLPNNMQHQVPIFSLPQEWLWCETWCSDESLKTAKTIDLCNNPLTKEPKLDRARRQIPEWETYDNEIDALPPIRNNRSTNKVHSNVGNIHDSNEDILRIIKLYNHGTIKTINDEATLNGIKYPRLLKYRASNFYIFLTAALSIFTSIYSTASLSTITVYIIEKQIRPSEATIHNGVDIFSDNAVAYVLSSFFLSGLLLGSLMFGWLGCQIRQRKYLLLIGTCASILAGGGFMVSIEYWMLFPAKFLQGVSNASIWVFSSALIADVWPQRMASGLTIGGVVLEYSDHKVCFFCALALACLTLVMQICIVERCTIPSDWLETKESCQADHRPEMQENLFNEMQRELNIMEEGAMWSKSSSLSTINLRDQPIIFENEKDATMKSTTKEAFQNLLVVRLVGSAQFMSCLYQLVVLSAILGALKPSLFIKLEYQMSILNASFRNAVLSTFLLPCAIFSFTGGWLCDRFGTKIVGLTSAIVSIPAFIWIGVPNQNIQSVVSALVVGGITLSGIAVSAVHTTLNDMQKILIQNQHDKTKLQQQQYQQKHMPATFAIVYLMSGVGLFSGFFLSKLNDIIGFFWLCFIFSMLLLTCVPLMAYFGKGKLKNNSQTDLSASTSKKSIVNNTRPESFAESILSDDETTIGSSSRSDCNVNLESKSIIVIP

SEQ ID NO: 3961 - protein, 3282 aa, Trichinella spiralis
MTVFCANFTVESLLEATVYSMWVFPLIVVCFVSPVLVSPRKAHKNVIVSVRSKWPSTSLIMEASEFMSKESNEKFWQFIEAVIDKHQNSLGNKTDREVYNGILQIGDQILKSKARLEFLKLALTVRVHSATVEMHRQIAATSLDVQNGKSVYAVVHGKQISDLQQLDTILKHAEALARPVTYQFDHIYPGSKQGSVCVLLYADIENPHFKPWHLQLKKLVQRDGISYILRHYPKMNDDMVALSGYAVELAIKSTEYKAVDDSDKQTGSESGVSSSEEEVTDLNGFNLHLLEADELTPLKVWQLQHLSFQAGQRVMLAPKEEALRVLRDISQNFPIMARKDFTLLYAMKGNDPNAEYAVDYTQWSPQIFVLRLGDRASQNLLSTAYQMYEHVLPIRIGFIFVVNNDKSVSGYDDAGVAMLNAFNFIKEDRSVSKAVMFLIKIYNTVMRETISVEDVHKLFKSSYRDEDLKSVFNSEEYNQGRSISPEHIEEAILSKVMRFTVDIQKDVYEGNLKENMDVQQHLMKKPTVLPKLNYNILQMENIFLDMTDTSMDMRIALIHNPKSEAQATKGTASLVQACIQFLPLYQSKAVIGKIFANKITTLEDLINLSPSGISWPEFKKAYNSMSDIWMQLHVHYAKFVLNLDPGVGAIVANGKIEASDPTAAQFDIVAIVDPLSPAAQKMSHLLVILSSVLNVHMKVCMNCKSKLSEIPLKNFFRMVLPRELEFADDGSLKAQPSARFSALPQKQLFTLNLIAPQSWMVESVDAVYDLDNIKMEEVKGDVVAKFQLEYILLEGRCFDERSGSPPRGLQFTLGTFHEPFMFDTIVMANLVAKKNDQLENELLAESEDAESESLWQSISKTFQSGEKYDVINIFSLASGHLYERFLRIMMLSVLKHTKTAVKFWLLKNYLSPGFKEFLPYMAAHYNFSYELVQYKWPRWLHQQTEKQRIMWGYKILFLDVLFPLDVKKIIFVDADQVVRTDMLNLMELDLEGAPYAYTPFCDSRKEMDGYRFWKQGYWENHLAGRKYHISALYVVDLKKFRQVAAGDRLRGQYHFLSRDPNSLSNLDQDLPNNMIHQVKIKSLPQEWLWCETWCDDKSKKFAKTIDLEPKLQSAMRIIEEWKDYDSEIKDLLDQRTKDKWKITEQKIVDIGFQFTAYFLVFLEESWNRAMNKENQVQDNRKAEITRRVVESCFAGLKCFPAYYSDQKMKNDSVDCSHNRDKFKNYYRKHWDTDITVEDETVVELKNRILKGDRSALASAITLVESNHPTKRAQGECLLQSMLKISKKRFDEHGPKSLIFRIAITGAPGAGKSTFIESFGLYLIRELKKKIAVLTIDPSSERTGGSIMGDVARMNELSKEPNCYIRQSATAGTLGGVRRGTHESVVLCEGAGYDVVLIETVGVGQSESAVANIADMVVLLLSPALGDELQGIKRGIMEMADLILVTKADGDLLKQARLTRAEFSSALKYSRSRFHCWRPQVLLVSSRTNKGITEIWNEMEHFRNALSESGVLLLQRHQQMLRWMWNHIDHVLSGLFRHHPDVVKMLPQLIREIQNDNVTPVTAGEKMEHFKKEHWKFRQEKNMLEIKVSKAEEKVYTDGFDLANASGSVNLKKNVRMSEENDLHEKEPERVPVSFADLRREQCDADNKIDPEFWRNRERMKTVSVALVLCLNIGIDPPDTVKPKPCARTECWIDPQCMPMQKALESIGTALQRQYQWWQPRARYKQALDPTVDDVRRLCISMRKNAKEERVLFHYNGHGVPRPTKNCEIWVFNKMFTQYIPLAIYDLQTWMGAPGVYVWDCNGAAQAIRAFKTCAKKQIQAYRCSLAARRKESTKTTVEFEPGVDLFQADDARQAELDRSHRRKTGLDCVSSKPLEVNFRSSSMVPNDPKIETNNKTTAKDASKHLTGNSSGNNNVRNGQHKNDGNNDGNTNGNDDDDDDDDDYDDDGEDDFDDDDPRKPKFKHCIQLAACARDQTLPTDPALPADLFTCCLTTPIRMAVMYYILQNKLTDRYPVCIADRIPGSTGDRRSPLGELNWIFTAITDTIAWNLLPSETFQRLFRQDLLIASLYRNYLLADRVMRSYYCTPVSSPRLPPTHEHVMWQAWDMVVESVLEQLDVQALVAEVEANEATVMLPPGVPTAAGHGGAGVGAGASTAVAAAAMPGGGTATTGVSDAGSRAVGNDPTLTAGQQAQHDKVVASVDYKNSPFFSNQLIAFEVWLQYGFYQGSAPQQLPIVLQVLLSQVLRVRALELLARFVDLGPKAVEQALAVGIFPYILRLLQSVSRDMRPLLTFIWAKILAVDNSCRLMLLKDHVHRYFLVHLNDPTVEVRRKLFAVFALARLMADCRQFQEAALCNGFVATCSDLFSDCNDAPMRQWLALALGHLWTDYEAAKWQAIRCSLHQTLIGLLEDRLASVRAAAVFALGRLISTGGSGDKENKQNDGDQGNHCPNDEQSTNLAHSVAMSLVQHVCADSSATVRREALLGFFAFVRRFYPQFVTIAYEIDRELASSVPSRRHQHHELVSSYTVTTATIVGNNNNNNNNSNNHNHHNLSNGSSNSLASFSPQQQQRTRNFGISSSPVAANVDSSTLVKSTSLLFQPLLTAVSSSLNSSSNSMINIPLVRPSSRKSVSWLFGLARSSQEHQKVDNSKQEQSSQETITVLSRREVRRHRSIGPAALVNVNNVYVSVWRAVLKFLYDPDIEVSRLAHRLFKYVDRSVQNLRLLSSVGHQDSVDSLPVRRRSTAGYFHSSPDNGTAGQHPSPRPKFSFSGTHDHHQQQLVNDGNGNSGGCESPMGVSPITLCTYSAIYTNPRRPVFGDGPASESSVHSSEASPETRRHLAPEREIGTTAASILSPPVDGEPVMKTDYLSTCAQQFRSPMFYLLSESSAPSPAALNAQPRTTQRILPSFIADRISLIHQHSSIEWNLLRDKRKKYGKLWTYKNDFPATCMEFLPLEPLLCIGERDSVTVWNCNKGSVVAHFDNSSTSYTGQSGSDLSGNLVYLTFVNPYTHGFILTGTDCGEVRVWDVRLINEPDLTSKVPKGSIDFALLTAWMCADDARRFHTKPFTCYFWEQDPGLLFAAGDFRNIILWDAHTELKLAELKVGAGGDTYVCSLSADSNGHHLTAAGCSDGSVRLFDRRLPTSDSRIMTLRDLGRAVFKVHLEQASVGGGGGGGGRLVAASRSGQLCIWEPRMYREPVLFKDVGVRCRSSFDVHRNYPLIAAWNGAQVDLINFDGKSMGLFRPDVSNMTTTLGRLAALRFHPVQVSIGLAEQDGQFSLYGLRP

SEQ ID NO: 3962 - protein, 1478 aa, Exophiala mesophila
MSSHSRTPQWSLALLGPLILSIFSTVAQSSAAVNVALKTSFDAAPYLVELLETAALENSSSYFPLLDRIADGAFADLESDQDLYNHFIEIVQKDGHLSAPDSLSSFKFALSLHAAAPRVQAHFQYYNTSVQSLLPAAQDAACPVWVYLDGQQYCSPSLDRAQQPVQLPDVDTPLPFDRILGESSDGPPSILYADITHPLFAQFHHVVSKTARDGASSYRLRYRPPVSTSSNPLYVSGYGVELVLKRTDYIVIDDRDATTPDRKSPEQLSLEKAEEEELSDLKPLTSSEVAPLALNAASFIASSSNPLDTLLQISSDFPRYSSLLASANVSDDFLREHRYNRERFLPSGYNVLLINGMQIEPRQINAYSLIDHLRRERRIIDNLKTIGLTSSEAIDLLSSQVIAESQANESPQRFDWRDNLEDGKALMWLNDLETDKRYAGWPSSLQALFQRVYPGQLPQVARDIHNLVVPIDMNNIKDVELVVTALQSLVRRKVPLRIALVPIGDGETADTYAKVSYHILDTYGLTTLMAFYNDIVSGKKLLSTPEQSFAAVIKGRTPREGKYVLTYDQALAADSVEQHLAARNTYIDRLALQGASIPFLINGVVMTRTDSWFETMSARLYADLQILQQAVYGDLILEESWIPEFFIGQAPSRRNQLVFPHDPKDVRILDVIALATAHGGDLAALPRVAGWDADLLGDRAHVLLVADLDSAAGRALLEETIAVQHQRPHTDILILHNPAVEDASPGIACSLYAMVEDGRRDVYIEKLWDLLERKEDFAVLDGAAVSACRTFWATKQPAARAIGFMAGETGLWVNGRTIGPLVAPFSTTDLESLLDSEREQRISPVTTAITGLGLEKRFEDAFDLAKVTSLVARSLKSDLPEGLRESAPLIRMDLFKVWNETYTAINLANHEDATVQVVAVMDPASEVTQQWVPIIQTLSQLHGINVKIFLNPKDRLTELPVKRFLRHVVSSEPSFDDKGSLQRPMASFKGIPKDTLFNLGMIVPPSWLVAPEKSVHDLDNIKLSSLAEGENVDAEYELEHILIEGHARDVTTSPAPRGVQLLLGTEQEPHFTDTIVMANLGYFQFKANPGYWQIGLKPGRSSKIFNIDSVGPSGYEAAPGDETTSVALLSFQGLTLFPRLSRKAGMEEEDVLESPTGALDYLSKGASFASSALSSLGFGKSTDSNADINIFSVASGHLYERMLNIMMVSVMKHTKHTVKFWFIEQFLSPDFKSTLPYLAEHYGFKYEMVTYKWPHWLRGQTEKQREIWGYKILFLDVLFPLDLDKVIFVDADQIVRTDMMELNRVDLKGAPYGFTPMCDSRTEMEGFRFWKQGYWETYLRGKPYHISALYVVDLKRFRQVAAGDRLRQQYQALSADPNSLSNLDQDLPNHMQHSLPIHSLSQEWLWCETWCSDESLAQAKTIDLCNNPQTKEPKLDRARRQVPEWTEYDDEIARVIEAAKGVGSDGEAMDGKRTRDEL

SEQ ID NO: 3963 - protein, 568 aa, Capsicum chinense
MCSKFSHGVDMYAVVLENESSSIHIDAVIDPLSSSGQKLASLLRLVSKSIRPSMRLVLNPMSSLVDLPLKNYYRYVIPSVDDFSSTDYTIYGPKAFFANMPPSKTLTMNLDVPEPWLVEPVVAVHDLDNILLENLGETRTLQAVYELEALVLTGHCSEKDQEPPRGLQLILGTKSTPHLVDTLVMANLGYWQMKAFPGVWYLQLAPGRSSELYALKDDNDGGQETTLSKRIIIDDLRGKLVHMEVTKKKGKEHEKLLVSADDDNHSQQKKKGNQNSWNSNILKWASGFIGGSDQSKKSKNSAVEQVTGDRHGKTINIFSVASGHLYERFLKIMILSVLKNTQRPVKFWFIKNYLSPQFKDVIPHMAQEYGFEYELITYKWPTWLHKQKEKQRIIWAYKILFLDVIFPLALEKVIFVDADQIVRTDMGELYDMDLKGRPLAYTPFCDNNREMDGYRFWKQDLPNYAQHTVPIFSLPQEWLWCESWCGNATKSKAKTIDLCNNPMTKEPKLQGAKRIVAEWPELDYEARRVTAKILGEDFETQDQAAPPAETPKAIGDPQLEDEESKSEL

SEQ ID NO: 3964 - protein, 1539 aa, Fibroporia radiculosa
MLTDPRTLLSPPSVTPETAYQNILKTVTSNGFLSKPGAYASVEMNLALHASTPTIEAFYQFYTDRHAQRLNSSHEGHCGSWVDWYGHVICDAETLAHAVDAEMAGQAGTDEAHARPTLMPFDHIQPLPTRNLDAPPRTAVLYASISSDNFRELHTYLYKASSGPSPHIEYVFRPLPPKDHDASQKVYLSGYGVALDLKKMDYLALDDRKKGTDSEEAAQEESFSSYSNADPIMALLQQYPENSTLDTGSPLTDEELLDIGLQATQLVHDADEPLVVLKQLVQDFPKYATALSRRVVIESGLLEEVEDNQITIPGGTSVVWLNGHSISEKDMNPFALLRLLRKERATMLSLTSLGLTPSQAVELLTHPSISAAQSESGVLDGIFDASDRLEGGGAIVWMNNIEKDSRYLRWGKSLSLFMRPMYPGQFPSLRANIFNVVLVVDLSQTSNIQFLAVTVSNIINRSFPFRWGIVPIVETEEGTRMARLFHFLITHFGRKRTVEFLQHISQADRSMESTTITVDWNLVRSAYRTLLASSDPLEGVPTDLDDILAGVTEGFRVDLEKTRSYANRLGANLSPGVQGHAFVNGKHFKLDDMFLRMMQMEFGEELDYFREQLMSGQISDSALSSISTYFYDLPGAAKRRNVYIYPSSNVGDLRIFSLPALVGESGFPVWPGSFLYPPELQQVSLTTYVVADFDSETGLLFMKEALGALAAGYNSRISFIHNPTHITSSSSKRPQISSLLAHLIVKDILHQVSPSRLLNVLGLGEVVAPNHNPQVVVSSEDSLNDILGGTVLEDAEYDNYVKASLLISRDLSLAHGDQALIVNGRILGPIQPGSFSADDFPTLSAYESRKRVEPVIGALESILGSFEGLNRESYADLTSLVSSITSAIQLPDPSELGLFNQPYRPRERPYAHLSGDYTAFSFGDNSTALFQFGIVLSPLSEAAQKWTSLMEWLLTIPDVSIDLHINPARYRELPLKRFYRYNLSPRLEFDGNGEEIHASAEFLGLPVDPIYTLAMDVPQSWLARPREALHDLDNLLLRGLSSHERKQGIQAVFDLDYLVVEGHARDTFTNAPPRGVQLQLATNAGVPIADTQVVANLGYLQFRAKPGVFHLAIRPGRGRQIFKMESVGNEGWTSSGVDEVGDEITLTSFEGLVLYPRLMRLPGMGRVDVLAEPAFSDHSSKGLLENAVSWVSQLFSNKHTTELALSSRQAEINIFTVASGLLYERFASIMILSVLRNTKSSVKFWFIENFLSPSFLEFIPHFAKAYGFQYELVTYKWPSWLRAQKEKQRIIWAYKILFLDVLFPMDLKKVIFVDADQIVRTDLKELVDLDLHGAPYGYTPMGDDNVEMEGFRFWKTGYWKEFLRGMPYHISALYVVDLVRFRQMAAGDILRSHYQQLSADPNSLANLDQDLPNNLQRDVPIFSLPEDWLWCETWCSKDRLHRAKTIDLCQNPLTKEPKLSRARQIPEWEEYDGEIAQFARKLAEEGKMRSEIVAADVNVLADVGSGRVSSTVGDVGQTENNPGDENQHNLGTHGVPKLY

SEQ ID NO: 3965 - protein, 1538 aa, Ostreococcus tauri
MWRRRRVVAFVFALCAACVSESNAARSVEVALSAGWNSTSISLEALAYALDVDRDAFWTLARSLDEGVRDSKTECDGFIDEASRRAHGSAASARAAGLARGLRVASPRVAATRDQAETDVGTSDGCCRVMYEGETYGEVEALGRAIEGGTTEGARGRRAEPRDAFWRDENVNISTAIAYAAPGTTCFAQMHEILAGASDAGRLNYVLRPTLFDGCARDDGCAALGQTGDNLRLAGFGVELAVKNMEYKAIDDSKVKTDGGESEDGSDDEATTVSPGAELKDESVLGFNFAKLSETYPDHVEGLRSFRDELVGKAQLSSDAPLKLWDIGNLGLQATQRIALADDPLRELVELSQNFPSLANGLSRMKLNSTLVNEVKGNHKMVYPGGLVMSLNGENLELDTIDIYTLTDIISKEIQHSQTLSRLGLSESAVSRLLRLPGRSGASVKVNMTSDSIIFFNDVEKDLKYKRWSKNLGQLRFQAQGGFHRVKYNMYNLAVFLDPSKPSTWDVIGMMAHFQQSTVPVRMAQVVVTKLGNEDPELKVLGERVYPDVGEPVMRAANYILQQYGAVAQHEFLAAIAASRRPHQDSSPWAPPMYYPPSVSMARAAFVKTLNKYADDSEFEADELFDEFESSDSPKADKYVDAVRAHVLGKGLTTQSFLLNGEYGDEMMAFRGQATLDQLIVHSLRQEMSRMQRLAFTDELTEATKNMAEFVQQGATTKYVPWIVDTQKFPPVYHAPIPFASIDALEYVQHGDIDVVKAMSLVVVADGDTDLGAAMIAAAVSHVSSHAGRNSRVTVVHSGVNVLGERARAIQAALHVPTRRTKIAKFLEELLSSREASAEEIAERVGLNADDFNRVSNDEKLMVDVVQHSKRFLSYHRMNSHCAIVANGRVLDLTERKCTIDVTDIDALVEVEMAQRSTYIFDVVSTEMLGKSEPIIEPKLLSQAISDAAALVAVKQKKASNKRTVESLDKLIAQAKSTAFVAGTGTIVQIEAVLDPLSKEAQRVAPVLALLRDRLPDEVTIRVVLNPRAALQDLPLKSYYRYALPPATLDADPLVVITNVPTHKTLTTHVDFPEPWMVTTHKAKYDLDNLILKDIKEKVVSAEYRLESILITGHVSDVDKDQTPARGTQLILEDKNTAVNPGTIVMSNLGYFQLPSSPGRHRLSLRAGASADIFAFKEVHDLLVADSEKLRVSDDELSIDVLVDSFAGLRLDISLKRRAGMETADVLDAGLSSTSPSGWLSKVLKKKSNERIHIFSVASGHLYERFLKIMMASVKRSTKNPVKFWFIKNWLSPSFKDFLPHMAEKYDFEYELVSYKWPTWLNKQTEKQRIIWAYKILFLDVLFPLELNKVIFVDADQIVRADMSELWNMNLHGAPYGYTPMCDNNKEMEGFRFWKQGFWQTHLRGKPYHISALYVVDLDRFRAVAAGDRLRVMYDSLSRDPGSLANLDQDLPNYAQHDVPIFSLPMPWLWCESWCGNETKAAAKTIDLCNNPLTKEPKLEGARRIVAEWPELDAEVRAFTEVVEHGWRASEPTVKDEL

SEQ ID NO: 3966 - protein, 1305 aa, Torrubiella hemipterigena
MVLTLFSQTEHVEFDRTLGSGKDAILYADPTSPKFGSYHQEISKMAAAGDVRYRLRYRRPNTLQTNPLPVSGYGVELALKRTDYIVIDDRDAGSQDSPKEKNQDTGSLEREDEEELSDIAPLSSSDLEGIGMKAASFIQQSKNPFETLIKLTQDFPRYSSIVARHVVSEEFAKEYEQAAEQRVPVGVNVLWINGMQLTDRQIQPFALISMLRRERQMLNEATSLGFSSKEVVSLLGHEKVAEANSDDSASLRYDWRDGTEDNNALVWLNDLENDEQYKDHPKTPRALLQRAYPGTIPPVGLNIFHAVTPVDFDDSEDIEMLTQLLTLVNRGITVRFGLVPALSSARLESTAKLVYYIMDTYGLPGLATLLEAKTNKADDKAALDHVATSNEPSADKKILELEKIQSSELYGEQVKSAEKWQSRLKASAADGKVMFVNGAIHTRSESWMQSLGMQITEDLQTVQRAIFQGELTDEESIAEAVFLTSAALRRNPYLSGGEGKPQVLDVNAIYSNYEDLFQNTPTFEASKDSAKEFWAAFSIISDFTSAEGRALVLAALEFKRQNDGVRLDFVHNPAADAPTTGIQSALKTKEDELKLVTDESQLGALVKSLESATSSTKVQKSLELLLSSAKLLSGHNYVLLNGRVVGPILADAPFLADDFSLLLDIEHKARIAPVYAAAEDLGLSEKLTDPVSVAKITSLVARSTVSDVPEGIFDSAPSTRSTLYDKWDLTHAKIEVGNPDTASVHLVGLINPLSEQGQKWAPILKVLADLDGVYLKLFLNPKTKITELPIKRFFRYVLESKPTFDARGNVKAPRGTFRNLPTDALLTAGMDVPPAWLVSAKSSVYDLDNIKLSSAKSDVDATYELEHILIEGHSREVEGGAPRGAQLVLGTKTDDHVTDTIIMANLGFFQFKANPGFYNIRLKDGRSADIYNIESIGTQGYNAVPGDEGTRVVLMDFEGTTLYPRLQRNSGMEEADVLAEPEDGVVAKGLKFAEGILGGLGKSASAKEHADINIFSVASGHLYERMLNIMMVSVMKHTKRTVKFWFIEQFLSPSFKDFIPELAKEYGFKYEMVTYKWPHWLRQQKEKQREIWGYKILFLDVLFPLSLDKVIFVDADQIVRTDMMDLVNLDLEGAPYGFTPMCDSRTEMEGFRFWKQGYWERYLRGKPYHISALYVVDLRRFREIAAGDRLRQQYHQLSADPNSLANLDQDLPNHMQFQLPIHSLPQEWLWCETWCSDESQAQARTIDLCNNPQTKEPKLDRARRQVPEWTVYDDEIAAVAKRSRKEEINTKSRAMRDPVHTKDEL

SEQ ID NO: 3967 - protein, 1491 aa, Erysiphe necator
MGGLNLALGLFLILLVNVFQDSLFSFASPTIDVELRTAFPAPPFLLELLETAGSENSSSYFPLLDKISDGIFASASTDEELYKKFLKVLLDEGHLADPEAVSSYQLALSLRLSTPRIESHYQYYNTSVETSITPENDSSCSTWFLFQGLKFCSPSLDKASGSASLDLKGDELLFDRVLGNKSAPATILFADITSPKFGAFHKLLAKNARDGKSSYRVRHRKSQTSEFKTLAIPGWGVELALKNTDYIVIDDRNDDNEHDSKTNLPLTEEEIKLKDNEMNDLKPLSTSELSSLAVKASSYIMQSESPLDTLLKLSQDFPRYSQTISSHNISLDFITEFQYNRAQSIEGGRNNIWINGLPLTERQMQIMDLIDIMRKERKIISGMSDIGFTPSEAIKLLLHKEIVSAQTLDGVDRFDWTDKTEGGNVIIWLNNIEKDRRYADWPVSLAAMLQRGYPGQLPFVRRDAFNLVIPIDLTDQLDLELILETALNFVNRRLPIRIGLIPVIRNSNAAIEAKVIYHLIEIYGLQTAIAYLRSQNESKLSLNSKDVFDQITQKAKIKTNKTRIIFDEVLKSDELESRIQSSQKWVDRICADDLVPPVIINGVVIPKDEFWLQKMSQQIYTDLQLIQQTIVLGTENVRSQDFWVPSIFLNQAINRRNKLIIPENRKDLNFFDLNSIEKKSSEFFKDLPRFSASSSVTNSDIIFMILIVDLDSEMGENLLTNAATLYKKSPSIELLILHNPATESKPKLSHGLFNYLENNNLNGLEAVENMTATLYGQQSFHESTKLGESKIYWQKFAPISRLLGLVPGQNAILVNGRLIGPILNSKYLQMEDLELLISFERNRRVTPIFTALKDLKLEDKIQDPLKAAKLSSIIALSTVSEITNSIFGEASSIREDQFSVWRSQYTAIEVGDASTANIQFTVLLDPASHIGQRWASILKVLSKLKGVYLKIFLNPKDRLKELPVKRFYRYVLESEPLFDDTGAIKSLHGSFTGIPQEALLTVGLDIPPAWLVTPKISAHDLDNIKLSSVKTDINAIYELKNILIEGHSREVVGDQPPRGTQLILGTKKNPYIGDTIIMSNLGYFQFKANPGYYSISLQKGRSFDIYHIDSIGASGWSSVPGDDKTEVVLMSFKGATIFPRLSRKPGMEREDVLETRASSEMSFVSQGLKFAQGILSKGTYSPENEASINIFSVASGHLYERMLNIMIVSVMKNTKHSVKFWFIEQFLSSSFKEFIPYLAEEYNFSYEMVTYRWPHWLRAQSEKQREIWGYKILFLDVLFPLSLNKVIFVDSDQIIRADLIELINLDLNGAPYGFTPMCDSRTEMEGFRFWKKGYWAEFLRGLPYHISALYVVDLRRFRQMAAGDRLRQQYHALSADPGSLSNLDQDLPNHMQKVLPIYSLPQEWLWCETWCSDEALKDAKTIDLCNNPLTKEPKLERARRQVPEWTKFDDEIAALDKRRRGSNDLGEKSSKSSSSETIPEIKSTSVKKDEL

SEQ ID NO: 3968 - protein, 1299 aa, Parastagonospora nodorum
MLSKTAKEGKTSYRIRHKPSNKASKSPLVVNGYGVELQLKRTDYIVIDDRQKDESQPSGQKPLVTGLDEDQEVADLKPLSKDEVSDLGVKAASFVMKSDQPMDTLLKLVQDFPKYSSIIAGQNVSESFLEEHTKNREFLLPTGFNMIWINGVQIPARDVNPYSLLSHLRRERTLINGIRSQGLSAPDVVALLSHEAIAATQTQDEPQRYDFRDEIEGGNVIMYLNDIEKDDRYESWPTDLRAVSQLPSVRRDIHNAIVPIDFTSIDDVTTIVDTILSLVQRGIPLRWGLVPQILTDGALEQAKVIYYLQDAYGIAGVTSYLQDSLNNKNLASPDKNAFASVIKDGQLVADREALELTEVLKSEEVLKRAEAAKQYLKRLAANVPNAPVFVNGVPVAQTDEWLGVLSQRIGSDLRQIQQNVFNGVFNEDSWVPQFFLLQASARRNPFIVPENEKNITLINMAEFEQAHGENFGKMPRIKAAESASKSDWVHITVLGDFDSPSGLALLKSAATYREENPNAEIVLIHNANADSERNTSDDLLKAFTESNGDFTTEALSALLDKTSDSRPVTEESKAFWKSASPILEVFTLKPGQNAIIVNGRQVGPIPDDLEFSKDDIETLVTYETNKRTEPLSLALTDLDLTSKLSTPFDVAKIQSLVTLSTISDVPDGIFESASTLRMSKFNNWTTEHTAIIKGDFDNAVFQIVASIDPATEQAQKWIPILKTLSDMNGVHLKLFLNPKQMLQELPIKRFYRYLLDARPTFNEDGSTGSLEAEFSGIPKEALLNLGMDVPPPWLVAPEESIHDLDNIKLSTLPAGKNINAIYGLESILIEGHSRDTTLGGQPPSGAEVVLATEKDPHYADTIIMANLGYFQFKTNPGFYNIRLKTGRSQEIFSLDSAGPKGWAPQPGDETTEIALMSFQGATIFPRLSRKPGQEMADVLTPDESLASELVGKGTEKVNKLLGKLGLNFDSQKVLDKGAELLGSKSKKKGTQADINIFSVASGHLYERMLNIMMLSVMKHTKHSVKFWFIEQFLSPSFKSFLPHMAAEYGFEYELVTYKWPHWLRSQTEKQREIWGYKILFLDVLFPLDLEKVIFVDADQIVRTDMYELVTHDLEGAPYGFTPMGDSRTEMEGFRFWKTGYWANFLRGRPYHISALYVVDLVKFRQLAAGDRLRQQYHQLSADPNSLSNLDQDLPNNMQFNLPIHSLPQEWLWCETWCSDADLEKAKTIDLCNNPMTKEPKLDRARRQIPEWNVYDEEVGALARRVKGEKAKEEAVVDVQAEEQVREKKEKDEERRRDEL

SEQ ID NO: 3969 - protein, 1470 aa, Chaetothyriales sp.
MPTSILTSSLAGLGLLACMLLSGSAQAASSVNVALKASFNSAPLLVELLETAAAENGSSYFPLLDRIADGAFAESSTDKELYDQFVGLLRDEGHLQSPEALSSFKLAFSLHASAPRVQAHFQYYNRTISPHLPAAQDAACPVWVQLDGHQYCSPALERAQQSLSLDEAEEVLPFDRVLGPEPGEAPSTILYADIANPLFPDFHKAVSAAARAGESSYRLRYRRSAGEHKPLYLSGYGAELSLKRTDYIVIDDRDAAQSDSGHQAVLKEPADADELEIKPLTSSEVSNLGFNTASYIGSHQDPLNALVQVTANFPKFSSFLAGQNASTGFLAEHQANRKRFVPAGANVLWINGLQIETRQVNAYSLLAHLRRERKLIEEMKAIGLAATEAVSLLSSGVIAQAQADEVVQRYDWRDDAEGGNVILWLNDLEKDKRYSQWPKYLVGLFQRGRPGQLPPLARDIHNLIVPFDVADIKDIELVVKHLQSLVKGNVPVRIGVIPTGSSQTAETYARLSYYLLDRYGVDTLLAFYQGLAKAKKISTNAAKHLAAAIKDAELAEGKQALTYDQILQNEALGEDVSKAHDYLDRLELKAHDPHFIVNGVVLPRGETWFELLSSRVFLDLQLVQQAVQQDAIAEDTWVPHFFLFQAVARRNSWVVPSDSKDIKIVDLAALTSAHPDAFAKLPKSDGEEATLLSDRAHLLLATDLDSPTGRELLASALELKAARSEIELLIHFAAFWAAYQQQAKELTAENLRALIQQYVDAAAADDTASSAAATVWEHGRGLIRDLGLEAGQSALWLNGRLIGPLPAPFTLPDLLLLLEYERSSRIAPVTTAITSLGLEERFANALDLAKITSTVARSHKSELPEGLRDAAPLIRTERFKSWNDTYTAITKEPAADPLVQVVAVIDPVSEVGQSWVPILTTLSELDGVNTKIFLNPKAALKELPVKRFYRQVLSSAPSFSQNGSIQAPGAAFTSVPTDTLFNLGLVLPPSWLVSSEEANADPDNIKFNPAGNDADVEVVYKLDHILIEGHARDVTAGPPPRGVQLLLGTTEQAHVTDTIIMANLGYFQFKANPGFWKISLKPGRSSKIFNIDSVGPNGYSAQPGDETSSVAVLSFDGLTLFPRLSRRPGMEGEDVLAEGSKGQVADMVSKGASFLSSLGLSKDSKLAKSSTNAEINIFSVASGHLYERMLSIMLVSVMRHTKHTVKFWFIEQFLSPSFKSTLPILAEHYHFDYEMVTYKWPYWLRGQREKQREIWGYKILFLDVLFPLDLDKVIFVDADQIVRTDMIELTRVDLHGAPYGFTPMCDSRTEMEGFRFWKQGYWKNYLRGKPYHISALYVVDLRSFRALAAGDRLRGQYQALSADPASLSNLDQDLPNHLQHNLPIFSLDQSWLWCETWCADDALTTAKTIDLCNNPLTKEPKLDRARRQVPEWTLYDDEIAAVVRDKTNNNQAQEQAQPVDTQSAWQKKEL

SEQ ID NO: 3970 - protein, 1574 aa, Termitomyces sp.
MRRSLQLLGLSLAVVGGRCASPPVEVLLRSSWPASPPLIEILETIALENPDTFFPLLDKLTDPDVLPTPEKLTPEAAHQAVMEIAAVNGYLTEPGSLAAVELNLALHAATPKIEAFYNHYLDHHNNTKGTDCGSWIEWYGEVVCDIEQLVKLAGVDTIDPTTKPVSSPFPRPRLLTFDHIYPSPAHTLNRPPRTAILYALLSSSNFRELHNYLLSLASKPNPHVEYVLRYVPAKRDASVRNFLSGYGVSLNLKKTDYLAIDDRNTRNGANGQGTVERDESVVTEDPVLALIHNHPENATAPSAKTPLTVEENLNLSFQAIQLVADSPTPLQTLKHLTQNFPKYAPTLARRVVVNESLSSEIYANSLKIQGGGHMFWLNGAMVPDRDVNPFGLLRWLKKERSLIGSLTGEVGLSRKEAFELLTSPEVAGSQGNGVLDGIVDASDRIEGGGVVVYWNDMEKDSRYERWSTSVFTLIQPVYHGIPSVKYNVFNIILVLDLSQMDGLAFIAGNMANLISRGIPLRFGVVPITETEDSTRMARLFSHLISTHGRKKTLKFIQDFIQAQPVEKTTVDWVVLSRTYTDLAESEGSGTHVTSLEDILSGKADPGTLLDKVRDYVERLDVRLEATTTGHVFFNGRHFSFDQDFMRNMQSELSKQMHFLQEKIYTGKLTEAHNETLGTYFYDQPTTGIRRNQYIFQTDAPGSLKVYNLPELFARMRFRVVPATFVYPACTVAESPIIPLSLFVIADLDSQEGLKLVEEALLSIVRFLYMLHFAPDDEYHVSQGLNTRTRISFIHNPIDDPTERTDRPLASWLIAYLIKTQSLSKASPEQLLRALDFSGKEYGEYVITSRLVARELDVKPGERAVLVNGRVVGPFVGGNFRAVDFAALENYEIRKRVEPVMNALETISPSASQTDRATYANLISMASSAIAAIQIPDPSEVGLFQTPQRPRNRQYQLLDSQYTAFEAGDHSMALFHIAVVMDPLSVVGQKWSSLLEWLANVPEMFIEIHLNPGHHIEMPLKTFYRYNLLSSLSYQENGQEVAAQTVFEGLPIKPLYTLAMDVPLSWLVRPREALYDLDNIQLVNLSPEDHSLKAVFDLDYLVVEGHAREVHNNNAPRGVQLELLRGGQEPYAVDDTQVVANLGYFQFKVKPGVFGLEIRMGRGRDVYRMESVGNEGWNSPTIHEKGSEITLTSFEGLTLYPTLTRKPGMDNVDVLTHPERENNFSSILGDLTSRVTSLFKPKGNVPHGEEQAEINIFTVASGLLYERFVSIMILSVLRNTQSTVKFWFIENFLSPSFLEFIPHLAKQYNFKYELVTYKWPSWLREQTEKQRIIWAYKILFLDVLFPMDLKKVIFVDADQIVRADLKELVDLDLHGAPYGYTPMGDDNPDMEGFRFWKTGYWKDFLRGLSYHISALYVIDLDRFRQLAAGDILRGHYQQLSADPNSLANLDQDLPNNLQREVPIYSLHEDWLWCETWCNKDRLHRAKTIDLCQNPLTKEPKLDRARQIPEWEEYDREIAQFTRQLADAGVIHSGLATADTNVLANAGTTQQENFEPSHSEPEGFPVRSSVPERDEL

SEQ ID NO: 3971 - protein, 1504 aa, Tuber melanosporum
MRLPNFGGRLSVGLLLLSPCVRLVSCGPAVGVALKASWNGAPFLLELLETAAEEVGASYFPLLDRIAAGDFANIDSDKALYHAFLRVALEEGFLVDQEELASFNFALSIHAAAPRIEAHYHYYENSLEPIMGRLYEATCEVWLQWSQKQICGTDGDFKDMLNNRRKLQFDRVLETREDKPAAILYADIEAPNFKRFHEVLKDYAKQGILTYRVRYKPRTNRKGRPVILSGYGVELALKKTDYIVMDDRDVSDEGGVKKGRDTQTPIGELDDQEIQDVEPLHPKDMSFLGMKAASFVMDSGDPLATLLKLLQDFPKHASSVAAIEINPDVADALQGNWDSFLGPGQNALWINGVQLENSDINAFALVEHLRRERRFVNSFKTLGVNSSEAVQLLSHQILASSKQDEVPQRFDYRDNIEGGKTIVWLNDLEKDLRYREWSAAVDTLLRRVYPGQLHPLRRNVHHLVVPVDLASKDDLALITEQLRLFVDRKIALRFGVVPLTGTPEAVAQAKVFYYLNETYGLPVALGYLELALGSGQFSKPNAKVLDQVIKEAELIEGRIALSLEEVLSSETIEERIKTSKSWAGRMGANTLIPPVFINGLSLARDEQWMQMMSARLQVDVQLTQRAVYEEIANDETDFAVLLLGNAATRRNYYIFPEGEESIKTTNVGKLLQEYARIFEKLPTVVSDKPDKLAESTIWVIGDFDEKDGYELLQGASELQKVASGVNLVFINNPQLVSERPALSTLLYQLHQVGFFKGPEQLQQLLEEVWQFPDHIESGNFWRESQKMLEVAGFKPGQRGVIINGRVVGPVPIDEEFGAEDFRQLLEYEHSRRILPALRAANEIGVLEKLKGFQSSACLTNLVALSNIPEVPTSMFQGPSLARTDAFNRLWKREHVAIKLGDKDKAIFQVVASIDPASELAQKWVPILKVLSEMRGVYMDIYLNPQRVITELPVKRFYRHVLNSAPTFDENGNLADPQARFENIPELPLLSLSMDVPPSWLVTPKESPYDLDNLKIQSLKDRLKGSDIEALYELRSILIEGHSTDIINGGAPKGAQLVLGTEKEPHFADTIVMANLGYFQFKANPGYYKMELKEGRSREIFHIDSTGTKGFQLGKREITDEDSEISLLSFQGATLFPRLSRNPGMEVEDVLEQSTGVPGNIGDFAAKFLRKVEDVLVNIGFLAPAVDLKPQADINIFSVASGHLYERFLNIMMLSVMKHTDKSVKFWFIENFLSPSFKDFIPIMAKEYGFEYELVTYKWPHWLRGQKEKQREIWGYKILFLDVLFPLDLDKVIFVDADQIVRTDMKELVDLDIQGAPYGFTPMCDSREEIEGFRFWKQGYWKSFLKGLPYHISALYVVDLKRFRQIAAGDRLRQQYHQLSADPNSLSNLDQDLPNHMQSMLPIYSLPQEWLWCETWCSDESLKTAKTIDLCNNPMTKEPKLDRARRQVPEWAAYDEEIGALASRSLKKGGEQEESETAREVEKEEETMEVLGEREGERLAIKEEL

SEQ ID NO: 3972 - protein, 1488 aa, Unknown
  Description of Unknown: fungal sp. No.14919 sequence
MIRLLNQPCSLAATLLAAVCLGPNYVTAGHSVHVAMKAAFPAPPYLIELLETAAGENATSYFPLLDRVAEGAFVESTTDKALYERFLEILQQDGHLATPQALSTFKLALSMRTAAPRIEAHYQYYDTAVTPSLGRAKGNCDEWVLLNNEQYCSVTLANSDGGVSGESQVRVLPFDRVFGTGEEAILYADITKPEFGPFHNALTDMARKGEISYRLRYRISQRGELEALPVSGYGVELQLKRTDYIVIDDREAAETGVDQLQKTGSTEVVLDGEEEVSDLKPLTTNELASLGLNTGSFIMESEDPFQTLVKLTQDFPKFSTSVAARNASSAFITEHRQNREVAAPAGINALWMNGVQLPERQIDPYTLIDGIRRERAFIKGATELGLTAKEAISLLGDREVTMAKTDDEGPRFDWRDQLEDGRVIIWLNNIEKDKRYSGFSPSLSTLMQISYMGQIPQVRRDMFNLVVPVDFSSADDISLVVERLQGLVKRALPLRFGLVPLTPTKESAERTKLVYYLVENYGLPSLMSFLEPFATEGQATQSEEASFDRAIKTRKLKADANELPFGDIFTSEDYERQLQLSKNWVERLQAHTNVPPVFLNGHAIPREANWLQTMSMKLSADLQQLQGGLFMGTVTDDMWLPSLFLENALTRRNPYTFPDSDNPLKVLNVHKLYSEHDDLFGRVPVIEADADTNKENWAVFTLVADFSSPSGLRLLHSMLKFRQSNLGVRVDLVHNPTSAENGHVINAFLAESASKLLEIENLETLEIIVSGDANKGDDGYGHALARFLAFSGLAPGNRALLVNGRVVGPIDAEFVFQEDDLQQLFEFEQSKRILPVYRAVETLGLVDKVSGPIAAAKLTSITALSTISDLPEGIFESPSIIRTTVYDLWNSSHTTIDVGNPDTADIHFVALLNPTSEIGQRWAPILKVLSELNGVFLRIFLNPNERLEELPIKRFYRYVLQSEPSFDDNGALRSQGATFKGLPSDALLNLGMDIPPAWLVAAKHSVHDLDNLKLSSIKSDVEAVYELEHILIEGHSRQIPGGGPPRGVQLLLGTERDPHFADTIIMANIGYFQFKANPGYYNIHLQKGRSSDIFEIISVGAKGYEAVPGDEGTEVALMDFQGTTLYPRLKRKEGMETVDVLEDPSAEGSNDLLSRGLKFAEGILGGSKSKSKSISNEIHAEINIFSVASGHLYERMLNIMMVSVMKNTKHSVKFWFIEQFLSPSFKEFIPHLAEEYGFKYEMVTYKWPHWLRAQKEKQREIWGYKILFLDVLFPLSLDKVIFVDADQIVRTDMIDLINYDLDGAPYGFTPMCDSRTEMEGFRFWKQGYWKNYLRGVPYHISALYVVDLHRFRQLAAGDRLRQQYHQLSSDPNSLSNLDQDLPNHMQFVIPIHSLPQEWLWCETWCSDESQKDARTIDLCNNPQTKEPKLDRARRQVPEWTVYDDEIAALDRRRKGLDAPQNIIGGEETNTKSRRLEDESVKTRTKDEL

SEQ ID NO: 3973 - protein, 1428 aa, Clavispora lusitaniae
MVLLLRFTVLFVAVVFASTLQIGLEANWTEAPFALQLIESVAEFDESLYIGAAKALFRGEEDNSDFDDVDDEEDDEHTGNSNEVPDGPKSDRENYESVAKVLSETQLGLVNLHLVNKLASPRIQAHYDFFNNEFDSEALKTIEKKCATDSFGEPLIDPLKAWVKYGNKYYCSESDLFALQTDTFSESVMPFDRVIGSDESKPLLVLYGDPSCSRFAGMFHTLMSFAESGSIRFVWRYVPSSFGASKIPGFGVTITSKSKSNKNAPQVEGDILKALIKIKKDGRELFDLEDDKLSTLSINIVSLVLQQSDPVSQLALLKEILHNLPLYGPYLGNVEASESSRRVEKHALANEKKGAAYESVGLYINGAATHRLQTDLPNIIDKLAQEVSTMEEFRSYGFNMEQSKLLLSKFALLSAFKESEFKSGSMSNRYSLYNDVFVPFDEDSGGVVFFNDIEKDESYQMISTDTKDMYTGSGASQLRVSQIPPLRENVHDLIFVMNFSNKHQLKVFFTMAKIILDRGIAQQIGVLPLMESDKDQYIADLFYHILEVGEVKEAMAFLYKYYESKEEEENELFSKIKMPPELLGSYTQYKRCIEDFSLTEASVVINGVIHSMRSNWRNALGHQITHDVKLLQKSIREGSDKDKSLKSVLYSDSKSSRNTHVVPLDPANIRYKKVTKEMIDSSYAFVKEKDSNDISLTFWLIGEFNLPIIRQQFINLLKFMDLYNDKSIQIRVFDTSKNQKHLNGIFESYANKSLKSDDIARIISMVKAGKAPHGEKDAEKMAILERNHIQSHSPMMLLNSRYLSLTQEFTIKDIEELLEYEFKQRLGIFKEITDAYPDQFSWKPIMHFRKGNLNHLDWFDLVSSTLSNSFFVEDVLQLSDVSRFDFSSLNFANSIDVTGYSKEKPIDLLAIVDPADEFSQKLVSIFSSLSDLSFVNARILLQPLSESKTPNDLSRFYVDGFQSSQPKFDANGRYIEFSSCNFESAVADTEMCIEIDAPSNWYIIQGKNSDLYDFTKFTMVGDTDLGFTLSKLVVEGYVRDVTTAKSIPGLILEASKGTTSQDAFTMQTMGYSQFRLDPGAWTLQVRSVEDEEPSYDLLSASENKYDKNDCLSDSVPLLVKSLKRHHIYPRMKRTETHTSHLRAAKEQADINVFSIASGHLYEQLMPTMMLSVVKNTGKSVKFWLIENFLSHGFRERVPGLAEKYGFEYEYVGYQWPAWLRQQKQLHRKVWGYKMLFLDTLFPADLDKVIFVDADQIARTDLKELVNIDLEGAPYGFAPMCDSRKEMEGYQFWKNGYWPTVLKDDLKYHISALYVVDLRRLRETLVGDKLRSHYQKLSADPNSLSNLDQDLPNNLQRQVPIHTLPQEWLWCETWCSDESKSSAKMIDLCNNPKTHEGKIEQAKRVISEWEDYYNEISQTEESLRVHDEL

SEQ ID NO: 3974 - protein, 1463 aa, Fusarium fasciculatum
MPCLSQCMTMALLAVAGASASPSINVGMNAAFPRGPYLLELLETAAGENSTAYFPLLDKIASGYFVSAKSDAELYDQFLEVLQNDDHITTPEALSTFKLSLSLRAAAPRIEAHYQYYSTAVDPEPQANGADSCDSWALVDNSKYCSPSLDTSVEGEVSTKQVKVLPFDRVLGLGKDAILYADPASTSFGPFHDALSKAARQGNLSYRLRYRRSAGASRPPLPVSGYGVKLDLKRTDYIVIDDREGGQKTPQTPVAADVDLDATEDVADLKPLSSSELASLGLKAASFILKSENPLDALVKSTQDFPKFSASIASHEVTQDFVAEQEKNVAAGVPSGINFLWMNGVQLIERQVEPFALIEMIRRERKLIDGVRELGFSGQQAVSLLGHSEIASSKADDEPPRFDWTDRLENGKAVMWLNDLEKDARYQKFPSDLTALLQRTYPGQLPQVAINLFHVVAPVDFTNLEDGRAFGQLAQFMQRGITIRFGIVPLATTPESTAQTKVVYHLMETYGFEALITYLQESEEGPEGVANKKSFARAIDGREPLPEMTKMTLSEVLEAESYVQKVKASQAWASRLNADTTVRPIFVNGMAIPREKSWVQAMGQRLTEDQQTIQKAVYFGHVNEEATVSDLFLNSALSKRNTYIFPDDDKALRILDINKLYTEHAGLFGKVAVLPADPESAKEDWAVLTTIADLNTDDGQDLLIAALEFKRNNRGIRLDIIHNPPSPTDAHAINGAFKLSEVKLAEMKSKDDLKAVLEASWTAEEDGFATKLSNFLSTSNILPGTKSLLLNGRVVGPLPSEISFKNDDIKQLLEFEQRNRILPVYAAIKELGFADKLSDPLAAAKLTSITALSTISDLPQGIFESAPSIRSTLYSTWNSTHSAIEVGNPETASIHIAGLLNPTSEQGQRWAPILKVLSELDGVYLKLFMNPKEVIDELPIKRFFRYVLDSTPSFDASGHVQSPKALFKGLPSEALLTAGVDVPPAWLVAAKDSVQDLDNIKLSSVKADIDVTYELENILIEGHSRDGKRGAPRGAQLALATEKDPLVTDTIVMANLGYFQFKANPGFYNIQLKEGRSSKIFNIESVGAQGYAAVPGDEGTEIALMDFKGTTLYPRLNRKPGMEEVDVLESPDSENDGIVAKGLKFAESFLGGTKSPKEISAKEHAEINIFSVASGHLYERMLNIMMVSVMRNTKHTVKFWFIEQFLSPSFKEFIPHMAAEYGFKYEMVTYKWPHWLRQQKEKQREIWGYKILFLDVLFPLSLDKVIFVDADQVVRTDMMDLVNHDLEGAPYGFTPMCDSRTEMEGFRFWKQGYWANYLRGLPYHISALYVVDLNRFRQLAAGDRLRQQYHQLSADPNSLSNLDQDLPNNMQFAIPIHSLPQEWLWCETWCSDESLSNARTIDLCNNPQTKEPKLDRARRQVPEWTVYDNEIAALDRRRKGIKDKNENTESQKAGDGTHTKDEL

SEQ ID NO: 3975 - protein, 1518 aa, Clohesyomyces aquaticus
MRAFRLLLSLRSLLGLSTLAPLRASAGPTINVALRASFSSAPYLIELLETAAEENSTAYFPILDRIAEGYFSTSKTDQDLYTSFVELLQSDSHITDPATLSSFRFALSVRSAAPRIEAHYQFYNTSVEPSLQAEQNEDCQVWVAFEGKQYCSPELKKAHGDIKSGRWAAGRDQGTELPFDRILGPKSGAIPSLLYADITSPAFAHFHKVLSKTARDGETTYRIRHKPSLKGSNSPLTVNGYGVELQLKRTDYIVIDDRPAAEGGKAAAQKSLNTELEGDEEVADLKPLSASEVSNLGASAASFVMKSENPIDTLLKLVQDFPKYSSSIVGHNASEEFLKEHTANREQLLPSGYNIIWVNGVQIPQRDINPFTLLEHLRRERKLINGVRSQGLSGPEAIDLLSNSAIMDTQSEDEPQRYDFRDATEGGNVIIWMNDMEKDKRYEDWPTTLNMLLQRLYPGQLPQVRRDIHNVILPVDLSSREDVFAITETIQGMVKRGIAVRWGLVPRTLNKGGEAHAKIVYHLLKTYGLSTVMKYLSACFEARKFAVPDKTIFDGAIKNAKLRKDHEVIPYEKVLASEESEQRLASAKQYLARLAADGAESPLFVNGVPIAQNDEWVQGMSQRISMDLRAIQKGVFEQIFQEDSWLPQFFLFQAALKRNPLIIPENEKNITLYNMAEFEAKHGGIFSQMPHVLVGEESSKAEWAQLLVVGDFDSTSGRALLSSATEYRKEHDNVELVLIHNPQADSDKSNASEDLLEAWQKSGHVLSIEMLRALLAQESTFSPTPGNSTIFWKSAQPIVEFFKLKPGQGAVLVNGRFIGPVASDYIFAKDDIETLVSYESKKRLEPVAKALENLRLSEKISSPFDVAKISSLVSLSTVSDVPEGMFEHASTMRLDVFKQWNDTFTAITKGDKSTAIIQIVASVDPATELAQKWVPILKTLSDMDGMYLKLFLNPKQMLQELPVKRFYRYLLDSKPTFNQDGSVDSLEAHFSGIPKEALLNLGMDVPPSWLVAPEESIHDLDNIKLSSLNNGANIDAIYGLESILIEGHSRDVTNAGQPPRGAELVLSTEKNPHFADTIIMANLGYFQFKANPGFFKIQLKSGRSQDIFNIDSAGPKGWAPQPGDETSEIVLMSFQGTTLFPRLSRKPGKEDADVLASDESLASELVGKGTEKVNSFLSQIGLGSLKTDKLVAKGAGLLAKTGLSTNPHAGAVQADINIFSVASGHLYERMLNIMMLSVMKHTKHTVKFWFIEQFLSPSFKSFLPTMASEYNFSYEMVTYKWPHWLRGQTEKQRQIWGYKILFLDVLFPLDLDKVIFVDADQIVRTDMYELVTHDLQGAPYGFTPMCDSRTEMEGFRFWKMGYWKNFLRGLPYHISALYVVDLKRFRQIAAGDRLRQQYHSLSADPASLSNLDQDLPNNMQFNLPIHSLPQEWLWCETWCSDESLKDAKTIDLCNNPQTKEPKLERARRQVPEWTAYDDEIAGLAERTRGGEGKGEEARVVVEKEGQGKKEGGHVRDEL

SEQ ID NO: 3976 - protein, 1664 aa, Sporisorium reilianum
MRALPLLSAGWAWLALALTLAIPAIPVHADSPPVKVQLRASWSKIHLPSGGSPFLLELLEAARSQRPSSFFPLVELLTSKYTAAELRGASDEWLANTVQELIQAHRLFGTSGQIADEALDTWRMSLALSNSSPRIQALVQLYQTLQLDETWRKGSKDASCVSWVHFRDQVLCSGEDVRQAVRDGGPATPSIHDPSRDVALGHSRSSVGRNAATQSLVLYADPFSDNFRGLFSALEEHTNQPDASFTYTLRWRPSTTNSASLSDVEQTALLSGYGAILDLKKVDYLVIDDRKLKDDSDIGDVGISASSQSEEGNAAKKAADEARWLRDQIGAESNSSSATLSSLSEDQIADLGIKAARLIMDSPDPLRALQELSQNFPLHAADLAQTTKWDDADRSAALVDAVLNLANMRIEPGHSDLWLNGQSTSTRDFLPLTLLETLRRERSFNHALQHPLAGGGLNVTEAGDLISSSLVGRAFLAQADGSAATAIFDASDRIEVKNAPEATDVGAITWLNDLEKDAATSGWSSDLMDLLHPMWPGKFPRLSLNLFNVVLVLDLSQKESCRFLADTVIQSLGRVGLHWGLVPGGLEDEAGGGDAVRMARLFWFLLDQAGAQTTSDVLRKAAASRAGTAGALDVSLAVKEAKFALKSIDADGALTAKLDEALSGTNATYTHKEALGRAYIKRLRATRKESASGHVFINGQHQPFHAQIVHVLHQTVQEQIQVLAPQIYYGQISGDTPGLETFFYDSVGALSFRSALVGGGGTEGEAGGVEHGAVDLWSALVDDSVPAAGVDKVLKFFYPAATAGLLNSTVWVIADLDSEEGVALLGRSFEALAKDEAKFRLGVLHVPSLDGRADARGNVVSTLLYRLLAEGRTEGVSPAQVLDVLKQAHDDPHVSVRHLEGALGLSTAEADSAQKAHQFWQTLSPVLVSELDISSSPAILVDGHLVSNLDPSTIEARDITALVEYEAGQKLPYIMQALKLLRPGIDDMPPRQRQDLVFAALSVMSGVYDQDSSGQGMFTPKANSRSGLPEQLGTRDHVFEHGERATADVRLTLLLNPLSEAAQRWSSLLLMLRELQGVYVRVILNPHIKLRELPLRRFYRFSAPHAPAFDAAGRAVATELRFFDMPEDAVLTLGLDAPAPWLTMPVEAVYDLDNIRLADVPAAARTKGVKAVYELKHILIEGHALQQTAASPAITVPRGLQLLLETPDGGTRLDTIVMANLAYFQFKAQPGLWKLKIRAGRSAELYEMQSVGGAGWSSASVGVAGEHMVLDTLAGLTIYPRVVKRRGKEEEELLEELDAQGRAVKPRGDAREGGVAASAGQLFLSARDKVASLARSVTGTPSSSTGVVTTRTHADINIFTVASGHLYERMTYIMVLSVLKHTRSSVKFWFIENFLSPSFKEFIPHLAAAYGFEYELVTYAWPHWLRAQTEKQRTIWGYKILFLDTLFPLDLGKVIFVDADQVVRTDMQELVDLDLEGNVYAYPPMGDDSDDMDGFRFWKHGYWKDYLRGRPYHISALYVVDLHRFRRVAAGDRLRGQYQALSADPNSLSNLDQDLPNNMQASLPIFTLPKEWLWCETWCSGKWLDKAKTIDLCSNPKTKEPKLDRAKRQIPEWTVYDREVARLAQRLVQEDKVGRSVVAPDSQVEAKHAQGEDKAADAHVHDEL

SEQ ID NO: 3977 - protein, 299 aa, Chaetomium thermophilum
ETGEATKSVSKTEHAEINIFSVASGHLYERMLNIMMASVMHHTNHTVKFWFIEQFLSPSFKDFIPHMAAEYGFKYEMVTYKWPHWLRQQKEKQREIWGYKILFLDVLFPLSLDKVIFVDADQIVRTDMYDLVEHPLDGAPYGFAPMCDSRVEMEGYRFWKTGYWANYLKGKPYHISALYVVDLQRFRELAAGDRLRQQYHALSADPNSLANLDQDLPNHMQFTIPIATLPQEWLWCETWCSDETLKDARTIDLCNNPMTKEPKLDRARRQVPEWTKYDEEIAELARRVREGTKHHHHHH

SEQ ID NO: 3978 - protein, 1785 aa, Smittium culicis
KTPQESYEAGIVWIRNQLAKPETELDPNSIDWVIGLYDLDLSTHTKVPKLISQFQYYNSIIKKSKEYTTNLEKINSKDSSEKNAIDCYSWVWWNGKMACSQEGLEKLVETDTFYGDTYKSTDSNIPVSLSFDHTYSTNLNDKDPENIAILYGNPSSPNFSKLNSYLMHLSDLGNTKYTLRMIPPKSDDSEIIINNNPNGMEMSGYSVTLFLKSTEYKVTDESDLFSNTDGEIEGSGNEWNFGFGELNELSYNSKKPEPFLEIDNNATVVENIDKELIKNLPKNIALKVLSSPQPFEMLEWILTDFPKYTHLLTDPIQNKTFSDILKKFPTGFGDLQNIVTLNGLVIPVTKLNPFDIVDKLENERNIISSLQSLGLPNDRVIDFISSSFSLNKEKSSYGSDSDAIKFDITDKKEDRVVVGWLNDLSTDSRYKNWPSGLMSILYSQSSSLPKISENIVSTVIALDFSSIEAVQFFIETILEAIFKNYPFRFGVVPMSSSSSASAVSNSKFCKNLSDYDFSDSIISKEIFPETSDPADIMGRVFYYFYNFYGIRATSDYFTDILTLIKSKDFINKVPKNSNLVLNAAKTTYESFFSEGKYKQNLKRINKLLPSFIKDKSLYQKIAKQYEQNPLSWDDIKSDFILSALMCKHNSYISRLDLILQDPAQNSASSVNSSPKVVAFANGDEIDMPNFLTGLLTSYRKSSAFLLTGLLSGTVQNNENDLLSLIISSSPNTSYRNPLITSKCSVDSSQSSNIASKKNQVGILSLYNTQQSKSQLDKVKNWISELKYLTILPDSDSSKIPTTVWLWADLDSAIGKSRVAESIVSIIDNTINNSKQSSGFRVSISHVPKSALRSNKSPKSTDQEDENDQEDGGDEGEGGDSSNDSSTPLPISNDGKLVYLFLKLAEESNSNGSYEKNLLTMVYTKLFLSNQNTEPIAGSTLISELKSIDSNSKSKFDEKLADEVASNLNSLVSKVAESITKETNQYYHKITSGLSNLLKVNYGSNNWDSVSVFTDGFESGDLLISVSGRIFPVVKKSQAFNHNVLSFLLSREYNSRIGGAEKAFIKLISGPDSSHKNIQERKNIDTFLMALSLIEQSKIKSKSDSIFETGKGTDRLDIFEGLKGYQDLTFETSPINSKGGDSNIYAHFKAMINPISDSSQDLVPFLRTLSKIPGIKVTILVNPLPQPDSLPLRQFKRYVMNHKPLFNEKSDGSRVGVGAEFNSMPNESLLTLAMNVPSSWLVSATKSDYDLDNINLRSIDSKHGVAALFSLNSVLIEGHAQDSADRSPPSGLQVVLTNGPHLVSKQKNKVDSSVYNRDAKQKYGKIHAETIVMANLGYFQLQAQFGVYSLSTRSGRSRRLYEMICLGSESYSKCNSVIGKKYTSNTESSNNYGVIMLDSFKGVTVYPVFSKRAGMENEPILAPEKENSFVKSASNDKGVLEQAKDMIGNLFGLKSNKATEDEDENTDETEKDSKIKNKEGELVHVKEADLNIFAVASGHLYERLMSIMIASVIKHTNSTVKFWIIENFMSPSFKKFVPILAAQYNFQYEFVTYKWPHWLNSETEKQRTIWGYKILFLDVLFPLKLKRVIFVDADQIVRADLQDLSNTDLKGAPYGYVPFCDDKKEIEGYRFWKVGYWKTHLRGKPYHISALYVIDLQKFRELAAGDKLRYTYQSLSKDKNSLSNLDQDLPNNIQHQVPIFSLDQNWLWCETWCSNSGLDKAKTIDLCNNPMTKEPKLERAKRLIPEWNVYDAEIQKLRKTFNMESNSSNKKKMGEESAKQFDKQEL

SEQ ID NO: 3979 - protein, 1757 aa, Leishmania mexicana
MVLILGVTAQTALGKGIHAAVEASWNETSLYQEGCEWAARSFGDEAFYSCLNALWPPSPSQDHRGSSADSEGAREAASARFRTQQLQYTRLLEVLFRLPETRGADRAFFEAEMAARVYSPAVEAHYALADKALRETTTPPSLSERDDSDEGEGGSNSRSACADSFAVVYTRTAPDAPLQALRVKTPSGLKSAVGGAGEPHRNALVSIDEVAFASFDHRHPASSLATVREVPAVVVLYGLPGSAAAHALHRVAVELSTPSDAASATAAGVPAYFWRHLPVSVSRLCAAAGAPERSYAAAMTSLWDRPLAVQGYGVTVDIKNMEYKVLDEKAAAQQQTQEQNSMTPDTGSSHDSTDAPASAIRVPETQMDRIVGGFHVDRLKERYPGSAASIDEFAILLDEEMGSDDVKVNFDAWELQKIGLAATQYISQVENHNRRLHVLMDMVKRFPTYAAALSRIAAVPSRLVEVQKTLFILRQRTRPGQSAFFVDGWRVAEKELTLFGVLEALHEEERLVRGIKTVLTTHAVAAADANSVGEDTVREARTVPLAPAVVEKVADYVKRKSRRAIVSFEDSADTESAYAIPSEHIIWINNVETNRRFKRLPPVLSLLLARGNVKTPLPRRNLLNFVFLLNPVSRSSLQMISLLFRLHQGDLVARYGLALADQTWSPVFEAEVQGGVGGFKGESAGSKAALQVFALVYHLAAKGKEDYVLLFLMELFEEATQARADTIPDAVISRVCTRTAQAQLNSDVGELISNADFLSHYHETQASLRRFRVPEYPAIFLNGVLLGNNIAVISTAFQREMALLRGWVERRALRDEMKDIYSAILKQRGAADHLQPAVVRAPVTMRWSDTPTTVAYIESLPYVYSASYAQEVPALTQLATLPCEFTTAMLQQLRTVMTALEECGGAAMAQGTIHEVCGTLRLSLVSCPAATSLFHRHVAALQQRLARSSMRKAARYTTLRRYVSHIAEAVASANVGVNAVLDTETVAAALAAAPLPADLQELVGVSRRTDTNASPQWARAEVQFWSALADAYHGSGGNVALVTNGRIVAMDASFSAADVLSAARLVAPITKAVQKAVMNVRFAEMSTADGGYAADELDNNFFASKAACLSSLFGDEFARHMVKQSSSMSALMREEGVLGSEKDWKPLQAVLFTVSNFAKEAGEEADATSGAVTQPLHHVTAVVDPSSRDAQVIVSLAHYLVQSPLHIHLTVLLNPSLDVKFPIRNFYQYVATPALAFEETTGRVVAPHATFSQMPSSTLLTLGVDEPPSWTVFSQDAEVDLDNIMLSRLPRNTLFVTAAYSIHSVLITGGTTDVQTGVAPDGLPLSLLHSSRARGAAEVASAARTTDTQVMANQGGYYQLQANPGLWYLSIKEGPVAAAYCIKAIDGHAVRDCAEGASGSSLTNWTQGQRIPLVIDSFRGRFLSLQVGHTPTSEVTTDLHTILQQMASDVRLEWPPSYSARTANPTLPAKPTLNIFSVASGHLYERFLRMMMYSVHKTSSDQHGINTTRIKFWVIENFLSPQFKRYIPLLAERLGFEVGFVTYRWPWWLPRQTEKQRKIWAYKILFLDVLFPLDVDRIIFVDADQTAQADLHELYNMNIDGKPIAMTPFCHKFKNKATTSFRFWEQGFWKDHLRGKPYHISAIFLVDLRRFRAMFAGDQYRSTYASLEGDPNSLQNLDQDLPNYLQSSVPIFSLPEEWLWCETWCSEKSKSKAKTIDLCNNPRTKMPKLENAKMVIPGWEELDNKLQSLSDSVLASL

SEQ ID NO: 3980 - protein, 210 aa, Moniliophthora perniciosa
MERADVLSEEDEEDDDDGFFGNIVDNIKSIFSSDDKEDGLVPKNEQAEINIFTVASGLLYERFVSIMILSVLRNTKSTVKFWFIENFLSPSFLEFIPHLAEKYNFQYELVTYKWPSWLRAQKEKQRIIWAYKILFLDVLFPMDLKKVIFVDADQIVRADLKELVNLDLHGAPYGYTPMGDDNYDMEGFRFWKTGYWKDFLQGRPYHIRQV

SEQ ID NO: 3981 - protein, 1335 aa, Zancudomyces culisetae
MRAGYGRLKGLGILLTGMLGFSMATGDTSPVKALIRGDFEAPDFFLELAEVIHSRDAKGFFKFVEYLAENKEVFAETDEKKYEIGKKWITQEMKSEYGNSERGKDFLLGVVDLELGLHSKVPKVVAQYNFYDAVVAKKEGSKACSVFVEWNGKQGCTVEELEKIVEVDTFYGDTYRDNTGNVEVIHSFDHMYEPEKSSSEKDNKDTEETENEEEEEQDEKKEPIKNVGILYGDPRSDGFMELHKFMKYKADQGDAEYRIRFTKKENGEKGKNMILSGYRVELALKSTEYRVVDDTGLFSSKELREQEGKEDEWIGERVNIGPRAQDRSAELRQADKKPIVKERTGKMEPASMKAAQMILEAEEPLNMLEWLATDYPKYSHVMMEYKNSSVLEKLNEYRSGANQNVNMITMNGLRLGEVDLEPFKIVEGIERERKAIKRLEEFGLSTEDAVNYISEGREKLGAEGSKELYDTREKEKVRAVMDIAKMLLFGKMSFEETDIYSAMLELRGRELVQDKSSLIIADDDEREFKMVQTEKLDEGWMKDIKYITNANSSVVNSNTVTIWMRADLDDVKSKKAVAGVLETMVNKVKKIDIRLGLFLEGTKQIKYTGKGGLIELYYLYKSINNESQTVDAQEIVELAKKTSKVNLKVEDVQAYIEKLSKAQDNQKNKAEELNLVLDKSQTEPGTVLVIGGKIYPTINKKVNVNTKIIRAIIEKEFEDNHEGIEMGDTLKQDNADKFIKCNVVYLETMRQHKSQGLFQNSWKHTRSNIELLIKNPEKFTKITKGKNDYFVEFKAIIDPVSEEAITWAPLLRILSAMTGVKVTVFIEPSADKMQDDGEGTIKKFSRIVMNHKPVFYKGERQEPIGEFENLPRQTLLTLDLKVPSSWMVSASKSEYDLDNIVITDNNDHIAAEYRLNKILLEGHAATTDGVSPAGIQLNLSQLRTKNSTVVSDTAIMANLGYFQLQSEFGAYFLNINKQQTVDDVYRIENIKHDDFNAASSDSNIIVIDSFNGKTIFPVFSKEDSGNLGRRTAQKAVKYLMDYIPRFGGGLTKSKKSLNIFAVASGHLYERLMSIMITSVMKQTQSHVTFWLIDNFMSPKFKNVFLPILSAKLGFEYRLISYKWPYWLNKETVKQRTIWGYKILFLDVLFPMDLERVIFVDADQIVRTDLQQLYDMNINGAPYAYVPFCNDRPEIEGFRFWNHGYWKDHLRGKPYHISALYLVDLTVFRKLLAGDKLRAQYQQLSVDKNSLSNLDQDLPNNMQHLVPIFSLPPEWLWCETWCSSKTFKNAKTIDLCNNPMTKEKKLDVARRLLPEWTQYDNYIHSVLNKAPVKDEL

SEQ ID NO: 3982 - protein, 1494 aa, Paracoccidioides brasiliensis
MVFKYIFSPWRLGGLALLATTFLFTPIASAGPLVNVALTASFNAAPYLVELLETAADENSTSYFPLLDHIAEGAFTEITTERDLYERFTQILQDNGHLTDAESISSFKFALSLRSTAPRIEAHYQYYHTSVEPSLVVAQDAVCTVWVYYDGYQYCSPSLKYAQQSVSGDQHERVLPFDRVFGDPSLPALVLYADVTSPMFSGFHQELSRKAREGQFSYKIRYRSSGTEASKPIFVSGYGVELALKRTDYVVIDDRDAEQSVLKDTDAAQTTLAPVDDAKNEPPTDLKPLSASEVSTLGINAASFVMSSDDPLATLLRLSQDFPRHSSAIAGRNATPEFIKEFHENQAAQLPVGLNTMWINGMQIDPNNIDAFFLLSHLRQERKLINRFREFGLSARQAVGLFSDPAVSKTQAADDSLRYQYRDDFEGGGVIIWMNNLEKDHQYDGWTKSLNSLLRPIYPGQLPPIRRDIHNVVIPVDLTSSKDIEIVVRNMQTLVKRRIPIRFGFVPLLQNPNSLEQARVAHYLLDTYGIEALVTYLQASYTANKTASPDQASFTAALKDHKVRDGHNPVTFKDVLTSENYDPILASTKSYLQRLAIEGKEPTFFVNGVAFVRDENFMQYIITAVSNDMDKIQKAVLEGDLEEDVWVPSYFLQGALQTRNPLLIPEDPRSIRIVDLNKIYENNKDIFDTLLRIPATSKSEHSMLDWTSIILIADLESESGVKQLRHLLELHEKHPGVETLLLHNGEASSVSKGLLTRLHSVRHGRDLDPAAVAATLDALVSGEDTPGSDANLATAYWNSLQELVREIGIGAGEYGMVINSRIIGPLPSSTVFDALDLEYMFAYERSERTEVVAQAALDLGLEDKISDPLSLAKLLSLMSLSTASDIPEGILNSVSNVRSNLYKKWNGTHSAISISNSDDPSIYIVAAVDPATETAQRCIPILKVLSELNGVNLKIFLTPREAIKELPIKRFYQYILKSTPSFSEDGSIAKPQATFHGIPGDALLNLGMDVPHSWLVAPKESIYDLDNIKLSSLKEGANVDALYELEHILIEGHSWDVTTRTAPRGVQLLLGTEKKPHFADTIIMANLGYFQFKAQPGCWKITLKPGQSERIFRLDSVGGKGHRPTPGDENNDVALLSFRGKTLYPRLSRRPGHEKDDVLDPDPKPNSAKDYLSKGLSFASSVLSSVTGPKEKHADINIFSVASGHLYERMLNIMMVSVMKHTGHSVKFWFIEQFLSPSFKSFLPHLAAEYGFSYEMVTYKWPNWLHEQQEKQRIIWGYKILFLDVLFPLSLDKVIFVDADQIVRTDMYELVTLDLEGAPYGFTPMCDSRTSMEGFRFWKQGYWKKFLKGLPYHISALYVVDLNQFRAIAAGDRLRGQYHTLAIDPNSLSNLDQDLPNNMQRVLPIKSLPQDWLWCETWCSDEALKTAKTIDLCNNPLTKEPKLDRARRQVPEWTVYDEEIAAVQRRVMEGKKGKEDGEEGRGSDGKRERRKDEL

SEQ ID NO: 3983 - protein, 949 aa, Escovopsis weberi
MKFPEIIESEPYTERMKHAQHWVTRLEAAKGARFVLINGFIASRETNWMQPLGTLLSSEVERIQRLVYLETIRDDTPLEDVILEDAVVKRNRYITPEDDKDLHFVDINRLRVDHADLLDQLPVLEACADSSKENWAVGTVFADLTTKEGRQLALSVLEFRRRNPEVRLDFIHNPKLPNGASAVNAALKAKQDALVNVETVGDLEILIQESGQASEDDSHDKLLDDFLAAVNVERGARVFMINGRIVGPFDEDADFDADDLQMLLEFEQKRRIMPVYAALDALGLADRLSSPLAAAKLTSITAVSTISDLPEGIFESAPTDRTDIFDGWQSEHFAFEVGDRETASIQIVGLLNPVSEQGQRWAPILKVLSELDGVYVKLFMNPAETISELPVKRFFRYVLKSRPSFDKDGRVESQEASFEKLPSEALLTAAMNVPPAWLVAPQDSAYDLDNIKLSSVKSDVTAIYELKHILVEGHSRQGSGAPPSGAQLVLATEKDPLLTDTIIMSNLGFFQFKANPGVYNIQLKQGRSADIYEIKSIGAHGWDQDTPDHGTEIALMDFQGVTLYPRLQRRPGMEAENVLEASSSKAGNDGILSKGLKFAEGLFGGGKAPKSEQQQQQQPPPAKAHADINIFSVASGHLYERMLNIMMVSVMRHTKHTVKFWFIEQFLSPSFKDFIPHLAREYGFEYEMVSFKWPHWLRQQKEKQREIWGYKILFLDVLFPLSLDKVIFVDADQIVRTDMMDLVQLDLRGAPYGFTPMCDSRVEMEGFRFWKQGYWERYLKGRPYHISALYVVDLRRFRQLAAGDRLRQQYHSLSADPGSLANLDQDLPNHMQFNIPIHSLPQEWLWCETWCSDESLAQARTIDLCNNPQTKEPKLDRARRQVPEWTVYDDEIAALDRRLRGEGQPVADGEQAGSETGSGSEPAKAAGAKINTKSRKYEEEDEAHTKDEL

SEQ ID NO: 3984 - protein, 1354 aa, Tetrapisispora phaffii
MEQKMMRFLLFWFFVVTVASLHGVRGSHFAVAPPTRIWSVLNRLLHGSSLRSRVLNDLYPLVTGVEEGVDAYAEDGELVDLVADVLVDKFDLPEMASLFLHYYDLYPMGFPSGNQTFNNENYFILNGQKFLNAEDIFYFKTGDLKAQSKIPDSQIVQDNDVVIGKDPTAPICILYGCPSPGDDSENSFDAFNRNLYSDAVNTGKLRFIWRSTCSFDFDDPEQELGYPLELTKREGLRNAIWKWDTPYDMPEQFSKVGYEMYEPKVEELGDLDLRVSSLIAKTYKENKDFKKTFKLIKGISNNFPLIIKDLLKLKINNKIMESNEKFQKSGVDYNMLGLFINGQSMRYSALDDYSLLNAITKEYKRISSFQNDLKHFKLKHFKKASKSLLNKFSSISLSNLQEMQPNKIDLHRHPAFANSIIYFNDIEKDKQYKGLSKKIERFFEKSKFGEVPELRKNWNEVIFVIDFNDLENSVTQEALAGLLRALTIIEQGYPQRIGLLPLNTGLDKNIINSIYELKESNLQNLIEFLTQLEANKEGERTDEEFLFSDFDDVPNVAELLNELQIFGTSIIINGEIYPFKSNTWHYLLTKVIKKDVNLLKRELTKYKGQKKVDVRGILHLKSATGRHFKYTPDYFSDATYTSMNSFELDSLDVGIIDFIPIEEYNVLHTISLVDDFENEISLERLHNILKVGFSGIRIRLINTNTNIKSKTWKSLQLILKTSNDDIESKLVSLIKQVRKSNKNKVTKSENKLNIELLSKWLPDISNRILKSSDAFFTINGRFVHLESSELPSTTDFKNIIQREAKRTIDAVMVLEDEYPGFTEERIDPNLIEMVSSHLTKLFYHGSQIYDNGIDYKTESTLPRMNLSGFFKNNGYTVFERSSKKSQPIELTLVIDPLEERTQKIMTLVDKIMDLDFISIQIVLLPTNELKVVPNQRIYIDDSSEYHSEIHSLKKTFNIDIDNPYQITIKNHENIGYKSVVLDVNAFNEKDPISENNIDGISGACLQLIGENGEVIDKTFTMGTFGYGQFQISKLSSKLKIQSCDNNFEVVSISMDGKPDYIEDETIELLNFDPHKVYVKLRKLESKPSNDAEDKTAINIFNIINDETENEEEQYKKFITTISTHNVDNKKINFWLLNEPYLSNNLLTFIQRFNNEHNSMSIELLNYQWPTWLRPQRFRSREMKISKILFNDVLFPREVKQVIYMDLTEEEPVAVDPFVIAKRLNQQRDQDYSFRMVKMEGTGYWDEGYWLKYKTENENNKLAFNFYSSRPIIVINIKKLREQKSEFYSDKSIGDLIRIHYQRVSNDFNSLQNIDQDLLNDLQNQVTIREIAKYLLKPLEANSSGSSDANLHDEL

SEQ ID NO: 3985 - protein, 1543 aa, Cryptococcus neoformans
MRANTVALALAASALAASASPPVRVSLETSWAAPPLVLEILETVYDEYPSSYFPLLHLLSSLPADSTDESILSSTLDLIQAYSLLPSPSSLSTFHLALSLHSTAPRIEAEYNWYNSAANRNQKPLSLPFDHTSPSVSSTSSSPRAIFYYAPFASTSNELLGYLDHHASQYPEFTYTVRYQPPLSDEAKKPLSLSGWGAEMALKKMDYLVVDDRATGETTFRDESDEVARNESNIFAHVFGDDPWGDQATHLTAAEIRDIGLKAATLIMSSDDPISALIHLSQDFPKYSAALARQVEVPEDIQSKGRTIAVRGNAKEAIYINGKPFDRDLNPYTLLKALRDERQLTVSLTSLGLTPKQSIDILGDPVVGQGQIEDDMGEGLVDASDRIEGGDVIVYWNDIEKDKRYQNWPIHPQGYMRPLYHGQFHTVRRNTFNLIFALDLSRISSLELIVHSISAMIQRGLPIRFGIVPVFEPEQQDDISFQMAKVFWYSVKTFGRSSTRDFLAAIIDATPRQLNNPAPQVNDDVLRKGYEALSATSKKASLAFDDVLTSEDWDRHVEKTGNYLKRLLITKKDAENGGMFMNGRFTPNAPAWPNIVTQEMQSQLAFIQGQASKVMLDAIPEDISTMFYDLPSTSKRRSSLVIPVGDNKLKVFNLVDLFKNEGIEGKLSGEFVYPDGERGTPISMWIIGDLDSPEGLETVKNGLQHLQTSQCASRLGFIHVPPARSHSSCPAGQYCFSTVLYQILSQNALSLTKPSDLLELISDVQHSIKTNLEKAGEIEVGNQGVDDCGTTFTLSPEDQQKYFEAKPLHGMTFGGWAAGDIAAASEFWKAGTQISGKLGITDGVHLLANGRLVGPITPVTFPLDDFEALEVYEHRKRVKPIIDILKTMYDDIAAFDRPTLANLISKVSSVVTSAYKPLDGEGIFAPTQLTRTRYYERLDDGSMSFKLGDEDMSLLKVAIVVNPLSEQAQKWSPLIQTLSEMEHVFVSVYLEPEALMEEVKLKRFYRTSVPSRLTFDVDGAAIAPGLTFNSLPSNPIYTLGLDTPPSWIVSPRTSPYDLDNLLLSSISSPVSVTFQLKQLLIEGHAREAGNIPPRGLQLQLKTLGGDIAADTQVMANLGYLQFRATPGYYTLSIRPGRGEEVFNLESIGAEGWDSPSVEEVGEGVDLGSFDGQTIYPRFARKEGMEKADVLQESVAAPEGLAKQVYSKMKSIVGLSTKATPAKTEHADINIFTVASGLLYERFASIMILSVMKHTNSSVKFWFIENFLSPTFIAFIPKLAEEYGFQYEFVTYKWPHWLRAQTEKQRIIWAYKILFLDVLFPMSLDKVIFVDADQIVRTDMKELMDVDLHGRVYGYAPMGNSRKEMEGFRFWKSGYWKEALRGRPYHISALYVVDLKKFRQLATGDRLRGQYHALSADPNSLANLDQDLPNSMQDQIPIWTLDQDWLWCQTWCSDESLATAKTIDLCQNPLTKEPKLVRARQIPEWDVYDQEIAAFGARVSEEGEESGALAISVDDLASEGYVSGVEGKEEETEREAEGRIGDEL

SEQ ID NO: 3986 - protein, 1747 aa, Micractinium conductrix
MGARLPWTAAAAVLLVAAWVGAAAAAPLPKGKAARITLQAKWEGTPLLHEAAEFLSVEDPALFWKFVEGWQGGADGLPPDATPARCWAGIRAAAAEHLSAPMARLFDASLTARQYSARLEMFRQLAAEGGNAGAGADAADSPAAGARRPCCFALLRGTAYSEPAALKAALEAALASGDGDGTEGGAGAVYPFDHVYASPAAAGAPPLNATASHGTLPVELFAPIGSPCAAQLHDVLSKAAEASDAAAAAAAARGARAAPPRRLAYAWRPLLEAGACGAQAHPCTRLGTGERLVLPGYGVELALKNMEYNAQDDSKQAGSDKAGEEEGDEEAAEEAGAAAGEQEGGGGEGPLQIKLKNLGLQAAQRVLNAANASAGLGDPLAAVQELAQDFPRLAQHLSQHKYGKSLRTATEALQRYVPAGAQFLALNGLLLEAKDLSLYDLLDAVRREIRLHDALAAAGLPPAQLREAQLLRGAAAGSDEPPRLRLAPEDDDAIAWVNDLEQDEKYMHWPPDLNSLLMPMYPGRLPSIRRNVLQAVYLFDPASPAALDICALVFQIELQSWPLRMGLVPVVPSRVARARGDAGAMRAGDAPSLSERMGRLLALIQHTFTVSEVTQFLFELRAAVPPEQDGQPGFPDRLWEEAARVLEEQWEGFGADSDTLTAEQALALAAAPGDGAGAEGADPAALKHLDSAARLALSSGLAGMARGGVLVLNGLVHTNDAGSGWQGLTMGALQPALQAVQEDVYMQRLRDSAADVQEEILRLHGSVSRYNPRIMPLDSGAPGFLRISGESEEYAARQLVLTGPLLGPAATARHAGTPDGAGLWVRYYGPEASLLDDEDASAARMASVTHWVVADVTQKQGLALVAAALQHRSAAGRVAVVVNAAGAGVPEEDPSSGRLRPIERLVVAAASGLFETDPIDLTEQLDAVLQLPQAPGELSLAQIEGAIGFGGHLAQALDSLAGKLPAAAASHARFVRSALGLPPGASAVVTNGRLVELPLPAEGSRANADFEPRDFELLELYAQRQQYSSAVAELVRGAHEAGALQAADLSAVAAAVSSALAAAKPEEADPRSGRVVELIAKHAEQRNFVRLPADAPAGGDAGEGAQAPLLIHAILNPLSKPAQRLAPLLRFVRAAVGAEVQLLLNPERDLDSMPLKTFYRYALPTLPSADAAPGGAAAAFTGLPGGKVLTLGMDEPEAWLVEPVRAQHDLDNLRLDELTAPPGGTAAGEPVMEATFELEALLLTGMCLDLASLQARMRDQIHPRGVQLQLLPASAPEGAPPLVDTLVMSNLGYFQLKSRPGLWKLKLAPGRSQELYTVASSTGASSSGQRAEAAVAGADAHSVPVALASFSGKHMHLFLRKHADRLHEDVLEAVNATTTEEEGGDVGAGLLGKVASLVGGGKGGPALAAQREGAEDDRVHVFTVASGHMYERLQKIMILSAIKRTSARLKFWFIKNYMSPQMKAFVPYMAKKYNFDYEFVTYKWPSWLHKQTEKQRIIWAYKILFLDVLFPLNLKKVIFCDSDQVVRADLTELWRMDLQGAPYGYTPFCDNNAEMEGFRFWKQGFWKDHLQGKPYHISALYVIDLERFRQMAAGDRLRVIYEGLSKDPNSLANLDQDLPNYAQHGVPIFSLPQQWLWCETWCGTQTRAEAKTIDLCNNPLTKEPKLQSARRIIAEWPFLNREAEEFTAAVERVQRGELSEAQLLSDESAFHVRLAPMVEGVVWASEEGELAGKLSESGGAAHDASEL

SEQ ID NO: 3987 - protein, 1153 aa, Erinaceus europaeus
DLRSRFDFHPGEAYLFINGLRFEMDTFDPFSILDVLKLEGKLMTGLHNLGISEENVDKFLKLNLHVWEDNYVIDIRHPSIKWINDLETDEMYLSWPASYQELLKPAFSGVIPSIRRNFHNLVLFVDPAQEHALEFIKLAELFYDNKVPVRIGFVFVVSTDDEVDGTDDAGVALWRAFSYITEQLDVSQAFTSIVQMYEKVKKQSVLTVENVKDVLQHKFPQADIWDILGIDSKYDDGRKEDASFYKMTGLGPLPQVLYNGELCDNEELSIEERESAILQRILDTTVYLQREVFVGIINDRTSAIDYLMEKNNVVPRINPLILNSEREYINLISTSVTADIEDSSTFFFLDSQDKSAVVAENMHYLTPEDGSMISAVSIWIVADFDKPSGRKLLLNALEHMKTSIHSRLGVISNPASKINEENTVISRGILAAFLTQKNSLLRDFLWKLAREETAAALYSGDQMKALVTEGMDKNAFEKKYNTIGVNIFQTHQLFCQNVLNLRPGEMGVVSNGRFIGPLHEDFYPEDFHLLEKITFTNSLQKIKDIVENMGINSKNMSDLTMKVDGLISSLPKRGSRHDITLLKENHSVIKVNPLENDMFFNIIAIVDPLTREAQKMAQLLIVLGKIINMKMRLFLNCKGMLSEAPLTSFYRFVLEPELMPGTHDFLGPVAKFLDIPESPLFTLNMITPEGWLVEIVQSNCDLDNIYLKDVERTVEAEYELEYLLLEGHCFDEVTEQPPWGLQFTLGTQNKPVLVDTIVMANLGYFQLKANPGAWVLKLREGKSEDIYQIVGHKGADSDPDLTHLEDVIVLLDSFKSKILEIQVQKKPGKMKDDILSDKVEKKKGVWDSIKSLTGRLHKEKEKTETDVLNIFSVASGHLYERFLRIMMLSVLRNTKTPVKFWFLKNYLSPTFKEVIPHMAKQYGFQYELVQYKWPRWLHQQTEKQRIIWGYKILFLDVLFPLAVDKIIFVDADQIVRHDLKELRDFDLGGAPYGYTPFCDSRSDMDGYRFWKTGYWASHLLRRKYHISALYVVDLKKFRKIAAGDRLRGQYQTLSQDPNSLSNLDQDLPNNMIYQVAIKSLPQDWLWCETWCDDESKQRAKTIDLCNNPKTKEPKLKAAARIIPEWVEYDTEIRQLLDQLKDKKKTSILIHDEL

SEQ ID NO: 3988 - protein, 1565 aa, Fopius arisanus
MWRIGIICLLLGFSSTASPDKKLSKYVTTLINANWRDTPIILEAAEYLNDKNANYFWKFVDTISQDDKSNFDTHEATDKETYDRLINITSNFLTSAENALLKLSLSLRTYSARIEMFSQMGENRKTESVGDCTNFVDVNGELTCDSNNVEKLLKSLESRIDEEEDDDEERTIYSLDHQYPVPLSGQSESKKKSIVNSNYVILYGQIGSVGFSDFHLKLKSLADAKEISYILRHYVKDRPKHHLRLAGYGVELQMKSTEYKATDDSDIKDNSGKEEYENEGVEEINGINFGVLRSLYPDKRGELDEFEKHLLETSDEIGALKVWQFQELSHQAAERIMKSPSLEAIKVLTDIAQNFPTQAKSLIRTKVTNEMKKEIKRNQELFFGKLHIQPTDTALFINGLFFDLDAIDILGLLETLRAELTVMETLHKIGVSNSKMEKLLALDLAGSETSDNSQDFAIDIRDSAIIWVNDLESDSRYNRWSPSLTSLLRPTFPGMLRNIRRNLYNLILVVDPLSPLSRPLITTAETLYAHSAPIRVGFVFNTNFDTSLTGQNDPSIAVNNAFHYLLESKGPKEAVYFLSVLLKDVEKRKSSDGNDKNNENDLQVADVVKALRSRDPSANVYYILGEESEYDVGRHLANDFIRRTGFKNFPQALLNGVPLEGVSSIVEAESLEEIVLSMIYSQTSMLQKAVYKGEVTEGDDIVDFMMNQPNIMPRLNERILKNDKTQWLNLVGEVPSTQDVSTWSPEDTSAWIIKNSNYLYMPRRKKSQHLYTYWIVTNLEHPDGRLLLREALEYLQSNADVRLGVIINSNSHQYDDKIGMNQIVLSALNTDYPTENHDKIIHYIQEILKEENGVLIEKGEFDRNAYREQIGVDFDENPLNYEFSLKVHKHFANIALRMDESSTTQRAVICNGKVIGPLDDDETFSSQDFALLERFSHSTYGEKLITNLEKIHAIDDEEEKEISDDVIMEIASLLVPRPQTRSRHDVIASGEDHSVVKIPARNSDQVAFNLIAIVDPVSRGAQKLGAILNTLQQAVNCNIKIFLNCVDKNSDMPLKNFYRFVFEPELQFNTEGQLVGASAKFNKLPTSSLLTQNIHAPDNWMVQVVKSVYDLDNIKLDNVAMGVHSEFQLEYLLLEGHCFEATMGNPPRGLQITLGTDTHAMVDTIVMANLGYFQLKANPGEWILRLRHGRSAEIYNITSVDGHDVIQHGNAVRVLINSLKSHVLKLKVTKKSDKLDMDLLAEDDEKKSGIWSSISRTLGSEDPEDGEEKINIFSLASGHLYERFLKIMMLSVLKHTKSPVKFWFLKNYLSPTLKDFLPHMAKEYGFEYELIQYKWPRWLHQQTEKQRTIWGYKILFLDVLFPLDVKKIIFVDADQVVRADLKELVNLDLEGAPYAYTPFCDSRKEMEGFRFWKQGYWKTHLQGRSYHISALYVVDLKRFRRIAAGDRLRGQYQALSPDPNSLSNLDQDLPNNMIHQVAIKTLPQEWLWCETWCNDASKKYAKTIDLCNNPMTKEAKLQAAMRILPEWTGYDEEIKTLQQTIENENKQTDKEDKVDADDGTKHEEL

SEQ ID NO: 3989 - protein, 1602 aa, Dendrothele bispora
MLWILPVSLALLTVKAASPPLKVSLRSSWPAPPFLVELIETVALENPNAFFPFVDRVTDPEALLVSQNLAPEALHQSALQIAVSRGLLPEPGALASVEMNLGLHAATPKIEAFYHHYTQVIEDHAPDCGSWVMWYGMRICDVETLVQLAGTDTIDSSDKKADSEHIYIRPKILPFDHIYPPPERRSETPPRTAILYASFDSPNFRSLHSYLLYLASQEVPHVEYVLRHIPPSTIDVSRKNHLSGYSVSLDLKKMDYLAVDDRQTNGRGSNGDALADDPKSAPKIDLVSSLIENYPEITTAPDASTPLTEDELVEIGLKASQLISESSEPLLTLLQLSQNFPKYATSLSRRVVVNEAFADELHSNQLRVQGGINLLWLNGVPVPEKEVNPFGLLRILKKERNLMLSLERLGLERAEAMDLLISPIVAEAQSDNGLLDGVVDASDRLEEGDVVVWWNDLEKDSRYAQWPSSIHGLLRPLYPGQFHNVRLNLFNIILALDLSKTTSLNFVAGPVSNIVERGFPFRFGVAPLVETEDGKKMARLFYYLVRNHGRKKTMGFLKKIAQLQIHPSVQTPSVQWDIVRSEFKAFIAAATEAGEMEGKETDLDAIFSGRNLEEGNENPVKKAEAYTERLGATLSSSPTGHAFVNGKHFEMNENFLRLMQIEIGKQLQHYQEQIYEGKLTDANNETISTYFYDLPTSSHRRNKYIIPAQGDLQIFNLPEIFERTDFRDHASAFVYPPETEIITLTIYVVTDLNKKEGLELMREALVSIEPNSSARFAFIHNPAVVDESPSRTSVSSLFSHLVSNHLLSKVSPNRLLLALGLTDPVTPKTDGSSSEQTPLQTQADHLREILGGVKPSEFNASTHTRFVDMGRRLLKEMGIAPGEKAILVNGRTVGPIQTGEFRAADFKALQAYELRKRVQPVLSALEDIRSSVTSLDRASLAQLVSLASSVISSIQIPDPSEVGLFDTPYRPRNRNYRLLDTNHTSFLFGDNNTALYQVGVLIDPLTETAQKWSSLLEWLLNVPDIHVQVHLNPARHGEMPLKKFFRYNLRPYLTFDEAGQEEASMTIFEGLPIEPIYTLAMDVPSSWLVRPREALYDLDNIQLGSLSPEDSSLDANFELDYLVIEGHARESKTSSPPRGLQLELVSSSTPFDDTQVVANLGYFQFKATPGVFHLQIREGRGKEIFTMESVGNEGWNSPTVETIGNEITLTSFEGLTLYPRLRRRPGMEMEDVLDDIDDEEPGLFDAVVSSIKGIFGFNEAVDDVAEKQADINIFTVASGLLYERFASIMILSVLRNTKSSVKFWFIENFLSPSFLEFIPHFAEAYNFQYELVTYKWPSWLRAQKEKQRIIWAYKILFLDVLFPMDLKKVIFVDADQIVRADLQELVDLDLHGAPYGYTPMGDDNTDMEGFRFWKTGYWKDFLKGLPYHISALYVVDLVRFRQMAAGDILRGHYQQLSADPNSLANLDQDLPNNLQREVPIFSLDEDWLWCETWCSKDRFHRAKTIDLCQNPLTKEPKLARARQIPEWEEYDTEIARFARKLAAEGKVHSRIAASDVNVLANVGSVDKSSKPGSAESEIKAENVAIEEPVSSESIGGQTRDEL

SEQ ID NO: 3990 - protein, 2012 aa, Cuculus canorus
MPGGLYGGTRSSCTNLKYKKEAYRRWKQEQVAWKQYKEIVQAARDQVKKANGPTEQNLTKDVKNNKKSFYRCIGDIRKTRENVALLLKETGHLVTWDMEKAEVLNNFSASVFIGKGSSHTAQVTEGNGRNWENEEPLTVGKDWVQDHLRNMKKHKSIRPHEMQPQVLRELADKVAKSLFIIFEKLEQFCKLQTDWKRGNRAADNSGRTARERHPLPGSLPTASGTVVSAFERVETKSNRGDLGAREPSHRAGKGGIRLGADGNQVPKARPSTTRVALRDSPRQPCSPHRTAGDFTVGRTRFQKAFPPRWEKWNQTSSGWKPSPTCEPSSTRGQRPPGFSRASSAARTDPRMRLPAREALPGAFPPRWEKWDQTSSRWKPSPTGETFNDAWDTALRDAPPPALQPALTRRCAGSASSKPSHRTGKSGIGLGTGGNQAPQGRLSSTRDQRSAGFPPACPAAHTDPQVRGTYFRAGKSGIRLGRGGNQAPQATPYRPRAKLSQVRAPASPSPPPPRRQVSEMDGHNMMGFLSNSSISRYFCGVFEFIAEDGNEKFWQFLETVRELTIYKRGDSEHSYYNLILKKAGQFLSNLQINLLKFALSVRAYSPTVQMFQQIAADEPPPEGCSAFVVIHEKHTCKTNEIKKLLKKATKRPRPYLFKGDHKFPTLKEDGPVVILYAEMGTKDFAKFHKILSEKAQKEEIVYILRHYVQKPSSRKMYLSGYGVELAIKSTEYKAVDDTQVKGANDTKEEEDGEEESDVQGFLFGKLKQLHPDLKNNLKEFKKHLIETTNNMEPLKVWELQDLSFQAAAQIMAAPVYDALKVMKDIAQNFPIKARSLTRVAVDKKMRSEIEANQKHFHETLGIQPGEARLFLNSLHIDLDFHDPFSILETLKLEGKAMHGLHELGIKEEILSRFMRLHVHPTDDSYALDIRHSSIIWINNIEQDPSYSTWPASYQELLKPSFPGVIQQIRRNLYNLVLFVDPVREDTGDYMKLAELFYHHNVPLRIGFVFILNTKEEVDGNEDAGVALWRTFNYIAEESDTFQAFTSIINLYHEVREGDVLTVNEVKDALRSEYPHADVESILGVHSEYDEGRKAGATFYKKTGLGPLPQALFNGVPFNREEMDAAELETVILQRIIDATGFFQRAVFMGVLNDHINAMDFLMDQHNVVSRMNPTILGAERRYIPFRSTNVPFDVEDFSTFSFLDSQDKSAVISDNMKYLTKKGEDALYAVTIWIIADFDKPAGRRLLSNALKHLKTSSHTRVGILNNPSSKIKEDNTVIARAILAAFLTQNNSNLKSFLSKLTKEETAKSLAAGTKITKFLVPGMDDNTFEKKYNTLGLDVIKTHQMFCQEVLKLLPGQMAVTSNGRVLGPLDENEFYAEDFNLLEKITYSTSAEKIKAIVKEMGNSSKSGSDLIMKIDALLSSLPKTEIRQDVELLKEQHSVVKVSPQQNEPFYDVVAIVDPLTREAQKMAHLLIVLKDIVNLKLRLFLNCRSKLSEVPLKSFYRFVLEPELNYGINKHLPSDPVVKFLELPESPLLTLNMITPESWLVEAVNSSCDLDNIHLQDIKGTVIAEYELEYILLEGHCFDVTTGQPPRGLQFTLGTKKNPVMVDTIVMANLGYFQLKANPGAWTLRLREGRSKEIYQVFSHEGTDSIADQADVTVVLSNFRSKIIKVQVQKKPDKINEELLTDGKTGKKGNRASVKRLSEESPTEEKEKKSDILNIFSVASGHLYERFLRIMMLSVLRHTETPVKFWFLKNYLSPTFKDVIPHMAKKYGFQYELVQYKWPRWLYQQTEKQRIIWGYKILFLDVLFPLAVDKIIFVDADQIVRSDLKELRDLDLDGAPYGYTPFCDSRKEMDGYRFWKSGYWASHLGKRKYHISALYVVDLKKFRKIAAGDRLRGQYQALSQDPNSLSNLDQDLPNNMIHQVAIKSLPQEWLWCETWCDDESKKKAKTIDLCNNPQTKEPKLKAAARIVPEWVDYDSEIQKLIQQIQKEKKNLTSAFQKGLKHDEL

SEQ ID NO: 3991 - protein, 1521 aa, Mizuhopecten yessoensis
MATSIKMLPAVGLVVVCLLTVVEGQSKPITVTLNAKWNSTPLLLEASEYIAKESPESFWRYVEEIAKLDPKATALETDHGYYHMILKFASKVISPLQLKLLQLSLSLRIYSPAVETFQQLAEGAPDGCFAFVNIHGQTTCNPAEVKSLIEKAADLPKSSIFKFDHIYPGSAGNDTVVVLYAEVGREGFPEFHQTLLDMAKQKQIKYVLRHFVRDQAKEKTRLSGYGVELAIKSTEYKAQDDTKVESGGSADTEEDAVDEVQGFIFSKLRELHPESKEDLAAFKNHLVATSTDLAALKVWQLQDLSLQAGQILMTTPASEVLSVLTDISQNFPQRARTLVKTVLTEEFKKEVKQNQQYFETNHGLSAGDSAMYLNGLPVDMEAYDVYSLLELMRTETNLMEGLYSLGFKGPEVNQILKLDLSGDSEDFALDIRHIAISYLNDLESDRKYKNWPSSVQDILRPTFPGMLRHVAKNLFHMVFIVDPTEKESRELLKMAEAFLVHSAPVRIGIVLVVDSDKEVTGYDDTGVAFSRAFDYLIREESADRAISFITDVYEKAQSEELTADIVVKEFHRLYGDAEEGTVFGEDDDYNTLRKASNDFVSKSGLKDFPQVLMNGVPMDKKYLTEEAFEEGVVSTILAHTPAIQKAVYQGTLHDFVNVQEWLMERDNVLPRLNSRVLTPAKKSLDFTLRLEANVYGDVDQFSVLNTKAMTSIMTQNMKYLTRKDEDMLRPVTMWVVCDLETAEGRDLLYSALKQLKHTHDLRVGVVFNSQLGKTESAFTISRAVYAALTTLEPGIAKSFITKLVKEENVKDILAHSKQLSDFEVHGMDTMSYMLAAEVQTTDFLKVHRAFVDKALGWDESARGVLANGQILGPLDKDERFIPEDVDLFQKYVFQNSAKKIKGLLSVLGHKDDKGSDLVMKVAALLSQSGSTKERKEVQYAGDQHSVIKLPADSGTPAYQVEVIINPASPDAQKMSAILMILEEVANVDIKIFMNCKDKLSELPVITFYRYVLEPTITFKVDGSYSEGPIAKFTDMPTKSLLTLGMNPSESWLVEAVSAPYDLDNILLEETKTGIHADFDLEYLLLEGHCSDSTTGQPPRGLQFTLGRNRTEAAVDTIVMANLGYFQLKANPGTWFLKLREGRSHELYDIASHEFTDTPDGSDDVVVVMNSFKSKIIRLKVAKKPEKSGEQLLVDDAERGIWESISSTLTGDKAEDDGDKTLNIFSLASGHMYERLMRIMMMSVLKNTKSKVKFWFLKNYLSPSFKDFIPKMAQEYEFEFELIQYKWPRWLNQQKEKQRIMWGYKILFLDVLFPLDVKKIIFVDADQIVRTDLQELNDLDLGGAPYGYTPFCSSRTEMDGFRFWKSGYWASHLAGRRYHISALYVVDLKKFRRIAAGDRLRGQYQGLSQDPNSLSNLDQDLPNNMIHQVAIKSLPQEWLWCETWCSNESKAKAKTIDLCNNPQTKEPKLKAALRIVPEWKNYDYEIKILWDKVYKTNTRSQIEYDPPDIETSTIGSKIKDEL

SEQ ID NO: 3992 - protein, 385 aa, Octodon degus
VLGKIINMKLTLFMNCKSKLSEAPLQRHEETDSPSDIEDVIVVLNSFKSKILEMEVQRKPHKINKDVLTDKDEEKGMWDYIKSFTGKLHEDDEPKEKDILNIFSVASGHLYERFLRIMMLSVLRNTKTQVKFWFLKNYLSPSFKEIIPHMAKQYGFQYELVQYKWPHWLHQQTEKQRIIWGYKILFLDVLFPLAVNKIIFVDADQVVRHDLKELRDFDLGGAPYGYTPFCDSRANMEGYRFWKTGYWASHLLGRKYHISALYVVDFKIFRRIEAGDKLRGRYQALSQDPNSLSNLDQDLPNDMIYQVAIKSLPQDWLWCEAWCDDESKQRAKTIDLCNNPKTKEPKLEAAARIIPEWVEYDAEIQQLLDHLENKKKSTISAHDEL

SEQ ID NO: 3993 - protein, 2132 aa, Mucor circinelloides
MNMVLQYTHLPLELWMNILDKVDSLVQLGECRLVSRKWDDLAEAIMFSRNIYISGEGNIVKLYNHLVRKPSRAHFIRSLEVYVPPHERLYAYNLLEISFTPTMRNLTILAGSAMDTEFFGLLYGIVKGSPEGHYNLETMPLTLDPTDDNYTNAVLAFKHTLRYLQTSYKCSALNTRYGKLTEFKKLETLELEAEPFEDIFKLDAILKNCKRLKSLELFHRNGDRHAEQNASRIANWARHTVDKVNSLTHLRISYVYPDLIQYLTFKYPNIEELHCTMANTYHDDDFQSVMDAINTLPQFQIQFLFEDQELLDSAITTICQKTQSAGLVFQIEYSELLREDLLAELYLAIHNTLSKDVFLTVCIADTASHQAHQGIINSLQDSIGSTQIHHLSIDLLGFRRWPPRNHPEEPITFYDIVDNLPGLEKLYFTTDRIEYEPIVASSEPIERRLQALTISYAIIDTKVFPQISQLYPTLDLLRFESCTTLDEQQRDNMIKIDMPFTKVLQLDLENGEPYLGSTGDFEDHIGSMLYWKLNASSQPLPLTANEYGFGQEQGSGTCISITCASLHNLTIYLSDLQVHLRIFKAILGLVTVGLCSLKQVSASAGTDASPTVDLTMIAPWSAPNLLVEVAETVATYNESAYLNFIHDFVALEQQSTSWTPHQAYKEAVEVISSLGVDETNFFKLSLAIHEAAPRIEAYNQFYRESVVPGISAYNDACDVWAQFQDQQYCDITQFVDALTSQSATSTKSIELLPFDHIVSKSQADPIVALYTDRFSASFAQFHDVLNQHDISHVIRYRPDTTNVPVPLYLSGYGVEMALKKTDYLVIDDRSSQKTSNIKDKITNMGKKLGQSLFHATQKETIEPVTPGEIHRLSFKAAQYISKSSNPLATLNQLVQDFPKYAKSVSELDVDIELEEEILDNQLNFLRNGMSAVWLNGKGLEFSQMDPFFLIRALRKERQLIASFEQLGFKPKEAIEVISNPAFTVASQAGNSVNDEIFDMRDTPEEPFVVWWNDLEKDKRYDEWTSSMEDYVKPQYPGQLLPVKKNVFNLIMVEDLGQQGSIARVVNELHMMIKRLVPVRFGIISIIKEEDSVSTKMAQSLSYLIEQHGKGAGMNFLATVLETLRAEGKSEPTLEIISNSFAKTVSSSGKPKSGNKISFEQALETQDSYTQASSQFLKRMGITELGAQDGIMFINGKLLEFNEERPWIQVLMPALHEITRSIQKMVYMGDFLDEKFDYYQHVMTQPNVATHRNSFIVPSNAHPLVIQGFATARKSEELKYFQVDQQDAAINLWVSADFNSAHGLKLASEALLYAESNPKVRVALIHNPAGASTEDGPEISIPVVEDQNYKPTFSDLLGSIIFTNKDTHFEQLAKLVQNAVEQLDGESVEKVVPEAIIPGSPIIEMEAKAQSTNWRNLVHALEQDGLDTSFQGIVVNGRVVGPLPASTVFSKENFATLVDLEYNKRIAPIEQAIAQVKYTMPANEDLADVLTKISVLIETDKAVTSKSLVEENEPVYRHRVYENIPKTKHTRLVIGDIDNAFLQIGFIIDPLSETAQKWVPLINTLASIDGVSIIMYLNPVNGLQELPLKRFYRYVFDKEPHFDPATGVREIPTAYFDDLPTDPLYTLGVETTNAWHVTVREANMDLDNIVLKSLSEEESGVSAVYELENILLEGHCLDSNNKSPPRGLEFEIATPSNHSRKDTLVMANLGYFQLKALPGVWNLGLREGRSSAIYSIEDIGTEGKWNWDASKRNSKTEQGSGVLALTSFEGITVMPLVHKNPGMESEDVLETAEDRKHSDGSGLWSSFSSKLFGSSKKNQDVATTAKQADINIFSVASGKLYERFLSIMIASVMEHTQSTVKFWFIENFLSPEFKDFVPHMAKEYGFDYEMVTYKWPAWLRAQREKQRTIWGYKILFLDVLFPLDLDKVIFVDADQIVRTDLKELVDMDLQGAPYGYTPFCSDRTEMDGFRFWSEGYWKTHLRGKPYHISALYVVDLVRFRQLAAGDRLRAQYQQLSADPNSLANLDQDLPNNMQHIVPIFSLPQEWLWCETWCSDESLKTAKTIDLCNNPLTKEPKLDRARRQIPEWESYDNEIDQLRKRVSLGHPYVVADEHGEQIVISAANEKKEHLKDEL

SEQ ID NO: 3994 - protein, 1540 aa, Astyanax mexicanus
MAVRGAESGAGGGMKMWLLCVSLVILHFVASADGSSKAVTTTLTTKWPSAPLLLEASEFLSEESQDKFWDFVEANQDIENEHDGSDLSYYELIIKRAGQLLSPVQLKLLKFALSLRSYSSTIHSFQQIASNEPPPPGCRAFFSVHGEKSCDPESLKTMIDTASERPKPFLFKGDHRFTSSNPGAPVVILYAELGTKEFASFHQQMLSRVNKGLINYVLRHYLPNPSKSKVFLSGYGVELAIKNQEYKAKDDTQVQGADVNATVIGGNDPVDEVQGFLFGKLKTIYPELKEQLKELRKHLVESTNDMAPLKVWQLQDLSFQTAARILAAPPVDALNVMRDLSQNFPTKARSITKTVVNSEIRKEIEENQKYFKGSLGLQPGDSALFINGLHIDLDVQDIFSVFDVLRNEARVMEGLRSLLIDSPYIHDILKLNVQPADSDYAVDFRSPSIYWVNNLETDGRYASWPSNVQELLRPTFPGVIRQIRKNFHNLVMIIDPTHENTAELLSVAEMFYSNNIPLRIGLVFVVNDADDIDGMQDAGVAMLRAFNYIADEVDNQMAFDAVLSMLNRVPSGGKLKVEHVVGVLEKRYPYVEVRSILGADSAYDSNRKEGKAYYQQTGVGPLPVVLYNGMPLQREQLDPDELETTVMHKILETTSFFQRAVYLGELASDHDVLDFIMNQPNVVPRINSRILTTTRTYLDLSSTNNHFIDEYARFLFLDTKEKNTAVANSMNYMTKKDDGIIRPVTFWVVGDFDDPSGRQLLYDAIRHMKTSNNVRLGMINNPSENPSNSTTLIARAIWAAMQTQTANNAKNFITKMAKEETAQAVYSGTNIVDFAVGGMDVPLFQSAFESPKVDFLLAHSAYCRDVLKLRKGQRAVISNGRIIGPLDEGEIFNQNDFLLLESLILKTSGERIKSKIQQLNVEEDRASDLVMKVDALLSSQPKGEARVEYGFAADRYSAVKIRPKEEEVYFDVVAVVDPVTRDAQKLAPLLLVLKQLVNVNLRVFMNCQSRLSDMPLKSFYRYVLDPEVTFMTDNSFSPGPMAKFLDMPQSPLFTLNLNTPESWMVESVHTRYDLDNIYLEEVDTGVAAEYELEYLLLEGHCFDVSTGQPPRGLQFTLGTAADPVIVDTIVMANLGYFQLKANPGAWILRLRKGRSDDIYKIYSHDGTDSPAEAEDLIVVLNNFKSKIIKVKVQKKPDKMNEELLSDGTNENDSGFWQSLTRGFTGGSKVEETKPDKDDVINIFSVASGHLYERFLRIMMLSVLKHTKTPVKFWFLKNYLSPTFKEWIPYMAKEYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKNAKTIDLCNNPQTKEPKLQAAVRIVSEWTDYDQEVKRIYNKFLEERERGGPSGSSQTQGRTQRGDEKHTEL

SEQ ID NO: 3995 - protein, 1458 aa, Operophtera brumata
MEHFGLSHILLEPDKYNPDTLDLISDEEAREYWLNTCEKLVEKYVNFALANSSDDPTVEIRALKFKTCYVEALKELRINPLAHGQLTIRLLLDINETCLRSQGFFDLWKQRNMFDWGAQAVTAILDSGLYEALEKIQQRPWLYDGLEKWLEKLQNTVHHCAAIFVDNSGVDIVLGILPFVRALLLRGTAVILCANEWPALNDVTNVELEEILQRVSHICPVIAAALTTGDLVVRSSGQRGPCLDLRTISVGLCTEMKVRGVDLIILEGMGRSLHTNLNARLAVDSLKLAVVKNAWLAQRLGGPLFSVIFIYEDKPTLNSEPSNQYERKSKSVTSFVSSKWETTPIVLELAEYLAGESADLFWSYVDGINSLKSSLDSLKTDKEVYDSCIGVASTLLAPAQLRMAKLSLSMHTMSPAVRMFDQVATQNNAKDVQCDTFVAIGSRQVCDDDALRDVLKNYNEIKVDEHLLATYLLDHSYPSSDNKSLAAILYGELGTKDFANKHKILAGYADKGAINYVVRWNVKGMEWNCNSRARSTRVKMTPCPKNLKEMQPLLQRRRMRMTLRTKNLFPALRTPLERFRRHLSETNEELAPLKVWQMQALSMQAAAAVVDAHDAGGDEALKEYGLDIRDTSITWFNDLESDERYRRWPSSYMELLRPTYPGMLRNLKRNIYNYDIWSSALGLRAAEPLLLVSGAQYDAEEKLINTLMSLELGESFTWEEYGLDIRDTSITWFNDLESDERYRRWPSSYMELLRPTYPGMLRNLKRNIYNYLLNPPEGEELSIEYVKKQLKKYSSPSANLDEIVAEDSEYNFGRQLAEEFIAKIGNNKYPQSSQYLDLTGVPSSADLFTEDKVHRLLHLTVLKYFTKAGKAEKITQTIWVAGDLNQKASRELLRDAITFMKESGGTRVAFLPNVDGASTDDQSLNKVVLAALTALEPAKATKFSHQVYGDKISEFTADGALTGGAIARFSRLPHAPLLSMEIRTPPNWLVECVNEFELEYLLLEGHAWDTTLGTPPRGLQLVLGTLEKPELMDTIVMANLGSFGGGDEPESQDETINVFSVASGHLYERFLRIMMMSVLKNTKSPVKFWFLKNYLSPSLKEILPYMAQEYGFEYELVQYQWPRWLQKQRDRQRTIWGYKILFLDVLFPLQVKKIIFVDADQIVRADLKELVELDLGGAPYGYTPFCDSRREMEGFRFWKLGYWRNHLQGRSYHISALYVVDLKRFRRIAAGDRLRGQYQALSQDPNSLSNLDQDLPNNMIHQVAIKSLPQEWLWCETWCDEPSKKFAKTIDLEYDAEIKGLQARVRRGLYQAADHEQEAKLSAAMRIVPKWKEYDAEIKGLQARVRRGLYQAADHEQEAKLSAAMRIVPEWKEYDAEIKGLQARVRRGLYQAADHEQEAKLSAAMRIVPEWKEYDAEIKGLQAREIEMNVEEPTVSTTAAPKTDSTAREEHKAERVEL

SEQ ID NO: 3996 - protein, 1664 aa, Phascolarctos cinereus
MKPPAGAPKLINRVNVPGSKMAAERRSGNVGPRAVTRWPEVFRTCGSGSIGALRPGLFAGVSGQPPRRAGASGRGRVGRARTGAERSVAAAHWSGSCSSSRPPRAPSLSRAERESGSGMSRREGGGGCAAVARRVTGVNCKMEVLIALCLFISLVKADSKAVTTSLTTKWFSTPLLIEASEFLAEDSQEKFWNFVEASENIGSTDHDGTDYSYYHELLKIAFHYLSPLQQNLLKFSLSLHSYSATVQAFQQIAADEPPPKGCHSFFSVHGEKTCDFDTLGALLQTASKRPKPNLFKGDHRYPSLNPGSPVVIFYSEIGSKEFYNFHHQLVAKSSSGKINYVLRHYISNPSKERVYLSGYGVELAIKSTEYKAKDDTQVKGTDTNATVIGENDPIDEVQGFLFGRLRELHPDMKDQLKELRKHLVESTNEMAPLKVWQLQDLSFQTAARVLAAPLEVALVVLKDLSQNFPTKARAITKTAVNQELRTEVEENQKYFKGTLGLQPGESALFINGLHIDLDTQDIFSLFDVLRNEARVMEGLHRLGIEDLSLHNILKLNIQPSDADYAVDIRSPAISWINNLEVDSRYSSWPSSLQELLRPTFPGVIRQIRKNFHNFIIIVDPAHETAVELMNVAEMFLSNHIPLRIGLIFVVNDSEDVDGMQDTGVAVLRTYNYVAQDVDDYHAFQTLISIYNKVKTGEKVKVEHVVSVLQKKYPYVEINSILGIDSAFDQNRKEGRAYYEQTGVGPLPVVLFNGMPYEKDQLDADELETITMHKILETTSIFQRAVYLGELSHDQDVVEYVMNQPNVVPRINSRILTSERQYLDLTATNNFFVDDYARFSLLDSQDKTAAVANSMTYLTKKDNSFIRPVTFWIVGDFDSPSGRQLLYDAIKHQKSSNNIRISMINNPREEPRFENTRISRALWAALQTQTSNNAKNFITKMVKEETAEALAAGVDITEFAVGGMDVGLFKDAFESSKADFILSHALYCMEVLKLKRGERAVISNGRIIGPLKDGELFNQDDFHLLENIILKTSGQKIKSHIQLLGVEEDVASDLVMKVDALLSAQPKGEARIDYQFFEERHSAVKLKPKKKETYFDIVAIVDPVTRDAQRLAPLLMVLTQLINMNLRVFMNCQSKLSDMPLKSFYRYVLEPQISFTADNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYKIYSHDGTDSPPDADEVVVVLNNFKSKIIKVKVQKKADMMNEDLLSDGNHENESGFWESLKWGFTGGQKTEEVKPDKDDVINIFSVASGHLYERFLRIMMLSVLKHTKTPVKFWFLKNYLSPTFKEFIPYMAKEYNFQYELVQYKWPRWLHQQTEKQRIIWGYKILFLDVLFPLVVDKFLFVDADQIVRTDLKELRDFNLDGAPYGYTPFCDSRKEMNGYRFWKSGYWASHLSGRKYHISALYVVDLKKFRKIAAGDRLRGQYQGLSQDPNSLSNLDQDLPNNMIHQVPIKSLPQEWLWCETWCDDASKKKAKTIDLCNNPMTKEPKLQAAVRIVPEWQDYDLEIKQLQGRFQKEKEMGIKHPENETKEPSTEGLPAHVEL

SEQ ID NO: 3997 - protein, 1483 aa, Trichoderma virens
MTRHRCWPWNLTVGLMLALQAHSTPSVNVGMNAAFPAGPYLLELLETAAAENSSSYFPLLDRIAAGSFASASTDAALYSEVLDVLQKDGSISGSEALSTFKLALSLRSAAPRIEAHYQYYTTAVAPTVDDPECVNWVLLEGKQYCTPELDKVNRDGLLSLQAKHLPFDRTLGTGKEAILYADPTSNTFGAFHKALAEAARQGSLSYRIRYRRTETTHAAALPMSGYGVELALKKTDYIVIDDRLHGEEAHHESPSSSTNLDDSEDVADIKPLAASDLSSLGMKAASFILQSDEPLETLVKLSQDLPKFLTSIVAHNVSAQFEEEFQSNGVKGVPDGVNILLVNGVQVSERQIEPFALIERLRQERKLIDGFRTLGLSGKQAVSILGHQAVSIAKDSTEPLRYDWTDRLEDGRVLIWLNDLESDDAYKDYPKTLASLLRGAYPGQLPPIAKNIFTLVAPVDFSSSEDISFITQLLSFISRGIAIRFGLVPLMSTPEATAKAKIVYHIFENYGIQGLASYLGRLQDYATALTNEELFAEITRDQTLLEDSEKMELVDVLERETYEQQLKLAQQWINRLKAETPIRPIFFNGLLIPRDDNWIQGLGMQIGDDLQTVQKGVFHGILSDDDWAPSVFLSNAITRRNSYISPEDEKKSLRVLNINKLYNEHADLFESVPVLDALAGLQKEDWAVMTVIADLTTTSGKALVLSALEFKRNNPGARIDFVHNPVAAAGAASVNAALRANQGSLSDVQDADKLTSLMETQSEDLNDDYFAALEQFLGTAKILSGAQMIMLNGRLIGPISEDSQFDVDDFQQFLEVERTKRILPVYAAIEELGLGDTLATPIDAAKLTSITALSTISNLPEGIFESTSSARTTLYNTWDSTYTTIEKGDQETASIYIVGLVNPVSEQGQRWAPILKVLSELQGVHLKLFVNPTAKIEELPVKRFFRYVLESQPSFDEEGGVKRLEATFNGLPSEALLTTAVDVPPAWLVAPLVSIHDLDNIKLSAVKTDVHATYVLKHILIEGHSREGKGSAPRGTQLVLATEKDPLVTDTIVMSNLGFFQFKANPGVYTIQLKEGRNAEIYEIESIGAQGWSPVPGDNGTELALIDFQGVTLYPRLNRRSGMEAEDVLQEKDAQENNLVAKGFKLAEGLFGGKSKKKSLSEQEHAEINIFSVASGHLYERMLNIMMVSVMRHTKHTVKFWFIEQFLSPSFKEFIPQMAKEYGFKYEMVSYKWPHWLRQQKEKQREIWGYKILFLDVLFPLSLDKVIFVDADQIVRTDMMNLMNLDLEGAPYGFTPMCDSRTEMEGFRFWKTGYWANYLRGRPYHISALYVVDLRRFRELAAGDRLRQQYHSLSADPNSLANLDQDLPNHMQFQIPIHSLPQEWLWCETWCSDESLGEARTIDLCNNPLTKEPKLDRARRQVPEWVTYDEEIAALSQLSKGEAGITNKEKLSNNGDSDAAESQGKNTKSRNLESEKTHTMDEL

SEQ ID NO: 3998 - protein, 487 aa, Phalacrocorax carbo
VLKDIINVKLRLFMNCRSKLSEVPLKSFYRFVLEPELTYGINKHLPSEPMAKFLELPESPLLTLNMITPESWLVEAVNSSCDLDNIHLQDIKGTVIAEYELEYILLEGHCFDVTTGQPPRGLQFTLGTKTNPVMVDTIVMANLGYFQLKANPGAWTLRLRKGRSEEIYQVFSYRKSLIKRVKISLLMEQQEEKEIRNQLQVASGHLYERFLRIMMLSVLRHTKTPVKFWFLKNYLSPTFKDVIPHMAKKYGFKYELVQYKWPRWLYQQTEKQRIIWGYKILFLDVLFPLAVDKIIFVDADQIVRSDLKELQDLDLNGAPYGYTPFCDSRKEMDGYRFWKSGYWASHLGKRKYHISALYVVDLKKFRKIAAGDRLRGQYQALSQDPNSLSNLDQDLPNNMIHQVAIKSLPQEWLWCETWCDDESKKKAKTIDLCNNPQTKEPKLKAAARIVPEWVDYDSEIRNLIQQIEKEKKNLTSFFQKGLKHDEL

SEQ ID NO: 3999 - protein, 1642 aa, Trypanosoma grayi
MADYLIPQSGGGHRRGVTFLMLLLVVTVTPLCGMRVAYGKGIHVTVVAPWNETSFLQEGCEWEAAHNALQDGFYTCLQNVWSHITTDNSSGGALALTQKSQYDMLLSVMEGARRPPSQVALLKMNLAARVYSPAVEAHWQLARRSVSLIGGCSAEGRPFVLVAGVAICDEQLLQNMLEASLTNVKNDDDKGETAALFPKLDHIHPQSRGQRTVILYGIVGEERTMQLLRVVERHLDRVCLAFRHLPLWGAMWKNALSVQGYGVTVDLKNIEYKAMDEKKGDAGTERDEVNVREVGDSTEPVGGFDVQLLKQRYPELKANLSSFAEFVAEIIDRDEVKVDFHIWEIQNMGSAAVQHVMSADNDEQLGVLLNLLMNFPLHASRLSKMGSAANAKMDNAMRNTMAEIASVVHPGQVLVFFNGRRVQTPQYSLFSLLQMMEEEEQMLEGLTRVLTSHRIPSENDHGFASVSAGVMNKVLNWVTRTVRQQTPEKGSEEDEPSRRIWIPKQNIFWLNDMEGDSAYDHLPDSLEAILSVGFNGMPTFPQKNLFHVVCIADPTTAMGLQTINMMLQLESRKQPLRLGIVLADTHWSPEIKVTAEGAEMITETVVSGATAAITATVWELLSDGEGLPVIMGFFAQLARLLEIHDVINEESVQIVATDALLAAGKRTLNDLMVDPKFVVFYQETQEQLFMMHLKDLPVTLLNGKMFPEGIVWALRNGLSRELHYVRQLVHKNKLQDTDKNLYDSIMQHGGALQRYSAALYEDETYVDWTSKSVLDFLHYRRFLLPYSHAGEVPLVSGVVVLRAAVTPRNLNAILKATWQLMQCEEGAHDCSRVRLTYAVCGVVQRAGRRTVWGDLERLLLTEDGSGEKRQLRLVYDFLATVAKKSAQRLDDPAVYESFVADMNFSPELHSILDSPAASTATQQQQQHALVEGFCTQMDRQLSAANGHTAEEAAEQTEKKKEEAVYYYANGRRFVYDDKFVDDDFADASLLEMSYAKIVQSVLAKVKFEKMSTELQQAGLDNSFYASKITALAALMKRDAAHGGHGEEKRLLPPAPGPLSFVVGPAKGTVPRHKLTIVVDPIGRQSQLLVSLCDYIARSPIGAVCAVYLNPSQRVDKPMRNFYQFVGDAHVHFDAAGRVVPPAAVFGRLPSQHLLTLGVEEPESWTLFPMEAKYDLDNIVLAKLPTASYYLYATYRLNSILITGTAKETGMSSPPRGLPLMLRSSRDAAPAAAAGVTRDTLVMANLGYFQLQSAPGVWYLTVQPGDIATAFYISRINKAQVSNAANGPNNGEFNYTSGQSIPIVVTSFNGEYMTLEVAKTPGHKTTLIQDLVAASDTRAEWPPRGPRAKRPERPTLNIFSVASGHLYERFLRMMIRSVMLTSSDVHGANTTRIKFWLIENFLSPQFKELVPLLAEHYGFDVGFVTYRWPWWLNKQTEKQRTIWAYKILFLDVLFPLDVERIIFVDADQTVQSDLHELYNMDIGNAPVAYTPFCRRHPNKATTNFRFWDRGFWVDHLRGKPYHISAIYLVDVRQLRAIAGGDQYRMVYSQLSRDPNSLANLDQDLPNYMQEQVPIFSLPEEWLWCETWCGEESKARAKTIDLCNNPLTKIPKLENAKRIIDGWEDIDAELEALSEKLRKQHSKK

SEQ ID NO: 4000 - protein, 1495 aa, Polytolypa hystricis
MARLKNYFAPWRLGLLFTAILIPTVVAAGPSVNVAVSAAFNAGPYLLELLETAAEENSTSYFPLLDRIAEGVFVDALTEKDLYEQFLQVLQDDGHVRDAETLSLFKFALSIRSTAPRIQAHYQYYNTSVEAEMMVAQDAVCPVWAYYEGHQYCSPSLERAQQSVSGDNHLRTLPFDRSLGDSESSLILYADIKSPMFNEFHPELSKRARAGEFSYRVRYRPSKSDAQRPLFVHGYGVELALKRTDYIVIDDREADQNVLKPKDDVKPTLAAVDDLKEESPADLKPLSASEVSRLGLSAASFVMSSENPFGTLLKLSQDFPRHSAAIAARNATPEFLTEFRESREMLPPGTNVIWINGVQMDPRTIDAFSLLGHLRHERKLINGLRGVGLSAKEAVTLLSDPIVAKSQVSEDVIRYDYRDDIEGGGVIIWLNDFEKDQRYEEWPTSIQALLQPTYPGQLPPVRRDVHNVVIPVNFADPRDVHLVVESIQVFVKRKIAVRFGLVPTLQDSGSVDQAKVTHYLFNNYGLVTALTYLEDSLSAKKVSSPHKGTFQAIVAERKPREGATLLSFEEVLKSDKYDSMISATKSYLKRLAADRKDAPFFANGAALLRDENWIQLLIARVSKDLEAIQRAIFAEDLEEESWVPQYYLADAITRRNALILPEDPDSIKILDLNELYQKYKAAFDTLLRIPAASESSLEEWATLLLVADFDTEDGRRQLAQIPEFKNKHPEAEVLLLHNGRRADASTAFSATLYGLRNGRDIDSAALRSLLKKWETPVEESSDSELAFAYWQGAQLLGEELRIKEGDTSVLLNGRMIGPIPSSFILEAEDLQQLLSYERKSRIDPVARATLHHDLATRFKEPLDFAILTSLVALSTESDVPEGIYDSGPHVRSNRFENWDTTYSAITVSKSDDPSIQIVAAVDPTTEVAQRWVPILKVLSELNGVNLKLYLNPRELLQELPIKRFYRHILAAEPGFGEDGSLVKPQASFQGVPAEALLNLGMDVPSSWLVAPKESIHDLDNIKLSSLKEGTDVDAIYELEHILIEGHSRDTSTGMPPKGVQLLLGTEKTPHFDDTIIMANLGYFQFKAQPGIWKITLKPGRSENIFNLDSVGGQGYKPKAGDNNNDVALLSFQGKTLFPRLSRKPGHEEDDVLDIGAARPGSARDYISKGLNFASGILSGVKGTPKERQADINIFSVASGHLYERMLNIMMVSVMRHTKHTVKFWFIEQFLSPSFKSLLPHLAKEYNFSYEMVTYKWPHWLRAQREKQREIWGYKILFLDVLFPLSLDKVIFVDADQIVRTDMYDLVSLDLEGAPYGFTPMGDSRTTMEGFRFWKQGYWKSYLRGKPYHISALYVVDLKRFRQLAAGDRLRGQYHTLSADPNSLSNLDQDLPNHMQHVIPIKSLPQEWLWCETWCADEELPAARTIDLCNNPMTKEPKLDRARRQIPEWTVYDDEIAAFERRVAEEQRGAAGEEEEEDEGDDDFEGGEKTGWKDEL

SEQ ID NO: 4001 - protein, 1349 aa, Zygosaccharomyces mellis
MKLLATVVALLSVLECTICLSISLQSAGISEKLKIWTIAQHLFRGDKKDILSKIYPLVMQLDEKFENIPVGSLCEAVSNCLSELGEPDLASLMPLYCQGYPMGFPPTSNYNHSNSNSYFVLNKKRYDNSDDVFYLKSSELKKQAQVPDQTMIAVNDVVIGYNLEAPIIYFYGCPNEDEGIFEEFSRNLYSEATKNGKLRFIWRSTCYVGHDVKVGPFPVELSLRDGKSDIDVLPIDHLDIPHQFDKSKYGLISPTDNQMSNLDLKVAHLIAQKYNSSKNFNSTLGFARGIINNFPLLVPELITVKNDTEAIMKSNTNLTESGVDHKLLGLYINGQNWRLSSLDQYTLLNALESEYRRLKQLVSGLIKIYSKSSLITAKDLITRFSQISIPNLQQSQPIKIDMHRIRGFSESVIYFNDIEIDDQYRDLSTDINAFFEKSKFGEIPEYRHNWNELIFIIDFSRLEDQDTQLALEGLKRAIGVVTQGYPQRIGLLPLNTGNSDNIVRKIYELKDRDLLELEDFLSDMLVGGSKITSDYVDIPDVSKLLRNLQIYETSIIINGEIYPFRKNTWHYLIAKTIKKDVRYLKRELKRHLRREGDKVQPIIDVRGVLHLKSSEARHMKYTPDYFADSTYTTLDNTAMQAWDERILEYFKGEEYNILHTVTLVDDFNTLQALKRLHNLVGIKFVGVKFRIIHSGVLGATWNTLKKISSKPSFLEEIKLLIRNSSRGVPNNQLNSTILRNWLLDLKPEFLSATSFMLVNGRFIHFEENEIPQIRLFEVTIKREAQRTIDVLEALETMFPGFTNSKIDPEFIETISATLAKMFYQGTELYGNGPAFTTESSLSRFDMTGILPINNFTIFESDSNQDKPIDLVLVIDPLEERSQKLLSLITDVQHLPFLNVKIVLYPTTDLNFMPIDRIYVPDFPDELSNKLNDIESKFDVKVEVPQNFVLNGHKNVYGYLVEIHAFDKRQPVSEGIIDGLGDVCLELVDGNGKSVDKTITMKTFGYGQFIVPKLSSNFSIGSCDPRYRVVSFSSDARADYMPAKSVSVTSFNPVVIYVKLEKIDDAVQITAEDNVINIFTVPRNEPLFEQEYRNMVLYVLHSPQTSYMGVKFWLLDQPFISLSFRKFINAINLDSKLNGNIELLKYEWPPWLRPQRFLERRMDAYKVLFLDVLFPKSVSRVIYMDPLISQLPDPFKFNERVKTKLPFAMYRMLGHGYWETRYWSQRLGDRNLKFHSVQPTFVVNLRNLRAYDGGNKLRIHYQRLSADVLSLTKIDQDLINDAQEDVPIRTLSSSTIVFLDTRNQDLVDAWLRDFKNLVAEDDIITATAASTTPQITENIREVQDFTHDEL

SEQ ID NO: 4002 - protein, 2133 aa, Umbilicaria pustulata
MDSSSSSSSQEGSMFPWILEHLLAYPGTYEIPLRTMYTLNSAPRAQPLPQATTIPNTPALSDGSSADSSPLSPAFPPEQKQAFATQAATEHFKSCLMKQVSKLPSQPFSLPPSFVTAFVRRCFTEELCLVDFTQALTAMDYLKDLETRRKRELRAALRRLGVDPKTFGTEGDDVSKKYPGVATWISGMQEKEKKVEALYTQVYIGLRRWTLINEMRLEPFNKANSIAMLNTLYPPTTNHPPTPQLTSTILASQRNGFFRYIQGVEKNGKGILSNLEQQGKRPNDENGWTVVRETVDKYLRTTNGVLEECAEVTGLDTFDPESNEYRHGGRRADSGISFVSADRPSTTTSNYSDKERASNKHIHNKPLPPEPVTKQLPPLVPGTKKGGSTLERIAREIKKIRSRSDVQEVSKKEEKDRMRGLKKMKSFGDIGKSKHTRTASGGDQTFDAEEMNRKRMIWEAQREKEADQMDSNTMASTHIVVHELFMGMSMLQQSADYSDLVITCGEEVSNVHRAIDAMTGKVELKEEDAVLVQHLVDHLYTLDYDYGLGAIRRLPDGEKVSAFWLEHYACKLAIDMHELADKYGVQGLSELATVKLEEIMLNLEFGPWKADDFVAIVDQVYEKTCLVDRMREVIVAQAVRDLDKLIGPSFHELIAKEPGFSMDVHTSCSRLVKPYRELKSQIREARYPPGNYGQYRLRRNGAAYQGETAAEENSTSYFPLLDRIAEGYFADDATEQDLYTGFLKLLKDDGHITDPDALSSFQFALSIHSAAPRIEAHYQYYTTSVEQSLMVGQDAACPVWVHFNGKQYCSPSLERAQQDFKGSKDPQDLPFDRVLGESAQAPSSIIYADITSPLFGQFHQIISRTARKGQSSYRLRYRPSPAASPKPLMLSGYGVELALKRTDYIVIDDRNAEKGEEAEETISSEAEDVSLEAGEVADLKPLSSAELLGLGLKAASFILESEAPFDTLIKVSQDFPRHSSAITKGNANVEFVTEHRSNRELFLPAGYNVIFMNGMQIDARQMDAFALLEQLRKERKLIGGLGDLGLTGSESVQLLSHPAIAQSKIEDVSQRYDYRDTLEGGNIIIWLNNIEKDKRYEGWPTHANALLQRTYPGQLPTVRRDIHNLIMVLDLSDLQDTEMLVDSLYNFVQRKVGIRFGVVPSLKSAAAIDQAKIAYHLLDTYGLSAVITYLQSSVQGRKAVGPSKGNFETTVKDRKLRKDRAASGLQAVLEADESLDRLENVRRYLSRLAADGASPPIFVNGLAIPRNEGWLQAMSSRVELDLRTIQRAVFEEAIGEDAWLAGQFLEGAATHRNALIIPEDESSIVIVDMGTLIKEHEHIYRGLPHLMPKEDTLKQFWAHLIVMADFDTPEGSKLVAEAVEYAKQQGEVEIVLFHNPSTSENTLRPISSAVFDLLLKGLELDSDELLLALKGSHKLDDSDNPMGVPGMDISGMAAAYWEAMQALSRSIGLEAGEQGLVLNGRFIGPIPRSAGFSSADYRQLLEYERSKRLAPANTALAALGLEERIDSPLSAAILSSLIALSTVSDVPEGIFETGPTLRMNRHAQWNASHSAITTGDAATASIEVVASIDPTSEIAQRWIPILKVLSELSGVHMKLFLNPKERMQELPVKRFYRHVLDAKPSFDEEGSLKEPRATFEGLPKEALLNLALDVPPAWLVAPKESIHDLDNIKLSALKEDSNIDAIYELEHILIEGHSKDVTLGPPPRGVQLLLGTEKDPHAADTIIMANLGYFQFKANPGYWKIQLQEGRSQQIFNIDSVGAEGYNPKPGDERTDIALMSFQGKTLYPRLSRKPNQEMEDVLEEGSKAGSTMDFVSKGFKFAETMLSNVGLTKQSQQADINIFSVASGHLYERMLNIMMVSVMRHTKHTVKFWFIDQFLSPSFKSFLPHLAAHYHFDYETVTYKWPHWLRGQKEKQREIWGYKILFLDVLFPLSLDKVIFVDADQIVRTDMHDLVTLDLHGAPYGFTPMCDSRREMEGFRFWKQGYWKSFLRGLPYHISALYVVDLRRFRQMAAGDRLRQQYHQLSADENSLSNLDQDLPNHMQMVLPIFSLPQDWLWCETWCSDESLREARTIDLCNNPLTHEPKLDRARRQVPEWTVYDEEIAGVARRSFFTMY

SEQ ID NO: 4003 - protein, 1435 aa, Thecamonas trahens
MRYLLAVVAACLLAAVVVEAQVRVAMRPRWAPTSVLQEASEFARTWGEPGLAFVDAVANHCPKCAHVVTDVQVVEALSASEAYGLAGRADLLRMALNVGAHAPAVEAARQVAALLADEACSSVSDGLILVAGEKVFCSEAAIDTGLADGSLVAAAGAGGLEELPMIRDALAAELLAVAAGTAPKAIMFGVLGTRTVSRVWLELRLALGDELAFGHGVASGGQEPSRLAGYGVELAIKSTEYKVVDDSSDEENDEGETVDADAPLPSLPGLDVTKLVERMPDEEAALRAAGVAFGNAAEIKPLKKWQLRDLGFKAAQAVVDASDPLAELARISQNLPSLASWLARKKNSAAGLHREVRETAAVAGAGSTALVVNGRVVDVSSTSIFQLYTLVGEELVLADKLRSLGLAPEHVAAVASAASPNQGASGDSVRVAVTEVKHIAYLNNLARDEQYASWPASIAVITQPTYGFHRVRRNVVTLLYVMDPSSPASLGVVFQLMQFHSGDAPLRFGLVLRPGPSDLSSRLVRGLLHVRGEGGSALMWQVLGGVAMRARGGVPLEEHFDAALSAVANWDGPITLADILASEAGDELADELAELAAYHASINIPANTFVINSRVVPNEGALQSVVASALRDELTRLAALVVAGKVNDKVNVFKYVNTEPDVLSSYSRLAVPSADAPLRVVALDPSKVGLAIGAWHGAEAAPVSILVVARDDGSAQCVVDKLAAYAVSELAHSGKFRYARLGVEAWASAAGDGDDAELVVVVNGRVIAMAASTACDELALGDLELMVKLEMESRVGLLLEGEAELASAGLRGRNKADVLMYASSLVFASARAADEARPVGAIRSLERAAGGVVVGPEAGATIRAIAVVNPLSEAAQELAPVLALLRESVGARVVVRLNPDPALSELPLKRFYRAALAPALVFDGQGARQQAQAVFSGLPTQFLLTLGVSTPDAWLVQPVAAKHDLDNLQLGALRRGDEVAAEFELSELLVEGRAYQVAPVGPPTGLELVLGTPREAVVEDTLVMANLGYFQLKAQPGVWQLQLKPERPSSEMYSMLNTTDYGLLKERSKAEFDELVDEARLADGTGRVVAVTSFDGASVTMLVAKKPGYEEKSLLAAHAEVADSGLSSVWSSLTGSRGGSKSDVINVFSVASGHLYERFLAVMMRSVMSSTQSKVKFWILRQFLSPSFKEALPKLAADLGFDYQLIAYQWPRWLLGQSEKQRLIWGYKILFLDVLFPLEVDRLVFVDADQTVRADLLELHTMDLEGKPYGFTPMCESNPDTQGFMFWKQGYWSSHMKGKPYVISALFVVDLTRFRAMSAGDTLRATYQSLARDPNSLSNLDQDLPNYLAPGQLPMHYLPQEWLYCEAWCEDGTGKLLDAAKSIDLCNSPLTKEPKLDMAGRVVAEWHDFDDANRALLRSPPSPSPGDSDVRHDEL

SEQ ID NO: 4004 - protein, 833 aa, Zancudomyces culisetae
MLELRGRELVQDKSSLIIADDDEREFKMVQTEKLDEGWMKDIKYITNANSSVVNSNTVTIWMRADLDDVKSKKAVAGVLETMVNKVKKIDIRLGLFLEGTKQIKYTGKGGLIELYYLYKSINNESQTVDAQEIVELAKKTSKVNLKVEDVQAYIEKLSKAQDNQKNKAEELNLVLDKSQTEPGTVLVIGGKIYPTINKKVNVNTKIIRAIIEKEFEDNHEGIEMGDTLKQDNADKFIKCNVVYLETMRQHKSQGLFQNSWKHTRSNIELLIKNPEKFTKITKGKNDYFVEFKAIIDPVSEEAITWAPLLRILSAMTGVKVTVFIEPSADKMQDDGEGTIKKFSRIVMNHKPVFYKGERQEPIGEFENLPRQTLLTLDLKVPSSWMVSASKSEYDLDNIVITDNNDHIAAEYRLNKILLEGHAATTDGVSPAGIQLNLSQLRTKNSTVVSDTAIMANLGYFQLQSEFGAYFLNINKQQTVDDVYRIENIKHDDFNAASSDSNIIVIDSFNGKTIFPVFSKEDSGNLGRRTAQKAVKYLMDYIPRFGGGLTKSKKSLNIFAVASGHLYERLMSIMITSVMKQTQSHVTFWLIDNFMSPKFKNVFLPILSAKLGFEYRLISYKWPYWLNKETVKQRTIWGYKILFLDVLFPMDLERVIFVDADQIVRTDLQQLYDMNINGAPYAYVPFCNDRPEIEGFRFWNHGYWKDHLRGKPYHISALYLVDLTVFRKLLAGDKLRAQYQQLSVDKNSLSNLDQDLPNNMQHLVPIFSLPPEWLWCETWCSSKTFKNAKTIDLCNNPMTKEKKLDVARRLLPEWTQYDNYIHSVLNKAPVKDEL

SEQ ID NO: 4005 - protein, 1091 aa, Strigomonas culicis
MAFEPMFMQANVLPRRNLMTSVYVVDPMDEESMYETVRAYQAIESGLFLRIGVVFFDPTWTETVDGDNVHGSPKDTEKLSVARLLSALLYAMDNKKDTSHKLYVIQTLYQDMKQSEQAKEPESVFQFVLGAMEKYTRTTLEQVLSSADFATWYHAQQQALRERRLAAQLPAVYLNGLHAREVEVKSLYKVYVDEVSTIRKLIQTAVLQDKDKNLYDTILKHFNARAKKRIHFTRPRNHLPLDTVDMFHFVSSRPYVYAEAYDGVVSPVTLALVVPCEAPLAHALTSLEIALSYTKAAAELRVRLTVAVCPARPATLASQIERVWRAAETLPEERRVGFLLDFVAHAKRAVEQLALDPLTNVSSVPALQLDDPSLTETLLRYEQHATAEASRRLDYLQQKFFENVRLRGPWYDPQLPWLFANGVTQALEADFTTADVRDIVEDCGALTKTVMRQIEEVPFAGPGTSFAPEALDSAFYATKIALVASITTPLAKRVSGRRAVTPIHEFIRATYGKTAFKMKPEGPVRHHMCVVLDPVLRESQLVMALSDHFLRSPLGVHLTVLMNPSTNVRIPIRNLYTFAADWDVHFDATGRVVPPSSIFRGLPTQALLTLGVEGPYAWTVFPSETDHDLDNILLSRLPADETLLRATYRIQSLVFVGSAYLNERPAQGLPLQVTPLLTREKPIDTLVMMNRGYYQLLVKPGVWHLSISPGPVASAFYIDTIDEQKLSAVRNGELLPSKERAQQIPVLMDSFEGKQLDLDIVAMDPERSVSLKELIQVSYTAKRDAWPPAKGTQATERPARPTLNIFSVASGHLYERFLRMMMRSVFRASSDLHGANTTRIKFWVIENFLSPQFKLYIPGIAAKYGFEVQFVTYQWPYWLHPQTEKQRRIWAYKILFLDVLFPLDVDRIIFVDADQTAHADLHDLYNMDIGDAAIAMTPFCEAHKNQATAQFRFWESNYWKKQLNGRPYHISAIFLVDLQKFRSSGSADIYRFIYQEYTTDPSSLANLDQDLPNVIQHLVPMYSLPEEWLWCETWCDQESKKKAKTIDLCNNPLTKIPKLQNAKTIVPQWEDWDRELEALAEEVLANLEAKS

SEQ ID NO: 4006 - protein, 1521 aa, Limulus polyphemus
MEVTGLKVCIFLIVFSCVRAKSQKSITVQLDAKWLDTPLFLEASEYLAEDSPDYFWKYVESIVRLGPGALQQKTAKQQYEVVVDIASKLLSPPKLAFLKFSLALRVYSPTIEMFHQIAKSSHFPSDCDSVAQVGGEFICDPEELRTLLASESKKSHTDTYQVDHHYPSSTSAPVTVILYGEIGTPSFIELHQYLKSKAEKKEVDYVLRHYIRRRSNKKVKLSGYGVELAIKSTEYKAQDDTQVKDEKQRDEDEEEQDKPDEIEGFIFTKLLDLYPEKKIELENFKSFVLDSTKEIATLKVWELQELSLQAAQKIISSPVEESLKVMQDIAQNFPTQARSLVHISVKPEIKKEIDANQQMFMQHHNLAPSDSALFINGMYFDMEITDVFSLVQVLKQETKLLEGLHNIGIPEAVVSKLLKLDMTEDKVDYAVDIRDSAIMYVNDIESDKQYRNWPSSIQDLLRPSYPGMLRNVRKNIYHLVIVADPSQSDVRDIYRLAESFYVHKAPVRIGLVFAVNSNASVDGYSDPGVALLNSYNFIAQDKTAYEGLSFITDVYVAMGDKDITVEDVTSLFKSRYPSEDMDIVFGIDSDYDTGRKLAWDFIERTGIGSPPQVLINGIPLKNKYLNGDMFEEAVLSEIMKQTPFIQKSVYKGDLSDHEEVIDFLMAQKNVMPRLNQKILSSDGTYIDLTGRVVEDLTIEDFNSLNVADMATTFSAHLKHITKRVEGIYFHPLTIWIAGDYDLPEGRALLASALAHLKSSQEVRLGVIFNPTVPLSPGVISKAIHSALSSLEQNTAKLFINKLLKEANIKAIEAGNKTLLNFAVSNMNTERFLEVFENDVTEIFARHSSFSKNVLGLPSGSRAVVANGRVYGPFDEEEKFSEDDFSLLEKYSMNMYGTKLSKELKSSPEMGKQDSELLMKAASLLLANPPNRVRHDVKFYSDKHSVITIPAADATEPAHEVLAVVDPVSRGAQKLAPLLMVLQRVINAKFRIFMNCVEKHSNMPLKSFFRLVLEPEPVFSPAEELGEGPVAIFSKMPTSPLLTLAMATPENWLVEVIGSPYDLDNIHLEQVESQVYAEFELEHLLLEGHCFEQSSGNPPRGLQFTLGTNSTPVMVDTIVMANLGYFQLKAEPGAWLLRLRQGRSSDIYEIVSHDGTDSPPSSKDVVVIISNFRSHVIKVRVNKKSGKLHQELLNDDDDNDDGSIWNSITSKFSGEKKDKDEEEEDKLNIFSLASGHLYERLLRIMMLSVIKNTKTPVKFWFLKNYLSPNIKDFLPYMSKKYGFEYELVEYKWPRWLNQQTEKQRIIWGYKILFLDVLFPLDVKKIIFVDADQVVRADLKELRDLDLGRSPYGYTPFCDSRKDMDGYRFWKSGYWASHLGNRKYHISALYVVDLKKFRRIAAGDRLRGQYQGLSQDPNSLSNLDQDLPNNMIHQVNIKSLPQEWLWCETWCDDESKQYAKTIDLCNNPKTKESKLVSARRIIPEWSDYDDEIKQLFETYQEEKQLNETKLLHKTETSHSHVEL

SEQ ID NO: 4007 - protein, 1585 aa, Dichomitus squalens
MIGALFPLLAWPILRTSAQAGKPPVNVELRTSWPATPILLESLEAVAIEDPSSFFPVLDAVTDPSVFPLPADKSSPEHAHKHVFDVALALDHLAAPGAYVAAEMHLALHSASPKLEAFYQYYNDHHAPRKETSGKNDDECGSWVDWYGEVVCDSKTLARLVETETLEPAEGSENVTSSAPPSSPKLLPFDHVLPDPTRLLDHQPQTAILYAALDSPNFRELHTYLYAAAQSPYPHITYVFRPIPPVHRSASKRTYLSGYGVALDLKKMDYLAVDDRLQSGGTQDDDSGTAVQDEEVDPIVTLLQQYPIDDGVDVTLPLTEAELLEIDIQAAQLVYDAPLADKLTTLKHLSQNFPRYAGALARRVPIQEDLLEEIAANQPRARGGLNAVWLNGVPLEEKDLNPWGLLRLMRRERKVVGELMSLGLSSEESIELLTHAKIAKAQTEGGALDGLFDASDRAEGGGVIGWFNDFEKDERYARWGGSLKILLRQMYPGQFPALKFNMFNIVLAVDLSRLSSVDFLATTVQALINRGLPFRWGVAPIVETEDGARMARLFYYLRENFGPQETFGFFYNIAQRDQAFETLRPSVDWPNVRSVFKALLARQEELPEGLETDLDTILEGTEGDLDKQRAYATRLSTKLSEAPQGHVFFNGKHFDLDDDFLRYLQTEASEHLQHLQLKVYRGELTDEDDAESISTYFYDLPTTAKRRNMYVHPSTAAGGLRIFSLPELIESNGLESKPGAFVYPEQSEQVPLTTYIVADFDSEESRGLIKEALLSITPGSLSRLSFIHNPATVSPFAKSDKFASPSRFLAELVTRGLLSKVTPERLLNALGLGDPEVSVDHEKQEPYFFNELTGSKVFSGEEYSKYLNACRLAARQLELQPGEQAVIVNGRVVGPIKPGEFVAGDFETLAAYENHKRVQPVYEALLDVHKSLENATKEDLAEFVSIVSSIVSSIQQPDPSEVGLFNAPQRPRLRSYQMLGGIYTSFSVGDNSTAIYHFGVLVDPISSAAQKWTSLFEWLQEIPGVYIEFHVNPTRFHELPLKRFYRYNLSPRLTFDEYGNEVHAKTQFTQLPVEPIYTLAMDTPQSWLIRPKEARYDLDNIQLSKLSAQDRVSGLKAVFDLDYLVVEGHARESATNAPPRGLQMQLVTSNSTPIADTLVMANLGYVQFKTKPGVYKLEIRPGRGREIFLMESAGNEGWTSPIVDEAGDEVTVTSFEGVTLYPRLARLPGKEREDVLQATSSQTKEQGVVENLMAKVSSLFGSKHKEEAAVAPVDDGQADINIFTVASGHLYEAGSFPSRRFASIMILSVLRHTKSSVKFWFIENFLSPDFLEFLPHFAAEYGFQYELITYKWPSWLRAQTEKQRIIWAYKILFLDVLFPMDLKKVIFVDADQIVRADLKELVDLDLHGAPYGYTPMGDDNPDTEGFRFWKTGYWKDFLRGLPYHISALYVVDLVRFREVSSILDILRGHYQQLSADPNSLANLDQDLPNNLQREVPIYSLPEDWLWCETWCNKDRLHRAKTIDLCQNPLTKEPKLDRARQIPEWEVYDNEIGAFARRLRSGQADSEDTQDTLIEDTPKHVKHEEL

SEQ ID NO: 4008 - protein, 1299 aa, Glycine soja
MAFRDYLLSSTVSDTLDVWELKDLGYQTVQRIVRASDPLQSMQEINQNFPSIVSSLSRTKLDDSIRDEIMANQRMVPPGKSLMALNGALVNVEDVDLYLLIDLIHQDLLLADQFSKLKIPQGTLKKLLSTSPPLESSIFRVDFHSSHVHYLNNLEEDAKYKQWRNNLDESIDMIISLYENNFPVRFGIVLYSSKFVMQLENHATKEHSDEDISTTIICLFSYINENYGAEMAYRFLSNVNKLRIESDGNADDALELHHVEGVFVETILSKVKSPPQEILLKLYKNQKLKELSQESSKFVFKLGLSKLQCSLLMNGLVIDPTKGPAWGCVGGVELVVHVDGVAVGVMHRSLAEERRKGHQKKGSEQKGPPRTEALINALNDETPRIQEQVYFGQIMSDTDVLAKFLSEAGIQRYNPKIISDSKPRFISLSMFTFGEESVLNDIVYLHSPGTMDDTKAVTHLLAVDITSRNGMKLLQQGIHYLIEGSKNARVGLLFNANRSPNLFSLLFVKVFEITASLYSHKTNVLDFLNQLCSLYEKNSILSPPMEAESTQAFVDMVCELGEANGLPSKGYRSALLEFPAGEVRKHLTKVQNSLYRVLGLESGANAVFTNGRVTYPIDESTFLSADLHLLESIEFKQRTKHIVEIIEEVEWHDVDPDTLTSKFISDIVMALSSSMAMRERNSESARFEILNDQHSVIILNNVNSSIHIDAVLDPLSPTSQRLSGILRVLWKYIQPSMRIVLNPVSSLADLPLKSYYRYVVPTMDDFSNTDSAINGPQALFANMPLSKTFTMNLDVPESWLVEPVIAFHDLDNILLENLGDTSTLQAVFELEALVLTGHCSEKDHDPPRGLQLILGTKTAPHLVDTLVMANLGYWQMKVSPGVWYLQLAPGRSSELYILKEDGEGSYDKQSSKLITINDLRGKLFHMEVLKKKGKEHEELLLPDDNAQDEKKGSGLNSNFLEWASGFIGGNKLSKKAEKSSQEKGRGGRHGKTINMVSIASGHLYERFMKIMILSVLKNTHRPVKFWFIKNYLSPPFKDLIPHMALQYGFEYELVTYKWPTWLHKQKEKQRIIWAYKILFLDVIFPLSLEKVIFVDADQVVRADMGVLYDMDIRGKPLAYTPFCDNNKEMDGYRFWRQGFWNDHLQGKPYHISALYVVDLKKFRETAAGDNLRVIYETLSRGPNSLANLDQDLPNYAQHTVPIFSLPQEWLWCESWCGNATKYKAKTIDLCNNPMTKEPKLQGARRIVSEWPDLDFEARRFTARILGDDQESESILPPNQSKNLNSEDSSNEDMESRAEL

SEQ ID NO: 4009 - protein, 1537 aa, Pleurotus ostreatus
MTPSRGFRRVAVLLVLPCLVHSTSPPVRVSLRSSWPAPPPIVEILETVALQTPSSFFPLLDALTDPDTLANFPSLSPEALYQASIEVASENGLITDAGAFAAVEMNLALHAATPKIEAFYHHYSNMQSKGTLKPDYTRPKVLPFDHINPSPQQTLDRPHRTAVLYASLESPNFRELHSYLFSLSNRGDPHVEYILRYVPPAGREVAQRNYLSGYGVALDLKKTDYLVVDDRQASQSRDGSQGEQRDGEDAVDLVMNLLETFEDKKGDAPNVASALSEEEIAELGFQATQLIATSDDPLGALTQLSQNFPKYAPSLSRRVVVNDSVRRELGNNQVQVQGGINMMWLNGATVQDKDVTPFALLRLLQRERQIVDSLTSLGLSNGQAVELLTHPTIAEAQSSSAALDGMFDASDRIEGGDVIVYWNDIEKDKRCALPMMHPTYPGMFHNIKLNIYNVILVVDLSQPTALNFITGPVSNIIERNFPFRFGIVPILETENGTKMAKVFKYLVKTVGRKATMEFFRALTQSPTFDIAHVSVAYEAFRASLDSEDISLKPLAEILSPEAESDESLMKAKHYAQRLGTTLTSSEGGHAFINGKHFNLDDVRVSLCSFDLLYTGELKEEAAETISTYFYDLPSTNERRNRYIYPSSDANSLRIYSLPEVLADTGYHPIFIAPEDTEDVPMSTYVIADFDNSSGVQLAIEALKSMLQLPQTGGSQTRLTFVHNPASVPSSDRSSVSWLLSHLVASDRLSKVTPGQLLRALNNDVTISGDAAQAPLSQVKELVGVDAAEFDATAYAAYVRAGRLISRKVNLQPGQQGLVVNGRVVGPLPGGEFLAPDFLALMKYEHKKRFGVVAAVLREVLSLAPEPESTSFSNIATMVTSVISSIQLPDPSESGLFDTPHRPRRRAYQALESNLTAFSFGDNTTAIYQLAVLVDPLSETGQKWASILNWISKVPGIFIEVYLNPARYREMPLKRFYRYNLISSLTFDMDGNEIPSRVVFEGLPIEPIYTLAMDVPSSWLVRPQEALYDLDNIQLGRLSSEDTTIDAVFGLDYLVIEGHARDSVSNAPPRGVQLELIDGDDNAIDDTLVVANLGYVQFKAKPGVFQLQIRKGRGRDIFEMESVGNEGWDSPTVKAVGSEITLTSFEGLTLYPRLRRKEGMDDVDVLTDTDEEDAPGMFGGLASKVMSIFSPKEGTKDVATTIPQADINIFTVASGLLYERFASIMILSVLRNTKSTVKFWFIENFLSPSFLEFIPHFAEEYGFQYELVTYKWPSWLRQQKEKQRVIWAYKILFLDVLFPMDLKKVLFVDADQIVRADLKELVDLDIQGAPYAYTPMGDDNYDMEGFRFWKTGYWKEFLQGRPYHISALYVVDLVRFRQIAAGDMLRGQYQQLSADPNSLANLDQDLPNNLQREVPIFSLHEDWLWCETWCSKDRLHKAKTIDLCQNPLTKEPKLSRARQIPEWEEYDAEISRFAQKLAKEGSLHSRIAAADTRVLADAGTASSGKSDETSAEAGGGDPASNEAAREKEESPKDIRDEL

SEQ ID NO: 4010 - protein, 1415 aa, Meyerozyma guilliermondii
MHYVSWTLVWLVTWLGFVCGDLGSLEFEVRAAWKNTPFLANLIESVAAYNETWYESAVAAYAGFGDDDDVQDSSEVSDEAIYQRIMAQLPAELKDFINFDSVYKIHSPRIATHYHQFEEEYGGNNLSKLEKACSTDSFGAKVPFINGHPHSFLVFNDKIYCSPDDIYALQTQDASDYTPLEIDRVIGSHTKAPVVVLYGVPGSPSTLAFLRHLMADSQAGKLRFVWRYLPATNIGDFMVGYGVQLELSNRTLPKHNVDELCMSVLAEKSANELYYHLRDILRSPFSKLNTAAEKLRQAFYDAKDKNARLGLTKASNGIYINGAIIPKAELSVYSLVAKIKSELSRMKNLKSLGFTTTQARALLEKFALLSAVKDAQYRKGNTIMGGNDNRFRVYQDDGVIFFNDIESDKNYVEYTTDAHVAYLEQSKSLRVGQIPALRQNVHDLIFAVNPSDRRQLEVFFTLAKLILDRGIPQQIGLLPLITSKTDEAVARAVHFLFKKGSPQEALGFLYKCLQAEKGNEEIAELAGTIPVPPEYRAPLFTESTFRYSIEKPSVVVNGVIYELQSPGWQTAMVNQLSQDVMVLKRHLETNSQTNMKQILYENASKFRNLRISPQDPSSIIYKEITADLVLHATTLKMKAESSTELPGTIWLIGDYTTSRVLEQLHVLLKFIKREKRFQINMIHTGTNEDFLEEMLSGTKDTQNLDTKGHKILLENIMKLIPTASSHSTVCSTAQHLLERNNLPLAYPYILFNSRFFRLDTKFDLKEISLLASYDSKQRMSILKDLVGAYKDIFDMKSLMEFAPNEHKEDWFDLLSSLVTTLYYNSEYITSGDVNRFDFSGLAYDNSVVLQNDEDEVEIVVIVDPMDSYSRKLIETVHAVKEFKSVSIKILMHTTEEDTETTDCVYSSIIPSASPQFSQTGLYISENSIHIRGPKNVSTSFTIDAPYSWHVVPQLSSKDLDIQKFNLSEEKWAIYELKSLVTDGYAKDILTGFSPSGAVLQMEQTNFKQDTAVFGILGYFQFRTPPGIFHLKTKCLADAENCYDLLSAGNAFNASREIVNLVKIPVFSLNGLQITPRLQISEKKQEKTQGSKLNFWSSKGVENTGEDINIFTIASGELYEHLLSIMLASATSHTKRLVKLWLLEGFLSPKFRLNLPALASKYGFSYEFISYKWPIWLRSQQPVLRTVWGYKILFLDALFPQDLKRVIFIDADQVLRADLMELMETDLQGAPYGFVPMCESKEEMKGYQFWKQGYWAQMLQDDLKYHISALFVVDLVEFRKRRVGDRLRAHYQKLSSDPKSLLNLDQDLPNNLQRIVPIHSLPPEWLWCDTWCAKEELGRAKAIDLCNDPTSTEDKIVRAKRVTSEWDDYNEEISRLLSESSMEYCQKPGDLKDLQLTLKDDGSVEADDSDYFHDEL

SEQ ID NO: 4011 - protein, 1418 aa, Brassica oleracea
MGTNLRSVIYVFLLLFVVVFTVNAQNRRPKNVQVAVKAKWQGTPLLLEAGELISKESKQLFWEFNEAWLGSDGDSDCKSARDCLLKISTQASALLAKPVASLFQFSLTLRSASPRVVLYRQLADESLSSFPHGDDPSASHCCWVDTGSSLFYDVADLLPWLASPPTAGGDAAQGPELFDFDHVHFDSKAGTPVAVLYGAVGTDCFREFHLSLAQAAKEGKVTYVVRPVLPSGCESKTRPCGAIGARDNVSLAGYGVELALKNMEYKAMDDSAIKKGITLEDPRTEDLSQDVRGFIFSKILDRKPELRSEVMAFRDYLLSSTVSDTLDVWELKDLGHQTAQRIVHASDPLQSMQEINQNFPSVVSSLSRMKLNESIKEEILSNQRMVPPGKALLALNGALLNIEDMDLYMLMDLAHQELSLANQFSKLKIPDGAIRKLLLTTPLPEPDSYRVDFRSEHVNYLNNLEEDDMYKRWRSNLNEEETLLNAMNDELPKIQEQVYYGQIESRTNVLDKLLSESGLSRYNPQIIGGGKNKPRYVSLASSTKSGESMLDDVNYLHSSETSDDVKYVTHLLAVDVTTKKGMKLLHEGVRYLIGGSKSARLGVLFSSSPNVDPYSLLFIKFFEITASSFSHKEKALHFLDKLCSFYEREYLFKTSVESGSSQMPIDKVLELAEEYGLPSKAYQSRLVESLDEELRKRMIKVAQFLSWELGLESDANAIISNGRVIFPVDERTFMGHDLHLLESMEINQRVKPVQEIIEGIEWQGVDPDLLTSKYFSDVFMLVSSAMATRDRSSESARFEVLSSEYSAVLLGDENATIHIDALIDPLSPTGQKLASLLQVLQKHVQTSMRIVLNPMSSLVDIPLKNYYRYVLPNTDDYSSTNFDVDGPKAFFANMPLSKTLTMNLDVPEPWLVEPVIAIHDLDNILLENLGDTTTLQAVFEVESLVLTGHCSEKDHEAPRGLQLILGTKNRPHLVDTLVMANLGYWQMKVSPGVWYLQLAPGRSSELYVLKGGNDGSQDQSSLKRITIDDLRGKVVHLEVVKKRGKEHEKLLVPTDGDDGVQQNNERGSWNSNFLKWASGFVGGRQQSVKEVAKKENEKGGRHGKTINIFSIASGHLYERFLKIMILSVLKNTNRPVKFWFIKNYLSPQFKDVIPHMAHEYNFEYELITYKWPSWLHKQKEKQRIIWAYKILFLDVIFPLSLEKVIFVDADQIIRTDMGELYDMNIKGRPLAYTPFCDNNKEMDGYRFWRQGFWREHLRGRPYHISALYVVDLVKFRETAAGDNLRVFYETLSKDPNSLSNLDQDLPNYAQHTVPIFSLPQEWLWCESWCGNATKSKARTIDLCNNPMTKEPKLQGARRIVTEWPDLDLEARKFTAKILGEDMELNEPVAAAATDKPNPPPSSDISVDSEQDLESKDEL

SEQ ID NO: 4012 - protein, 1535 aa, Sarcoptes scabiei
MSSNIEKKFSFKILLILLFFINLYPIFSKDISRTKSVRISLQSKWPQNPIYLEVAEFLSDENSDYYWRFIENLGTHLSSSKRKNLSDLSLKEQYELSLTLASQLLRSEAKLSILKFSLSVRSYSPKVIVFQNIIQDLLSFNQNSLVNCVDHFVELSLLSNKSSPLDRYVCGAEAIEKSINEYIELIQKNFDQKIDHPATYSIDHIYPSKFSCLQHSKPILTVILYTNIGSENFYRIHKLIRDKITSDSPLRYIVRHNPLISNEPTKVALSGYGVELAIKSTEYKAQDDTRVRGEILSVQKEKALTVLKEMSQNFPIVARSLVKINVDNELRREIVRNQQIFYQTLNLATSDSALFVNGLYHDVDSIDIFSLLETVKSEFYTVSKLHWLLNGDQSRIKQLDSILNQQQKHEIQLDIRDAAVLYINDLEKDDLYRNWPYSLNEMLRPTYPGILRNLRRNLYHLVLVMNPSHKESFDMLRMAESFYVHKAPVRIGLVFDVNDADSVTGYTDASVACLEAFNYVAQTKNAFEALSFLTDVIAFVTSSEKVRNLESVDIIGQLKSKFKLETDDLDDIFGSESSFDTGRKLSADFLKRTGLYHGPKALLNGIMLKESHLNADYFEDAVLGEIMRQTSQLQKAIYKNELTDNDDVLEWLMSKKTVMPRINRLIFDLIDNYQQKSSSSKVIDLMSEKIIKQHSSSLDPTRLFESNVNDLLAELTSSLRYINSKKDCNPVTVWLVSDFHQEESRNILLSCLKHLRETSRAMRLSLIYADHNPITRLFESAFSVINSSSQSLNFLIKSIEHNDWNDMETIYEFASQEYRQSLRERYSLLNDSNHSPFPLHQVLASKLFSISSHSNEMILVLNSRIIRLPLKREKNSSQVINEDDFALMERFVKNFFTDKILSLLEESVKTMGTRKCSDLILRLCSVLSGKTSTSKQRYDISSNIYEEHSVLTLEPKSLEDPFIEMIAILDPLTRGAQKISPILENFYQVFNCKIRIYFNAMDKHSDMPLKSFYRFVLDRELKFDSSGRIISPSALFKSMPTTPLFTLGMSVPENWMVEAIEAIHDLDNIHLAKVSSNIVAAVFELEHLLVEGHCFEQSSGNPPRGLQFTLGTKTDPTKYDTIVMANLGYFQLKASPGIWTLKLRHGRSDDIYTIVSDEDSEQGPNGTEVFPIISSFRSLVLKIRVNKKPGKQHEELLYDSDDLSKENEGWFASWTSDLNKSMSHSSKSIDSEDDEDSKRINIFSLASGHLYERLLRIMMLSVLKNTKTAVKFWFLKNYLSPHFKQVLPKMAIKYNFQYELVQYKWPRWLHQQTEKQRIIWGYKILFLDVLFPLNVKKIIFVDADQVVRADLKELRDFDLEGAPYGYTPFCDSRKDMDGFRFWKSGYWATHLHGRKYHISALYVIDLQKFRRIAAGDRLRGQYQGLSQDPNSLSNLDQDLPNNMIHQVSIKSLPQEWLWCETWCDDESKSKAKTIDLCNNPKTKEPKLTSARRIVDEWETYDKELRSFLESLKSEEEKADQYSASVVHPIDHHQEL

SEQ ID NO: 4013 - protein, 1614 aa, Heliocybe sulcata
MKPASALWTVAACLTSVLAVLSPPVKVSLRTSWSAPSILLEIIETVSLENPNAFFPLLDVLTNAKISSLPSDATPQATYEYVLSTAISEGLLLDPSSKAIVQMNTALHAATPKIEAAYQYYLDRHGKEKADTDNDGCRSWVDWHSQKVYDVETLAHLAGHETIDSSHPMNETTAPLARPKLLPFDHVHPARSQLRDLPPHTAIFYASPITDNFRELHEYLLSLARKPNAANVEYVFRHMPPCESRQAKEMSYLSGYGVAMDLKKMDYLALDDRRATAHSQNEVSDIEREKEGAIADAIAADPIITLLQHHPENTTADANAPLNEDELLEIGVKATQLIMSSPNPLATLQHLSQNFPKYATALARRVVVNESLLEEVGNNQYKAQPGISAVWLNGNPVSEVDLNPFGLLKLVRKERTLVASLTSLGLTPPQVVDLLTHRAIAAAQGGGDILDGMVDASDRSEGGDVVVWFNDLEKDARYARWSPVLRTLLRPIYPGSYHNLKLNLFNVVLVLDLSRTSSLHFLTSTISQIIQRSFPFRFGVVPIVEGDDGMRMAKLVYWCAKTYGRAGTMKFLKNVVQLQTAPIVDWRTVRTAFESFVANEEPPTEEFSAPDLDAMVGSESGSELEMNVKGVAQYAKRLGATLAASPSGHAFVNGKHYDLDDEFLRNMQVEISAQLQHIQEKVYMGEIRDEDADKVSTYFYDLPSTAKRRHPLIVPSSSGSLQIRSLPEVFSRVGRGLGVEGYLLPPGDRHLPLTTYAVADFDTPEGLWLVKELLETMDEESLSRITFSHNPIIPSTPSWTESPVSTLFAHLVQNGLLDKATPERLLRILGFGAAAAQNGHPQIVISNEDDLLSELIGGVDAEVTAQTYDEYLGFGQLFAKELGLKPGEQALVVNGRIIGPMKNAQFLAGDLRELYTYEMRKRVEPVFQALQEIVPDMATFDRGTFADVVSLSSSVVSAMQIPDPSEAGLFNAAYKPRTRNYRLMEGNFTRFEVGELGSALHQFGVILDPLSEAAQKWSSLFEWLSNAGNVYFEIYLHPAGYREIPLKRFYRYNLLPKLSFDADGKELQSTTVFQNLPLEPIYTLGMDAPPAWLVRPREAQHDLDNIQLGIITAKEWLLGVEAVFDLDFLVIEGHARDTMTNAPPRGLQLQLTSGTGNATIPVADTLVVANLGYSQFRAKPGVFQLEIRDSRGREIFETESVGNEGWDSPSVKEVGNEVALTSFEGLTLYPRFARKPGMERADVLEELDDSSSISSVAEEVLHKAWSMVTSFFAPKAEAPKSQELQTRQAEINIFTVASGLLYERFLSIMVLSVLRNTNSTVKFWFIENFLSPSFLEFIPHFAQAYNFQYELVTYKWPTWLRAQKEKQRIIWAYKILFLDVLFPMDLKKVIFVDADQIVRADLKELVDLDLHGAPYGYTPMGDDNVDMEGFRFWKTGYWKEFLQGRPYHISALYVVDLVRFRQMAAGDILRGHYQQLSADPGSLANLDQDLPNNLQTQVPIFSLDEDWLWCETWCSKDRLPRAKTIDLCQNPLTKEPKLARARQIPEWEEYDSEISRFARKLAEDGLIHSEITAAGADVLASVAAGAAAPAVGTADIPEERLDAESEGSRVHEEL

SEQ ID NO: 4014 - protein, 1502 aa, Pochonia chlamydosporia
MITDTPLEILPGFQEKALALVPVEGARTERNFNVTHGVTGTTCRGAPRGVLLRTTSTPIHAHGGGFLAFLQETAAGENESSYFPLLDRIGNGYFATATSDSELFRRFLEVLHHDGHITNPDALSTFKLALSLRSAAPRIESHYQHYTTAIEPLEGLQECDMWVLVNGKQYCTPDLDEAVANQLLSAAVKSLPFDRALGRGTTAVLYADPTSEGFPDYHRTLSKAARVSTLTYHLRYRRSKSHIGRPLPISGYGVELALKKTDYIVIDDRRSSQSIEQKSLEQEEILDGKENMSDLTALSKSELASIGMKAASFIQKSNEPFDTLMKFTQDFPKFASSISSHNVSHTFTEEYKHNQAQMVRGGINFLWMNGAQLIERQIQPFTLVNMLRRERRLVDGIRGLGFDGNQAVRLLGHEAVSAANENSEPLRYDWTDRLEAGQVILWLNDLENDDRYSSYPKTLSSLLQRTFPGQIPPIGRNIFNLIIPADLSNIEDLKFIAEVQSILDRGIPIRFGLVPLQSSHEAKIQAKIAYFLAKSYGLECVSSYVTGLTKAQPNGANPETLLSAVTANYSLLPEGEDMTLSTILETNEFTEKLSMAKRWSNRLKADTAVRPLFINGAAVHRDQNWMQSISLTVGADLQTVQKGVYHGALDDHTWIPGIFIDGAATRRNIYISGKDEKTLRMLNIAKIYDESAAQLDALPVIESSTESTKESWAVVTVLTDTSSNAGLGFFLSALEFRRNNPGVRLDFVNTQSNVRLSSQINAALKANQAKLKDIKTIQELKKLMQEATNYTASDDYEEFLSKVLAVSKTGIGSQGLIMNGRVIGPIAPTTPFDSEDFEQLLVYEQNRRIFPVYAAVADLGLSEKLSTAMTAAKLTSIIALSTISDLPEGIFESAPAIRSNIYDSWNANHTVIQTGNPKTANIHIVGLLDPVSEKAQRWAHILKMAAELDGVYIRLFLNPREHVEELPVKRFFRYIVESTPKFDETGSVKAPTAAFEGLPSDVLMTVGMDLPPAWLVAPKLSVHDLDNIQLSSVESDVEATYELQHILIEGHSRENEGSAPRGAQLVLGTENNPALTDTIVMANLGFFQFKANPGVYNIHLKPGRSADIYTIESIGANGWDAVPGDEGSELALMDFQGTTLYPRLKRRPNMENQDVLLDTSSQTEGSIVSKGLKLAEGLFGGGRNKPTISPRHAEINIFSVASGHLYERMLNIMMVSVMRNTKHTVKFWFIEQFLSPSFKEFIPHLAKEYGFEYEMVTYKWPHWLRQQKEKQREIWGYKILFLDVLFPLSLDKVIFVDADQIVRTDMMDLVNLDLNGAPYGFTPMCDSRTEMDGFRFWKQGYWANYLRGKPYHISALYVVDLRRFREMAAGDRLRQQYHALSADPASLSNLDQDLPNHMQFQIPIHSLPQDWLWCETWCSDDDFAKARTIDLCNNPQTKEPKLDRAKRQVPEWMVYDEEIAALDLRRKHREFGQSKEQKVEKETERTNSGDDVAESGHSRDEL

SEQ ID NO: 4015 - protein, 1451 aa, Candida tropicalis
MMSMKCISTFLAFCLLSTTVNAFLNNNLSIQLDAPWQKIDFLPSLIETVASYNSSLYYTTIETIFGLDDSDNDFDEDSSDKNIYEQICKNLDKYTKSFVDFDLINKKHGARVVSHYDHYQQVLSRMGDRLQKECEYDSFGNEVKKKNGQLQTWLLYNDKIYCSANDLFALRTDTSKEKTLLFDRVFGDNEEAPLLVLYGNPVEESTKEFFKVLYPDAMAGKIRFVWRYIPTFRKRQDTLPGYGVSLNMKNYDYGNGEKTSNFDLNKDLHKINDSGILIPVPEKNRDELGIKFTSFILSNRYKIHKYELLSTLLNDFPKFIPYIAKLSKSFNYEKVKTKVTANQDIGMSDESYGIYINGSPIHGLELDIYKLGNKIREELETIQNLVKLGFDSIQAKLLLTKFALLSAVKQTQFRNGNTLMGNNENRFKVYQSEFEKGNPGKGGVLFFNNIEVDVTFSEYTTNREEAYLGVSSYKLKPNQIPPLKENIHDLIFALNLANKSQLRVFFTIAKVILDSGIPQQIGLIPVIGDDPLDKEIARKFYYIAENSNTPEALALLYKYFDSANSDEAAAILNQVKVSKNFDVDYNYVLDKFSITEASVIFNGVIYDLRSPNWQIAMSKQISQDVSLIKSFLRQGPVEGKLKDKLYSNAKEKRNLRVIPLEPSEIIYKSVDTELLNESIAFKKIDKEDGVSGTFWLVSDFTKVEMFNQLIDLLSFLKKKPIQVRVVNTGDSKVFKSLHKNYKLTTLTNSQIEEIIEVLEDAELSKYDNPEVKRLLERKHLPSHHSFMLFNSRYFRLDIPLEPTELEELLEYEFTQRLNLFNDILYAYPDEFESKKLNEFNSLVSGLDSMDWFDLVSSIVTKSFHVDEKMFISDVNRFDFSSLDLSNSIDVSVNKEENPIDILVIMNPMEEYSQKLLSIVNSIKTFPFVNIRILLQPKVVSNEEIRVHRFYRGVYPSSDIQFDENTGIVVENNIAEFHNLPVDTRLSTELDVPTKWIVVSKSSSTDLDNVAFNKVVKSVNGKFLLKHILIEGFARDIHTGRTPDGLSFKLVHNNITTDTQVMSSLDYFQLKAIPGISLLSSNPEYNLLSASENKYDFNHDSLDEVEVPVFSLDGVTLYPRISKGDGITKYSNRHADINIFTIAGGSLYEKLASIMIASVRKNNPESIIKFWILENYITPEFRQLMQLISKKYTVQYEFINYKWPKFLRNQKSKERTIWGYKILFLDVLFPQDLDNVIFIDADQTCRSDLTELVNMDLQGAPYGFTPMCDSRKEMEGFRFWKQGYWSDVLKDDLQYHISALYVVDLKQFRSIKAGDRLRAHYQKLSSDPNSLSNLDQDLPNNMQRQIKIFSLPQNWLWCETWCSDESFRDAKMIDLCNNPLSKENKLDMAKRLLPEWVEYEKEIDELVSNLKEISSSVEDDENEEMEDDSILFEDTGFDEEEEEEEEDYHDEL

SEQ ID NO: 4016 - protein, 1558 aa, Frankliniella occidentalis
MTVKLWAVVAIAALMPHVLYCASPGKKTKSVTTLINSKWEATPFTLEIAEYLAEENKDSLWNFIDEVSALSPPLVDLGTDQQIYEKALAVGSRFISSSQSQLLKLALSLHIYAPKIEMYSQMAKEHGVVDKGCPCAVLLNGRLICHPSQLEESIANELSTNKVPSESFRVDHHYPGSENRSLVAVLYGEIGTYEFAQFHKVLKTQASEGKLGYILRHYVKERPNRKLRLSGYGVELQMKSTEYKAQDDTEVKGGAEGDGSQEEKEDEEIEGFNFNVLKSLYPDKIENLDKFRQGLIESSNEMAPLKAWQFQELSLQAAERIMSSSKDEALHVLTHIAQNFPLQARTLVRTVVNPELKKEMKQNQDLFSTSLNLQPQDTAIFVNGMFFDLDVVDVISLLEIIRQEQRLMQGLHTIGVSDKKMNALMSLDLSSGLGGNTEYGIDIRDSAVFWVNDIENDKAYKRWPSPLRDLLRPTFPGMLRSIRRNLFNLVIIADPSKLNSFSILKLAESFIHHQSPLHIGIVLATSPDSKQTGLTDASVALLNGYNYAVENGSPSDGLSFLTDVYAAIKTENRDVKVEDVHKKLKSKYKGVDLEDVFGADSDYNTGRKLAREFVERSGFRNLPQALMNGIPLSDKMLTADEFEEAVLSEIMSQTPIYQKAVYKGELRDSDNVIDFIMERPNIMPRLNERILNSENNRQIDLMRTVTSVEESISPPVFSLLGSSDQSALMVSTMRYFSPRKQSKTYFLTNWIVADLTSSCAKGRNLLQSALKQMKSSGAVRVGLIVNPIEGKSNDLLNRIALAALKVLSPDEATTFMLKLLDSKEVIQQLLAGEKKLSALGLTGINVAAVETAADTKPIKDNIKRHIMYVERTLGLNSGDTAVVSNGRVLGPLETTETFTVDDFSLLERHSFSTHIEKIKSALQPSPSASFFDEDDIEDTTELTSDVALRIVSLLVSHPQTRSRFEIPTFTTDHSVINIPASRPKEPAIRIDVIVDPVSRGAQRIGPILTTFQTALNCHIRVFLNSVEKNSDMPLKSFYRFVLEPELQFTPEGQLTAGPIARFTNLPEAPLLTQNLQVPENWLVESVASPYDLDNIRLEDVVGNVHSEYELEYLLLEGHCFEAMTGNPPRGLQITLGTEKEPVKVDTIVMANLGYFQLKANPGAWVLRLRQGRSADLFDIVSHDGSDTPPNSTDIKVVISSFRSHVLKLRVQKKPDKMNIDLLSEDDDANNPGIWNSITSTFGSNPKQGEEEPEEKLNIFSVASGHLYERFLRIMMLSVLKQTKTPVKFWFLKNYLSPTFKDFLPHMAREFGFEYELVQYKWPRWLHQQTEKQRIIWGYKILFLDVLFPLDVKKFIFVDADQVVRADLKELHDLDLGGAPYGYTPFCESRKEMDGFRFWKQGYWRSHLQGRRYHISALYVVDLKRFRRIAAGDRLRGQYQALSQDPNSLSNLDQDLPNNMIHQVSIKSLPQEWLWCETWCDDASKQNAKTIDLCNNPLTKEAKLTAAMRILPEWKGYDEQIKKLQQKVESEALDAHSEFHHSQPSKLSNNGHLEKHTEL

SEQ ID NO: 4017 - protein, 1673 aa, Schistosoma mansoni
MITFWAFLVLCSTSLDTYLSDNRVSVTLVPKWKNTPLLSEASEYVARESNSAFWRFLDLISKDLDFIRTNLIPPVDDYLLLSKNRLLEKRVKELAIQAISATSLNNSSLEIRNRLFTLSVSSRMFSPTVEMSHQLALTDASYLLNCSRETVLAELKRRTSGVAWVLAGSDAVFSIDKLKESIEKVVDPNSQPTLFPLEKVYSSPKDTSNNIPTVILYGDLSHHEFYSWHRSLKALSDDGLCNYAFRHYFQNRDLSGTSLNGYGVELALKSTEYKAMDDTKSEESDNVSLKETDKIVDVPIVAGFNFTQLRNIHPELTKELNEFHSHLLTTDDELRPLKAWQFRDLSLQACQIVMDGFLSNMKHEGFIGSYINLGLWSLRDISQNLPARASRLVNVNVNSSLRTESSKNQHVLTGTYGIQPGQSLLLLNGILLSPSVDIFALLDVIRQESKMMTQLHDLGIPGSNISQLIIEYGSSSGSVTNKNDPNLPGSRHSISNQFVLDLSNAPISYMNNLETDPAYAYWPSSLHTLFNFDFSGGLRRIRKNLYNVILIIDPVSFESREMLKLTESFLLHMTPVRFGIIWAVNPKLNSTSLILTRIFSYISSTIMNSHESPFPVQINGLGSPGPMAALSFLTEIYANAEKSNSELSIDLIKRKFEKLFPTADSDDIFTPESGNSDYDKEVTSHHEFLIRSGLQSIKKIPLILFNGIILDNDGIKKIGGFEDTVVTLSMEELMHVQSAVFQGQLSNSQAIFDLYQKTATIVPRFNVRLLNKKKDNSNQGSLNSPKYINFNGYSIPMGIFTMWIVIGDLDQIFDSNLPEEHRLQLQMDCNLALNALTFLRSAHSTKGLRIGFVYNPLKIIKEEKKSTDHWLTRVLYLVGNPINITLPLSNQLNNEIIAKRKYAEQMSGRNFAIRLIKEILESIKTSKPMKSLEELLVSGMDSKQIHDAIQLFDRNSFMQMHSTIACQIIGLKPGERAVVVNGKIVGPFEPFEEFLSDDFRLAERLALDNGAKELGDKLEKILGTTAGAPDIISELTWQLSSVLQSDGISDKSQNGHRILLHGVSYNHSGFIIHGNKNEPNFELVAIIDPASRDAQRLSHILIVLQHSLPCTVKVLFNPSPSLSELPVKSFYRFVWEPSLFPENESILNPSVIVPRAYFTHLPGQSLLTLGMDEPHGWMVAAIKAVQDLDNLRLVDYHSTQHLVEAVFELEYLLLEGHCMEEGSMKPPRGLQFTLGPTPTTTEYDTIVMANLGYFQLKANPGAWHLNIRAGKSQKLYEISGQEHTDTSVNSKEIITLISNFRSKIIEVSVNKRAEFASESMLDDSSEESNNCLKHSIASHLPWHKCASNQETINIFSVASGHLYERLLRIMMLTVIRHTNSPVKFWFLKNYLSPTFKDFIPYMATEYGFEYEFVQYKWPRWLHAQTEKQRIIWGYKILFLDVLFPLNVTKIIFVDADQIVRADLKELADLDLDGAPYGYTPFCDSRKEMDGFRFWKQGYWANHLAGRPYHISALYVVDLTRFRRLAAGDRLRGQYHGLSQDPNSLSNLDQDLPNNMIHQVPIKSLPQEWLWCETWCSDESLAKAKTIDLCNNPRTKEPKLTAAMRIAPEWVDYDREIKKLWKRVYVSPESSSSSSSAASASEFSTVSTTAEPTHLKESPVEGSKIDDDTVKTEL

SEQ ID NO: 4018 - protein, 1526 aa, Lingula anatina
MAGLVLLVILVLHACSEVDAKSKFVSVSLDAKWESTPLMLETSEFLAKESNAMFWAFVDTVAEANTADMQDKEPKEVYEMILSIAEKLIPSKLQLGLLKFSLSLRSYSPAVEMHNQVAKDNNPPRDCDTFVDVQGKVTCDSKEMKRLINSATQRAMPELYPFDHHFLTTKKSGPVVILYTELGTSSFNLFHGELKKLAKRGMVDYVLRHFVKEPSEEKVRLAGYGVELAIKSTEYKAKDDTKMQAGEDEEDDLEDDEGKDVQGIVFSSLRMKHPDLKEKLKEFKKHLMMSSNELSPLKVWQLQDLSFQTAEKVLSSADEDMLETLQDLSQNFPSRAMSLAKVSVKDDMRKEVKQNQKYFEQYLNILPGESALFFNGLQYDLDISDVFTLLDTLRADAKIMEGLYSMGIKGESLSSLLKLDLKETGTSYAVDIRNGPIQYINDLEKDRRYQQWPSSVQDMLRPTFPGMLRHVAKNFFTMVFMVDPSQPDARDLLKMAESFYVHNAPIRLGLLFVVNNEKEVDGEQDAGVALYRAFNFVKTANTVSAALSFLTDVFDKVQAGDLTADQVVAEFRSQYQDEDVNMVFSSDSDYDDGRISSAEYFSRIGLTSLPQVLLNGVPLKKETLNQDSFEEGVVMEIMKQTPDFQKAVYKGELTDRDNVLDWIMEKENVLPRLNDQILDTKDKRYLQFGHDAGLIDVNKAGTYTDMTDKELTASLAASMVYMKRQEEADKHPITMWVVADLSSPAGRAHLYSAVRHLKHSHTLRVGIVHNPRSLSTKLYEGSQIPLAIHTALGTQVPHIARSFVTKLLKEDNIHAILEGTKSLSDLEVHGMVMEVYLKALDVQTVAFLQFHSAFCTHVLGFEPGARGVIVNGRIIGPLKDQETFIEDDYNLLEKYTLKSSAEKIVQMLTGFTEDTKRVSDMVMQVGSLLMSNQQASIASRTDVQFAGDQHSVLKIPAKPEEPAYDVTFIVDPVSREAQKVTPLLRALLKVANLKIQIFMNCREKLSEMPLKNYYRYVIGSELEFSSRESLGAVATFHGLPQKSLLTLNMNPPEGWLVEAVRTQYDLDNIMLDEVDKGINAEFELEYLLLEGHCHDQNSGQPPRGLQFVLGTRSQQAVVDTIVMANLGYFQLKAKPGAWMLQLRHGRSEEIYKIASHERTDSPPDSPNITVVMNSFLSKIIKVKVSKKPGRESDDLLGGEEDKRGGLWDSLSSSLSGPSEEGNRETKVNIFSVASGHLYERFLRIMMLSVVKNTKSKIKFWFLKNYLSPTFKEFIPYYAREYGFEYELVQYKWPRWLHQQTEKQRIIWGYKILFLDVLFPLDVEKIIFVDADQVVRADIQELYDLDLGGAPYGYTPFCDSRKEMDGFRFWKSGYWASHLAGRKYHISALYVVDLKRFRKIAAGDRLRGQYQGLSQDPNSLSNLDQDLPNNMIHQVNIKSLPQEWLWCETWCSDDEKSKAKTIDLCNNPQTKEPKLNAAKRIVAEWEEYDNEARRIFENFTSNKPTLGSLSAGHIEAQETSTQPRDEL

SEQ ID NO: 4019 - protein, 1788 aa, Trypanosoma cruzi
MSTARFVFKIPCVCVCVYVCVRSFFHYSTQLQLYSRRATLVMTIPLIIPAPIFMFVLFSLSRRRAHLLPHNFSFCLFVCVCVCVSLLFFFLLVYCFFFIPVFYLLFSSSHTFPMDMGPQDCSRSMNQLHHRPRNLACRTDWRRSRGRFAATLTLLLLWSVSWIVLETSTAEGKGVHVTLLAPWTETPLLQEGCEMLAARGAPFVGFYQCLQEVWKCVKAMKSSGGAAKLTQKSQYDILLDMLEKANWPPAQVKLAKMKLAARLYSPAVEAHWQLARKAKQLTGGCSIEGNPFVLTAGKVICREDLLEETLSSPAPVNETEDSHEDEAFSLFAELDRIHPNSKGSRVVILYGIVGEEQTMQLLQVVERHLHTVRLAFRHLPISGRMWEHPLHVQGYAVTVDLKNVEYKVIDEKDKNDAGTDAKDTNPIEETENMGSVGGFNLALLTQRYPQLKPKLTAFAAHLADMIDRDEVKVDFQMWETQYMGIAAAQYVMDAENEKRLNVLMNLLTKFPLHASKLSKIGTTVKAKMDKKMHEELMEFASVVHSGTSPVFLNGRRLAAEKLNLFSLLEKLDEEEQLLEDVQRVFTSYRLPSVNDDGFLSVKTDALHQAMKSVRESVHGYIASNGLEDRESMPRIWMPQRSILWLNNIQRDVNYIYMPAALESILHVNFNGVPIIPRKNLVHAVCVVDPTTVAGLQNIFTMLKLEESKQPVRLGIVFADKNWSPELSVFTKGNHFMTDTSISVVTAIIAATVWELLKGEEHPQDVLEFLSEVVQSRSTRGTLEENDIKMISTNSLTLAGKRTVDNILADVSFMEYYQDTQMKLREMRLDAAPVMLLNGKIFQGNMLHALRQNFMEELHYVRGLVQSDALTERDDSDFYESILRLSGARERYNEAFYSKKVYADWTSKPVLDFLLHRPFLLPTVRSKKTPLVSSVLTIQSPMGEAALNALVKTIRNILQCEDETQKCVNVRFTYVVCDVAKESKRRTMAGDLERLILRRKEGDGGKEQVQWVYDFLQKITAQNNTRKLMDPDLYEGLVAEVNFSPEVKELLDASDEGLDAQLQLQRGIVNGFCAQLKADALSTSSSSSANGAAAAAAAAAGGEKGKEEGAVYYYVNGRRFVYDDNFLEDDFRAAEEMEMILAEAVSEALSKVDFKTIGSELEPSDLDSRFFASKVAALSELLRRDAARGSPMQEKNQLPSTTGLTSFVVNPANGDTVPRHTLTVVIDPVAQQSQFLISLCDYVTRSPLGVSCTVHMGAAEHASKLMRNFYQFVSEMELRFDAVGGVVPPAAVFHRLPSKHLLTLGIEEPESWTVFSLDAKYDLDNILLDKLPSSSEYLHAVYRINSILLTGSARDAEQPNPSRGLPLLIRSTKTNPDAGVTRDTLVMTIMGYFQLQSTPGVWYLTVQPGDIATIFYISQVDGIPVNDGANKNHHGKFNYTAGQNIPVVVSSFTGTFLMLGVSKTPGHEEVSIEDVNEASASHVDWPQKGPLKSKPDRPTLNIFSVASGHLYERFLRMMIHSVMRTSFDVHGANTTRIKFWLIENFLSPQFKTLVPLLAKHYGFDVGFVTYRWPWWLHKQTEKQRTIWAYKVLFLDVLFPLDVDRVIFVDADQTVLADLHELYNMDIGNAPTAYTPFCRKNPNPATKNFRFWDHGYWLEHLHGKPYHISAIYLVDLRRLRAIAGGDKYRLVYSRLSSDPNSLANLDQDLPNFIQDQVPIYSLPEEWLWCETWCGAESKARAKTIDLCNNPLTKMPKLDNARLIIPGWEETDTELEALSEKLLQQQKQQMS

SEQ ID NO: 4020 - protein, 1578 aa, Candida boidinii
MKHLGILQFYLLFQAIGLAVCLIAGNATDHSIDLSLVGTWKKVPFYLNVIETFSNESPDLFGSLVAKLLGLSVSTESEEDEYDEDTTIESNKISYYSVQNEENVQLDEKSFYEYAVELFESQSDQNKFKRSLLDIKLANKFYTPRIESHYQYYQNEVVPEFESKLKSDNLKSSWLYDGSKYFYTNPENTFALKTVNSALEDSKILLPFDRVIGKSGNIFILYGHFEDPKFKQFFTNLYQLALNGDLRIVWRYAPDFVHESDASEYETLGGYGIDLTLKRTDYIVVDDRGFTKEQQEKLVFDSPAEEIQNIGNTNSVEDITLELLNEYSKNIHLVEKENLSELGVKLVKIILDLKEKGRSPDELLLILKSLILEFPKHSYKISKFYNEKKSKSGSESESESESESESESGSESESGSESESESGSESDLLELKKNLSDSKLHQLPNGFYFNGAPISENNLNLYEILKVLERELNYINSLKENLGIKSTDKLKQLMLNFSQYINQLESKNLTKKRYNIDSFKNSVIYFNNIETDRMYSGLRTPKIAYKTKPTFGQVPQARSNIHDLVFAIHFSSQAQLYYLLQTFTVIMSYKIPQRVGVIPLIDNEIDERITKYFLSTVSSKGPIEGIKFLIAMYEEVYASQLDQVEIFNYLKTLEIPDEFDLDKFYKPTKDLIENLSITEPSIISNGVFIKFTDNWQKSLSEQLDFDCNLLFEATKGNKIKKGESYRSHLMKGSLKRKVPVLIPDDFSKSYEMYKQINDIPKLLSIFKNYSVIFDKSSNSDEPDDHEFNNRASTLTAIGSFYDKNFISQIITALNHLKTENSNDISRLRILDTSDNAEILKELKDVKNIEIAVHFFENISSKFTTSGGSVKQSLASELSELFEIDLSSITLSSTFIFISGRFIDTTGLKIKEEDFENLMEFEIVTRLGIINTELIGLIKSGELVILNSNDDLIQVSEIVSMILTSSYFYDDGRLLIDESIKRLNFGVLKPNEIAHLILPASSNENDSLIDIDLIIDPTTEFAQKLISMVSLFENMSFIKLRIHFVLDVSEKAPFSTIKRLYKGVYSSKVEFNENNHYSDSLLKALFINVPETALFTLDVDVPQSWIVTIKEAETDLDNIKLDISGSISGIYELENILIEGHAREGSSNATPRGLSIEISNKKGYSDTNVMANLGYFQLKANPGLWDLQIREGTKSFEIYSLVEIYDKFILFPSEMNFAKEKKSVKLAVLDLSGREVYPIFLKKKGRENEVLVDLDPTQGQINRSSNFWKSWSAKLSSLIKPKNLRKHADINIFTVASGRLYERFLGIMMASVMKHTEHTVKFWLIENYMSPLLKKDLPKLSEYYGFEYEFITYKWPSWLRGQREKQRTIWGYKILFLDVLFPQDLDKVIFVDSDQIVRTDMKELVDLDLHGAPYGYTPMCDSRKEMEGFRFWKQGYWAKLLGDDMKYHISALYVIDLQKFRSIGAGDRLRQHYHALSADPNSLSNLDQDLPNDLQDRIKIYSLPQEWLWCETWCDDDSLKKAKTIDLCNNPLTKEPKLDRARRQIPEWVQYDTEIANLLSDKPVDGTTDDSTLDEHDEL

SEQ ID NO: 4021 - protein, 1452 aa, Scleropages formosus
SVRSYYNLIIKKAAQFVSDLQVSLLKFALSLRSYSPTVHAFQQIASNEPPPEGCSAFVVIHGHHACSTKDVKKLLKTALDRPRPYLYKSDHKYPGANSTDVPVAILYAEIGTKKFNTLHKVLSEKADEGKLTYVLRHFVKETKPEKLRLSGYAVELAIKSTEYKAVDDTRVKDAKPTVTAEEDDDDEVQGFLFGKLKKSYPELQDHLTDLQKHLLESSNDMAPLKVWEMQDLSFQAASRIMSASKFDSLKLMRDVSQNFPIKARSLTRVVVNHEMRKEIEGNQKVLSETLGIHPGEAGLFINGLHIDLDIHTPFSILDTIRGEGKILEGLHNLGIKGEEQAKFLRLPETRRTLQSNAAALQQCLELFTAVSGGLQYRSLWLLSPHIQWVNDIEMDHMYRSWPSSSQELLRTTFPGVIRQIRRNFFNLVLFLDPCHEDSGELVKLAELFYSHTIPLRIGFVFVVNMDDRVDGTIDAGVGFVRVLNYVTEEYDFAQAFASMIYKKVEEGQVLSAGDVASYLKKKFPKASVAKILGPDSIYDDKRKAGRAFYRKTGLGSLPVALFNGVPLSSEEMDPEELETVLLQRIMDSTSFFQRAVFMGQLTDDMDVVEFLMEQANVVPRINPLVLSPLRRYLDFTSSPVVDDWKDPNTFSYLDSRDQSAVIATRVKYISKSDEDTIYGVTIWVVADFDSAPGRRLLQAALKHMKSSPNVRVGVISNAGAKLTEDNTVITRAIWASLHTQRSKETFSFLQKILKEENTKQLDQGAKMRDFLVQGMNSDTFEKKYNTIGVEFLHSQRLFCQNVLKLTSGQQAVVINGRILGPFEEEFELEDFHLLEKITLSASAEKIKGMVKSMGLMAKHVLHLSPRPDEVFYDVVAVVDPLTREAQKMSSLLIVLSQVINMKLQVFMNCRAKLSEMPLKSFYRFVLESDVMFLANDTVSPGPLARFTEMPESPLLTLNMITPESWMVEAVRSSYDLDNIHLQEVSSVVMAEYELEYLLLEGHCFDQSTGQPPRGLQFTLGMTRDPLMQDTIVMANLGYFQLKANPGAWILKLRKGRSEEIYQILAHDGTDSPADADAGDVIVVLNSFHSKIIKVRVQKKPDKTDEELLSDGKETKGLWESMRSITGQPTSEEAEKKEDVLNIFSVASGHLYERFLRIMMLSVLRHTKTPVKFWFLKNYLSPSFKESIPHLAEAYGFQYELVQYKWPRWLHQQTEKQRIIWGYKILFLDVLFPLAVDKIIFVDADQIVRADLKDLRDLDLQGAPYGYTPFCDSRKEMEGYRFWKSGYWASHLGNRKYHISALYVVDLKKFRKIAAGDRLRGQYQALSQDPNSLSNLDQDLPNNMIHQVAIKSLPQEWLWCETWCDDASKAAAKTIDLCNNPKTKEPKLAAAVRIVPEWAEYDHKIKELLKKNSGKPQSRTEAPQGRGGQDNLGNAPCRIALGLIGFGWINGID

SEQ ID NO: 4022 - protein, 1539 aa, Quercus suber
MRASTRSWLGAGLLNLIIHVDAVPGVDVALRTSFGAPPYLVELLETAAEENATAYFPLLDRIADGYFDASTTDYELYTAFRGLLQEEGHISRAEDLSSFDFALAIRSTAPRIESHYQYYNTSAPLSKDEECDTWLYVPFNGQKFCSPDLNEANAHAVEKVSSAKLRLLPFDRVLGDASSEWPSVLYSDITSTSFRAFYKTLSKTADVGKTSLIVRYKPSKDGITRPFTVSGYGVELALKRTDYIVIDDRQAEQEAREIPVSEETTLSEDEMSDLRPLSSSELRGLGMKAASFVQSSDSPFDTLYRLLQDFPKHSAVVAGVNISDDIVQEHLANREVLLPSGNNMLWINGVQVMPRDVDAYSLLEFLRKERRTIRGIRELGLSAPEAVDLLAHEAITTSQTGQEAQRYDWRDDNEGGNVILWLNDIEKDKRYAEWPASVTALLQRTYPGQLPAVRRDLHNLLMPIDLADAADVELLVDGIQNYVKRLVPIRFGLVPTAPSAASADQAKIVYYLVDRYGLGAVLSYLELSVVGAGRKYGAPQEKYFTKVIEERQLRKNRAILSFEEILTGVDGASRLSSSADYLHRLGHKPTSPSIFINGVPIAKTDEWLQAMSQRIGQDIRVLQEAVYRGTVTDNDYLPDLFLMKASLRRNALISPEEDNQIRHLDLGILSEIADLPSLPFSEDTIERELIHVTIIDDFDTLKGFSHLMEALIFKRQHDNVELAVLHARSDAIELRRKIQDYETMQSTEVMQTLLYKYDSSANMVLEAAGVTAPDELSVVHRQSIIQTIFDSFPENNAESSNTWPAFSEVINSAGPKAVLINGRVVGPIPLGAELVLDDFESLLSYERRKRLLPAALVIEGMKLTAMAATPSAFARVSNLIALSRVNDIPEGIFETPSTARTSKFKSWTAEYTAIKLGDAGSANIQIFASIDPASETAQRWLPIISTFSKLDGVYVCLFLNPKERLDELPIKRFYRHVLKPKPTFTSDGALEALSAKFSGLPADALLNMGMDLPPSWQVAPSDSVHDLDNIKLSAPKSGHDIEAVYELEHILIEGHSRDASSGPPPRGAQLVLGTQLDPHFAATIVMANLGYFQFKANPGIYNLGLKSGRSEEIFKIDSAGSKDNTQTDDGTSEIALMSFRGVTLYPRLSRKPGMEEEDVLEASKSGLESLAEGADRLLAQAGIHNVEASKLINQAAKFGSSLFSSSVAKLVTTSHHADINIFSVASGHLYERMLNIMMLSVMKHTKHTVKFWFIEQFLSPSFKDFLPAMAEEYGFRYEMVAYKWPHWLRGQKEKQREIWGYKILFLDVLFPLDLDKVIFVDADQIVRTDMYELVEHDLKGAPYGFTPMCDSRTEMEGFRFWKQGYWKNFLRGLPYHISALYVVDLKKFRQIAAGDRLRQQYHQLSADPASLSNLDQDLPNHMQMALPIHSLPQEWLWCETWCSDEALKNAKTIDLCNNPQTKEPKLDRARRQVPEWTVYDDEIAAVANRHKLNSSSGKPIAGDAGDAGLQGQEEESIQEKLQREDAEKEKKKKQVRDEL

SEQ ID NO: 4023 - protein, 645 aa, Eumeta japonica
MHSLTPRIQAHFQIASEALSLGNCADSSIFAQVGNELACTLDELRQKIKLEKAIGGDVKYITRHYLPDKQKSQKRVRLSGYGVELHLKSTEYKSQDDALKPVEDSNEERIEDVDADMEVKVSILSSGSKEFAIDIRDTAILWVNDIENDPQYRRWPSSVMDLLRPTFPDEDSDFDYGRQLALEFVDRLGFADSPQALLNGVPMPQNILASDSDFEEAIFAEIIQQTTALQKAVYKGDLTDSNDLLDYLMNQTHVMPRLNQQILGNNENAKFIDLSGEPHKDINNVQALAKLSNRDMTATLLYNIKYFEGKNSFETIGATKLHFLTIWVLGNVETDEGKELLKNALMYVKAGSSVRIAFIPNTEGANLSKKNNLNRLVWAAQQILNPQQATDLVLKWLKQSSDKWEYQNNQNFYRYVIESEIQFSPNGEFAEGPIAKFTGVPANSLLTQNVQVPENCEFELEYLLLEGHCFDAATGAPPRGLQMTLGTQNDPTMVDTIVMANLGYFQLKANPGVWTLRLREGKSSDIYDITYAGDLILCIKKHADLLGDEDNNHNGGIWNSIASSFGGGSSNDEKAETINIFSLASGHLYERALRIMMLLLPYMAEEYGFQYELVQYKWPRWLHQQTEKQRTIWGYKILFLDVLFP

SEQ ID NO: 4024 - protein, 1600 aa, Xanthophyllomyces dendrorhous
MRLSLALLMTCTVVVAAQKHVNLQLETVWQDHPFLFSILEQTSLNSPEAYLPILTHLSQRPDFPILAANSTALYHAAHALLPNYLHPSQIPAWDLGLAAGESAPAVEALLSVHQMLVDPEMNDCGAWVEWNGKRGCGPDGAVEVLGLGKGKEGINWDESINSTIRSYPFDHLLCLNIDSTLPPLTLYFAPSSTLFPPLLHLLQSFPELPLLVRYRMDPPLVSDLEGSSQATFVPVKKQKGVPVQGWGVEMVLKKMEYSSVDDRQDNVFNEEQIKEKRIIPEEDPILTEALGNDPWRENATPLNEVELTQLPFATASLILSHPSPLVALELLSQSFPLFTNALSRLPFDPKEPDNRALIKEGSFNRKQWEQLGGAGVGWQGSRREVEGRVWIDGKEIQAGKEGIFDLLPVVRRSISHSLALTELGLTPSQASSLLTLPQREPPIFDGLVDASDRMEMEAEGLVLEDQDLGEKTEKSGGVEGVVLWWNNLETDSRYKKWRSDLKMLLRQQPGQVPQLKRNLLNVIVSVDLSTTFGMEVLIGPVNQFINRGLGIRFGMVEVLDGEAGVATRMARLTRHLVKTYGRASTMQFLSHVVQSSPTPDISLTLVEKIYARFIQYVEPLGFEGDRQNAPRLLSFVEVISEAHEKRERATYKWIERLDLKGPDGGRLTFVNGKAVERTETQAWIRALQVELSKDLVFLTERIEAGHLADTVGIPVEVANYFYDLPQTSNRRTGAIFEGKGADESRLKVANMNDVLRKVNENSDIGQRWIYPDGSSKTPLSIWIAGDLDSEQGLGLVWEALVAMQSTPFRLSFLHKPKRLLERSSRTLLSTLLFETMHDPILGSATPSTLLEIIDKAEIAPVHESSTQPSGEDEAAKVYWEGGRHALGPRGLDVADGEVILVVNGRIIKSDANRIFDSHDYEVLLRHELHVRAEPIVDALEEFYDNTSVFDRTTYSNLVAFTSSTVSQAVAEDVVPGMFGVASASTRSQAYELFRSDKTSFEIGHKATALLRIVAIMDPATEFAQKWSTTLRVLSEMNFVYVKVILLPSGVLNETPLKRFYRLNLQSKVTFEDDEQTRSRVSFQNLPQEPIFTLGVETPPSWLVTPKESVHDLDNLKLIDLTSDVEPVFELRTLVVEGHARETKTGSPPRGLQIELTDSNGQPMADTSVMANLGYFQLKANPGVLSLRIREGRGREIYELASVGTSGWQSPPTNETGPEVPIYSFSTGLTIYPQMSRKMGKELDDVLEIIDVKPSFLNSLKSRISSLFGSKTDEIAPIKKNADINIFTVASGLLYERFAYIMAISVMRHTNSTVKFWFIENFLSPSFLEFIPHLAKEYGFEYELVTYKWPSWLTGQKEKQRLIWGYKILFLDVLFPMDLNKVIFVDADQIVRTDLKELVDEDLHGAPYAYAPMGDDREEVEGFRFWKTGYWKEALRGRPYHISALYAVDLDRFRQIAAGDRLRGQYQGLSQDPNSLANLDQDLPNSMQDQLRIHTLDKSWLWCATWCSAESLKDAKTIDLCQDPQTKEPKLARARRIPEWEVYDSEVASLAARLSKESVIRSGPVEIDKLDRDGKKSEMVEEYEQSDHAHQGEADQKRDEL

SEQ ID NO: 4025 - protein, 1974 aa, Cafeteria roenbergensis
MFDVLQQASEFIADEDAMRGDESGSLFWGFVDGVHSLLDAGAKVDTAEDAAALAVTAASRVMQPLSVRVMRVSVAARAHAAAVEMHREQAVASAGRCPDSPDAWAVVLPQNRVACSAAELRRLIGAHATSGSSPDPPLTRLASQDHVLRSADASAAAATAAAASAAAGPATVVYGLLGTRGLQDLHEVAASAARRGATTYALRHWVPAGGAGNTRLSGWSAGLDVKNTEYRATDDRAGGPSEPSGREAAALRSVSPADAHGTPLADVVLEAAPLGALWGSDGKATLASDGTPGAGSAPGPTPDGPAGAGSSAGVLAALLEAHKGWRAADPSLPDASTMHVRDVNATGIGVKTTAYLLQASGRFDEGVAFAAQRDAAVSQASAKRHQDAVERKRARMQRLAKRTGKSMPDHVQLSRNELVLLAREPLPGIEPAAVAQARFDKRWASNQTAPEALSPAADPLALLSHLTGNFPAAAAALSTAPVDPALLSALRSSAYSVPHGQNIVLVNGRQIDATASSFNFFSVLRTLQDEASVLSQFASLPIAEQEVLALRALAAGTKGAEADGDDGAASADPVSEAEGGSPTLRVDYRSGADDCVVWLSDVEKDAQFRRMRASVRALLTQTWQLHQVRRNLYTAVLLGDASSPGGLRAILTALYFVQNALPIKFGFVPVASPADAPTEDLEAAAARFRTGAASKPDAPGGARAELAADDPVNSLDVALLALAAERNLGRAASSAFLANLAQAWQESVQARAAKLRAQAKSQQELQQLLQGMDINVAVSAEQAIDAFVEASASASGGTSLFGNGKHLNAARAALADATGEGRAHVLRIRKWAASHGLPSPGFLVNGRPGSGLAVQEEVVPQIQADLRTLQNLVRLGHLDDDSKSDALAVLLSSAGAVPVYHRAALDTSTSPFVPLASAAAAPLLWGVRYFHAPGTADVAKTVTVTLLDDLNSRMGVESALAALQAAAVPSTGAAARVGVVHSGPSPASSPGTVAAVLTAAAWAIGDDDAAGTVKVNDRLPAFTAVVSAAKQALAAGGPSPAQATVSALLSAGKGEASSLSSVISGRAFKRIASVVKAASSPSGKVARKAAKAAAEARGAARSAASVAGAVEESGAPSTGSALVGAWSRAEAARGVAAAVVPRVPAPAGAPAGAVPKPGPDGTVRAILTNGRVVALRREETVSPEVVSAAVGAEDRARGTRVQSTLSAASILSVLPDEDDAAAKPSSAHLSGPWAVKADDATAEFTSALIAAASSAVGAYGAGGVRHRLPHEALDTPLTSFLTFPAPVLAGTAEPSGVEVEALLDPVSEAAQRAAPLLQLLRDAMGARVRVYLHPSTSMRGTGEDSDRKLPLSSFYRFAGPGMGPGAADSASFDGLPPFLLTAKVYPPEPWVVQTDASAMDTDNIQLARGERLSVRYGLRSLLVAGQCDELGASAPPNGLQLQLGPAPGLPATAAAGAPAVLPSSPEFLRPMADTLVMQNLGYFQLKAQPGVRALALAPGRATQLYDIVIPEGAGRDGRLPGEARSGVLRNVGQHQQRLIGEEADDDEPEMESVASLEVTVRDFVGDVTQLRVRRRPGFESAKLLVEEEEEAAEVALQASQETSRGFWGSVRSFFGGKASAGSTAVAGKDDRIHVFSLASGHLYERFLKIMMLSVTKRSSRPVTFWLVENFLSPQFKETVPALAESAGFEVKMVTYKWPNWLRGQTEKQRIIWGYKVLFLDVLFPLDLDKVIYVDADQVVRADLAELWDLDLEGAPYGYTPFCTSREETLGFQFWRQGYWKDHLRGKPYHISALYVVDLKRFRRQAVGDKLRAVYDQLSRDPNSLSNLDQDLPNYAQGMVPIKSLPQEWLWCESWCSDSTKGAAKTIDLCNNPLHKEPKLDMARRVISGELFNESWVELDAEAARSEGRAPPAAPAAAPAATAEPQPAATPASDSAETGASPGKAKKGKRPGKASKKPRKGGKRKASKAAAKDEL

SEQ ID NO: 4026 - protein, 1775 aa, Monosiga brevicollis
MPNWAHLILRHVAFLCRFEPIGVPPDVCMCANKNVWHISRHAWHQRLVKLQQDGRILYILRHYRRDHEQDGPIRLSGWGVELAVKKTEYIATDDSAVEEDVTEALADEAVEDEDQVAGFDFAQLRALHPDQQEHLARLQRQLLETPIEIHPLKAWELQDIDLQAAQRVLEAADPVQTLQAITSNFPTIQHVLAQNKPNETIKQEIAMNQQSLQYVGLSAGTTLMTLNDVILDTTTVDIFYLLKILAQHSDTMSELQEAGIPAKHVPEFQGISLQTNPPAEVLNLKSSAVQYLNNLEKDSAYSRWPSTLTALLQPLSPGTKYRVSRNIFTILLTGRVLDPVFAAQLLEAHGQLVKKQEMVRVGILAATTVGQRQLRQRTVEFTSTGHAKTGKETDVLALAQSEEERLEVLLVRAYSVVQKRKKSTRRALDWLCSFYQRYPDVTEKAIQEHALTVITSTDWQTTVLNYAKDVDTIRSRMDAHFEASGLPLRQVTVLFNGRPVSLEDNKNSVKQIFTQNSRQQFGMLQRQIYYRQISDAGSVYDAIMKLNKATKRMTAPELMKHTNVVLCGRPQNITSAAELQGATSGQVLSWLDQSLKYYVKPESSATVKLSSTRVRVAFLNSASGEQADVHHLINAIGRHFASDVALMKIGHVLAHSINHPDANLDDLIKVLKSKDQAAVRTLVRTERDNALKARLHEVAVKQALQLENGALALVTNGRVYGPFGPDVSFSGSDLAFLENFHNNEGQAKQVANRVGRLLPGLRQRDRETIVRNLLALLTNSAEKAGTSGRPQQRLDRRHLSNVAQKYSAVTVAPRDSTDNALVHRCFVVLDPLSAQAQRVAPLLAMLHANVNVEITLLMNPVLKVSEVPLKRYYRMVLPSVEFDAQGRLTPGPRAVFRQLPRAPLLTLGMETSASLMVEAEQSAHDLDNIHLQSADGDVYALFRLRYLTVEGGSLAADTRAPTAGVQLQLGTPLAGALYDTLVMANLGYFQLKSQPGAYELQLLPGKSTDIFTIEEAGGSDSHSQDQRPLVLVRDFTGTHVSLRLKRRPGQEKARLLDDMPSAHSAGDGAADKAEETDPGASSGGGLWDSLSSLMGTGEKGSATAVGAHSGRVERAGETINIFSLASGHLYERFLKIMMLSVLKNTRNPVKFWFLESCMSPQMKAFLPHMAAEYGFEFQLVSYNWPRWLNKPAEKMRLIWAYKILFLDVLFPMDVKKIIFVDADQVVRADMRELVELDLKGAPYGYTPFCDSYQGLSQDPNSLSNLDQDLPNNMVHNVPIRSLPQEWLWCESWCDDRSKGRAKTIDLCNNPKTKEPKLQAAVRIIPEWTALDQEARNLTNRVVNAGPAPGSGHKILLISLSLSLSLSLSLSLSLSLSLYCVTIQAGCHPESFAGLKHDDHSLVFEPSDCDDRPEPASVESSAATSQDNSASASDGTWEPDTLTETELSLAHHNPRASHQTRPHPGHSSVQKLAHVALAFAPTKDCVTQFNALLVHGITTRAALCHALNFHVTRHAGYRALCGASDTQGVESVLQDLLSLAIRLRHTALVKYLLEQHACLRVKNPQPGKRSPMMLACATGHLPVVEALIQHQKFILRDFRAMDMEALVTAVAHNRRAVVTALLKRYNFNLRDARARNNVLLKVCARNGWQQMLELLLEKFAYTAADVQRDDYEAPCLAYEHGHTTVFWFLVDRFGLAKPELLEARHFSVLRWAVDRQDGAMLGALGRKLGSAQATACLRRMWRATGASLRPATTEVATEPAMAVPKERLRARPRPAA

SEQ ID NO: 4027 - protein, 1619 aa, Zostera marina
MSRVLVFFLLFFVGISISAAGESISRTKNVQTALRARWPGTPILLEAGELLSGEWKDFYWDFIDVWLQDDDSGCSTARSCVEKIVKYGQSLLSEKLGSIFEFSLMLRSASPRLVLYRQLAENSLSSLSSVKGSNGTLSVPEGSCCWVDTGSKLLFSELDFFLWVDSLSESSEVDILSKLELFDFDHLYPGSSIKSHTTILYGALGTKCFRDFHRFLTEAAKKGKIKYVVRPVLSFGCGGINNYCGSVGSLDALNFGGYGVELALKNMEYKAIDDSVVKKGVTLEDPHTEDLTQDVRGFIFSKLLDRKAELSSEIMSFRDHLLSSTVSDTLEVWELKDVGHQTVQRIVHASDPLQAMLEINQNFPSIVSLLSRTKLNDSIKDEIVANQQMVPNGRSLMAINGALLNIEDIDLYMLMDLVHEELSLADQFLMLKIPHSTVLKLLSTPPLSESHVIRVDFRSCPVHYLNNLEEDSMYKRWRSNMNELLMPVFPGQLRYIKKNIYHAVYVLDPGTHCGAKAIDVILSLYENNIPMRFGILLYSSKIIKIIEANGGELPVSSTDEVLNEKMDDISTLLIRLFMYIKESNGAQLAFQFLSNVNSLSNISEDLPDELIEVHHVEQAFVETMTSKTKSLPQDILLKLEKDSKFMVATEQSSLSVFKLGLSSLKCCLLMNGLVHEASEDASMSAMNDELPRLQEKLYYGQIHSHTDILEHFLSENSFKRYNPQIIVEGKDKKKFISLSTLVVGKESLLGDISYLYSPGTADELKPLTHLLVINATSMTGMRLLHEGIHYLMEGTKKGRVGVLFNLNNDVLSPAIFFARIFNITASSFSHKAKVLEFLDQLCSSYQTTFLSMSSLDEENFMLFTEKVFELADDYGLPSEYYKETLSKLSADIIKSHLDKVSHFLYGQLGLDCGANAVVTNGRIILPRDNIFSKEDFVLLEMIEYEHRIKNIMEIIDKVEWVGIDPDDLTSKYISDAVLLVSSSLSIRERSSERARFEILNSKYSAVVLNNENATIHIDAVIDPLSPSGQKISPLLHILWKRIRPSMRIVLNPMSSLVDLPLKNYYRYVTPTMDDFSTTDYSVNGPKALFLNMPLSKTLTMNLDVPESWLVDPVVAIHDLDNILLENLGDERTLKAVFELEALVLTGHCSEKDHDHPSGLQLILKTKNSPHLIDTLVMSNLGYWQMKVSPGVWYLQLAPGRSADLYELNEIDDEGIKHPLSKRIVINDLRGKPIQLEVSKRKGMEHEELLVASAHDNQQTDKNKDSPSSWNKNLFKWASDFIGGNVKSRRKETNTTVVNKVVREGKTINIFSIASGHLYERFLKIMMLSVLKNTQRPVKFWFIKNYLSPQFKDVIPHIAQEYGFEYELITYKWPTWLHKQKEKQRIIWAYKILFLDVIFPLSLEKVIFVDADQVVRTDMGELYDMDIKGRPLAYTPFCDNNKEMDGYRFWRQGFWRDHLRGRPYHISALYVVDLVKFRQTAAGDNLRVVYETLSKDPNSLSNLDQDLPNYSQHQVPIFSLPQEWLWCESWCGNATKFKAKTIDLCNNPMTKEPKLQGARRIISEWEDLDQEARHVTTKMSSEGQETEDAIKQPVTFQVEDRSFTKKNTVSTDVDVDHSEL

SEQ ID NO: 4028 - protein, 784 aa, Tropilaelaps mercedesae
MKQTPKIQRAIYKGELADDDAVIDYLMSQLTTLVQSTLCSMGQMESRQFLTKVLRNWDKLKSGEMAATDLLPRGANLQLLSDAEISNTVALHKAFVGSLNIKPGSRGIIADGRLLGPLQEGEEFTAEDFNLLERLSMAVYGEKVAELLGSSSSDLLMKASSVLQRFAQVKMRHELKFATDQHGVIKVASKNANEAAHDITVIVDPASRGAQKVSQILLLLQQVVNANIRVFFNCNHGHKELPLKTYYRFVASNEPQFGGNGELSAPRAAFIGLPTKPILTLAMATPENWLIGAVRSVYDLDNIRMADVESRVVAEFELEHLLVEGHCFEQSSGSPPRGLEFTLGSPANPVMYDTIVMANLGYFQLKANPGTWFLRIREGRSTELYEIASTENTEKSGEDVAVLVTNFRSKVLKVRVAKRPGKESEELLVDDDSQNDGLWNSITNSLSGSKTRESADRENDSEDNVINIFSVATGHLYERLLRIMMMSVLKNTNTKVKFWFLKNYLSPSMKDILPYYARRYGFEYQLVEYKWPRWLNQQTEKQRIIWGYKILFLDVLFPLSVKKIIFVDADQIVRADIKELRDLDLGGAPYGYTPFCDSREDMEGFRFWKRGYWSQHLGHRKYHISALYVVDLKKFRRIAAGDRLRGQYQGLSQDPNSLSNLDQDLPNNMIHQVAIKSLPQEWLWCETWCSDESKPHAKTIDLCNNPKTKEPKLTAAARIVPEWTSYDEELKKMIEDFQKEKEGGFIDDASQEDKIPPPKTGPQQQRVDMHGQPSVIDSQHRTEL

SEQ ID NO: 4029 - protein, 1491 aa, Tolypocladium ophioglossoides
  MOD_RES (1441)..(1441): Any amino acid
MIRLSNLPWGMALALTAALQATAASSVNVGMKAAFSAGPYLLELLETAAGENSTAYFPLLDRIATGHFASASSDAALYNTFLDVLREDGHISNPEALSTFNLALSLRSAAPRIEAHYQYYSTAVEPALADFDCQDWVLFEGKQYCTPALDIVVKDGLFASEVSTLPFDRTLGAGREAVLYTDPTSDTFGEYHKVISKAARALALKYRVRYRRRNAKTTQALPVSGYGVELALKRTDYIVIDDREATQDSAQKPLASGAILNGEDEEVADLRPLSTSELASLGMKTASFIQGSDNPFETLVKLTQDFARFSASIAAHNVSKDFVTEYGQNKVQMGRGGINLLWMNGIQLIERQIEPFALVEMLRRERRLISGVRDLGLSGKHAVSLLGHSAISAAKGDVGPVRYDWTDRLEDGRVIIWLNDLEEDSRYEKYPKTLTSLLQRAYPGQMPPIGRNIFNLLVPADLSNAEDLAFVSQVVSIMNRGIPIRFGLVPLTSTAESTAQAKLLYYLAEKHGPEALIAYVQGLSEKTQTVADEKLFTNVIAARELPSDSQDMSFQEVLEAEFYKEQTKLARRWVERLKADTLIRPLFINGIVIPRDKNWMKTMSMRIDEDLQVIQKGIFHGILDEETWIPGTFLEGAAARRNVYIALDDDKALRMLDVGKIYNDHADLFRQIPLLESYSDSTKENWAVMTVLADMTTDDGLQLVLSALEFQRNNPGVHLEFVHNPEDSTAASQVNAAFKADMETLGSIETKDKLSKIAEAAKDFLDDEDYAAALTSLLTMANINSGTKMVILNGRVVGPIPGNASFTADDFQQFFEFEQNRRILPVYAAMGDLGLGDKLSSAIAAAKATSITALSTISDLPEGIFESAPAIRSTLYDSWNSSHTAIEIGDPETASIHIAGLLDPVSERGQRWAPILKVLSELDGVYVKLILNPLEKIEELPVKRFFRYVIESKPSFDESGQIRELKAAFKGLPSEALLTAGMDVPPAWLVAPKESTHDLDNIKLSSTKSDVDATYELEHILIEGHSREGQGAPRGAQLVLATEKDPLLTDTIVMSNLGFFQFKANPGFYNIQLKEGRTADIYAIESIGAQGWEAVPGDEGTGLALMNFQGTTLYPRLKRRSGMEKEDVLEKADGSSGDSLVTKGLKFAGLFGGSKTKSVSAQEHAEINIFSVASGHLYERMLNIMMVSVMRNTKHSVKFWFIEQFLSPSFKEFIPHMAEEYGFKYEMVTYKWPHWLRQQKEKQREIWGYKILFLDVLFPLSLDKVIFVDADQVVRTDMMDLANLDLEGAPYGFTPMCDSRTEMEGFRFWKQGYWAGYLRGLPYHISALYVVDLRRFRELAAGDRLRQHYHSLSADPASLSNLDQDLPNHMQFQIPIHSLPQEWLWCETWCSDESLASARTIDLCNNPQTKEPKLDRARRQVPEWTAYDDEIAALDRKRRQXQQNTGGDTESAGSPAGGEQKAMEEAKQREVNTKSRRWDEGGGNVHTMDEL

SEQ ID NO: 4030 - protein, 1535 aa, Hortaea werneckii
MILTNQRLVLAAGLSCLISHAHAVPPVDVALRASFGAPPYLVELLETAAEENATSYFPLLDRIADGHFDSATTDQELYTRFRSLLREDGHLSQSEELSSFDLALSLHAAAPRIEAQYQYYNTSPDMTEASAQKVDSVTGRVHELPFDRVLGDLDNVKPSVLYADITSDSFKKFHKTISKTAREGKTSYRVRYVPPKVATPVPLTVSGYGVELALKRTDYIVIDDRQAEEEQKDGTVPATEATLTEEEVADLRPLSSSELLRLGLKAASFVLSSDTPFDTLLRLSQDFPKHSGSIAATNVSKDFLQEHRENRETLLPPGFNVLWINGVQIMGRDVDAYSLLKHLRRERKMIGGVRELGLSGPEAIDLLSHEAITASSADQEVQRYDWRDENEGGNVIMWLNDIEKDKRYAEWPGTVNALLVRTYPGQLPSCRRNIHHVVLPVDFSDYKDVAVVVEQVQNFVRRKIPIKFGLIPLFHTQEGEQQAKLVYYLLDRYGLTVALDYLGKSIIGSGRKFGAPQEKFFEAAIADRTLRSNKEQLPFNDVVTSDEFGARLKGAESYMSRLGAGSTKPPILLNGAPIEHTDDWLQVMSQRVSIDLRIVQQAIFEETMGEDDYLPEIFLAKAVLRRNPIIVPEDDKDIRHLDLGELPFASLHSLSADPDAIERELVHLTVAADFNQPEGFEQLMEALIFKQQHDNVELAVLPTGGSGKVTARLGLDQDGQVSTDKLASLLAVYDMLSSNAKASGADGAESEASKQDTQLNLAARRSVYRQMLNAANEDTTAGGGQRAASLSSAYKTIAAAAGLEANQEALILNGRLVGPFSSNASVEMEDLEALLEYERKKRLLPTALAIDDLQIRDKASSPLAFARISNLIALSQVSDIPEGFFEAAPTLRTDVFKKFNSSHTAIKTGDMSSASVQIVSAIDPASELAQRWVPIIKALSELDGVATILFLNPKDRLEELPVKRFYRYVLDSKPTFSTDGSLESSIARFSGLPAEALLNIGMDLPPSWLVAPKESIHDLDNIKLSAVKPGSDIEAVYELQHVLIEGHSRDTTLGIPPRGTQLVLGTDADSHFADTIVMANLGYFQFKANPGVYRLALQKGRSEEIFQIDSAGTNGYKPRPGDNFTEMALMSFRGATLYPRLSRKPGMEEEDVLEAAKSTLDHFADGADQLLAQVGINGLKASKYMSKAAKLGSSLFAGSDSKQSAGTVEPHADINIFSVASGHLYERMLNIMMVSVMKHTQHTVKFWFIEQFLSPSFKDFLPVLAKEYGFKYEMVTYKWPHWLRGQKEKQREIWGYKILYLDVLFPLDLDKVIFVDADQIVRTDMYELVQHDLQGAPYGFTPMCDSRTEMEGFRFWKQGYWKNFLRGLPYHISALYVVDLKRFRQIAAGDRLRQQYHQLSADPASLSNLDQDLPNHMQMALPIHSLPQDWLWCETWCSDEALKNAKTIDLCNNPQTKEPKLDRARQQVPEWTLYDDEIAALAKKHKDSEAAGKPVAGDAADAGVQGQEEESVQERLQREDAEKERKKQVHGKDEL

SEQ ID NO: 4031 - protein, 1453 aa, Marmota marmota
FMAEESNEKFWQFLETVQELAIYKKTESDFSYYNLILKKAGQFLDNLHINLLKFAFSIRAYSPTIQMFQQIAADESPPDGCNAFVVIHEKHTCKVNEIKKLLKKVTSRPRPYLFKGDHKFPTNNENLPVIILYAEIGTKAFVEFHKVLTQKAQNGKILYVLRHYIQKPSSRKMYLSGYGVELAIKSTEYKALDDTQIKTMTSTIEDETEANEVQGFLFGKLNHAPGSWCERPQLSALVGAIPKCCFFFLTDLSFQAASQIMSTPVYDTIKLMKDISQNFPIKARSLTRIAVNQRMKEEIQENQKDLQDRFEIQPGDARLFINGLHVDMDVYDPFSILDMLKLEGKVMNGLRNLGINGENLSKFLKLNSHVWESAYILDIRHSSIVWINDLENDGLYVTWPTSCQELLKPVFPGTIPSIRRNFHNLVLFIDPAQEYTSDFIKVAELFYYNKIPLRIGFVFVLNTDDKVDGTNDAGVALWRAFNYIAGERGLSEAFASIVHMYQKAKDQNILTVDNVKSILQNEFPQANIWDILGIHSIYDNERKAGASFYKMTGLGPLPQALYNGESFNHEEMNIEELEMAVLHRMMDASEYLQRDVFMGTLNDQMNAVDFLMDKNNVVPRINSLILHTNPQYLNLISSSVTTAIEDFSTYFFLDSQDKSAVIAENMHYLTQEDDDVISAVTLWIIADFDTPSGRKLLFNALKHMKTSVHSRLGVVYNPTSKINEENTVISRGILVAFLTLQNSFLRSILKKLAKEETATALYSGIKIKTFLTEGIDKNAFEKKYNTIGVNIFRTHQLFCQDVLKLRPGEISIVSNGKFLGPLNEDFYVEDFYLLERITFSNFVEKITEFVENMEIGSKNMSDLIMKADALVSSLPKQASRYDVTFLRENHSIIKINPQENDMVFDVIAIVDPLTREAQKMAQLLTVLGKIINMKIKLLMNCRDKLSEAPIQSFYRFVLEPELMSGANGSPLGPVAKFLDIPESPLLTLNMITPESWLVETVHSNCDLDNIHLKDIEGAVTAEYELEYLLLEGHCFDATTEQPPRGLQFTLGTKNKPVVVDTIVMANLGYFQLKANPGAWMLKLRQGKSEDIYQIVGHRGTDSQPDIGDVIVVLNSFKSKILEVQVQKKPDKIKEDILIDNHEKKGMWDSIKSFTRRLHKDNKKEKDVLNIFSVASGHLYERFLRIMMLSVLRNTKTPVKFWFLKNYLSPTFKEIIPHMAMEYGFQYELVQYKWPHWLHQQTEKQRIIWGYKILFLDVLFPLAVDKIIFVDADQIVRHDLKELRDFDLGGAPYGYTPFCDSRTDMDGYRFWKTGYWASHLMRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLKAAARIVPEWIEYDTEIRQLLDNLENKKKSAILAHDEL

SEQ ID NO: 4032 - protein, 1458 aa, Penicillium digitatum
MRVSGRSHISWRWCAAVGVLLPSWIVNASPAVNVALQASFDSAPYLVELLESAAEENSSSYFPLLDRIADGTFEDLTTEKELYDRFLTVLKDDGHIRTPESLSSFQLSLSIRSSAPRIEAHFQFYNTSVEQSLMVAQDAQDIVGEIDPRELPFDRVLGDLSLPPAILYADVASPMFRDFHETLSDMAKQGQISYRVRYRPPQHWISRPLFVSGYGVELALKRTDYIVIDDRDAEQLEEKGAKSLPTDPDETKEDAPSDLRPLSSSEVTRLGLNSAGYVMDSADPFATLIKMSQNFPKYSSIVAAHNYTGEMAQEIRHNRLNMLPGGYNAMWINGVQMGTQQIDAFSLLEHLRRERKLIEKFRGLGLSADDVVKLLSHRLLTEAQTGGEEQRYDYRDNLEGNQVILWMNNLEKDSRYESWPSDLEAYVTGSYVGQLPPVSRDLHNVIVSMDASNPQHMMLIAGNLNTFIKRGIPVRFGFVPASSSAESIAQLKVAHYLFDAYGIESLLQYFEEHASKGKAGFPDKSCFQSATKERDLLDEYEALSLDQVLKSEKYDALVSQTAAYQRRLNLTSDAPQFLVNGIPVSREGNWMQGMSMQIGRDLKLVQQGILQGIFEEDAWLPKYFLAGAFERRNTFLMPEDPKSVQIVDIASILPSDKDVLSKIPHVLSDKGALESAHVIVVGDFESEAGMKLLTEALNLRKKNSDVEILMLHNAASDVEDNVPKNLVTLYLSLAKGDTIDQVLAKIVSGDLEPEAQEISPLQALHQNLAKELGFNPGTEGLVVNGRAVSPIGEEHPLSVEDMSQLIAYERVKRLDSVAAAVGELGLADKISNPLDFAKLTSLVALSTVPDVPEGIFENTPDFRIDVPGKWRAEHSVITVSNSDDPTIHVTVSLDPASEVAQRWLPILKVLSELSSVHLKIFLNPKDELTELPVKRFYRYVLESEPSFTDKGALARPQASFTGVPVDALLTLGMDVPSSWLVAPSESVYDLDNIKLSSVKSGTDVDAIYALEHILIEGHSHDLTTKSPPRGVQLILGTENNHHFADTIIMANLGYFQFKAQPGLWQINLKPGRSEKIFRIDSVGGLGYRPQAGDENNEVALLSFHGRTLFPRLSRKPGQEGEDVLETGVHPGSKMDYFSKGLNFASGVLSSVGVGSKSGGEQHADINIFSVASGHLYERMLNIMMVSVMRHTKHTVKFWFIEQFLSPSFRAFLPSLAREYGFSYEMVTYKWPHWLRAQKEKQREIWGYKMLFLDVLFPLSLEKVIFVDADQIVRTDMHELVTHDLQGAPYGFTPMGDSRTEMEGFRFWKQGYWSTFLRGKPYHISALYVVDLNRFRALAAGDRLRGQYQMLSSDPNSLSNLDQDLPNHMQHHIPIHSLPKEWLWCETWCSDEDLDVAKTIDLCNNPLTKEPKLDRARRQVPEWTVYDDEIAALASRIASEQAAAGVEFVQTGEDRKDEL

SEQ ID NO: 4033 - protein, 841 aa, Trypanosoma cruzi
MGEAALEALVKTIRNLLQCEDETQKCVNVRFTYVVCDVAKESKRRTMAGDLERLIVRRKGGDDGKQQVQWVYDFLQKIAAQNNTRQLMDPDLYEGLVAEVNFSPEVKKLLDASDEGLDAQLQVQRGIVNGFCAQLEADSLSTSSLSANGAAAGREKGNKEGAVYYYVNGRRFVYDDSFLEEDFRTAEEMEMLLAGAVSEALSKVEFTTMSSELEPSDLESHFYASKVAALSEVLRRDAARGSPMQEENHLPSTSGLTSFVVKPANGDTVPRHTLTVVIDPVAQQSQFLISLCDYVTRSPLGISCTVHMGATEHASKLMRNFYQFVSEMELRFDAVGRVVPPAAVFHRLPSKHLLTLGIEEPESWTVFSLDAKYDLDNILLDKLPSSSQYLHAVYRINSILLTGSARDAEQPNPSRGLPLLIRSTKTNPEAGVTRDTLVMAIMGYFQLQSSPGVWYLTVQPGDIAKIFYISQVDDIPVNDGANKNHHGRFNYTAGQNIPVVVSSFTGKFLMLGVSKTPGHEEVSIEDVNEASALHVDWPPKGPIKSKPDRPTLNIFSVASGHLYERFLRMMIHSVMRTSFDVHGANTTRIKFWLIENFLSPQFKTLVPLLAKHYGFDVGFVTYRWPWWLHKQTEKQRTIWAYKVLFLDVLFPLDVDRVIFVDADQTVLADLHELYNMDIGNAPTAYTPFCRKHPNPATKNFRFWDHGYWLEHLHGKPYHISAIYLVDLRRLRAIAGGDKYRLVYSRLSSDPNSLANLDQDLPNFIQDQVPIYSLPEEWLWCETWCGAESKARAKTIDLCNNPLTKMPKLDNARLIIPGWEETDTELEALSEKLLQQQKQQMS

SEQ ID NO: 4034 - protein, 1501 aa, Talaromyces atroroseus
MFGSRMRQFSSLGLVSGLLLLLQPPRCVAASPSVNVALQASFDAGPYLVELLETAAQENSSAYFPLLDRIAEGVFDDATTEKELYTTFLKLLADDNHIKDEESLDTFKFALAIRSAAPRIEAHYQYYNTSVQSTLVTAAQDAACPVWVHMDGKQYCSSTLERAQQDVSGDSDPRELPFDRTLGDPLATPAVLYADIASPMFAQYHETLRGLAEEGQLAYRVRYRPSQDDSPRPLFVSGYGVELTLKRTDYIVIDDRQAEEREDKANAKAKAPSAADLDDDEEESPPDLKPLSSSEVAALGMNAASFVLDSADPFATLLKLSQDFPKYSSAVASYNVTEAFTNEYNKNRQAGLPGARNIMWINGQHVDSRQIDAYSLLEHLRQERQIVAEFKKVGLSSSDAVNLLSYPALAEAQMTSEVQRYDWRDEIEGGGIVIWLNDLEKDKRYANFPTSLQSILQPTFPGQLPPVRRNMQTVIAPVDLTKVEDVNFVATYLQTFIKRMIPVRFGVVLIANTEESKAQAKIAHHLHQTYGLTSLFQYLETTLSSEKVSHPDGASFATAVAERDTRPGQESLPFEEVLQSEALDDIVSRTAKYLRRLDLDGPSPPTLANGMIMSRGRNFLQELPMQIGKDLNILQQALIQGALSEDDYVPDYFLSQAAQSRNEWIVPEHGSSGIRIADILSIAEAHNDFADVLRLPSDPKHPSSNVQLFVVADFNTEHGLALLISALKFRQLHLETEVIPLHNPDTDGYAGGGISSKLYQLLRQTEPVKLVDVLLSQIGLAADKTQAMSEEEQAYWTQAQKLIVDLGFSRGTSSILFNGRVVGPFPPSAAFGEAEFEQLFTYESSQRLRPLAEALKDLGVDSKVAGPLSFAKLTSLVESSINSDAPEGGIDSRSKYRLDVLKKWNSTHSAFDAATNTDDASINIVAAVDPTSELSQKWVPILKTLSELAGVNVRIFLTPNKQMKELPIKRFYRQVLEAKPSFDEDGSLARPGASFRGLPQDALLTLGMDVAPSWLVAPKESVHDLDNIKLSALKEGSDVDAIYELEHILIEGHSTDTTLRTPPRGAQLLLETEKGSFFADTIIMANLGYFQFKAQPGFWKIELKEGRSRDIFQLDSLGGSLQPGDASNEVALLSFQGKTLYPRLSRRPGQENEEVLEETAHGAGSAMDYVSKGLSFAQGVLSSVGVKSAASSESAEKHAEINIFSVASGHLYERMLNIMMLSVMKNTEHTVKFWFIEQFLSPSFKSLLPHLAAEYGFSYEMVTYKWPHWLRGQREKQREIWGYKILFLDVLFPLSLDKVIFVDADQIVRTDMYDLVSLDLEGAPYGFTPMCDSRTEMEGFRFWKQGYWKSYLRDTFSYHISALYVVDLKRFRELAAGDRLRGQYHTLSADPESLANLDQDLPNVMQTLIPIKSLPQDWLWCETWCSDEALETAKTIDLCNNPLTKEPKLERARRQVPEWTVYDDEIARVAAAAATATSDNVGDDNEKVEYSVGKEERKDEL

SEQ ID NO: 4035 - protein, 1601 aa, Lactuca sativa
MKTRIRSGFQILIIIAVCIIVCGYSVSAETQRPKNVQVALRAKWPGTSLLLEAGELLSKEWKDLFWEFIEAWLNNESGNTDPFTAKDCLQKISNYGQSLVTGPLASVFDLSLTLRSSSPRLVLYQQLAEESLSSFPLSDDINPSPGGKCCWVDTGGALFFDVPELLLWLRDPHKNGDGFQQPELFDFDHVYFDSSKGSPIAILYGALGTNCFKDFHRTLVEAAKEGKVKYVLRPVLPSGCESKSGYCGAIGTKDPLNLGGYGVELALKNMEYKAMDDSEIKKGVTLEDPHTEDLSQEVRGFIFSKILERKPELTSEIMAFRDSLLSSAVSDTLNVWELKDLGHQTVQKIVRASDPLQSMQEINQNFPSVVSYLSRMKLNDSIKEEILANQRMIPPGKSLMALNGALIDIDDIDLFMLLDMAHQELSLADQYTKLKIPSSTVRKLLATLPPPDSNTIRVDFRSDHVHYLNNLEVDARYKQWRSSLNELLMPVFPGQLRYIRKNLYHAVYVLDPASICGLETIDTIVTLFENSLPVRFGVILYSGKLIEKLEENGGELPSSDSSIKEDLSSLTIRLFLYIKESHGIEKAFQFLSNIHKLRMESGEEDAPLLHHVEGAFVETLLPKAKTPPQDTLLKLENEQSFHEESQESSLHVFKLGLAKLECSLLLNGLVLDSNEEALMNAMTDELPRIQEQVYYGRINSRTDILDKYLSENGIHRYNLQIVGGKAKPKFVSLTPSILGDESLLNNIEYLHSVGTMDDLKPITHLLAVDVTSRKGIKLLHEGIRYLLADSPRGRVGFLFNSDIDSDSNSLIFMKVLEVTASSYSHKKKVLNFLDQLCSYYESSQESQEFLDKISELADANGIQSKGFKSAISEFSVDKFTRHLKKVGRFLNGQLGLEKGDNAVITNGRVVRLTDDATFLSQDLHLLEALEYKQRTKHIADIIEEVTWENVDPDTLMSKFMSDIIMSITSSLSTRDRSSEGARFEMLSAEHSAVVIGSENSSIHIDAVLDPLSSSGQKMASLLRILWKCSQPSMRLVFNPMSSLVDLPLKNYYRFVTPTMDDFSSTDLTVHGPKAFFANMPLSKTLTMNLDVPESWLIEPVIAIHDLDNILLENLGDTRTLQAVFELEALILTGHCSEKDHDPPRGLQMILGTKKNPHLVDTLVMANLGYWQMKVSPGVWYLQLAPGRSSDLYLLQDGQEMRSTKRIIIDQLRGKPFHLGVVKKKGKEHEQLLIPSDDDESSRKQDDKDSWNSNILKWASSLIGGNVQTKKGVKTEVENVSNGRKGKTINIFSIASGHLYERFLKIMILSVLKNTQRPVKFWFIKNYLSPQFKDVIPHMAQEYGFEYELITYKWPSWLHKQQEKQRIIWAYKILFLDVIFPLSLEKVIFVDADQIVRADMGELYDMNLKGRPLAYTPFCDNNRDMDGYRFWRQGFWKEHLRGRPYHISALYVVDLIKFRETAAGDNLRVFYETLSKDPNSLSNLDQASDLPNYAQHTVPIFSLPQEWLWCESWCGNSTKARAKTIDLCNNPMTKEPKLQGARRIVAEWPDLDLEARHFTSKILGEAVSPVEKVVSPPAQPHVPEEAGPPPTEEEDEESRAEL

SEQ ID NO: 4036 - protein, 1505 aa, Cytospora leucostoma
MLRLSQLPWGLVASLLVATVFEPQPVCAGPSVEISMKAAFPSPPYLIELLRSSETAAQENASSYFPLLDRIADGYFAEVTTDKDLYESFLSLLQEDGHITSPESLATFKLALSTRSAAPRIEAHYQYYQTGVEPTLRGDQEGCDAWVVWQGQQHCLPSLDPGQARGQVSERQERDLPFDVSLGDGPSCILYADITSPRFGPFHMILSEKARNRECTYKLRHRRLSYESLEPLPVSGYGVELQLKRTDYIVIDDRKAEEDTAQKEIGSTEVVLDGEGDVADLKPLSKAELAPLGLKAASFILQNEKPFDTLLKLTQDFPRYSTSLATQNVSEDFFLEHKSNRAQLVPAGANVLWANGVQVVERQMDAFTLVNLLRRERKLIKGVTDLGLTGEEAIALLAHKAVAAAKTTDEAQRFIWHDEPEDGKVIIYLNDIEKDQQYEGFQTNLRAILQGGGPGSLPQIRRDLFNLVFPVDFTKEGDILLVVKQLQEFVKRKLPVRFGLVPLALAEASERQAKIVYHLVETYGVETTLAYLQAGLDAKIHEDADKGLFDSTIADHKLPEDATALSFEEVLASEHHAEQVRLSKHWAERLRVNGAPVVFVNGLPLPREGSWLQPMSQQLGVDLQALRQAYFYGEVDEKEWIPGYFLEDAATRRNTIIFPSNPKALTVLDVHKLHLEHADLFNIIPVLESFPETTKENWAALTVVVDLNDPEGLKLTASALQFRNNNPGVRLDIIHNPVETTEAYKINSALKASQSDLPAADSEDLVKVIIDTTEGLPDDDQYDSALRYFQASAGIRPGQNLLILNGRVIGPIQTADEFDVEDYQLFLDVEQRLRILPVYDAIDDLGLADKVSGPLAAAKVTSITALSTLPDLPEGMFETGSPLRISAFNVLNSTHTAFEVGDKSTATIQLVAIINPASEQGQRWVPILKVLSELEGVYLKVWLNPKDRLDELPVKRFYRYVLDSAPTFDQSGKVSALGAEFRGVPSEALLNVGMDVPPAWLVASKQSVHDLDNLKLSSIKSNVEAVFELENILIEGHSREPTGSLPRGAQLVLSTEKDPKVADTIIMFNLGYFQFKANPGFYNIQLKEGRSSDIYHIESVGAKGYKPVPGDEGTEVALMDFMGTTLYPRINRKPGMETEDVLDIGKEGGALDLVKQGFKFGKDLFGVKTKSASDEEHAEINIFSVASGHLYERMLNIMMLSVMKNTNHTVKFWFIEQFLSPAFKDFLPSMAEEYGFKYEMVTYKWPHWLRQQKEKQRQIWGYKILFLDVLFPLSLDKVIFVDADQIVRTDMYDLVQHDLEGAPYGFTPMCDSRVEMEGFRFWKQGYWATYLRGLPYHISALYVVDLRRFREIAAGDRLRQTYHTLSADPNSLSNLDQDLPNHMQFHIPIHSLPQEWLWCETWCSDEAFTEARTIDLCNNPQTKEPKLDRARRQVPEWTKYDDEIADLDRRRKGKSSAALGDDEQKVIRGDGQELKEAEEGVERNTKSRAFEGEDPSATAHVKDEL

SEQ ID NO: 4037 - protein, 1544 aa, Stomoxys calcitrans
MGCEKILKLTVVLFLGLISGKLQQVTSSKSYPITTLINAKWEQTPVHLEIAEYLADENPNLYWDYVKDASELDTPLSSYDTQSQSYNAALKLVRKGLTDIQIPLMKLVVSMHSLTPRIQTHFQIASEVVNKSSCMDSTTFAQIGSELVCSFDELRQKLASSKQGKALDATIETYAFDHIFPGSENNTRTVVLYGDFGTSSFAQYHYLLSAKALSGTVRYVTRHYLSPKTRDERKRVRLSGYGVELHLKSTEYKSQDDAPKPAEGSTEADLSAGADMEIQGFDFSVLKERFPTMVHSLDKLRQSLLQGNDEIAQLKAWEFQDLGLQAAQAIAEIDGEEALKILQYTAHNFPMQARALLGHKVSDQLRSEVKHNTEVFGRNLNIVPPDGALFVNGLFFDADSMDLNSLIETLRTEVRVLESLHKSQVRGGLASALLALDFSGSGSKEFAIDIRDSAITWINDIEQDVQYRRWPSSVMDLLRPTFPGMLRNIRKNVFNLVLIVDPLQPTSRSLIKLAESFVLHLAPVRLGLVFDARQASDDNQIDYLSISCAFNYVMQKKDARSALSFLTDIFADVDAKQAVTRKHIKSQLKKSFDRLSSSAVDDILDEDSDFDYGRQLALEFVERLGFSDSPQALLNGVPMQSNILLSDSDFEETIFSEIIQQTTTLQKAVYRGDLTDSEEILDYLMNQPHVMPRLNQRILGNNENAKFLDLTGSPHNDLSNVNALALLSNRDMTATLLKNIKYFEGKHSFETIGDQKLHFLTLWIFADLEKESGKELLKNALQYVRAGASVRIAFIPNVEGSDVGRKDNLNRLVWAAQQTLGPKEATELVQKWLKQTSDKWDIPEAVSEIISSTELHMKILRVYAQRVLNLKAAERLVIGNGKIIGPILDTELFGIEDFGLIDRFNAIQYADKLRKALNQNSHELEPNFNSDTLLKLYTSLLSRQTKTRFKLPDDVKDAHSVVKLPSNRNDLPSFDISAIVDPASRSAQKLAPILILLRQTINCNMKIFLTPVGQHSDMPVKNFYRYVVEPEVQFTPSGELAEGPFAKFTGVPANSLLTQNLQVPENWLVEVVRSVYDLDNIKLSDINGPVHSEFELEYLLLEGHCFDSTTGAPPRGLQVTLGTLEDPVLVDTIVMANLGYFQLKANPGVWTLRLREGKSADIYDITYAEGPNTVHKNGNTQVVISSLKSHVIKMRVTKKPGMANADLLEDGSGQQQSGIWNSIASSFGGGSTTDDEDKDTINIFSVASGHLYERLLRIMMVSAMKHTKSPVKFWFLKNYLSPQFTDFLPHMAKEYGFQYELVQYKWPRWLHQQTEKQRTIWGYKILFLDVLFPLSVRKIIFVDADAIVRADLKDLYDMDLGGAPYAYTPFCDSRKEMEGFRFWKQGYWKSHLMGRRYHISALYVVDLRRFRRIAAGDRLRGQYQALSQDPNSLSNLDQDLPNNMIHQVAIKSLPDEWLWCQTWCSDSAFKNAKVIDLCNNPMTKEAKLTAAQRIVPEWKDYDSEVKSLMARIEDHENFEQHDDTGGGNINENPTSKEFVKHSEL

SEQ ID NO: 4038 - protein, 1649 aa, Plasmopara halstedii
MWLSAGLAAFLAAMQPSSSSARSVHVNLTASWPSSPSFPLIETSEFLAEENPLYFWQYLEELGNRTHYVEFMGSDVDALGDLALTVAEIIAPGLQNVLELMLATRTYSVKVEMFRQLGLDSGIRPCGEHADTWAVFYHEPHCVKAVACSVDELDAVIHGKKQPMSDQCVAAGINDVELQVDHKYPYVAINPEKTSMTAILYGLVGTSKFHVFHSRLVIEAKENKFQYIVRHYPHDSHLKTLLQGYGVALDIKNMEYKTIDDSKTSNNGDFVAGDVNDEDDDDEEIDDEEIDGFLFKPLIARHSAISKALKQFYDKLVNKFHDEQDQELKAWHLKNLGTSAVRAIMDAKNPLKRLESLSQDFPVQAKKLAFSRKTISAELREEIAATRVQSMTRRLMNKFIVNGIAIDPTERSFNVFDFMKTLKKEWSVAKQLDGLPLNQTELEGMLTHARETNLEKSVKRIHVRGPLSGSTPLYLNNIETDSISSNWPSDINMLRRPSWSLIFVRKNMYECVLVMDPLTGAGRAALSHISLMRLRGAPVQWALLVSSKELMSQTSDERQASVEQYKTYKGTDKATAWHFAKLLMLAQSKDRAETESNDVQIKNVISDEDERTETEEDQIVSTQVASGFISRVGEDASPNVLVERLVEVYAEAAGVLGTVEDGEEEALACLQSNQFDDEVLEMTEYIHLKHLPLDSFVFNGVIHKDLDIQKSMMANFGRDQPLYVNMAHQGKLDGEMDLIEELLSAQDAYPAYLSIFETSEDEPGDIGAESPHHLFADDVDGRLETLARSSLTYLHAPSSRAVPKKQTVIFPVDLNDPQNADYAYRVVKAVLEDSNRSLRVGLVAQLNGNAKSEGANELVAGIIAIMGDTDKEACLRFVLEALNCIVKQKSIDTMRGKLKLLWAKTPREENEKDPVFGKVAALLSRKQGDWLTTKRRRRLTEFSTLLRSRFPPTYEGDGSSKIALPHLFLNGKQVNLPPQLLSDEDVATILNFDLKYRTQPVAKALIERSAMLKIKEADRLSFSIMRTTGIVDKYVKTDRTSRINLPEDSLNTIRLSGDRSLQVAAYVDPLSEAAQIMSSMLRMLHSQLNATIELVLIPADEYTKFPLQRFYRYLFDKKPTLSATSVEFRKLPVHPILTMKIDTPEAWNVQTFQAGDDLDNLRVDPDTSTAVRSTTRAVFQLESLLVYGQCRDTTFNMYAPPNGLQLVLEREVGAQLLHRDTLVMQNLGYFQLQATPGVWSLHLARGRAAEIFDIIDPYTNLPLETHPIIVHDFGSHISQLFVRKKTGMENEELLQPVEKALSEDRSSAESDAEPSDKNDGALRSYWDSLLNVMGKHDETLKKVVHDPLNSFSGKSHLVQTKQRTGETIHVFSVASGYLYERFVKIMMSSVLKRTNNPVTFWLLENFLSPDFKKSIPALREQLGMDIRLITYKWPNWLRPQTEKQRIIWGYKILFLDVLFPLGVQKVIYVDADQVVRADLKELWELDLEGKPYGYTPFCDSRNVGFQFWRQGYWKDHLRGKPYHISALYVVDLALFRQMAAGDMLRAIYSQLSADPNSLANLDQDLPNYVQDQIPIFSLPQEWLWCESWCSDDTKATAKTIDLCNNPKHKEPKLEMAKRIIAGELFDESWTELDQEIKDAEANYIAQDAA

SEQ ID NO: 4039 - protein, 1488 aa, Penicillium decumbens
MRVSTSRTSWCWYAAIGALLPSLVANASPAVTVALQASFDSSPYLVELLESAAEENSTAYFPLLDRIANGAFDDAITEEELYHRFLQVVHEDGYLRTAESLSSFKLSLAVRSSAPRIQAHYQFYNTSVQQSLMAAQDAACPVWVHSGGKQYCSSAMERAQQDVEGELDPRELPFDRVLGDLSLPPAILYADVSAPMFKEFHETLSDMAKQGQISYRLRYRPPQHWTSRPLFVSGYGVELALKRTDYIVIDDRDAEQREESLKESTEPGSEKLKEDAPDDLRPLSASEVSRLGMNSAAYVMDSEDPLSTLLKLSQNFPKYSSTVAAHNATKELRNEIRVNRARMIPPGYNVMWINGVQVDERQVDAFSLLDHLRRERRLIEKFRDLGISGQEAVKLLSHPLLAEARSDDIVQRYDFRDQLEGGDVIIWLNNLEKDSRYEAWPSDLKSYFANAYPGQLPPVRRDLHNVVVPVDLSRPEDMLLVVKQIRTFIERSIPVRFGLVPTASSPESAAQLKVAHYLQETYGLSSLMQYLQDSATKLKKGSPENSVFKLAVKEREARAGKEVLSLDDLLKNEHYSTVATHTLDYQRRLSLTGEAPNFMVNGIPIPREGNWMQQMSMAIGRDLKLIQQGIAEGVFEEDAWLPEFFLGPAFERRNAFLIPEDPKSVQIVDLASIFGPDVNLDGFPRIEPKEGVMGGIHVILVGNFESKEGLKLLIDALNFRKENSEVELLLVHNGASDSEEGTLNLNKIQKLITEGEDVDNILASISAEDSESDAESQSPITLATHRRVADKLGFTPGTEGVVVNGRVVGPIDKSFGLSVDELSQLVTYERSKRIDPVARAALSLGLNTKLSKPLYLAKLVSIVSLSMISDVPGVIFESTPDFRLDVSEKWKTKHSVISVSNSEDPTINVATVLDPASEIAQAWLPILKVISELAGVQLKIFLNPKEEIQELPVKRFYRYVLQSEPSFASDGSLSRPGASFSGVPVEALLTLGMDVPRSWLVAPKESVHDLDNIKLSSLKSGTNVDAIYALEHILIEGHSRDVTTETPPRGVQLILGTEDNPHFDDTIIMANLGYFQFKAQPGLWQIHLKPGRSEKLFNIDSVGDLGYRPKAGDESNEVSLLSFQGRTIFPRLSRKPGYETEDVLETGHKAGSTMDYVSKGLNFASGVLSSVGVGTKSSDEQHADINIFSVASGHLYERMLNIMMVSVMRHTKHTVKFWFIEQFLSPSFRAFLPHLAQEYGFSYEMVTYKWPHWLRHQREKQREIWGYKILFLDVLFPLSLDKVIFVDADQIVRTDMYDLVTHDLQGAPYGFTPMGDSRTEMEGFRFWKQGYWSTFLRGRPYHISALYVVDLNRFRALAAGDRLRGQYQMLSSDPNSLSNLDQDLPNHMQHHIPIHSLPQEWLWCETWCSDEDLASAKTIDLCNNPQTKEPKLDRAKRQVPEWTVYDDEIAALAERVASEQVGFVQTGEEAERKIDDKTDVDENRKDEL

SEQ ID NO: 4040 - protein, 1258 aa, Cladophialophora immunda
MRTSNIPWTWALLPLLSWDSFVAPARASPSVNVALQASFSAGPYLVELLETAALENSSSYFPLLDRIADGAFADLQTEQELYTRFLNILQEDGHLSTPESLSSFKFALALHAAAPRVEAHFQYYTTSIQPHLMAAQDAACPVWVYLDGEQYCSPALDRAQQPVSIPDTVNDLPFDRVLGASSDGLPSILYADITHPLFGQFHSVVSQTAREGRSTYKVRYRPSASASHNPIHVTGYGVELVLKRTDYIVIDDRDAQKPEDATPDQQSLETVKDDELKDLRPLTTSEVANLGVNAASFILSSSNPLDTLLQVTSDFPKYSSLLAAANASREFILEHRANREQFLPSGYNVLWINGVQIEPRQINAYSLLDHLRRERRIIAELKNLGLTSSEAISLLSSEIIAEAQANETPQRFDWRDDSEAGGVLMWLNDLEQDRRYAGWSSSLRSLFQRTYPGQLPQVSRDIHNLIVPLDMGNIKDIELAATSLQSLVRRQVPIRIALIPTGDGETANTYSKVAYYISDTYGLTALMSFFSDVVASKKLDASPEKSFNTAIKGRATRPEKEPLSFQDVLTDESLHLRLQARDEYLKRLALAGPNPPFLVNGVVLPRTDNWFELLSARLYSDLQLVQQAVFQEAISEDSWIPEFFLFQAVKRRNEIVFPDDPKDTEIVDVGQVTAKFADSFARLPRLAGTEATLLSDRAHLLIVIDLESETGRALLLEAMLFHQRNAETELLIIHNPSPETQSSTFAPGLYALLQEGGRDLTVERLEELLKGDLNSFTDDLTDASAEFWRSQADLIRTLSLAEGQNGLWLNGRLLGPLEQRFTSVDFESLLEFERRERIAPVTTAITGLALEDRFTGALDLAKITSLVARSLKSDLPEGLRESAPLIRLERFKIWNGTHTSIKISNSDDINIQIVAAIDPASELVQQWVPILQTLSQLSGVSVQIFLNPKDRLTELPVKRFFRQVISAEPSFDAHGSLVIPNASFSGIPRDTLFNLGMIVPPSWLVAPKQSIHDLDNIKLSNVAEGENIDAIYELEHILIEGHARDVTNGPPPRGVQLMLGTEDEPHFTDTIVMANLGYFQFKTNPGYWQISLKPGRSSKIFHIDSVGPHGYSAQPGDETTSVALLSFQGLTLFPRLSRKPGMEDEDVLESSALGGAMDYLSRGASFASSALSSLGFKKTSTNADINIFSVASGHLYERMLNIMMVSVMKHTKHSVKFWFIEQFLSPSFKSTLPVLANHYGFDYEMVTYKWPHWLRGSL

SEQ ID NO: 4041 - protein, 1518 aa, Orycteropus afer
MAVAKPFYVVRILLGSMPLWLSLLRAGTTSASKAVTAHLAAKWPETPLLLEASEFMAEESNEKFWEFLETVRELAIYKQTESDYSYYNLILKKAGQFLDNLHISLLKFALSIRAYSPTIQMFQQIAADEPPPDGCNAFLVIHKEHTCKINDIKKLLKKATSRPRPYLFKGDHKFPTNKEHLPVVILYAEMGTRDFGKFHKVLSEKAYNGEILYILRHYIQKPSSRKMYLSGYGVELAIKSTEYKALDDIQVKDVNNADIEDDTGASEVQGFLFGKLKEKHSDLRDNLTAFQKYLTESNKEMMPLKVWELQDLSFQAASQILSTPVYDAIKLMKDISQNYPIKARSLTRIAVSQQMREEIQENQKDLQDRFDIQPGDTRLYINGLRIDTDAYDPFSILDTLKLEGRLMNGLQNLGINGEDTSKFLKLNSHVWEYTYALDIRHSSIKWINDLENDDVYVTWPKSCRELLKPAFPGNIPSIRRNFHNLVLFIDPSQKYTLDFINLAELFYFHKIPLRIGFVFVLNTDDEVDGTNNAGVALWRAFNYITKERDVSQAFVYIVHMYQKVKDQNILTVDIVKSVLQNKFPQANVTDILGIHSKYDKERKAGASFYKMTGLGPLPQALYNGEPFKHEEMSIKELEMAVIHRMMDTCIYLQKEVFMGTLNDRTNVINFLMDKNTVVPRINSLILHAKPQYLNLIPTSVTADVEDFATFFFLDSQDKSAVIAKNMYYLTQEDDDVISAVTLWIIADFDKPSGRKLLFNALKHMEASVHSRLGVIYNPTSKITEETTAISRGILTAFLTQKNKYLRSFLRKVTKEEIATAIYYGDKIKTFLIEGMDKNAFEKKYNTVGVNVFRTHQLFCQDVLKLGPGEIGIVSNGKFLGPLDETFYAEDFYLLEKITFSSLVEKIKGIVKNMEINSKNMNDLVMKVDALVSSLPKRVSRHDVTFLKEDHSIIKINPQENSMFFDVIAIVDPLTREAQKMAHLLIVLDKIINMKVKLFMNCRGKLSEAPLNSFYRFVLEPELMSGANDIHSLGPVAKFLDIPESPLLTLNMITPEGWLVETVYSNCDLDNIHLKDIEKAVTAEYELEYLLLEGHCFDTMTEQPPRGLQFTLGTKNKPVVVDTIVMANLGYFQLKANPGAWILKLRQGKSEDIYQIVGHEGTDSQRDVGDVIVVLNSFKSKILEMQVQKKADKIEEDILTDKDEKKKGMWDSIKSFTIRLHKEDDKGDADVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLTVNKIIFVDADQIVRHDLKELRDLDLGGAPYGYTPFCDSRTEMDGYRFWKTGYWASHLLRRKYHISALYVVDLKKFRKIAAGDRLRGQYQALSQDPNSLSNLDQDLPNNMIYQVAIKSLPQDWLWCETWCDDESKQRAKTIDLCNNPKTKEPKLKAAARIVPEWVEYDTEIRQLLEQIENKKNNASKSSSFSVV

SEQ ID NO: 4042 - protein, 1606 aa, Gelatoporia subvermispora
MQLLGLGLALSVFAGRTYGAAVSPPVQVELRSSWPAPPALLESIETIFIEEPDAFFHLLDVLTNPELRPVARSSQEWYRHALDAATAEGYLSEPGAYAAVEMELALHSSSPRLEAYYQFYRDRQSQRNTDPQAECGSWVDWYGQVVCDAETLAHLAGVDTIDPPEGEAANTTVVQPKLLPFDHILPSALQSTDVPARTAILYGLPDSNNFRELHSWLYSAASAPSPSVQYVFRPIPPSGDDTAQRASLSGYGVALDLKKMDYLALDDRRRGSAQEGGDSGDLPELVTSVDSVHTLIQQYPENETYDATIPLSPEELLEIGFQATQLISDAEEPLSVLKQISQNFPKYATLLARRVTVDSELVEELDRNQIKAQGGVSMAWLNGVVVPETDMNPFALLRLLRKERRIMLNLMSLGLSSEQAMRLLTHPTIGAAQGDSGVLDGLYDASDRPEGEGVIGWLNDIEKDVQYERWGTSLRILLRPMYPGSFPAVRQNLFNIIVATDLSHPAATSFIAVTVSNMISRNLPFRFGVVPLVETDDAIRMARLFYHLEENYGAPVTLSFLRSLNSVQARRPSLTTDWSAVRAEFAALVEMAEPLTEAPETTLDVILNEESADWEKHEEKIRGYARRLGVNLESSQFGHVFVNGKPFDLDDDFLRYMQVEVSQQLQHIQEKLVAGSLTDEDGERISTYFYDLPTTAKRRNQYVYPSAKSGSLRIVDMKDAIIRANFPSQRGSYIYPIDSGKTSLTTFIVADFNTEAGRALLKEALDALTPGSPSRLGVIHNVEDGPSPQGFSPAALLAYLTTTGTLSQVAHSRLSEILESLQMVASRHDESSQVVLSPETILADILENEPRSVGLVQTIESFTKAGRQMLRDLELAPGELALVVNGRIVGPLEPEDFVADDFSLLWDYELRKRVTPVVAALEDVKASFDESSQFEDMVLTASSIISSIQLPDPSEVGLFNAPQRPRRRNYQLLDGRYSTYAFGDNTTALYHLGIILDPLSETAQKWSAIIEWALNIPGVYVELHINPGKYNELPIKRFYRYNLRPRLDFDTEGNEVQAKTVFTDLPMEPLYTLAMDVPQAWLVRPREAEHDLDNIQLSALSVGERRQGVWALFALDHLVIEGHARDTLTGAPPRGVQLQLMAASREGEHPIADTLVAANLGYLQFRTSPGVYRLEIRPGRGRDIFTMESVGNEGWNSPTVGEAGDEITVASFEGVTLYPRLTRRPGMERADVLAEIKLRNDKDNKGVLGDVMSRVSSIFGHHDSDGKYAIAKTNSDEAEINIFTVASGLLYERFASIMILSVLRNTKSSVKFWFIENFLSPSFLEFIPHFAREYDFSYSLVTYKWPSWLRQQHEKQRIIWAYKILFLDVLFPMDLKRVIFVDADQIVRADLAELVHMDIQGAPYAYVPMGDDNTDMEGFRFWKTGYWRDTLRGKPYHISALYLVDLVRFRQLAAGDILRSHYQALSADPNSLANLDQDLPNNLQIEVPIFSLPEDWLWCETWCSKERLDRAKTIDLCQNPLTKEPKLSRARQIPEWEKYDAEIAAFARSLAEQGRLHGGIVAADVGVLAEGAARKPTSTLEHEEAVQTEQATSIVDDEAGHVKDEL

SEQ ID NO: 4043 - protein, 1486 aa, Exophiala sideris
MRWSTLPWRLAAAGLLPLVSLSSFAHASASINVALETSFSAAPYLVELLETAALENSSSYFPLLDRIANGAFSDLQTEKELYSKFIDVLQQDGHLPNPESLSSFKFALALHAAAPRVEAHFQYYNTSVQPHLMAAQDAACPVWVYLAGQQYCSPALDRAQQPISLPDVDDELPFDRVLGANPEGPSSILYADITHPLFGEFHQIVSQTAREGRSTYRLRYRPSSLSDSRPLYVSGYGVELVLKRTDYIVIDDRDAQQIDAAEAADISLEQIQEDELTDLKPLTSSEVVSLAANAASFIASSSDPFESLLQISSDFPRYSSVLASANASKEFLTEHRANREMFLPSGYNIFWINGVQIEPRQINAYSLLDHLRRERRIISDLQQIGLTASEAISLISSEVIAEAQANESPQRFDWRDDMEADQVLMWLNDLEQDKRYAAWPSSLRTLFQRMYPGQLPQVSRDIHNLIVPINITAIKDIELAATALQNLVKRTVPIRIALVPIGTGETADLYSKLSYHLLDTYGLNTLMAFFTEVASTKRLSTSPERSFTAVIKGHSPREGKEQISYEDILKDEALISRLEARDSYVERLALIGPTLPFIVNGVILPRGDNWFEVMSSRVFSDLQLLQQAIYEGAVLEDAWVPGAFLFEAATRRNEIVFPSDPKNVHIADLNRLATEFAGELSDIPRAVGAEATLLSDRAHILMVADVDSEDGRALLSRSLELQKQHPEIDLLILHNPSTNTYSGSAATALYSLTQDTGRDVTVEQLQRLLEDNISTDAGTGDAAEAATLYWTSKQELVKSLGLSAGQNGLWLNGRVIAPLDQSFTEADLQSLLDYERRERIAPVTTAITRLGLEERFTDALDLAKITSLVARSLKSDLPEGLRESAPLIRMDRYKIWNDTYTAIKVSNSDEPTIQIVAVIDPASELVQQWVPILKTLSQLNGVSVKIFLNPKDRLTELPVKRFFRQVISAEPTFDSDGSLERPTASFQRIPKDTLFNLGMVVPPSWLVAPKECIYDLDNIKLSNLPEGESVDALYELEHILIEGHARDVTTGPPPRGVELVLGTVQEPHFTDTIIMANLGYFQFKANPGFWHISLKPGKSSKIFNLDSVGASGYAARPGDETTSAALLSFQGVTLFPRLSRKPGMEDEDVLESSMLGGALEYLNKGRSFASSALSSLGFKKTSSTNAEINIFSVASGHLYERMLNIMMVSVMKHTKHTVKFWFIEQFLSPSFKATLPGLAQHYGFDFEMVTYKWPHWLRGQKEKQREIWGYKILFLDVLFPLDLDKVIFVDADQIVRVDMMDLNRVDLKGAPYGFTPMCDSRTEMEGFRFWKQGYWETYLRGKPYHISALYVVDLKRFRQLAAGDRLRQQYQALSSDPNSLSNLDQDLPNHMQHVLPIHSLSQEWLWCETWCSDESLSVAKTIDLCNNPLTKEPKLDRARRQVPEWTEYDEEIAAVLKEAAQTQDPSPELEDAAQEIISDERKRDEL

SEQ ID NO: 4044 - protein, 1014 aa, Citrus sinensis
MESADSADDDALEIHHVEGAFVETILPKAKTPPQDMLLKLEKEKTFMDQSQESSMFVFKLGLTKLKCCLLMNGLVSESSEEALLNAMNDELQRIQEQVYYGNINSYTDVLEKVLSESGINRYNPQIITDAKVKPKFISLASSFLGRETELKDINYLHSPETVDDVKPVTHLLAVDVTSKKGMKLLHEGIRFLIGGSNGARLGVLFSASREADLPSIIFVKAFEITASTYSHKKKVLEFLDQLCSFYERTYLLASSATADSTQAFIDKVCEFAEANGLSSKVYRASLPEYSKGKVRKQLNKVVQFLHRQLGVESGANAVITNGRVTFPIDESTFLSHDLSLLESVEFKHRIKHIWEIIEEVNWQETYPDIDPDMLTSKFVSDIILFVTSSMAMRDRSSESARFEILSAEYSAVVFNSENSTIHIDAVIDPLSPTGQKLSSLLRVLQRYAQPSMRIVLNPMSSLVDIPLKNYYRYVVPTMDDFSNTDYSISGPKAFFANMPLSKTLTMNLDVPEPWLVEPVIAVHDLDNILLEKLGDTRTLQAVFELEALVLTGHCSEKDHEPPQGLQLILGTKSTPHLVDTLVMANLGYWQMKVSPGVWYLQLAPGRSSELYVLKEDGNVNEDRSLSKRITINDLRGKVVHMEVVKKKGKENEKLLVSSDEDSHSQAEGHWNSNFLKWASGFIGGSEQSKKEKAAVDHGKVERHGKTINIFSIASGHLYERFLKIMILSVLKNTCRPVKFWFIKNYLSPQFKDVIPHMAQEYGFEYELITYKWPTWLHKQKEKQRIIWAYKILFLDVIFPLSLEKVIFVDADQVVRADMGELYDMDIKGRPLAYTPFCDNNKDMDGYRFWRQGFWKDHLRGRPYHISALYVVDLKRFRETAAGDNLRVFYETLSKDPNSLANLDQDLPNYAQHTVPIFSLPQEWLWCESWCGNATKSKAKTIDLCNNPMTKEPKLQGARRIVSEWPDLDSEARQFTAKILGEEVVTLETPAPVGPMQTSGSDASSKGDLESKAEL

SEQ ID NO: 4045 - protein, 1562 aa, Anopheles gambiae
MAIVAVGILCLFNAALLVHAEPKSHPITTQLSAKWGITPAQLEIAEFIDEESANSFWDYVELLNNVPDGLYRFETEEKRYRKSLELASDILGEGQMGLLKLALSLHSFSPKVQAHLQVATEVLAKGDCETTIFASINGKVACTVDDLRSILRSAAKDPSTVETFAIDHIYPGSENNSLTVVLYGEIGTSEFKQFHAAVKAETERGTVRYVLRHYVRKVSSRKVRLSGYGVELHLKSTEYKSQDDSPRPQDAAAGADGTDPIDELEVEVEGFDFGQLKKRFPHLSHSLDRFRSALLEQHEEIAPLKAWEFQELGLQAARRIAEMQGDEALQMLQFISQNFPTQAKSLLTQTVPEEFKKEMRHNIEVFGRNLNLQPPDSALFLNGLFFDAETIDTVTLLDTLRSEMRVLEGLNRINIRGGSATPLLGLDLSSSAKEFAIDIRDSAITWINDLENDAQYRRWPGSLKDLLRPTFPGMLRNIRKNLFNLVLIVDPVEGDSAGRDIVKLAESFVVHMAPVRIGLVFKTGEGEDYRAVTCGFNYVHQKKSSTEALGFLTDLYAATADQKVIRFADVRQVLKKKFNRLKLEEVDEILGEDSDFDYGRQLAQEFIDRLGLKTVPQALLNGVLLPQSTLTSDEFEETILTEIMQQTPTLQKAVYMGDLHEGEPVIDYLMKQPHVMPRLNQRILSQDEPHFIDMSGRAHPDLEDVTALGQLSNPDLTATLMKNLKYFGGKSTYQKFLGYRVHFLTVWVVGDLRLAAARKQLKNALKFMKSSSGTRVAFIPNVDGTDAVRSELKKDLNALVWATINTLEADESYDQVMKLFEAYESDPSTVSSSVPDSVLGFLPATQMHLKMLRVYCQRVLKLKASSGTVMANGRLLGLFDKDEFFDTEDFGLLQSFNALQYTDKIRTAMKQASQGDADDTPTMTSDTVMKLVSILVPRQQSKSRYTIPSDVQDSRTVVKLAPKRTDQPFFEIVAVLDPASRGAQKLSSLLLLLRDVVNCQMKIFFCAIDKHSDMPVKTFYRFVVEPELHFTNDGRLSAGPSAKFVGLPANPLLTQSLNVPENWLVEVVRSVYDLDNIKLSEINGPVHSEYELEYLLLEGHCFDSSTGSPPRGLQITLGTEDRPIIVDTIVMANLGYFQLKANPGAWILKLRHGKSADIYDITSADGPNTVHTAESTRVIISSLRSHVLKLRVTKKPGMAGVDLLGDEKDAAGGGGIWDSISSIVGTGGGDSAASGGTGETEVLNIFSVASGHLYERLLRIMMLSLLKHTSTPVKFWFLKNYLSPQFIDFLPHMAEEYGFQYELVQYKWPRWLHQQTEKQRIIWGYKILFLDVLFPLDVKKIIFVDADQIVRADMKELNDFDLGGAPYGYTPFCDSRQEMEGFRFWKQGYWKNHLQGRKYHISALYVVDLRRFRKIAAGDRIRGQYQALSQDPNSLSNLDQDLPNNMIHQVAIKSLPQEWLWCETWCSSDTLQHAKTIDLCNNPLTKEAKLTAAQRIVPEWKNYDAEIKRLQAKVDDREHEEQAAVAAAAAAAAEASTMGHEPSNVHSTEDKETNAEARHTEL

SEQ ID NO: 4046 - protein, 1428 aa, Metschnikowia bicuspidata
MGCLIQIVACLLFTLQIKASTISIGLQANWTAPEFAILLIEASSLHNESLYYEVTKALFQSQDGESDWDEEWADTEEWELVSLGEWPLTDRQCYELVTKRLLLVDTGFINLNLANKMASPRIKAHYSHFATDVESNVLPLVEKQCAKDSFGQPLDDPTAAWVKYGSRIYCSEEDLYALQLRAHLEEICAFDRVFGDNLDAPVLVFYGKPSSERFAPIFRTLFNFANAGTIRFVWRYMPLSSEKEPLYGYGTTFTVQAKGSELKEKQGKISFIGKFLSDYRSIETRHQPQDELVDVAYKATALVLKASISEQLLFLSEFVRNIPLYAPYLAKSDSTVSSKQVQEAAQQNERIGASSDMVGISINGATVHRLETDLPFVISKLKSEVQLINSMLALGFTTTQAKHIFSKNALYCAIKEHGYKTGSKFNRFEVYKDLFSPGKPSSGGVVFFNNIEDDANYELLSPDRYEIYVENANQVRMGQVPPLRENVHDMIFVINLSDKNQLRVFFTMSKIILDNGIPQQLGILPFVSNGKDKKVAALFYHLIEVGERHEAMALLYKYYDSEEGKEDEVLDLVALPDNQYDHYKTYQNTLDKFDIAEPSVIVNGIIHNLRASEWQTKLVEQVSHDVKLLRAKILEGLPNDIKLRDALHQYSHSKRNRNVVPQSPANIRYKRISKELIDNSIGIQKFGSETKFGPTFWLIGDFNSLSILNQFKEVLRYMKSNKKMSSCVRIFNTALQSKLLDRINDKFGNKTIDNTQIDQLLDLVGDLHIQTVLEPDNNKLTILRNNRIQLHNPVFLFNSRYIKIGRLLEARDLKLMVEYEFSQRLNFLADIVESNPSIFEAGLPGIMPSNFDPLMWFDLTTSVITDSIFLEDSQVRSDFGRFDFSSLNFENRIDLTGFDPSKHVDILVVVDPLDALSQKLLSMATSLADLPFVNMMVLIQPFSKLPADLNIDRFYSSNFVPSKPKFDADGNYKQQSWPNLQCSLRKVLSADLDAPHNWHYVKGDNTHLYDLDKLGPAEDISANFTLSQLVVVAHVKDVLTGKSIPGLVFDAQSGEIYREGRTLQTKGYCQLRLEPGNWLLLLKKDTVSSTSFELLSASSNQYEPNDQAIASEPLLVHSLYGQQIYPRIRRRADNDREDAFPITGDKIQSTATVNLFCVVSGFTQEQFLAFLMKSASENTCRPVKLWLLEMYVSEHFLRQLPELSSRYNFQYELLSYKWPLWLRQQKDRVRQVMAHKALFLDVLFPETVDKVIVVDADLVVISDLSELIELDMHEVYGFVPMCEHRPVSEKFWHAGYWKDVLKDDLHYYSSSMFVVDVARFRAARTGEHLRRQYQKLSSDINSLVHLDQDLFNYLQHLDKIDLLPAEWNWNPAWCSANARKNAKIVNFALGQLSQSKAFIYAQNFYSPWTPLLTTSSTSLSQHMVHDEL

SEQ ID NO: 4047 - protein, 1564 aa, Anopheles darlingi
MSRMASSARFLYVALVTGWLAVSLVQGESKSHPITTQLSAKWKITPLQLEIAEFIDEERGNSFWEYVELLNNVPGGLYGIETEEKRYLKSIELASEILGEGQINLLKLALSLHSFSPKVQAHLQVAQEVLTKGDCETSIFASVHGKVACDISELESILRAGGKDATTVETFAIDHIYPGSENNTLTVVLYGEIGTPEFKKFHQVIRPVADRGTVRYVLRHYVQRVSSRKLRLSGYGVELHLKSTEYKSQDDSQHAQDPVANGGTDESEMLESEVEGFDFVQLKKRFPHLTHSLDRFRNSLLEKHDEIAPLKAWEFQELGLQAAKRIVELPGDEALQMLQFTAQNFPTQAKSLLSQTVSEEFKKEMRNNIEVFGRNLNLQPPDAALFLNGLFFDAETIDTITLLDTLRSEMRVLEGLNRIQIRGRSATPLLGLDLSSSSKEFAIDVRDSAITWINDLENDAQYRRWPASLKDLLRPTFPGMLRNIRKNLFNLVLIVDPVAGDSAGRDIVKLAESFVVHMAPVRVGLVFQTGAGEDYRAVTCGFNYVHQKKSATEALGFLTDLFAATADRKVIRYADVRDVLRKKFNRLKLDEVDEILGEDSDFDYGRQLAQEFIGRLGLKTVPQALLNGVLLPQSTLTSDEFEETILTEIMQQTPTLQKAVYMGDLHEGEPVIDYLMKQPHVMPRLNQRILSQDEPNFLDMSGRPHPDLEDISALGQLSNADLTATLMSNLKYFGGKSTYERFLGQRVHFLTVWVVGDLRRTAARKQLRNALLFMKSSSGLRVAFVPNVDGSDAARSELKKDLNALVWASINTLEADETYDLVMRLLEAAEAGTDLAAVSVPDSVLGFLPATQMHLKMLRVYCQRVLKLRASVSTVMANGRLLGAFEAEEYFDTEDYGLLDSYNGLQYTDKIRAALKQASLTDNVDTPAMSSDTIMKLVSILVPRQQSKSRYTIPTDVQESHTVVQLAPKQAEQPFFEIVAVLDPASRGAQKLSSLLLLLRDVVNCQMKIFLCAIDKHSDMPVKTFYRFVVDPELHFTNEGRLAAGPIAKFVGLPANPLLTQSLNVPENWLVEVVRSVYDLDNIKLSEINGPVHSEYELEYLLLEGHCFDSATGSPPRGLQITLGTEDRPIIVDTIVMANLGYFQLKANPGAWILKLRHGKSADIYDITSADGPNTVHTPESTRVIISSLRSHVLKLRVTKKPGMAGVDLLGDEKDGAGGGGGGGGGIWDSISSIVGTGDSGNGGGSAGEGEVLNIFSVASGHLYERLLRIMMLSLLKHTHTPVKFWFLKNYLSPQFIDFLPHMSAEYGFQYELVQYKWPRWLHQQTEKQRIIWGYKILFLDVLFPLDVKKIIFVDADQIVRADMKELNDFDLGGAPYGYTPFCDSRQEMEGFRFWKQGYWKNHLQGRRYHISALYVVDLKRFRKIAAGDRIRGQYQALSQDPNSLSNLDQDLPNNMIHQVAIKSLPQEWLWCETWCSSETLQYAKTIDLCNNPLTKEAKLTAAQRIVPEWKDYDAEIKRLQAKADEIEHAGEAGEQETGSSGQHSTGGIAEEQEDTTRSKHTEL

SEQ ID NO: 4048 - protein, 1487 aa, Cavia porcellus
MGCKGNASRVRAAAVRPVTGLCCQMGLLIALSVLWLFSSVKADSKAVTTSLTTKWFSSPLLLEVSEFLAEDSQEKFWNFVEASQNIGSSDHHGTNYSYYHAILEAAFPFLSPLQQNLLKFCLSLRSYSATIQAFQQIAADEPPPEGCNSFFSVHGEKTCDFDVLETLLLTASRRPKPLLFKGDHRYPSSNPESPVVIFYSELGLQEFSSFHHQLVSKSNAGKINYVFRHYVSNSRKEPVYLSGYGVELAIKSTEYKAKDDTQVKGTEVNTTVIGENDPIDEVQGFLFGRLRDLYPDLTGQLKELRKHLVESTNEMAPLKVWQLQDLSFQTAARILAAPAELALVVMKDLSQNFPTKARAITKTAVNSELRTEVEENQKYFKATLGLQPGDSALFINGLHIDLDTQDIFSLFDVLRNEARVMEGLHRLGIEGLSLHNVLKLNIQPSEADYAVDIRSPAISWVNNLEVDSRYNSWPSSLQELLRPTFPGVIRQIRKNLHNMVFIVDPAHEHTAELITTAEMFLSNHIPLRIGFIFVVNDSEDVDGMQDAGVAVLRAYNYVAHEVDEYHAFQTLTHVYNKVRTGEKVKVEHVVSILEKKYPYVEVNSILGIDSAYDQNRKEARGYYEQTGIGPLPVVLFNGMPFEKEQLDPDELETITMHKILETTTFFQRAVYLGELSHDQDVVEYIMSQPNVVPRINSRVLTAEREYLDLTANNNLFVDDYARFSVLDSQGKTAAIANSMNYLTKKGMSSKEIYDDSFIRPVTFWIVGDFDSASGRQLLYDAIKHQGMDFSLFKEVFESSKMDFILSHAVYCRDVLKLNKGQRAVISNGRIIGPLEDSELFNQDDFHLLENIILKTSGQKIKSHIQQLRVEEDVASDLVMKVDALLSAQPKGDARIEYQFFEDRHSAIKLRPKEWETYFDIVAVVDPVTREAQRLAPLLLVLTQLINMNLRVFMNCQSKLSDMPLKSFYRYVLEPEISFTSDNDFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPEADEVVVILNNFKSKIIKVKVQKKADMVNEDLLSDGTNENESGFWDSFKWGFSGGQKTEEVKQDKDDIINIFSVASGHLYERFLRIMMLSVLKNTKTPVKFWFLKNYLSPTFKEFIPYMANEYSFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKEMGMQHEKKTEKLSQEASQAREEL

SEQ ID NO: 4049 - protein, 1394 aa, Aspergillus niger
MVSGLANFASWRLASVLIAGLLAIQGRASPSVNVALQASFDSPPYLIELLESAAEENSTSYFPLLDRIADGIFDDAVTDKDLYDRFLEVVREDGHLRTPESLSSFKLSLAMRSASPRITAHYQYYNASVQYSLMAAQDAVCPVWVHSEGKQYCSSTMERAQQDVTGSDDPRELPFDRVFGDPSLPPAILYADIASPMFKEFHQSLSTMAKEGQVSYRVRYRPPQHWSPRPVFVSGYGVELALKRTDYIVIDDRDAEERGTGSIESGKSDETEDDLDDLRPLSSSEVSRLGLNTVGYVLDSDDPFDTLVKLSQDFPKYSARVAAHNVSTELLQDVRSSRLRMLPPGLNVLWINGVQIEPRQVDAFTLLDHLRRERKLIEKFRNLGLSATDAVELLSHPLLGEALARDGPQRYNYRDDIEGGGVIMWLNNLEKDARYESWPSELAGFMQRTYPGQLPAVRRDSNNIVFPVDLTSTEDADIVVKTIQVFVKNKIPVRFGLIPVTFSDGAIAQLKVAHYLQETFGLASFMDYLEASASKNKLASPDKACFQAATQDRSPRLEKVSLSLDEVLNNAVYDATVSKTTAYLNRLGMKHEPSHAFVNGIPVTRNDKWAQEMSTKISKDTQLIQQKIADAEVDEDTWLPELFLSQAFDRRNPAIVPEDPKEIRAVDLVQLADSQEKLFSQIPRLGLDESNALESAHAIVVGNFDEKSGYELLSAALESRKTHGEVEMLFLHNPKLEASPASRSVAVRRLLNGGKEVDASQILEAIASSASPADEEAGDAALFWEAQRAVVEELGLAPGERALVINGRVVGPIAEDTALTSEDLDQLLIYEKQKRITPVAKAVKALEFDEKLSDPLDFAKLTSLTTLSTISDVPEGIYESTSDIRLNLFNRWNDSQSAITVSNSDDPAITIVASIDPTSEDGSNVDAIYALEHILIEGHSRDMTTKSPPRGVQLVLGTENNPHFSDTIIMANLGYFQFKAQPGLWNINLKPGRSERIFTLDSVGSLGYNPQPGDENNEVALLSFQGRTLFPRVSRKKGYETEDVLETNPKPGSAMDYMNKGFNFASGILSSVGVGTKGSTSGKQADINIFSVASGHLYERMLNIMMVSVMRNTNHSVKFWFIEQFLSPSFKSFLPHLAKEYNFSYEMVTYKWPHWLRAQKEKQREIWGYKILFLDVLFPLDLDKVIFVDADQIVRTDMYDLVSLDLEGAPYGFTPMCDSRHEMEGFRFWKQGYWKNFLRGQPYHISALYVVDLNRFRAIAAGDRLRGQYQMLSADPESLSNLDQDLPNHMQHHIPIKSLPQEWLWCETWCSDESQSQARTIDLCNNPMTKEPKLDRARRQVPEWTEYDDEIAALSKRVAAEKQQGQVEEERAGESYPDEDEEGETSSGWDKDEL

SEQ ID NO: 4050 - protein, 1693 aa, Ceraceosorus bombacis
MGPPSTSAALPFLVTRDTKRRSHLAASWQASLKTTTNLANLLVKHVHFPVARIAHTVLPKPRRRCSPWPATPLLLEILEAAHTQDPDSFWPLLDRLTDQSVVLDRNASDERTYKAAVQALDDAGLLEKLWDRQLWNWALAMHTEAPKVTAFWQMYNRGGAEERWSKRSQEPAVDCGSWVAWGQKVLCTASEVAEALGTGSEADTTLLEVPFDHIRHSKQGAPASSGLAKPRVAILYADPYSANFRSLHQELSRHVSADQSPALRYVLRWKAPRAEEAAISPALLAGYGATLDLKKVDYLVIDDRRIKESALADTVQGKSLRSAQSEGDLTEREWLDKLIGTTDEDKAESLGNLNEGEITDLGAKATQLIIQSPDPLRALAQLSHDFPVHAVGLARRAAGPKQELLEELEEMHTTAMEAGSSDIWLNGKALAEKEISPLGLLAPLRADQAHITSLTSPYLNLTPAAALDLLTYAPIGQAQDPDASSNVFFDASDRIERGMPRGAAASVPQAAPKDAESSAEGSRDLNFPREGAITYLNDLEKDSMYASWSPSLQALIRPLWPGAFPHIAKNIFNVILVMDLTKRETCGFLAESLFPTIPRIGLRWGFVPGGLEDLDQFQSLQMARLFWLLHAEVGNTGVVEWLKALVHTTSSGQQIDVKLALKEARRVLKGKADALNPEQLLTDPELSERERSVRSYVKRLHLDLKGSHARGHVLVNGQRIPFNAQAFNAIHSLVSTQTQALARPVYFRQIDPEQDISHYFYDLPTTFTSRSSLVFPDEEMSTPDNPAPAAVKPRAVDLVKAADTLKNKAVVERFVYSPAFEKVNATVWVVGDLDSQEGSSLVREALNALSQNAFRLGFVHVPRRPSEASRLQPSASLLSTFLHDMLKIPTDLKSKLGPENLIELVEGYQGSLRDIVTEGRVEGQQVFGHADPQDDVSAMKEKGWNTPAATAAGLFWDEAAPFANALGIDKREFGIVLNGRVLTGFNAQNIDSGDFEALVSLESRRRIDPVVEGLSQAGVHFEGLNKEDHAQIATFATSIMSSVYYVDEAAEGIFQPPQTARSSLFDQIEARHTSFEKGDRSTAHTRLFVALDPLSERTQSWMPVLKLIASMKDTYIRIILNPETKQTELPLKRFYRSSAPTQMSFDASGKQQGSKLQFFGMPEDAVLTMALDTPPSWLPMAAEAVYDLDNIRLRDVPLSGREAGVNAVYELKHILLEGHAREEGVPGARQIPRGLELVLESPDGAVQLDTIVMANLAYFQFRAQPGLYRLRIREGRSSELFEMRSVGNHGWESPSVNQTGDAVTVDTLHGLTIYPRVKRRPGKQEESLVVDLDEDMPSGEEDSAGKGLLAAARQAFKAAKGKADEVVNKAVRPVSKRSSADINIFTVASGHLYERMTYIMILSVLKHTKSSVKFWFIENFLSPSFKEFIPHLAEEYGFDYELITYAWPHWLRGQREKQRIIWGMKILFLDVLFPLDLSKIIFVDADQIVRSDLQELVKTDLHGAPYGYPPMGNDSYDMDNFRFWEQGYWKNFLRGKPYHISALYVVDLNRFRRVAAGDRLRGHYQQLSADPNSLANLDQDLPNSLQFQLPIFTLDKTWLWCETWCSKDWLAQAKTIDLCQNPKIKSTKLERARQIPEWTAYDEEVARLASRLAGQDKLGKNVVVDKQESVKEKEVELETSANFAHETVHHDEL

SEQ ID NO: 4051 - protein, 2092 aa, Cyanidioschyzon merolae
MLPETPDLMRTRRRFHDYLQRACFRKHQISCVPDVDSTTTYNERASGNTRSHALTSDYTIKRPAFAPALTPGSQSSLRWQRTYQQAAREYASSPTVRTGRRKHLLLHSALERKHGPWCTWLNEGPTQTQAGAIPSRGGSGCYRAVAAQACYALPARCFPHELAAEVLMRSFGRQRFSLGLWVCAVYTLIICASLCIGISQSFLPAAVRRSVKALHVDVVAPWNASSLPLELLEGIRRIYSDRLFWSLLDQIADGTDLLRSANSDSERELSAIRWLRTRLELAWTAAAADLTSSVEADALTAAVRQAWRSLEVLVVQRVYAARLQLHERLETDDRDQLEPALNAVDSTWVLLVCGAERIPIADEAALASLGHHVDACRSRFPRNIDEVHRWNLASQRFLLPSDTVLGCVGGSAAAPHVPGDKRWTDQSGTEPLIAAILYTDVFRDDAFSAFHRAVRERAQNCELVYVIRMRRAAPSRAALTADFSSDATQMMSLSGYTVELALKSSDYVVLDTKQNETLWLQRNKTQHVRQRGAAGSVAIDIQDLDKDEIQATLDALLMQSLWSEATKHTGASETLEELLMDLTGSLLQGIEQLGNDLPSIGAALWKEAKAEPSFAASVAQSRALLTASAENLSRLHPELHWDNLPSVLFLNGRQVSPDASSVALCAASIAAAHLAAYRIWDMMDPLKTAAIDDRERFLANITHRQSEAEASTTIVDTRLYLPALLDCTEESDSDPVQSVEQLFIFRLNDIERDRKYQNWSPSFQELLQSPSAKAFPKLRRNAFRLVAFVNPGSAAGLEASAQLIQWVKNRDPVLPFQISLVLVPPHEAAYRWNASAGDTAGAPRSPWSRALGMLRSLGWRRGDLQSPGELPPRRSPLEPSTDAVICRAVYYLLHVRRSRRAAASFLSELHATVQREHPLAALWMLQGLGGRSSTIALPPLPPRADQVRRVFLQTAAGMQAASPNQTSSSFDAEHDYESLILHPHGKKRVLGALFGLRSGGAAAAAKVHDSSQCAMLVHAEVRTRQWLRSIGLPADTSALLALNGKRIGDLAKDPVDASTVFRYLNAEVQRLAELTRAGLAPDAACVDDVVYQTSSWRTSTTVTPGPYPSPRRKESATAAVLATRLVLVPAFETQLLSATSQLVSGSTALQQEHIEQGLQSIALLWDALFAQQQQHTQGDAVHLLNIPYRLAVVDAADAHDDGCQPPLTVWLLLDLDTTFGCRFLHDAMRVLAEQQWTQPSHHPGAAAWPSAVRLGLFHTGLQAGPVARSLMQLWTATPANASRSSMQLDDALRRRLERICGGVEVSPASTAPTLTGTPAPNWLRLLFSGGWGVDPGQLALVVNGRRYRIDRDEVWAHHAAALFKAVLQREAALMEARCGSYIIRQTKPLSGRCSPVDQSHQADAVLISTILADVLDGSCRPSGGSLLVQQSPSELPLDSLRRLRHLVPALRYRKAPAVPRQHTGSALRAEGLIAPFTAADASFTLVLRKLLGEALDAELDVTLNPRLQWRGDDGRLLQPRYVRSKLVTRFADALANGTSASVIFDRLAEHRIHSVHLRTPATWFTTVQHAELDPDNVALVQWAPPGTPSHRSIRYELSKLIVEGFVVDRQPSTRAPGLALRLEQHGGIRHPDHCSRERRSRVETVVMEGSGYFQLALTPGIWRLVPIPIPSAFGRQRDDLSIALVEAQRAPYAARLVDLQPIDASNATLLVVDDLWGQSTQSQPLLLLRVAHLQRTWYERVWALVAALRTSSQVQRRERLCLPPSASSSSSSSADKRPLIHLFSIASGHLYERLLRIMMLSAVRATPRYRCKFWLVGNFLSPRFRAQLPRLAHRLGFDYELVWYAWPRWLRPQHEKQRLIWAYKILFLDVLFPSDVERIIFIDSDQVVRGDLGELWELALGSRAVYGFVPFCDDRPEMDAYRFWKRGFWAKHLRGQPYHISALFVVDLKRFRAHRAGDTLRALYQRLSADPESLSNLDQDLPNYASVPLAEQSGTMNAAEPLVPLESLPSEWLWCETWCSEQSKARAKTIDLCNNPSTHESKLESARRIIPHWDELDTEATAAATLVDDHAWEAFVAQREQSMHPTRHDELR

SEQ ID NO: 4052 - protein, 1705 aa, Serpula lacrymans
MHYFLALALALFPFANASPPVSVQLRTPWLSPGPLLETIETISIEDPSAFFPLLSLLSTNPPDPNASPKTVHAHVLDLASPLLDGPARASVDALLVLHAASPRIAAFEQHFLARTHEQAVEDASGETCAAWVDWYGHVVCTVDGLKRAVSSISFEHKPQPRSLPFDHVYPSPHSQKPTAIFYASLTAPNFPALHHALVDLTQSAGIEYVLRWAVSPDPQSTRAHDKDALGASLSGYGVSLDLKKMDYLALDDRGRSASTGQASPDSTAHAREQDQDALLALFDSLPSLNASTELHIEGGTKDAALSEDEIADLGLRATQLIYSYSSPSKREDDKSHENSVTASLSPLTLLRQLTHSFPLYATKLARKDLLDGLDSSYSLPSDKGTEKNEEHDAWAGHQPTGVLSPLFDSVRSNWEKVAPGTSLFWVNGRVLGEGEVGVFGLIRTLRKERSLVRALMQLGMSTREAVEVVVHDAHSRTGADGDYADKDITRRGKGVKKGSEVEEEREEEKGGSRSGRWNAKHSKLDPRPEDASKASSPVHSSHDDVAKSTSKKSNKDGGVHRPKFPDALVPTEATEGLVDASDRTEGGGVVVWWNDLGADARYARYSSSLSVLLRPLYPGQLPMTRFNLFNAILVLDLAQPRTLSFLAMSLEGIVARGWAVRWGIVPFVEWKEGEGVDGTKMARLFYFVSEKYGRDVIIGFLKRVSAAHVQTPTLSWPLVRMAWADFGMPDDFDSVVEGRVVASVGDEAEKDGGNVDTLHKARLYARRVGITDASGHAFVNGRYIGMSDAFLRDLQVEVTQQLQYLQELVYTSILTDSYVPTISTFFYDLPWTPARRNAHIYPLISSPASGGVQPAGSSARPLRMFSLPELPKVVGKGGFVTPQDDDYLPISMYVIADFDSESGLALVKEALDFILISKDVLATISPARLKRALGLDEAGSVSTPDESAQVALKADLLREYGVDGGEVVVAEDAYAGYVGSCKALARELRLLPGEQAILVNGRLVGPFDASEFMVEDFEMLETYEMRKRVGSVVVALEDVLGEKADDLDSSSYAHLVSTSSSLISAIQLPDPSEAGLFDTAPKPRSRKYKLLDGNYTSFEIGNADDALYHVAAVVDPLSETAQKWTSLLEWLVEFPGVYLELYLNPSQHSEIPLKRFYRYNLAPRLTYDENGLEVPAKVVFNGLPIEPIYTLGMDVPSSWLVRPREALYDLDNIQLGSLSPQDRVTGLEAVFALDYLVVEGHARETLLNSPPRGLQLQLSTPDGTPVDDTQVVANLGYLQFKAKPGVYELSIREGRGRDVFEMESVGNEGWESPRVEEVGSEVTVMSFEGLTLYPRLVRKPGMEMVDVLDELSYKEEETHGVIEDIVSRMTSLFSHKGEKSLQAQGDGQADINIFTVASGLLYERFVSIMILSVLRNTNKTVKFWFIENFLSPSFLEFIPHLAEAYNFQYELVTYKWPSWLRAQKEKQRIIWAYKILFLDVLFPMDLKKVIFVDADQIVRADLQELVDLDLHGAPYGYTPMGDDNYDMEGFRFWKTGYWADFLRGRPYHISALYVVDLVRFRQIAAGDILRGQYQALSADPNSLANLDQDLPNNIQQQVPIFSLHEDWLWCETWCSKDRLHRAKTIDLCQNPLTKEPKLARARQIPEWEEYDAEIARFARKLAEEGKIRASAATADTNVLANVGATPQAAESVGDNSEEARPRDEL

SEQ ID NO: 4053 - protein, 1651 aa, Puccinia striiformis
MERAETAEAKFKKLEMDSMLKDQELVSLQHKVSNLETDLETAEKKISDSKVHKEEEESNKSANENLNRKIALLESELDNAEKNLRETTDKLRQVDVKAEHFERQVQRIESERDSWEKKWEETQEKYIASKRELEEVVQAMEISTMKRSAGLRAHLGLLLISTIDVLAGSPPISVSIQATWQEPPILIQVLESAALERPSLFFPSIDAVCSDWENSKSKLSTDKQKYEYLTSLLGSPGLLDGPGGLESLAFSVALKEAQPKIEAFRAWYASLPSNLTGELDSTDQCQSWTLINDSKICNPSELSELLDSNNFSENNFTESSRNLKSFPSIISTSYTKPPQSSRLRLLHIFRWKIPSGPLKTSSKSQSASLLSGWGASLDIKKSEYLTLDDRPVESSSSDDTQLIIDGTSATENLADSEQAKLKPLKAAEIFDIGAKATQHVLSSPSPLSALRKLTEDFPLVAHTLVNEWVPGRISTELRLELKENMANSIPPGQSVIWMNGLQISSLVSLENLNLFKLVEIMRNERRWIGSLSSLGLNSLQARNLIIDEKLNSAMNPEASSGSAIGEIDASSLGVRFDASDRQEGGGAIIWLNDLENDPRYSMWPSTLRAILRPTFPGQLHPIGRNLINVVLGLDLTQTQNLHTLGHVIEAFITRTLPIRWGIVPIPTKDPSEGEKISRSFWDMTEALGPMEALKFIKEFTQNLEEESRKIDIKKFVIQANERVSNENESSSKDIKSDQDEKFKIWLNKSQLYSSRLSLCSNDHSLPACMLINGRFFPMEENYRSHLQETATLHTGFIQHQVYYNLLKDDQNVADYLYDLPLVHRARNDLVFPSEARPLKFVIWSKLFNLLPMFLRQIRFSRMQMRLRAMPNRAPSHLMGSWKSRFQGWDKGSMHDVSVQVSFVHTPSDNSETPTELSSSLAELITASVDAKITTQDVIDQLSRHEYQITVSDDGSPTTPGSDIPVARHQTWLGTHEFARTIGVKSDDGLAIIINGRLVHVSSTTKLLNEDLTLLVEYETQQRINPLMEALKTLDEFDLNKYHSNLPLIMSTVGVVLVGSDDGSSQTSSSEARSAKHLSRIGTHSSYQHGDKENALFEFSVILNPPAKLLNDDVSMKVWFNPSLELNELPIKRFFRTAISNSLEFDKNGRAIPALVNFDGIPTETLFTLAIDTPPAWLALPHDSIHDLDNIMLSELLLHLLRNQEVDTIIMANLGYFQFKSSPGIHRLSIRPGRSLELYQFEKTDSSLGIDDDEPYQFLCLTTFNGLTIYPRVRKRPDKISESLIQPLSASSTSSKKGPVGEFSKLMGQVKDLASGMLRGQGSDLANGTSRSVINVFTVASGLLYERMAYLMCSGSTDLKRLLKFLVWFISNFLSPSFKRFIPHLAKEYGFDYQLVTYRWPSWLRAQKEKQRVIWGYKILFLDVLFPLEVDRVIFVDSDQIVRTDLKDLYELDLEGAPYAYAPMCNDRNETKGFRFWDTGYWKESLQGRPYHISALYVVDLRVFRTIAAGDQLRQHYQSLSADPGSLANLDQDLPNNMQSILPIYTLDQSWLWCETWCSDEGLKTAKTIDLCNNPLTHEPKLKRARRLIPEWDTYDQEVAALASRIKKNLNEDDSSAKITVQAGLKIDDEDLNHSVHQKDDQSSSVLDRDEL

SEQ ID NO: 4054 - protein, 1629 aa, Chenopodium quinoa
MMGKYDRSKFWVLIILIFISISGIFVSAQSHRPKNVQTALRAKWEGTPLLLEAGELLSREWKDLFWDFIDVWLQHENDEIDSNTAKGCMVKIVKYGRSFLSEHLGSMFEFSLTLRSASPRLVLYRQLAQESLSSFPLTDEAVTNAGDVASDLHDTNMGNRKPDLLLVGVNPKSPGGKCCWIDVGSSLFFDVVELLEWLQIHGGDSSQQPELFEFDHVYSVSNSSSPVAILYGALGTKCFREFHGALVNAAKEGKVKYAVRFVLPLGCEVNISHCGALGTKSPVNLGGYGVELALKNMEYKAMDDSMIKKSVTLEDPHIEDLSQEVRGFIFSKILERKPGLSSEIMAFRDHLLSSSISDTLEVWELKDLGHQTAQKIVHASDPLQAMLEINQNFPSVVASLSRMKLNDSVKDEILANQRMVPPGKSLMALNSALINIEDIDLYLLIDLVHQELSLADQFSKLRIPEPTIRKLLSTVLPSESNMFRIDFRSSHVHYINNLEEDSMYKRWRSNVNEILMPTFPGQLRYIRKNLFHAVYVIDPATSCGLEVIEMIVNLFENQFPMRFGVILYSTTFINEVEKNGGDNLADISVNSTDEDISSLIIRLFIYIKEHHGMLTAFKFLGNVHSEFSDSGEEAPERHHVEGAFIDVLSNKAKSSPQDLLLKLDQEKDFQDVAQESSMFVFKLGLSKRKCCLLLNGLVYNSNEETLLSAMNDELPRIQEQVYYGNIDSHTDVLDKFLSENGVRRYNPLIIIDGKVKPKFVSLSDSILDEGSALHEISYLHSPETIDDLKPVTHLLAIDLTSTKGLKLLQEGIRYLGDGSTKARVGVLFVPNFASDSPSLFFVKIFHITSSSYSHKEGVLKFLDQLCLLYERIFMKNSSLHTENIKTFVEKVSDLADVNGLPSKGYSSLLTDFANEDLQKQLNKAGLFLHKHLGHESNLNAVITNGRVTVLSDEDTFLSHDLHLLESYEFKQRIKHISEVIEDLKWENIDPDSLTSKFISDVIMLVSSSMAKRDRSTEGARFEILQATYSAVVLTSESPIHIDAVIDPLSPSGQKLTSLLQILGKYFQPSMRIVLNPLSSLVDLPLKNYYRYVVPSMDDFSGSDYAVNGPKAFFANMPLSKTLTMNLDVPETWLVEPVIAVHDLDNILLENLGDTRTLQAVFELEALVLTGHCFEKDHEPPRGLQLILGTKSAPHLVDTLVMANLGYWQMKVSPGMWYLLLAPGRSSELYHLIEDDGGSHKTTFSKRIIINDLRGKVVHLEVVKKKGKEHEKLLASADDDGQSPERIKDSQRSWNKNIIKWASGLIGGSQNTKKSDSAVPENKSDRHGKTINIFSVASGHLYERFLKIMILSVLKNTNRPVKFWFIKNYLSPKFKDVIPLMAQEYGFDYELITYKWPTWLHKQTEKQRIIWAYKILFLDVIFPLSLDKVIFVDADQVVRADLGELYDMDIKGRPLAYTPFCDNNKDMDGYRFWRQGFWKEHLRGKPYHISALYVVDLDKFRQTAAGDNLRVVYETLSKDPNSLANLDQDLPNYAQHTVPIFSLPQEWLWCESWCGNSTKPKAKTIDLCNNPMTKEPKLQGARRIVAEWVDLDQEARQFTAKVLGEELDPVESTPPSPNDEEIDIESKAEL

SEQ ID NO: 4055 - protein, 1607 aa, Coprinopsis marcescibilis
MKRPLHSLFLAAYASLSVAASSPPVQVSLRTSWPAPPVLIEILETVGLENPDAFFPFLDLITDPEVLHSSTSLSPEAIHQASLKVAVSKGLFAKPGSLSNVELQLALHAASPKIEAFYNYYTSYVNKTLACNGGSWVDWYGEVVCDVDTLKKLAGTETIGTGAYPRPEALSFDHAYPPSEQLVSKPARTAILYVSLPSPNFRALHTYLYALASQDDPRVEYVLRHIPPPHRENGRRTNLSGYGVSLDLKKMDYLALDDRFSGGKRQQSTKDDELEGEELLDPVQALIETFPLDDSAPDASVALTKEEIEDLGAKAAQLIASSPSPLDTLLQLSQDFPRYATSLARRVSANSSISDELHANSLKAKRGVNVLWLNGVAVENHDVEPLPLLRLLKKERTLMVGLEAVGLSRQQAFGVLTHPAVAGAQREAGGADVLYDASDRAEGGGLVVYWNDLEKDARYAGWSPTLHTLIRPMYPGQFPSVKANLFNTVLALDLSQVGAVNFIVGPVSNIIERGLPFRFGVVPIVETEDGKKMARLFYHLIKNYGRKKTLGFLRKLAQPDLQPQDPPLVTNVDWKAVAKAYEELAEAELVDEPDKVAASLSDVLQGKFTLPPPIAPVEGETQGEGVEWPSVERQLGEYHRRLETSLKGAKEGHAFFNGKHYPFDGNFLKGLQSDAMEHQQYFMEKVYRGQLTDDILRNEGLGNHFYDLPTTNRKRNRYVFPKTRADVRIVNLGEVGERVGVVGAGGYVYPKVNAEEKERDAPVLSVFVLGDFDAEGGRVLAAEALKSTERDGAASRITFVPNPAELDAVKAGSRNAVVSRVVVQELLREAGRGDLAEVFSSSLPTSSGVKDAIARLTAGTNDAEFTQGKMQAHLKASRLFAREAGVKPGESAVVINGRVVGPIEDGEFGAFEFETLEEYEMRKRTGPVVGALVELGVDMQDRDRFSDAAAVASSIIAWSQVQDPSETGMFDTPPRPRQKTWEMLDSNYTAFEFGDKSNALYHLVFLVDPLSGTGQKWASVVQWLANIPDVFIQVQLNPDKYAELPLKRFYRYNLLSSLSFDTDGQEIPSQIVFNNLPIDPIYTLAMDVPASWLVRPKESRYDLDNIQLGQLFPPDTSLSAIFSLDALLIEGHAREVATQSPPRGVQLQVVTTSEGRSVPVQDTLVVANLGYFQFRLNPGVYGLEIRAGRGRRVFGMESAGGVGWESPGVEEVGNRVALVDFEGVTLFPRLRRNKGMEEEDVLEDGEEEVGGGVLSGFSNKVKAMFTTRKEETGVAMVKKEQAEINIFTVASGLLYERFASIMILSVLKNTNHTVKFWFIENFLSPSFLEFIPHMAAEYNFDYELVTYRWPSWLRAQTEKQRIIWAYKILFLDVLFPMDLKKVIFVDADQIVRADLKELVDLDMQGAPYGYTPMGDDNTDMEGFRFWKTGYWKDFLMGKPYHISALYVIDLVKFRQMAAGDILRQQYQGLSADPNSLANLDQDLPNNLQRQVPIFSLHEDWLWCETWCSKDRLHRAKTIDLCQNPLTKEPKLSRARQIPEWEAYDAEIACLTRRLAEEGKISSGLATADANVLAGGSSSAEKTEPEPVEEAPAADAVGEEHARPTDEL

SEQ ID NO: 4056 - protein, 1486 aa, Beauveria bassiana
MFRRPAAHTAQCPRMAIRLGSGLLVALLASSQVSASPAVNVRMQAAFNSGPYLLELLETATAENSSAYFPLLDRIAGGQFSRSSTEAELYNEFISVVRDDGHISSPEALSTFNLGLSLRSSAPRIEAHYQYYDTAVAIAEIDLSCEAWVLLEGNQYCTPQLDAAVRNGLFDPNITALPFDRSIGAGKHVVLYVDPASPHFRKFHAPLRIAAEAGEYNYRVRYRRPINASNKALHVSGFGVELALKRTDYIVIDDRASQSDAKAQKPLDTEAIFEEQELTDLRPLSTSELATLGMKSSSFIQSSKTPFETLVKLMQDFPKFSASISAHNVSANFSEEYQRGHIQRVPRGINALWMNGLQLIERQIEPFALVEMLRDERKLIDAVRNLGLNGDEAISLLGHESIAATQSDAGGTMRFDWTDKPEDGQAIIWLNDLENDDRYDQYPDDLSSLLQRTFPGQIPPIARNIFNVVTAIDPSDADDLTILGQLMALIGRGIPIRFGIVPAASSPESSNLAKIVYHLIRTYGFESLRNYIESVGEEPNAALGEAKFSQIINGLTPVAGNHPIKFLEVMENDDFNSQLEMAGRWISRLKASDKSSPIFFVNGVSTPRVANWLQRMSMQVSEDLQTIQRGIYHGVISDDVWVPGIFLEGALLRRNEYVSIDDAHPLRVLDVSKLYGDHKDLFGIIPVRNCDPQTERESWAAVTVITDAMTSRGVQLLISALKFKQSRPGVRLDIIHNPATTERASDLNKSSRAEASLLGLGMSEELEKIVREAEASSSTGAYAVALKRFLSYAKIQPGSSCVILNGRMIGPIAPEHTFTEDDFVQLLAFERKSRILPVFEALDDLGLGNRISGPISAAKLTSIAALSTISNLPEGIFESSSSARTMIYRKWDAKHTTIEVGDAKTASIHLVALLNPLSEQAQRWAPLLKVLSELDGVHLKLFLNPKEKLEELPIKRFFRYVLESKPSFDDGGAIRTGQAIFSGLPSEALLTLGMDVPPAWLVAAKESMHDLDNIKLSSINSDIDASYELEHILIQGHSREGKSSPPRGAQLVLGTESEPHMTDTIVMANLGFFQFQANPGVYNIHLKEGRSAETFEIESVGAQGWAAVPGDEGTSLALLDFQGTTLYPRLLRKPGMEEVDVLEQADQVTENIVSKGFKLAESFLGNVLGKKSTANLQHAEINIFSVASGHLYERMLNIMMVSVMRHTKHTVKFWFIEQFLSPSFKEFIPHLAEEYGFKYEMVTYKWPHWLRHQKEKQREIWGYKILFLDVLFPLSIDKVIFVDADQIIRTDMMDLVKLDLEGAPYGFTPMCDSRTEMEGFRFWKQGYWANYLRGRPYHISALYVVDLRRFRAIAAGDRLRQQYQALSADPNSLANLDQDLPNHMQFQLPIHSLPQEWLWCETWCSDESQGKARTIDLCNNPETKEPKLDRARRQVPEWTKYDDEIAAFAQRVKAAKSPDEDERRTNLERNTKSRNFEERLHTKDEL

SEQ ID NO: 4057 - protein, 1298 aa, Saccharomycetaceae sp.
MLHLRRQLAVTWLLIATVAAYDAVRLWQSVVRAGINDAGPWYGALTGAEDEISVQDLWNELGDDESTVLELLYETSVGVVEEVKQGARANWFELNGKRYSGSDDSFYLQSGELDAQRAVPDAAVLRPGEGVVGTAPDAPIVVLYGQAGSEEFEAFNWNLYREAQQGRIRLVWRPTCEGAGCGQPRVGDIYAHEYSVKEGSWDSTVRGQLAVPSEFAAKKYRLGGVKDEDLSLLDLKVATLIAEQYNRTSDFTETLEYARQLIDNFPLLAEHLVDREVDTNSTEAQLTEVATTGVTYDAIGLYINGQPWKLSSLDMRTFVLAIISEQKKMQYLMETLQSKYNQFGIEDARQLLSKFCQVSVVNAQDMQPARYDFHRVPGFSESVIYFNDIEKDPQYSNMSTRLDSVFEKSDYGVIPSYRKNWNELVFVVDFDSLDNEDTREILSGMVRAFSVADEGYPQRIGLLPMYHGDSNPIVEEIYRSKESGLANVKNYLRLLVLGERPESEDSVEIPPVKKILEDFSIFNNSLLINGQIHPFKKNTWHYLIASTLKHDVEILKSMVGRFPSPNVRELLHSKSLTTRDSRYIVDYFDDATYTVEKISALAELAQRVTVYEKGEPKQLYHTVTLVDDFESKPALQRLKNLLQVKFNAIRIRLIHIGVSSTSYGALQSSLTENKDLSKTIDALLAKAKESPKFDTSTVEKLEAWVPDLTREKIAGTSSTGTSFAIINGRYIQFGPESSISKVLWESLLQREATRTLDLLGIVDAQVPGMRDTKEDADFVEQLTSILSYLFYSGSNIFHSGIERTSESTLPRLNILDMLPEELAGALITNGNPTGQVELAVIVDPLEERSQTFLRLVDQVKSLSFLDIRILLLPTKKLTVFPIHRIYSDDVLSLNPVEAFDVSRDVPHYLYPEPNNPDVASIIIEGYAFDEKLPVSKTTVESHAGVCLELLNADGEVVSSSSTMSVFGYFQFLVPNLGYGFTVRSCSPEYEITSFSTDAKADYVPSAEISIIDVIPHRVFVKLRETHRNAAEYNTDQQEGIHIYVTIHDPSDEPSFKEKLFAILAGTPQHTPVTFWLAHGAPLSPELHTILRVAESLPGRHVACRPVRYAWPSWLRPQRFVDRRLDAARLLFLDTALPHTMHGRLIMLSLTEERTPDVATLSGLQTTAYLTMRPHRGHGYWEEGYWQNYLGKHNLRFYNPSRTFVVDLDRYRSLTAGDHLRVHYQRLSADVTSLLDIDQDLVNSVQLLLKIRPLRINKFLPPATKEWIAAWPSNSANDWTGNPPDTESASEEALDHDEL

SEQ ID NO: 4058 - protein, 1633 aa, Unknown
  Description of Unknown: Pyrus x bretschneideri sequence
MRIRFKSAFCVMIVLVCLGASGIGLVSGQNRRPKNVQAAVRAKWSGTPLLLEAGELLSKEQKDHFWDFIDAWHHSEKDDAESYTAKGCLKKIVKHGLSILDKPLASLFEFSLMLRSTSPRLVLYRQLAEESLSSFPLVDETNSSNDGGISETNELMEGQRSDLLNIGRNPKSPNGKCCWVDTGGALFFDPADLKIWLQSPRDFSGDSFQQPELFEFDHIHFDSSIGSPVAVLYGALGTDCFREFHLTLVEAAKEGKAKYVVRQVLPSGCDAKIDRCGAVGTRDSLNLGGYGVELALKNMEYKAMDDSAIKKGVTLEDPRIEDLSQEVRGFIFSKILERKPELSSEIMAFRDYLLSSTISDTLDVWELKDLGHQTAQRIVQASDPLQAMQEINQNFPSIVSSLSRMKLNDSVKDEISANQRMIPPGKSLMALNGALLNIDDIDLYLLFDLVHQDLSLADQFSKLKIPHGTIRKLLASLPPPESNMLRVDFRSDHVQFLNNIEEDDMYRRWRSNLNEILMPVFPGQLRYIRKNLFHAVSVIDPSTVCGLQSIDMILSLYENNFPMRFGVVLYSSKFIKQIETGGSEDDHEIEEDMSSLIIRLFIYIKENHGIQTAFQFLSNINKLRIDSEDSADDALEMHHVEGAFIETVLPQTKSPPQDLLLKLEKEQTFKELSQESSMFVFKLGLAKLQCCLLMNGLVLESNEDSLINSMNDELPRIQEQVYYGHINSRTDVLDKFLSESGTTRYNPQIIAGGKPRFISLPTSVLGGDGVLNDINYLHSPETMDDLKPVTHLLAVNIASKKGMKLLHEGLQYLIEASNRARVGVLFSVNQDADVSSHLFVKVFEITASSYSHKKNVLDFLDQMCSFYEHNYLLASSKGAESTQEFIDKVCELAEANGLSSKAYRFSLSEFSDEKLRKSMNKVSQFLYRQLGLESGVNAVITNGRVTVVNDGGTFLSHDLRLLESLEFAQRIKHIVEIIEEVKWEDMDPDILTSKFISDTIMSVSSSMAMRDRSSESARFEVLSAQYSAIVLNNENASIHIDAVIDPLSPFGQKLSSILRVLWKYTQPSMRIVLNPLSSLVDLPLKNYYRYVLPTVDDFSSTDYTINGPKAFFANMPLSKTLTMNLDVPDPWLVEPVIAVHDLDNILLENLGETRTLQAVFELEALVLTGHCSEKGHDPPRGLQLIIGTKSTPHLVDTLVMANLGYWQMKVSPGVWYLQLAPGRSSELYFLKEDGNESGSKTLSKRITIDDLRGKVVHMEVAKKKGKEHEKLLVPDGEDNSHDNKEGSSWNSNFLKWASGFIGGGEQSKKSESTSAEQGKGGRHGKTINIFSIASGHLYERFLKIMILSVLKNTRRPVKFWFIKNYLSPQFKDVIPPMAQEYGFEYELITYKWPTWLHKQKEKQRIIWAYKILFLDVIFPLSLEKVIFVDADQIIRADMGELYDMDIKGRPLAYTPFCDNNKDMDGYRFWRQGFWKEHLRGRSYHISALYVVDLKKFRETAAGDNLRVFYETLSKDPNSLSNLDQDLPNYAQHTVPIFSLPQEWLWCESWCGNATKSKAKTIDLCNNPMTKEPKLQGARRIVSEWPDLDLEARQFTAKILGDELDIQEPAPLPNESEKSVTGSPEEDLESKAEL

SEQ ID NO: 4059 - protein, 1585 aa, Cryptococcus gattii
MRANTVALALTASAIAAWASPPVRVSLQTGWAAPPLVLEILEIVYDEYPSSYFPLLHLLSSLPVNSTDESILSSTLDLIQAYSLLPSPSSLSTFHFALSLHSTAPRIEAEYNWYNSAVKGQENQLGVEGCEGWVEWRGKGFCDVDGLRRDMELSIEEGTHKIDQKHHSLPFDHTSPSVSSTSSSPRAIFYYVPSASTSNELLGYLDHHASQYPEFTYTVRYQPPLSHEAREPLSLSGWGAEMALKKMDYLVVDDRATENTSFQYESDEMTRDESSIFAHVFGDDPWGDQATPLTPAEIRDIGLKAATLIMSSDDPISALTHLSQDFPKYSAALARQIVVPEDIQSKGRTIAVRGKAKEAIYINGKPFDRDLNAYALLKALRDERQLTVSLTSLGLTPKQSIDLLADPVVGQGQVEDDMGEGLVDASDRIEGGDVIVYWNDIEKDKRYQNWPIHPQGYMRPVYPGQFHTVRRNTFNLIFALDLSRISSLELIVHSISNMIQRGLPIRFGIVPVFEPGQQDDISLQMAKVFWYSVKTFGRRSTRDFLAAIIDAIPRQPNNLAPLVTDDLLRKGYEALSATSEKASLAFDDVLASEDWDHRIEKTGNYLKRLLITKKDAENGGMFMNGRFTPNAPTWPNIVTQEMQSQLSFIQEQASLVMLDAIPEDISTMFYDLPATSKRRSSLVIPVGDNKLKAFNLVDLFGNEGIEGKLSGEFVYPNGERGTPVTMWIIGDLDSSEGLETVKNGLQHLQTPQCASRLGFIHVPPAPNQSSCPAGQYCFSTVLYQILSQNALSLAKPSDLLELISDVQHSIKTNLEKDGEIKVGNQKVDDCGTTFTLSPEDQRRYYEAKPLHGMTFGGWAAGDIAAASEFWKAGTQIAGKLGIRGGVHLLANGRLVGPITPLTFPLDDYDALEAYEHRKRVKPIIDVLKTMYDDITVFDRPTFANLISKVSSVVTTAYKPLDAEGIFAPTQSTRTRYYEKLDYGAMSFKLGDEDMSLLKVAVVVDPLSEQAQKWSPLIQSLSEMDHLCVSVYLEPEALMEEVKLKRFYRTSIPSKLTFDVDGAAIAPGLTFNNLPSNPIYTLGLDTPPSWIVSPRTSPYDLDNLLLSSISSPVSVTFQLKQLLIEGHARESGNIPPRGLQLQLKTLSGDIAADTQVMANLGYLQFRATPGYYTLSIRPGRGEEVFNLESVGAEGWDSPLVEEVGDGVSLGSFDGKTIYPKFARKEGMEKADVLQESVATPEGLVKQVYSRMKSMIGLSTSVTPIKTEHADINIFTVASGLLYERFASIMILSVMKHTNSSVKFWFIENFLSPTFIAFIPKLAEEYGFQYEFVTYKWPHWLRAQTEKQRIIWAYKILFLDVLFPMSLDKVIFVDADQIVRTDMKELVDVDLHGRVYGYAPMGNSRKEMEGFRFWKSGYWKEALRGRPYHISALYVVDLKKFRQLATGDRLRGQYHALSADPNSLANLDQDLPNSMQDQIPIWTLDQEWLWCQTWCSDESLATAKTIDLCQNPLTKEPKLVRARQIPEWDVYDQEIAAFAARVSDEGEESGALAVSVDDLASEGQVSGVEEKEVETKRGTDGHIEDEL

SEQ ID NO: 4060 - protein, 1374 aa, Pseudogymnoascus sp.
MVRLGNKWSLTGSALAFSCLQSIKVSASPTINVALATSFTSAPYLLELLETAGDENSTSYFPLLDRIAEGYFKDAKTDHELYNSFLKVLRDDGHLDSEGLASYSLALSLRTSAPRIEAQYQFYDTAIEQSGDDSSCPVWVLFADKKHCSPALDDAHGTYNGRRGTEQLQFDRITGNLSAPASILYADITSPEFTQFHKKLNQKAQKQEISYRIRHKKPNVEKSRPLVIGGYGVELALKRTDYIVIDDREAEAQVQGESVKTEVVLEDEVVADLKPLSSLELMSLALKASSFIMQSENPFEMLTRLSQDFPRYSSAIAAHNISHGFSNEHAYNRDQMVPSGTNVVWINGLQVPTRQMDAFSILDILRRERKLLNKFSQLGLTGAQTISLLSHKDIAFTKADDEPARFDWRDEGDGKTIIWLNNIEKDKRYDGWPASVTTLLQGGYPGQLPQVRKDLFNLVFPVDLSNLQDVELVVTQLSDFVKRALPLRFGLVPLTNSDAALDQAKIVYYLLDSYGLSTTVAYLNGFYASKGASSSRSANFEAAIEERKLLKDKIAKSLEEVLDANEADGSIAHSKQWCSRLGANDKVPPVFVNGAAVPRDENWMQGMSQRVQMDLRLMARAVYENTVTDDHWPPMLYLHDAASGRNPFLMPENDKDVQLLDVNAIYSDHAEAFEGLPTVKIDPSAAQDEWAHMVLVADVESEHGKQLLKAAVEFSKRNPSVELVIVPSSESPAGIASVYDYMAARSFQPLKSGVDLDTLVEAVSISTGGEGSQEKYVQKIAEKWAAIDDLLTSLSLKTGQQGLLLNGRLLGPIPTEIELGVSELEQLLGFERTKRIRPVLAAVKALGFSEAISDPLASSKLTSLVALSFISNVPEGIFEQASTLRIDSFKVWKSEYTAIEIGDESTASIHVQVALDPASQESQRWIPILKVLSELDGVYLKLFLNPKVVLKDIPIKRFYRYVLESKPSFNADGSLKDIKAQFASVPQEALLTVGMDVPAPWLVAPKQSVTDLDNIKLSSVNGDVNAVYELQHILIEGHSSEKETGQAPRGAQLHLGTAADAHFADTIIMANLGYFQFKANPGFYKINLQEGPSSKIYSIDTLGAPGRDAAKPDETTEISLISFQGLTLFPQLSRNPGQETEDVLEPTTDLKDDIVSKGFKLAESILGFGKKDTAAAQTTQAEINIFSVASGHLYERMLNIMMVSVMKHTTHTVKFWFISQFLSPSFKQSLPSLAAAYNFDYEMVTYKWPHWLRSQTEKQREIWGYKILFLDVLFPLSLDKVIFVDADQIVRTDMRELVDLDLQGAPYGFTPMCDSRVEMEGFRFWKQGRPTALPRDRRRRQTETAVPPAQCRSGEPGEPGPGSAESYADAPADL

SEQ ID NO: 4061 - protein, 1509 aa, Daphnia pulex
MKFIALFLCLIFYQLQFSETASETADDVKGKSKTVSTLLNAKWNSTPTALEIAEFLNDEDPSYFWAFLEDLSANVDTFSGKTDKSKYETLVDLTRKYLSEAQVSLMRFSLGLHVYSPKIEMFQQIAMVQGVPEQKCEAVAAVNGKLTCDPSLIKTLLNEKPNPELYKLDHQYPGKAAKGHPVVILYGEIGAKSLTEFHETLKALADSGEIIYVIRHYIRERKGPKVRLSGYGVELQIKSTEYKAQDDTKVTAEQSGAPGDEGASQQSTEDEDVDVEGFLFTKLKVLNPDLAPKLDKLRQALLDESQELAPLKVWQLQELSLQAAERILNAAKDESLKIMAQLAQNFPLLARSIVRTTVRPALKAEIKRNQQRFSNEFSLQPSEAALFINGQHFNVDSMDVFTLFEQLREEVKLVEGLHKIGVPSQYVSSLLSLDLSPPSRQYAVDIRDSAVLFVNDIEKDSQYKRWSPNIQDLLRPSYPGALRSIRRNMYNLVLVVDPLDIEARSLIKLAESFVVHNAPLRVGLVMAVNSDPKITGRDDPGVAMLNAFNYVSQRTHATDGLSFITDLFALVGDNSIVVDDVGKLLKKKFSADLEDVLGEDSDYDVGRQLTKDFLRRTGFRKLPQVLLNGVALEETSLNGDEFEEAVLTELMRQTSSLQKALFRGEMKEDDNVIDFLMGQPNVMPRLNDRVLSTSAKYMDTTGVVEGGIKDLTSLSSHQLIATFADSISYVSSNTRALTPITLWMVADLTQQAGRELVQNALEYVQNSRLIRLSLLHNPESSLTESANHYIDIIDAVLSSNDIKLFDKLLKNGNAEAIISGAKTGSDFGVEPAQKSSFGLKLHQLLAGRVLEFQPGQRGLIANGRVIGPFDDEEDFTADDVALLEKHTMSTSGEKILQFTQDLPQLHSSDLIMKVGGLLMSSASGTTPKTRHNIDERGSELSLLSFPPKFSDSPFIDITAVVDPLSVGAQKLAPLLLVLQEVLNCRVRVFMNCVEKNSEMPLKSFYRLVLEPDLMFGADERQLSGPVAKFGILPMGALLTQGMQVPDNWLVESVWSPYDLDNIRLRDVDTDVHSEYELEHLILEGHCFDSHSGSPPRGLQLTLGTPVDPLMVDTIVMANLGYLQLKANPGSWILRLREGRSTEIYDIVSHEGTDTPSSGGSGDIHVLIGSFKSHVLKLKVAKKSGKQQMDLLSSDDDDNNAGLWNSITSTFTSKSSEDDEDKLNIFSLASGHLYERFIRIMMVSVLKHTKTPVKFWFLKQYLSPTLKDFLPHMAAQYGFEYELVQYKWPRWLHQQKEKQRIIWGYKILFLDVLFPLSVKKIIFVDADQIVRADLKELRDLDLGGAPYGYTPFCDSRREMDGFRFWKSGYWRNHLQGRKYHISALYVVDLKRFRKIAAGDRLRGQYQALSQDPNSLSNLDQDLPNNMIHQVPIKSLPQEWLWCETWCDDTSKRKAKTIDLCNNPQTKEAKLDAAVRIVAEWNDYDTEIKMIQEELVRNRTEQQRQHDSSEL

SEQ ID NO: 4062 - protein, 1612 aa, Hebeloma cylindrosporum
MKRAFTVLGAALQVAGSVTSPPVKVGLRSSWSAPPFLAEILETISLDNPNSFFPLVDRLTNPEVLPNIHKLPPEAVHQGALGVAIDDGIIQQPGDLGIVEMNLAMHAATPKLEAFYNYYEDTHNSSRGRECGSWVDWYGEVVCDVEGLAHLVGTEAIDAKDTPNKQLSAKPKLLTFDHIFPPPSEILERPPRTAILYASLSSPNFRELHSYLYTLVNKPEPHVEYVFRHIPPSNPGEKNYLSGYGVALDLKKKDYLALDDRNLNAGDTTGAGSTSEADGQKERVDPILSLILAHPDNSSAPDANVALTNEEILSLGAKAVQIIAESSDPLSTLTHLSQNFPKYATSLARRVLVNESIGEELHNNSLKVQWGLNVLWLNGQQIDAKDVHPFGLLRLLKKERAVMQSLASQGLQPSQAFHLLTHPAIAAAQKDGGVMDAVFDASDRPEGEDIIVWWNDMEKDKRYASWNPSLYALLRPIYPGAMPSVKANLFNVVLILDLSQMPALNFISGPMQNIISREFPLRFGLVPVAETQDGKKMAKLFYYLIKNYGRKKTLEFLNIISQTQLPVHMQTEKVQWEAVSSAYVRLTESERQEKPSALVPTLASIIGEDAQSLVSLEKIAAYTERLGSTLATSATGHAFFNGKHFDVNDDFLRHLQTEVGVQMQFLQEKVYEGSLSDATKGESMSNYFYDLPTSSKRRNRYIFPSNAAGRLRIVNLPELFGRARFRVSPPTYIYPPEFDSVSESLYIVADFDSVAGLDLIKEGLNSLNADSKTRVSFIYNPTSDSKGPENIPRGPASWVLSHLHIQGSLSKVTPATLLLALGADSDIAGDVDPLSEGFQIPLGKKDGYEALMEDGVHLDDLKMEEYVDYVKAGRLVARELGLAPGQSALVVNGRVVGPISGGDFRAADFKTLEEYEYRKRVQSVELALKEVAPLVLEDRYLFADIASMASSVIASTQQPDPSEVGLFDAPPKPRQKTYQLLDSNYTTFEFGDNSTALYHVAVLIDPLSATAQKWSGILKWLSNLPDIFIEIHLNPGRYTEVPLKRFYRYNLIPSLTFDEAGQEIQPKALFEDLPVDPIYTLAMDVPNAWLVRPREALYDLDNIQLGKLFPGDTSVEAVFELDYLTVEGHARETSTSSAPRGVQVQLATADGHPIDDTQVVANLGYFQFRAKPGVFQFEIRPGRGREIFKLDSAGNEGWDSPPVEVAGSEITVTSFEGLTLYPKFSRLPGMETADVLEEKQSEESKSFFEDISNRVMSIFKSPKKPEGPTGVIPVKPQAEINIFTVASGLLYERFVGIMILSVLRNTNSTVKFWFIENFLSPSFLEFIPHMAEKYNFQYELVTYKWPSWLRAQTEKQRIIWAYKILFLDVLFPMDLKKVIFVDADQIVRADLKELVDLDLQGAPYGYTPMGDDNTDMEGFRFWKAGYWKDFLRGKSYHISALYVIDLVRFRQLAAGDILRGQYQQLSADPNSLANLDQDLPNNLQDQVPIFSLGEDWLWCETWCSKDRLHRAKTIDLCQNPLTKEPKLARARQIPEWEEYDTEIAQFTRQLAKEGKIHSRMATADANVLAGAGNAATAGDDKPREIADAAVSESENTHAEKVEAASEPERDEL

SEQ ID NO: 4063 - protein, 1130 aa, Lonchura striata
MHPDLKNNLIEFKKHLIETTNNMEPLKVWEMQDLSFQAATRIMSTPIYDALKIMKDVSQNFPIRARSLTRIPVDKKMQKEIEENQKHFHETLGIQPGEARLFLNGLHIDLDFQDPFRLQQIFQSPIGSSGRFKGVAVLFVDPVQEDTGDYMKLAELFYHHDVPLRIGIVFILNTREEIDGNEDAGVALWRTFNYIAEESDTSQAFMSIINMYHEVKDGNILTVDDVKHVLRSEYPHANVQSILDVHSEYDEGRKAGATFYKKSGLGPLPQALFNGVPFPREEMDAAELETLILQRIFDATGFFQRAVFMGLLDDHVNAVDFLMDQNNVVSRINPSILGAERRYIPFRFTSVPFHVEDFSTFSFLDSQDKSAVISDNMKYLTKKDEDALYAVTVWIVADFDKPAGRQLLSNALKSLKTSSHTRVGILNNPSSKIKEDNTAIARGILAAFFTQNNSNLKSFLRKLSKEETAKSLAAGTKIVKFLIPGMDGDTFEKKYNTLGLDLIKTQQMFCQEVLKLLPGQMAVISNGRVLGPLDENEFYEEDFNLLEKITYSTSAEKIKAIVKEMGNSSKSGSDLIMKIDALLSSLPKTEMRQDVELLKEQYRSVFVVKFEPQENEPFYDIIAIVDPLTREAQKMTHLLIKSFMFDLCISLNVGVLSHLFFNSFYRFVLEPELTYGINKHIPSEPVAKFLELPESPLLTLNMITPESWLVEAVNSSCDLDNIHLQEIKGAVIAEYELEYILLEGHCFDVTTGQPPRGLQFTLGTKKSPVMVDTIVMANLGYFQLKANPGAWTLRLRKGRSEEIYQVFSHEGTDSVADLTDVIVVLNNFRSKIIKVQVRMQAYENDNFLSDLYFHRIMMLSVLRHTKTPVKFWFLKNYLSPTFKDVIPHMAKKYGFKYELVQYKWPRWLYQQTEKQRIIWGYKILFLDVLFPLAVDKIIFVDADQIVRSDLKELRDLDLNGAPYGYTPFCDSRREMDGYRFWKSGYWASHLGKRKYHISALYVVDLKKFRKIAAGDRLRGQYQALSQDPNSLSNLDQDLPNNMIHQVAIKSLPQEWLWCETWCDDESKKKAKTIDLCNNPQTKEPKLKAAARIVPEWVDYDTEIRNLIQQIEREKKNLTSLFQKGLKHDEL

SEQ ID NO: 4064 - protein, 807 aa, Meleagris gallopavo
MTNYFCNDSFVRPVTFWIVGDFDKPSGRQLLYDAIKHQKSSNNVRISMINNPSEEPNSSNTIVAKAIWAALQTQTSNNAKNFITKMAKEEIAKALEAGADILEFAVGGMDTNIFKEAFESPKVDFILSHAIYCRDVLKLKRGQRAVISNGRIIGPLEDGEMFNQDDFHLLENIILKTSGQKIKSQIQQLGFEEDLASDLVMKVDALLSAQPKGEARIEYQFFEERYSAVKLRPKEGETYFDVVAIVDPVTRDAQRLAPLLLVLNQLINMNLRVFMNCQSKLSDMPLKSFYRYVLEPEISFTADNSFASGPIAKFLDMPQSPLFTLNLNTPESWMVESVRTPYDLDNIYLEEVDNVVAAEYELEYLLLEGHCYDITTGQPPRGLQFTLGTSTNPVIVDTIVMANLGYFQLKANPGAWTLRLRKGRSEDIYRIYSHDGTDSPPEADEVTVVLNNFKSKIIKVKVQKKLDMMNEDLLSDGTSENESGFWESLKWGFTGGQKNEDVKQDKDDVLNIFSVASGHLYERFLRIMMLSVLKHTKTPLKFWFLKNYLSPMFKEFIPYMAKKYNFQYELVQYKWPRWLHQQTEKQRIIWGYKILFLDVLFPLAVDKILFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAMRIVPEWQDYDQEIKQLYNLFQKEKETGTPAQTLGQHTQDAAAHVEL

SEQ ID NO: 4065 - protein, 1749 aa, Puccinia sorghi
MKRLRGLRKRLGLLLILSSGVLAGSPPISVSIQATWQEPPMLVQVLESATLERPGVLFSALDAVCTSWEDGKSKLSTDQQTYEYLMSLLRSPGLLDGPGEIESLAFSIALKEAQPKIEAFRAWYASLPSNLTAPIESQDNAAGSKTDDCKSWALINDSKVCDFSKLTQLLESKHLAEKIQPQPQVLPFDHQQGRSSPKSRVPIVILYASPDPGSLCPFHRVLHATSKKHQPGATYIFRWKISSVPSTSSKSSLLSGWGASLDIKKSEYLTLDDRPVESSSKEDFQLVIDGTKQPAGTEVQVVSEQAKLKPLKAAEIFDIGAKAAQHVLSSPSPLSALRHLTEDFPLIAHALVNEWVPGRISRELRGELQENIANGIPAGQSAVWMNGLQLSSLVSLENLNFFKLVEIMRSERRWIALLTSLGINSLQARTLIVDEKLNLAMNPEAASALEVGEIDASTLGVRFDASDRQEGGGAIIWFNDLENDDRYSMWPTTLRAILRPTFPGQLHAIGRNLINVVLGLDLTQRKNLHTLGHVIELMISRNLPIRWGVVPIPTGNTSEGEKMSRYLWDMIEAVGPMETLKFMKEFTVSLEPQAETIDVEQFSAKASELVSSEKKSPEEAQAHERKFQNWLNKSQQYSSRLSLCSNDNSIPACMLINGRFFPMEEVGLINCITLSCIYCNALICFFSSALAQNYRSHLQETATLHIGFLQHQVYFNLLKDDASVADYLYDLPMVHRARNDLVFPSETRPLQFVNLVEALQSTDVLAASTFFQNSALPRNDDQPIASLWVVGNLDSSIGISAVAATLGLLVCMRSSSDTFIQVSFVHTPPEDSDTPTEVSARLAALLSPAIDEKIKTSDLLDLLDRHGYRVIVSDDSDLGIELVLKKVQAEGSDVAGTNDQPAWAGTREFARTLGVQSDDLAVIINGRILHVSPGTKLLSEDLVLLVEYETQQRIGTLMEALRSLNDFDLAQHYSKVPLIMCTVGFVLVGSNDGFGLSSSSETRSAKHLSRDGQYSSFKHGDEQAALFEFGVILNPASEAAQRWSALLETLSHRSDVAIKIWFNPSLELNELPIKRFFRSAIWNSLEFDKNGRAIPALVNFRGIPTETLFTLAIDTPPAWLALPHDSIHDLDNIMLSELPSAYSSQGVEAIFQLDHIILAGHAREVPSDIPPRGLQVVLSDLLRNQEVDTIIMANLGYFQFKSAPGLHRLSIRPGRSLELYQFQSTDSESENNEAYQLLSLTTFNGLTIYPRVRKRPDKTSETLIEPLSTSSKKNPGREFSKIMGQVKDLAAGMLKNQGFDLASRAAPSIINVFTVASGLLYEMIFPPANGVFDVCQCHASHPQSVWFISNFLSPSFKRFIPHLAREYGFDYQLVTYRWPSWLRAQKEKQRVIWGYKILFLDVLFPLEVDRVIFVDSDQVISECNIDFWDRSGLNLAFLSVQQIVRTDLKALVDLDMEGAPYAYPPMCNDRNETKGFRFWDTGYWKESLQGRPYHIRYIYLFTALYVVDLRVFRTVAAGDLLRQHYQALSADPGSLANLDQDLPNNMQGMLPIFTLEQSWLWCETWCSDEGLKTAKTIGARERYEYLMLLPFFGHKYADLCNNPLTHEPKLKRARRLIPEWEEYDQEVAALAARIKKNHAGEFSSKITVQAGEKIDDGKDHYDHPKENHDDVKPSKGLADDDLDSSVWSLHGEEGLCDLGQASKCEILVTDKSAIFRKTIPVKVCVYESISQRSSLDIEKSLNVVPGMDF

SEQ ID NO: 4066 - protein, 650 aa, Syncephalis pseudoplumigaleata
IGPIGRDDAFDVDDFELLVDYEHKKHVKPIHDYLSALFDNEKMGDDYANCLLRAVVILGRLAQSSFVGDAFEKPDVIQRQGACTDSTISSMITVGNPLASVIRVQAILDPMTETGQKWAPILEASYAAAAAIGAFFNTDLLVKELPIKRFYRYLIPPRLTFNVTTGAIIPDRIAFAGTPKQTLLTMGLDTVSTWVAMPTASSYDLDNLRLTTSSALVEATFTLSELLVEGHVRDLTPDNPRGLQLVFSPSQGGTIVMANLGYFQLRAPPGMYRLSLREGRSSEFYHLLRIDHSMWAAFEDEDEDGQDASGSRDDATGKGAATPVDTRIVIESLEGAILFPVVRKNPGYETRELLASNEETASSSEGGIVGKLKDQATARQSADINIFSVASGHLYERFLSVMMLSVMRHTSSTVKFWFIENFLSPAFKDFLPHLAAKLGFQYELITYQWPHWLRKQTEKQRTIWSYKILFLDVLFPLDLDKVIFVDADQIVRADLQELVDLDLKGAPYGYTPFCSDREGMDRFRFWREGYWKNHLRGKPYHISALYVVDLKRFRAMAAGDILRGQYQALSADPNSLANLDQDLPNNLQDDVPIYSLPQEWLWCETWCSDEALAKAKTIDLCNNPLTKEPKLDRARRQVPEWSEYDTEITA

SEQ ID NO: 4067 - protein, 1554 aa, Ascodesmis nigricans
MWWSLHPAKLLSVALLISPFLQVATSSPAVNVGLKASWDSAPYILELIETAAAENPSSYYPLVAAISSGEFNPNSSTDQALYTEFLRVATAHGYLTKPEELSLFNLALSIHAAAPRIEAHYQYYEQNLEPRLGDDYKPECHTWIQWGSRQICDLSDNIDTLKEPKLGDTTFEDLLPFDRTSGDEGKPVAIIYISDVMDRNLKILQKEAAKGKIEYRVRYRRSKTEEGRPVILSGYGVGLALKKTDYMVMDDRDLGDGAEETGKGSIKTSETQAVLEDSESQDITPLQGKDLAGLGYKAASFIMASENPFDTLQKLSQDFPKYQAKLAAVETDEELVDELGDNWDMLFGPGVNQMFINGLQMEDSHINVFGLIEHLRGETRLIDGFKKLGLNTTEVMKLLTHETLTQAKADKTQRFDYRDVKEGGDVIFWLNDLEKDARYKDFIPRVFGLLRQVMPGSIHPVRKNIHQIVFPVDYSSQSDMMLISTQLRVYVHRKVAMRFGLVPMTTSQEAIDQAKVIYYLQDNYGLKYTLEYIDQSLVQKTWAKPSQKVFDEVVKGATGTLEGGKALSLQEVLSSEDLSNRMERAKKWGQRLGTDGPTPLILLNGQPIPKDEDWPAYMQPKLAADISLIQQATYLGELTDESSYPDWFLNDAAPRRNRHIFPEKGVDIKHINIAEVASAHKEVFKKLPKVNSNTVDRSKETNIWVVGDFDSPSGNELLTAAGEMQMHTTGANLVLINNPALLTEKPMLSTLLYHFQQVGPMTEVVFQQILLQVRSLIEKLDPRLDHVERFMEEFANFAKEETWGIPDHIEAGTFWGDARKLLASSGLKPGDRGLIVNGRVVGPIPVDEPFTFEDLQALVEYERRKRIEPVLKAAEDLGIMDKITQTDELGPAALTNQIALAGTPSVPLGFLDDPDMTRVDIRDKIALSYKHSGFTVGNKDSANIHIVVSLDPASEKAQKWVPLLNVISEMSGVYLELYLNPARTVSELPVKRFYRHVLQAKPQFDDKGFTINPRAGFENIPEKVLLSLSMDVPSSWLVTSKECIYDLDNLKIAALKDNLRGSDIEALYELRSILIEGHSSEVGGGAPQGAQLVLGTEKEPHIQDTIIMVNLGYFQLKANPGYYKINLKEGRSKEIYHIDTLGTKGQNSLADKDDKSEVALISFQGATLFPRLSRNPGMEDEKILAGDEAEEETTGALGKAVKWFKKAESLLGVGQNKANSVMNNHADINVFSVASGHLYERFLNIMMLSVMKHTDKTVKFWFIENFLSPSFKDFLPSMAKEYNFTYELVTYKWPHWLRAQKEKQREIWGYKILFLDVLFPLDLEKVIFVDADQIVRTDLKELVDLDLQGAPYGFTPMCDSRKEIEGFRFWKQGYWKTYLRGLPYHISALYVVDLKRFRQIAAGDRLRQQYHSLSADPNSLANLDQDLPNHMQSILPIHSLPQDWLWCETWCSDESLKTAKTIDLCNNPMTKEPKLDRARRQVPEWTLYDNEVARLAKRVAAERKDESGATAIEGHLVEAAKEEEDSRKKEEESSNGQKGDENDKEEKPRGHDEL

SEQ ID NO: 4068 - protein, 1534 aa, Thamnophis sirtalis
MGTVTALIGIWMTFSLAEAHSKAVTTSLTTKWFSTPLLLEASEFLAEEDNEKFWNFVETCQNFQSSNHDGTDYSSYNAVLQAASQNLSPLQQNLLKFVLSLRSYSATVQAFQQIAADEPAPEQCNAFFVVHGEKTCEADRLGTLIQTASKRPKPFMFKGDHKYPGSNSESPIVIMYAEIGSKQFSEFHRLLVSKAIAGEINYILRHYVANPNKEKVYLSGYGVELAIKSTEYKAKDDTQVKGTDINSTVIGDSDPIDEVQGFLFGKLRQSHPHLEEELKELRKHLVESTNEMAPLKVWQLQDLSFQTAARILAAPTMDALTVMKDLSQNFPTKARAITKTVVPSELRSEIEENQKYFKGTLGLQLGDSALFINGLHIDLDTQDIFSLFDVLRNEARVMEGLHSLGIVGHSMHNVLKLNIQPSDSDYAVDIRNSAISWINNLEIDSKYNSWPSSVQELLRPTFPGVIRQIRKNFHNFVLLLNPSHESSAELLGVAEMFLSNHIPLRVGLVFVVDNSEDVDGLQDAGVALLRAYNYVAQEVDTNYAFQTIISMYNKVNAGEKLKVEHVISVLEKQYPYVEVNSILGIDSAYDQNRKEGYTYYEQTGVGPLPIVLFNGMPLQKEQLDPDELETVTMHKILETTSYFQRAVYLGELSNDQDVVEYIMTQPNVVPRINSRILMSDREYLDLTANNNFYVDDYARFSTLDSKDKTAAIANSMTYLTKKGMSSKEIYDDTFVRPVTFWIVGDFDKPSGRQLLYDAIKHQKSSNFIRIGVINNPSEDPAAKNTIIARAIWAALQTQGSNNAKNFITKLLKEENAKMLESGTDITEFAVGGMEISTFKAAFEAPEVGFILSHAVYCRDVLKLKKGQKAVISNGRIIGPLEAGELFNQDDFHLLENIIVKTSGQKIKSHVQQLGVEEDLASDLVMKVDALLSAQPKGEARIEYQFFEDKYSAIKLRPKEGEIYFDVVAIVDPATREAQRLAPLLMVLNKLINMNLRVFMNCQSKLSDMPLKSFYRYVLEPEITFTAEKHLIPGPVAKFLDMPQSPLFTLNLNTPESWMVESVRASYDLDNIYLEEVESVVAAEYELEHLLLEGHCYDITTGQPPRGLQFTLGTSTNPVIVDTIVMANLGYFQLKANPGAWFLRLRNGRSDDIYKIYSHDETDSPPDASDVVVVINNFKSKIIKVKVQKKPDMLNEDLLSDGTNENESGFWESLKWGFTGGQKKEEVKQDKEDVINIFSVASGHLYERFLRIMMLSVLKHTETPVKFWFLKNYLSPTVKEFIPYMAKKYNFQYEFVQYKWPRWLHQQTEKQRIIWGYKILFLDVLFPLAVDKFLFVDADQIVRTDLKDLRDFNLDGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLQAAMRIVPEWQDYDQEIKQLYNQFHQEKESGILITTNETESQSQKDTLLHGEL

SEQ ID NO: 4069 - protein, 1628 aa, Ziziphus jujuba
METRFRSGFCILVVLVCLGLCGIGSVCAQNRKPKNVQVAVQAKWSGTPLLLEAGELLSKEKKEHFWNFIEAWLPNENESADSFSAKDCLKKILRHGRSLLDEPLASVFEFSLILRSASPRLVLFQQLAEESLSSFPLADESNPNSVSGGITETNEYVQAKKSDALNVGLNPKSPGGKCCWVDTGGALFFDIAELQLWLHTPGDSFQPELFEFDHIHYDSSLGSPVAILYGAIGTDCFKEFHSTLVEAAKEGKVKYAVRPVLPTGCEAKTSQCGAVGTRNALNLGGYGVELALKNMEYKAMDDSAIKKGVSLEDPRTEDLSQEVRGFIFAKILERKPDLTSEIMAFRDYLLSSTVSDTLDVWELKDLGHQTAQRIVHASDPLQSMQEISQNFPNIVSSLSRMKLDDSVKDEIIANQRMIPPGKSLMALNGALINIEDVDLYLLVDMIHQDLLLADQFLKLKVPPSTVRKLLSTLPPSDSNMFRIDFRSTHVHYINNLEEDAKYRRWRNNLNEILMPVFPGQLRYIRKNLFHTVSVIDPATVCGLEGIDMVMSLYENNIPMRFGIIMYSSKLIKKIETGGGGIYSSSMENDNQIEDDLSSLIIRLFIYIKENHGIQTAFQFLSNINKLRIESDGSTDDALEIHHVEGAFVETVLPKAKSPPQDLLLKLEKEQTFKELSLETSMFVFKLGLAKQQCCLLMNGLVIDSNEEALMNAMNDELPRIQEQVYYGHINSRTDVLDKFLSESGLSRYNPQIIADSKPRFISLSTSILGGEVVLNDINYFHSSETVDDLKPVTHLLAVDVASKKGIKLLHEGLQYLIEGSKGGRVGLLFSGNQDADVSSLLFIKAFEITASSYSHKKKVLNFLEQLCSFYEQNYLLVSSKPAENSQAFIDKVCEFAESNGISSKAFRAALTDFAADKLREQLNKVGQFLYRLLGLDSSVNAVITNGRVIVLTDRSTFLSHDLHLLEGVEFKQRVKHILGIIDEVKWQDLDPDVLTSKFISDIIMSVSSSMATRDRSSESARFEVLHAQHSAIVLNNETSSIHIDAVIDPLSASGQKFSSILRVIQKYVQPSMRIVLNPMSSLVDLPLKNYYRYVVPTMDDFSSTDHTINGPKAFFANMPLSKTLTMNLDVPEPWLIEPVIAVHDLDNILLENIGDTRTLQAVFELEALVLTGHCSEKDHDPPRGLQLILGTKSTPHLVDTLVMANLGYWQMKVSPGVWYLQLAPGRSSELYLFKEDDDGNQNKPLSKRIVINDLRGKVVHLEVMKKKGKEHEKLLVSDDEVQDNKNGNSWNSNFLKWASGFIGGKELSKKSESTSMEQGKSWRRGKTINIFSIASGHLYERFLKIMILSVLKNTNRPVKFWFIKNYLSPQFKDVIPYMAEEYGFEYELITYKWPTWLHKQKEKQRIIWAYKILFLDVIFPLSLEKVIFVDADQIVRTDMGELYDMDIKGKPLAYTPFCDNNKEMDGYRFWRQGFWKEHLRGKPYHISALYVVDLVKFRQTAAGDNLRVFYESLSKDPNSLANLDQDLPNYAQHTVPIFSLPQEWLWCESWCGNSTKSKAKTIDLCNNPMTKEPKLQGAKRIVSEWPDLDLEARKFTAKILGDEVDLQEPVPSPTDQLLEEDLESKAEL

SEQ ID NO: 4070 - protein, 1496 aa, Cadophora sp.
MGLFSMPWGLTGALLATTYLHSLCVSASPSINVGMKASFSSAPYLLELLETAGNENATSYFPLLDRIADGYFSKASTDKELFEKFVQVLKDDGHMLSPETLSSWQFALSMRASAPRIEAHYQYYHTAAEPSLKAEQDTSCPVWVLFNGKQYCSPALDAAHGDISGDSQTQELQFDRVLGNPSAPASILYADITSPTFGQFHKTLVKTARDGKTSYRVRHRKSLAAEDKPLIIPGYGVELALKRTDYIVIDDREESESKSVSSTPEKEVKFEDEDEEFADLKPLSASELFSLGLKASSFILQSGNPLNSLVKLSQDFPKYSSAIASHNVSSDFVAEHEFNRAQLVPAGGNIIWMNGVQLIERQIEALDLLDIFRKERKLINGVRELGLTGSQAIQLLSHEAIATVKAENEPQRFDWRDDIEGGNVIIWMNDIEKDKRYAQWPTSLNAFLQRVYPGQLPTCRRDAFNVILPVDFTDPQDVLIVADTLLSFVKRKLAIRIGLVPLTSNQYQLEHAKVVYHLLETYGITAAMSYLEAAYTREKLTTPTAESFKTAIGERKVRTDKTALTLEDVLEPESHKDQIEGSQKWIRRLAADSKIPPMFVDGVALPRDENWLQSMSQRVTTDLQILQQGIFTDTFNEDSWLPLYFLVQASARRNALIVPEDEKSLKIFDVNKLGGENQDILNILPRIEADVSAAKADWAHMVLIADLESKTGEKLLATAAVFREANPSVELTIVHNSGPEAAEPGLSKDLFSYMSKNNNKAFSHINDLTAVLTADLAAPGQQVQDHAIEYWRGADPLIKTLELLPGQNAILLNGRLVGPIPSDSEFDEGDFAQLLSYERAKRITPVHAALEALGLSDNVGSPLAAAKISSIVAISTISDTPDGIFEQASTLRMSQFDIWNSTHTSMETGDVLTASIHFTVLLDPASQLGQRWVPILKVLSELDGVYMKLFLNPKERLQELPVKRFYRYVLDSKPTFNDAGALLPLGASFKGVPQEALLNLGMDIPPAWLVAPKVSIYDLDNIKLSSIKADVEALYELENILIEGHSREIPGGAAPRGVQLTLGTERDPHTADTIIMSNLGYFQFKANPGYYKIDLLEGRSAEIFNIDSVGSKGWSPTPGDENTEVVLMSFKGATLYPRISRKSGMETEDVLEAKPESKMDFVSRGLNFAQGILGKATKSVEKEVQAEINIFSVASGHLYERMLNIMMVSVMKHTKHTVKFWFIEQFLSPSFKDFIPYLAAEYGFKYEMVTYKWPHWLRAQTEKQREIWGYKILFLDVLFPLSLDKVIFVDADQIVRTDMIELVNHDLKGAPYGFTPMCDSRTEMEGFRFWKQGYWEKFLRGLPYHISALYVVDLHRFRQIAAGDRLRQQYHQLSADPNSLSNLDQDLPNHMQTILPIHSLPQEWLWCETWCSDEALKDAKTIDLCNNPQTKEPKLDRARRQVPEWTVYDDEIAAVDRRRKGLPPVSASTAATEKNTKSRTLEVEKSSSTVSKKDEL

SEQ ID NO: 4071 - protein, 1479 aa, Penicilliopsis zonata
MAGTMSSASSWQWCVVIVAGVLACLAHASQSVNVALQASFDSAPFLLELLETAAEENPASYFPLLDHIADGTFDAAVTDKELYDQFLETLKQDGLIEAPESFSSFKLSLAIRSTAPRIEAHYQYYNTSVQQSLMAAQDAACPVWIHYEGKQYCSSAMERAQQDVSGELDSRKLPFDRVSGDVSLPPAVLYADVASPLFKEYHQTLSALAKEGQLSYRVRYRPPQHWAPRPLFVSGYGVELALKRTDYIVIDDRDAEKRELGKDELQDESPDDLRPLSSSEVTRLGWNTASYVMNSADPLDTLVKVSQDFPKYSSVVAGHNATKALVREVHSNRGQMYPSGHNIMWINGVQMDARKIDAFSLLDHLRRERNLIDRFRNLGLSAQETVKLLSHRKVARAQADNEPQRYNYRDEIEGGRVVLWLNDIEKDVKYESWTNELAAYLQRSHPGQLPAVRRDLHNIVFPVDLTNPEDLELVIQTIQIFVKKRIPVRFGLVPTAISKGSIGQLKITHYLHETFGLESLIHYLEQFASKKKVSSPDKFSFQAATKERETRDNVEALTFEQVLASDELDEIVSRTVSYQKRLDIHPETPYFFVNGVPVVRDDTWVQEMSSQISQDLQFIQRGIFNELYEEDTWLAGVLLAKAFTRRKTLIVPVDAKDVRFVDVVGLSESYQTALVNLPRVSSAVDKARENVHMIVVGDFDSEDGLKLLADALNVRREHPEAELLFLDNSPSQTIDQAVSHKFYGLLEQDEPVDVEKITAAVSSITETPDAETIFKYWTDRRLLAEALGFPTGTNGLVVNGRAVGPISQSSELVAEDLEQLLAYEQEKRITPIAEAIEELAIQAKPLNALEFAKLTSLVALSTISDVPEGIFESPADTRFSPSDNWNTSHSVVIVSNSEDPVINIVAAIDPTSEVAQRWLPILKVLSQLAGVEVKISMNPKDEMHELPTKRFYRYVLDSEPSFDTKGSLLKPQASFSGVPREALLTLGMDVPPSWLVAPKESLHDLDNIKLSSVKGGLDVEALYSLEHILIEGHSRDTTVKSPPSGVQLLLGTEENPHFADTIIMANLGYFQFKAQPGFWKINLKPGNSQRIFNLDSVGGLGYSPQPGDENNEVALLSFQGATLFPRLSRKKGRENDDVLETGPKAGSAMDYVSKGLGFAQGVLSGVGLKTSGGAVEKQADINIFSVASGHLYERMLNIMMVSVMRHTKHSVKFWFIEQFLSPSFKSSLPYLADEYGFSYEMVTYKWPHWLRPQSEKQREIWGYKILFLDVLFPLSLDKVIFVDADQIVRTDMYDLVSLDLEGAPYGFTPMCDSREEMEGFRFWKQGYWKNFLRGLPYHISALYVVDLNRFRAIAAGDRLRGQYQLLSADPASLSNLDQDLPNHMQHYIPIKSLPQEWLWCETWCSDESLGPARTIDLCNNPLTKEPKLDRARRQVPEWTVYDDEIAELAKRVAEKEEQEQEAATFTDGADAADWDKDEL

SEQ ID NO: 4072 - protein, 1517 aa, Neodiprion lecontei
MWVFILWYSFVLCLNQITADKQVNKYVTTLIDAKWKETPLILEVAEYLSDESHDYFWGFVDEISSSSYLLPPNAMERDAYNVAITATKKFLTPAEIAVLKLGLSLRTYSSRVEMFNQMAENRNVSHLGCSVAMDIGGKLTCSLKDLEDLVNKQAEVEIDTYSVDHHYPGGEQSDKTVILYGQMGTAEFSEFHSTLKSLAEQKKIDYVLRHYVNNRSEKKLRLSGYGVELQMKSTEYKATDDSDIKDNSDKEADSTSDGIEEIDGLNFGILKNLYPDKQAELDKLQTHLLENSHEIGALKVWQFQDLSHQAAERIMKSPASEAIDALTDIAQNFPMQAKSLIRTKVNSEMKKEMKLNQEIFSANLNIQPTDTALFLNGLFFDLEAIDILTLLESLRAELRVMELLHKIGFANKKMNKLLALDLSGNGDSQDFAIDIRDSAIIWVNDIENDSRYKRWSPSLTELLRPTFPGMLRNIRRNLYNLVIIIDPLSKDAVPLISLAESLYTHSAPLRVGFVFITNYNTSVTGQTDASVAVNNAYHYFAESLGHKEAMRFLSDLRHFIDEDDTDVGEIRKAILARDSSADVNYILGEESEYDVGRHLANDFVKRTGFHKFPQALLNGIPLPSNQLSSELFEEAVLSTIMTQTPAFQKAVYRGELTEGDDVIDYIMNQPNVMPRLNERVLKVEKHNWLDLIGSMPETNEISKWSSQDTSNWLMERMKYVYISRRSAVHHLFTFWIVVDLNLSIDRQLLREAFEYVKSNADVRISIIVNGIENNSRPEIDINKVVLAALNALSSEEAMRFILQVTQDDAISLITNGKYEIENEDVKKKLDEQTMTLEVHKHYVRNALHLESGMRAIICNGRIIGPFDENEEFTSEDFGLLERFSQNTYGNKLFKHVMKADSLDDDDEYEKIDITDDMIVKIVALLVPRPQTRSRVDVPFHSDEHSAIKIPAGDPDSVAFDLTAIVDPVSRGAQKLGPIISTLQQTLNCHVKVFLNCLDKNSDMPLKSFYRFVLEPELQFTPEGQIAGAIARFNKLPTSSLLTQHIHAPENWLVEVVRSVYDLDNIKLDNVAMGVQSEFELEHLLLEGHCFEAVMGNPPRGLQITLGTENEPVIVDTIVMANLGYFQLKANPGEWLLRLRQGRSAEIYDITSVDGQDVIQSENNVKVVISSLRSHVLKLKVSKKPDKANVDLLSEDESSSGLWNSISRTFTAAEESEDKDEKLNIFSLASGHLYERFIKIMMLSVIKHTKTPVKFWFLKNYLSPTLKDFLPHMANKYGFEYELVQYKWPRWLHQQTEKQRTIWGYKILFLDVLFPLDVKKIIFVDADQVVRADLKELANLDLGGAPYAYTPFCESRREMDGFRFWQQGYWRNHLQGRRYHISALYVVDLKRFRRIAAGDRLRGQYQALSQDPNSLSNLDQDLPNNMIHQVAIKTLPQEWLWCETWCDDDSKQYAKTIDLCNNPMTKEAKLQAAMRILPEWVGYDEEIKRLQQEIENANRQTEREEGEMMDDSPAHEEL

(The sequence listing continues in the following parts.)

What is claimed is:

1. A system for producing glycosylated cannabidiol (CBD) comprising:
    a yeast cell culture, where the yeast cells express a heterologous nucleotide sequence, operably linked to a promoter, encoding a UDP-glucosyltransferases (UGT) according to the amino acid sequence SEQ ID NO. 1, or a sequence having at least 95% sequence identity with SEQ ID NO. 1826; and
    wherein CBD is introduced to the culture where the UGT glycosylates said CBD generating a CBD glycoside.

2. The system of claim 1, wherein the yeast is *Picha pastoris*.

3. A system for producing glycosylated tetrahydrocannabinol (THC) comprising:
    a yeast cell culture, where the yeast cells express a heterologous nucleotide sequence, operably linked to a promoter, encoding a UDP-glucosyltransferases (UGT) according to the amino acid sequence SEQ ID NO. 1, or a sequence having at least 95% sequence identity with SEQ ID NO. 1826; and
    wherein THC is introduced to the culture where the UGT glycosylates said THC generating a CBD glycoside.

4. The system of claim 3, wherein the yeast is *Picha pastoris*.

* * * * *